United States Patent 11,001,841 (CCCTC-BINDING FACTOR (CTCF) RNA INTERACTOME) - sequence listing, part 25

SEQ ID NO: 61915 - DNA, 1020 bp, Homo sapiens
acacattatttaaggctgttatataatacagtaaaattgtagaactttcataccttgaaggatcttagcaattatttaattcaaacccattctaacatagatgataaaacagatttgcagggttgggcacggtggctcatacctatattcccagcactttgggagactcaagcgggaagattgcttgagcccaggagttcaagaccagcttgggcaacatagtgagaggctgtctctacaaaaaaatatttaaaaaatagccgggcatggtgtcacgtgcctgtagttccagctgcttgggaggctgaggtgggaggattgccagagcctgggaggttgaggctgcagtgagccatgatcacaccacagcactctagcctagagcctccctgtgtggcaggctctacacttcagataggcaacagatcgagaccttgtttcacaaaacgaacagatctgcaaagatcaacctgtcctaagtcatataatctctttgtgtaataataaaaaccccatcttctaaccttaaacctggtatttttttctacgaaactatgttctgcagtccaaattatttttctttattattttgaatcctaaagtagaaatagaaacttagaaaaataaaaagcaactcctttatgacatatgaggactttttcagttttaaataagaaaaacccaactcaaagtagcttaaataaaaggagacattttttgacttacataacctaaaagctctggcctggatctaggtgctcaacagatctcaagagtatctctcttattctctctccctcccttaccctcctcctcttttctctcttctgtatatatgttattttcaaacaggctctcacaagtagtggcaagatatagttcctaatagcttcaggtttgcattctacctactttagcaactatgatgagaagagagctacaatttgagcaaaaatttgtagggtgagttctgatttccctggattgaggcacatgcctattattcctgaaccaaatatt

SEQ ID NO: 61916 - DNA, 1331 bp, Homo sapiens
atcacgtagtttatatacatgctattagtaaaacccaggacagctgagtacaagttttacccttatattcacattgaggtccagatcctggttttgaatgagataattacgtgcagtcggactgttttctgatcctaaaaatagagacaataatatctatcttgtaaagttatggtagtgttaaagatatataaaatgttggcaagtaccttaatatacaataactactgctatatgttgtcattgtaataataatcatatttcttcctttgttgaattgctttcctgtagtaatcttattgtgatcatcctgaaacatagatttccgagcttcaagcaaacactattatgttgaaaaatctacattatttctaagtttagcagtgccagtggaaagtttattgaaatagaaaattacttttttaactgaggagtgtagattgtgaattcgtgattcatcttcttaggagatgatcggaatattgataaatattgatgcatagaatatgaacaaaacattacatatcttgtgctgtgatattaaagtagtattctgttctggtagtagtatggcagtattttaggtctgaaagatgtacataatctgtactttgaagtctgttttttaagagattaatcacaagagatttacataaaacaactaaggttaaaaataaatggtggattagagatacatcaggcaaatttcaatttcaaaagcagatgacagaatctcagtatcagggtagcatttaaagcaaaaagcattaaactggatcaaaaatgtcattttacatcaacacagggtacactccaggtaaagacttaacagttatgaacgaatgtgctaaacatcaaaatgtattaagtaaaagctgaaagaaatgaagaataattggtagaaaagcaatgataggaatccttaatgtacttcaaaaggcacgaagtaagaaggtacagtcatgtaccacataatgatgtttgagtcaacacctgacctggtatacgacaatggtcctataaaattataatggagctaaaaagcttctatcacctagtgatgttgaagccgttgcaatgcaatgtatcactcacatgtttgtggtaatgctggtgtaagcaaacttactgtactgtcagttgtataaaagcatagcacagttatgttcagcacataatactttataatgataaacgaatatgttactagtttacgtgtttacagtactattattttagcatgtgcttctgcttattaaaaaatgttaactataaaataatctttaggcagatcctacaggaggtattccagataaaggcattattgtcat

SEQ ID NO: 61917 - DNA, 1045 bp, Homo sapiens
caggctcaagtgattgtcctgcctcagcctcccaagtagctgggactgcaggtacacatcaccacgcccagctaattttttgtatttttggtagagacggggtttcaccatgttggccaggctggtctccaactcctgacctcaagtgatcagcccacctcggcctcccagagtgctgggattacaggttgtgagccactgcacctggcctgtttttaaattcacataaatatgttttatatttttcattagggagaagaaggttgtgtctacaatttttaagacattggggagatttagatgccagtagtaacttaaaagagaaataattgcaaattctttttcctcttgagtatactttcatttaaggtacagtgttctgtaagttacttttaccgttaaacttcttaatgttgcttattgtttgtcttacatttttaggttggatttttcttaagtcacatgtctaataaaaaaaacccttaaatacctcatttattcgtcttcgttagtgaatgcattgttgtacatattagatttttctctttagataactcagcttcccctattaagtgccacatgtattacaaaattttatttatgttttattgtttaataaactcttgagaactagatacattttaatcatttgtaatacttacattttctaaaacacttcatttttccctggtttcttcaacaaagagatgcatgtagtacaaggatagctttacctgtgttagaagattgtttcacacatttacatcaactgcatagtcctgtttttgttgggccctaatgccagcatcactttttgctactgctgtttctgccttaaaggcaatatgcctctgtctagtttgctgattctgatactctttcccctggaaagtaggtaatcaagtttgtgaggagctgtgtgtttaaggagtccataaatccttgtggggagccctaggtgtatagagcatagctgtagggcagaggcctttgacacttattctggatatgcagtggcctttgcctatggggttcatgggtcaga

SEQ ID NO: 61918 - DNA, 1503 bp, Homo sapiens
gaaaacattcactttagtaatctttcctcattttctagtttcctcttatgtactatgatttaatactgtagtaaagttttaataaaatatgagctatatgtaattaagtgggaggttgtggggctaggcacgaggctcacacgtgtaaccccagcactttgggaggctgaggcaggcggatcgcttgatctcaggagttcgagaccagcctggacaacaaggtgaaaccccatctctactaaaaacacaaaaattagctgggcatagtggcacacacctgtagtcccagcttcttgggaggctgaggcaggagaatcgcttgaatccaggaggcagaggttgcagttagccgagatcatgccactgcactgcagcctggacatcggagcaagactttgtcttagaaataaataaataaatataaaataaaataaatgggaagttgtgtatataaattataaatgctacattcagaaaagcttttgaaggttgtcagacagtttcttaaaggaagttcaccagttctttattgaacattgaagaaaacatacagtttagactggcattaaaactgaaagaagtggccagacgcagtggtagacgcagtggttcacgcctgtaatcccagcactttgggaggtcaaggtggatggatcacctgaggtcaggagtttgagatcaggctggccgacatggtgaaaccctgtctctactaaaaatacaaaaattagccaggcatggtgatgcgtgcctgtagtcccagctacttgggaggctgaggcaggagaattgcttgaagccgaaggtggaggttgcagtgagccgagattgcgtcattgcactccagccagggcggtaagagtgaggctccgtcttaaaaaaaaaataagtaaataaattaaaaactactgaaagaagtattacaggcaatgggaaatagcttgagtggaagtgcagcagaaggaaaaagctggacaagaatgtagtgtcagagaataggtatggaacgtgtgagtgactgttagaggatcttgaatggggataacagacttgatttcataaatactgagatgtcatgataatacttgaggactaaaccatgttttaaggacagttgtatgcaaagttgtaatcgcaagaggaaaaaatagtggaaaagaaaccagtaataaaacttgccttaatgcaggtatgctaagacaatcaaatgggatttcattaattttttatttgccatttatagccaaagattttgtaaaagttttgagcccagtcaggtgaaatagtctcagaaagaaagaaaagtgaatctgagacttggagacattaatgttgatattttggttttaaacgtgttttaaatccggtaaaagtgagcttctcacatgacaatattcagtgggtacttgggagtatgggttcgaatctaggtaggagatatatcgatattttgggcatcatcaggaaagggagagtagttaagcctttcatataaataatggt

SEQ ID NO: 61919 - DNA, 1050 bp, Homo sapiens
atgtaccagataattatttcatcgtttttaatgcttaaagtttttatttgtattaggatttttagtatgattttaatgttaaagttttgaagttactctgccactagaagtctaattttgggacttactattcatgaaataggaattgacttttatataagtaataggaccttattttgaaggttcaaactggagaaaatcttacattgtttatatttttatttcatttatttcagttgatttgcttgagatcaagattgcagatacagaatccatatttcgtgtatattgctgatattaatcattaaaatcgtttttgacagtttgacagttaaaggcatttcctgtgaaataatactggtatgtatttaaccatgcagatcctcagtttgtggtctgccagctaaaggtgaagatatattcctccaattcaggacccacacgacgggaagacaagttcatgtactttgagttccctcagccgttacctgtgtgtggtgatatcaaagtagagttcttccacaaacagaacaagatgctaaaaaaggtttgtactttactttcattgggagaaatatccaaaataaggacagattaaaagctatattttattttatgacatgtaaggaactataatttgttttctattagatctgcaggtgttttgcttactctggcattggtgagacattataagggtaaataatcctgtttgaaggaaaaggccttatggcattgtaacatgagaggaatttttcttaacaaggatggttaactgagaagaaattagcatgggaccaatattttaaaaattttggtctataggtagaaatgagatctgttctgtggtcttatgtagtgacacaaaccactttttctccattttggcttatgtttctttttctttccttttttttttttttcctttttgttagagacagggtcttgttctattgcccaggctgagtagctaagactacaagcatgtgccaccacacccagctaattttttttatttttatttttgtagggacagggtctcactatgtt

SEQ ID NO: 61920 - DNA, 1169 bp, Homo sapiens
ttgcactcaccgtccaagaacttttgttaaagtaaatcttggaataggtagctcatttgaaatgtagaaaaaattaaatccatatctgaattttgtttatatgtatgtacacgtaaactaaaaacgtatttaaagctagtattagatgagaaaagaggtttttttacttaaaattttaaggcaaaagtagtttatcttagatcttgtgagattgtatttttggtttaaaatttgagaatttgagtgaagaaaaatcatgtgaatgaaaatgcaacagataactcagattgccttataatagtctttgtgtttacctttattcagaatatcaaatgatagtttattttgttgactttttgcaaatgtttaacataggtgacagattttcttttttaaaaaaataaaacatcattaattaaatatgtcatttcatttctttttcttttctttttttttttttttaggacaaaatgtttcacttttgggtaaatacattcttcataccaggaccagaggaaacctcagaaaaagtagaaaatggaagtctatgtgatcaagaaatcgatagcatttgcagtatagagcgtgcagataatgacaaggaatatctagtacttactttaacaaaaaatgatcttgacaaagcaaataaagacaaagccaaccgatacttttctccaaattttaaggtcagttaaattaaacattttgtgggggttgttgacttgtatgtatgtgatgtgtgtttaattctaggagtacagctgatgaagaacttgcttgacaagtttttaacttatgtattatttcgaagcagtgtttacgtagcagtaacatgaaagtttctaataaaatacccaatgtacacagcgtcaaaaaagctgcatttttccttttcctaattcttcgttgtttgctgaaatctggggcaaaggtgcgggagggggctaaatgactgggatatgaagtaggaatgggagaggaaagaaatagatgggaactcagtcatttgggaatgattcatatggaatgtttttactgcttccactcctgtctgccttccaatttattctcaatccctcagagtgatcttaaaaatagacttgattgtgtcacttctgtttacactttataaggaccttgtgtttttttttttaccatgacctaca

SEQ ID NO: 61921 - DNA, 1061 bp, Homo sapiens
atatatgagtgagaacatacggtatttatctttctgtacctgacttattttacttaacatcatgtcctccgggctagacattctctttagaatccacaggtttcctttcttttctctaaatctgcattttgctcagccattaacttttaaaatgtctttttccctttagttttattgttttctattttaatattgcaagatgttttatatttgtgattacaaataaaaactccattattagtaaacaaatacaatgtcatatagtagtaagtgctataaaaaatagacaggatagaaagtaatcttggtttgtatgttttttgttttttagcaaagatgattagagaaggcccaaccaagcagataacatttaagcagaggcctaaatcatataagtgagttatacaaatatctgggaaaagagttaagagtacagatgcaaaagcccttagacaagagaatgagcttggtatatctgaagagtggataagtcattttgactgaaacagagtggacaagaaaaccagtccaagtgtaaagacactagtgtgtgttcagcataggaaggatgtaatctgaattttgtgtttaatattccctgtgttcatgctttcaaaatacagatgagtgaggaaagtagggagaaggggtaataaaggaagctgagagatcagttaagaggtacttgaatagtttagtaaagatgagagaagatgtttgcttcttgttgcccctcactgcttagaatagtggcagtgaagggtaacaagaagctgtcagattaacttaaagagtttactgatgcagtggatgttggttgtaagagaagaattgataatgactcttggataataggggagggaggggctgtcaatataatataatgaagaagggatttgaagtcatttctgatttaaatctcacatccactacctacttttaatagatatgtagcctttaacaagttccctaacctttctgggccttagctacctccccttggaaatggaaatacctaacatgtaaggttgttttgacagttattttcactaggcatgtaa

SEQ ID NO: 61922 - DNA, 3675 bp, Homo sapiens
gttttcattttaaattttctttctctaggtgaagctgtacttcacaaaaacagtagaggagccgtcaaatccagaggctagcagttcaacttctgtaacaccagatgttagtgacaatgaacctgatcattatagatattctgacaccactgactctgatccagagaatgaaccttttgatgaagatcagcatacacaaattacaaaagtctgaatttttttttatcaagagggataaaacaccatgaaaataaacttgaataaactgaaaatggacctttttttttttaatggcaataggacattgtgtcagattaccagttataggaacaattctcttttcctgaccaatcttgttttaccctatacatccacagggttttgacacttgttgtccagttgaaaaaaggttgtgtagctgtgtcatgtatatacctttttgtgtcaaaaggacatttaaaattcaattaggattaataaagatggcactttcccgttttattccagttttataaaaagtggagacagactgatgtgtatacgtaggaattttttccttttgtgttctgtcaccaactgaagtggctaaagagctttgtgatatactggttcacatcctacccctttgcacttgtggcaacagataagtttgcagttggctaagagaggtttccgaagggttttgctacattctaatgcatgtattcgggttaggggaatggagggaatgctcagaaaggaaataattttatgctggactctggaccatataccatctccagctatttacacacacctttctttagcatgctacagttattaatctggacattcgaggaattggccgctgtcactgcttgttgtttgcgcatttttttttaaagcatattggtgctagaaaaggcagctaaaggaagtgaatctgtattggggtacaggaatgaaccttctgcaacatcttaagatccacaaatgaagggatataaaaataatgtcataggtaagaaacacagcaacaatgacttaaccatataaatgtggaggctatcaacaaagaatgggcttgaaacattataaaaattgacaatgatttattaaatatgttttctcaattgtaacgacttctccatctcctgtgtaatcaaggccagtgctaaaattcagatgctgttagtacctacatcagtcaacaacttacacttattttactagttttcaatcataatacctgctgtggatgcttcatgtgctgcctgcaagcttcttttttctcattaaatataaaatattttgtaatgctgcacagaaattttcaatttgagattctacagtaagcgttttttttctttgaagatttatgatgcacttattcaatagctgtcagccgttccacccttttgaccttacacattctattacaatgaattttgcagttttgcacattttttaaatgtcattaactgttagggaattttacttgaatactgaatacatataatgtttatattaaaaaggacatttgtgttaaaaaggaaattagagttgcagtaaactttcaatgctgcacacaaaaaaaagacatttgatttttcagtagaaattgtcctacatgtgctttattgatttgctattgaaagaatagggtttttttttttttttttttttttttttttaaatgtgcagtgttgaatcatttcttcatagtgctcccccgagttgggactagggcttcaatttcacttcttaaaaaaaatcatcatatatttgatatgcccagactgcatacgattttaagcggagtacaactactattgtaaagctaatgtgaagatattattaaaaaggtttttttttccagaaatttggtgtcttcaaattataccttcaccttgacatttgaatatccagccattttgtttcttaatggtataaaattccattttcaataacttattggtgctgaaattgttcactagctgtggtctgacctagttaatttacaaatacagattgaataggacctactagagcagcatttatagagtttgatggcaaatagattaggcagaacttcatctaaaatattcttagtaaataatgttgacacgttttccataccttgtcagtttcattcaacaatttttaaatttttaacaaagctcttaggatttacacatttatatttaaacattgatatatagagtattgattgattgctcataagttaaattggtaaagttagagacaactattctaacacctcaccattgaaatttatatgccaccttgtctttcataaaagctgaaaattgttacctaaaatgaaaatcaacttcatgttttgaagatagttataaatattgttctttgttacaatttcgggcaccgcatattaaaacgtaactttattgttccaatatgtaacatggagggccaggtcataaataatgacattataatgggcttttgcactgttattatttttcctttggaatgtgaaggtctgaatgagggttttgattttgaatgtttcaatgtttttgagaagccttgcttacattttatggtgtagtcattggaaatggaaaaatggcattatatatattatatatataaatatatattatacatactctccttactttatttcagttaccatccccatagaatttgacaagaattgctatgactgaaaggttttcgagtcctaattaaaactttatttatggcagtattcataattagcctgaaatgcattctgtaggtaatctctgagtttctggaatattttcttagactttttggatgtgcagcagcttacatgtctgaagttacttgaaggcatcacttttaagaaagcttacagttgggccctgtaccatcccaagtcctttgtagctcctcttgaacatgtttgccatacttttaaaagggtagttgaataaatagcatcaccattctttgctgtggcacaggttataaacttaagtggagtttaccggcagcatcaaatgtttcagctttaaaaaataaaagtagggtacaagtttaatgtttagttctagaaattttgtgcaatatgttcataacgatggctgtggttgccacaaagtgcctcgtttacctttaaatactgttaatgtgtcatgcatgcagatggaaggggtggaactgtgcactaaagtgggggctttaactgtagtatttggcagagttgccttctacctgccagttcaaaagttcaacctgttttcatatagaatatatatactaaaaaatttcagtctgttaaacagccttactctgattcagcctcttcagatactcttgtgctgtgcagcagtggctctgtgtgtaaatgctatgcactgaggatacacaaaaataccaatatgatgtgtacaggataatgcctcatcccaatcagatgtccatttgttattgtgtttgttaacaaccctttatctcttagtgttataaactccacttaaaactgattaaagtctcattcttgtcattgtgtgggtgttttattaaatgagagtttataattcaaattgcttaagtccattgaagttttaattaatgggcagccaaatgtgaatacaaagttttcagtttttttttttcctgctgtccttcaaagcctactgtttaaaaaaaaaaaaaaaaaaa

SEQ ID NO: 61923 - DNA, 1851 bp, Homo sapiens
gaagataattccccagaatggatttgatactttagatttcaattttgtggcttttgtctattattctgtactctgccatcagcatatggaaagcttcatttactcatcatgacttgtgccatataaaaattgatatttcggaatagtctaaaggactttttgtacttgaatttaatcatgttgtttctaatattcttaaaagcttgaagactaaagcatatcctttcaacaaagcatagtaaggtaataagaaagtgtagtttgtacaagtgttaaaaaaataaagtagacaatgttacagtgggacttattatttcaagtttacattttctccatgtaattttttaaaaagtaaatgaaaaaatgtgcaataatgtaaaatatgaagtgtatgtgtacacacattttatttttcggtatcttgggtatacgtatggttgaaaactatactggagtctaaaagtattctaatttataagaagacattttggtgatgtttgaaaaatagaaatgtgctagttttgtttttatatcatgtcctttgtacgttgtaatatgagctggcttggttcagtaaatgccatcaccatttccattgagaatttaaaactcaccagtgtttaatatgcaggcttccaaaggcttatgaaaaaaatcaagacccttaaatctagttaatttgctgctaacatgaaactctttggttcttttatttttgccagataattagacacacatctaaagcttagtcttaaatggcttaagtgtagctattgattagtgctgttgctagttcagaaagaaatgtttgtgaatggaaacaagaatattcagtccaaactgttgtaaggacagtacctgaaaaccaggaaacaggataatggaaaaagtcttttaaagatgaaatgttggagccaactttcttatagaattaattgtatgtggctatagaaagcctaatgattgttgcttatttttgagagcatattattcttttatgaccataatcttgctgtttttccatcttccaaaagatcttccttctaatatgtatatcagaatgtgggtagccagtcagacaaattcatattggttggtagctttaaaaagtttgtaatgtgaagacaggaaaggacaaaatagtttgctttggtggtagtactctggttgttaagctaggtattttgagactacttccccatcacaacaacaataaaataatcactcataatcctatcacctggagacatagccatcgttaatatgttagtgactatacaatcatgttttcttctgtatatccatgtatattctttaaaaatgaaatttatactgtacctgatctcaaagctttttagcttagtatatctgtcatgaatttgtaggatgttccattgcatcagaaaacggacagtgatttgattactttctaatgccacagatgcagattacatgtagttattgagaatcctttcgaattcagtggcttaatcatgaatgtctaaatattgttgacattaggatgatacatgtaaattaaagttacatttgtttagcatagacaagcttaacattgtagatgtttctcttcaaaaatcatcttaaacatttgcatttggaattgtgttaaatagaatgtgtgaaacactgtattagtaaacttcatcacctttctacttccttatagtttgaacttttcagtttttgtagttcccaaacagttgctcaatttagagcaaattaatttaacacctgccaaaaaaaggctgctgttggcttatcagttgtctttaaattcaaatgctcatgtgacttttatcacatcaaaaaatatttcattaatgattcacc

SEQ ID NO: 61924 - DNA, 1047 bp, Homo sapiens
attttatttgtgtggaatgaagtgaggcttgtagtcatggttctagtgtttcagtttgccaagtctgtttactgcagtgaaattcatcaaatgtttcagtgtggttttctgtagcctatcatttactggctatttttttatgtacacctttaggattttctgcctactctatccagttgtccaaatgatatcctacattttacaaatgccctttcagtttctattttctttttccattaaattgccctcatgtcctaatgtgcagtttgtaagtgtgtgtgtgtgtgtctgtgtgtgtgtgaatttgattttcaagagtgctagacttccaatttgagagattaaataatttaattcaggcaaacatttttcattggaatttcacagttcattgtaatgaaaatgttaatcctggatgacctttgacatacagtaatgaatcttggatattaatgaatttgttagtagcatcttgatgtgtgttttaatgagttattttcaaagttgtgcattaaaccaaagttggcatactggaagtgtttatatcaagttccatttggctactgatggacaaaaaatagaaatgccttcctatggagagtatttttcctttaaaaaattaaaaaggttaattattttgactattcggttttaaactttttattcaacaaataccaagtccctgctgtatatatgggtttggaatacattagtgatcaaaacacaccctctatccctgcccttgaagagtttacactccagtagaggaaacagaatttacattaacaattataaattgtgatacatgctgtggaaagtgaggtgcatgtgataatggttatcaaacattatgctccccaaaatttccatcaccttgcagttgaatgaggcctatgtaactagtttattctaatgtaatacagaaagtagtgtgacactccactttctgtaaaggcaatgaaaaaaatttaccatccagtttctctcttcccctactgctgtgattaaggattttgcatgttctagatggtgcagctttgtcagcct

SEQ ID NO: 61925 - DNA, 1141 bp, Homo sapiens
acacctgtaatcacagcactttgggaggctgagacaggaggattgcttgagcccaggagttcaagactagcctgaggaacatagcaagaccttgtctctacaaaaaagttaaaaaattatccaggcatggtggtgcatgcatatagtcccagatacttgggagaccgagctgggaggattgtttgagcctgggaggttgaggctacagtgagccatgatctgtgccttgcactccagcctgggcgacggggtgagacctcatctcttgaaaacaagtctaaaacaactcacaggtaatggagtcatgacaaattttttttttgtttactgacacaagaaaagcaagctaacacaaggcataaatcctgcaaaatgaacagcaaagaagataaatatttaacaattgttcaagctacaaatgagaaaattatgtatcttgcaacattcttgacaggtaagatgataagatgttggtatatatttttatatcaaaacccagaattacagttctttgatttgctagtttggtataaaatccattaaataaacttgtgccttatttttgcttgaactagaatgcccagactgtttaaagtgattggttctcagttaaataggccaaccggccacctaacaagtatttgttgcatgcctgctgtgtcaagttggaatacaatagtggagaagtgagaaaaggccatagattttacattttagagtgggaaaacagattttatacagagagttgagcaagtgtgatggcttgatgtaggaacaaacttggtcacttaggaaagcgtaagaagagaaaggctagagcagagtaagtgatgggagattgatgtaagataaattttggagaagtaggcaggagaacttctggtttcagccaaggtggaataaaaccactaaattctgtcccctactgatgacaaccatcaataaactttttctacactgttttattcaaactcattagtttatcttattctttgaatagatcttttaccccggcctgattttgtgacatcatcgatgagtcatttggaaaatacaggttcactgagttttgtagattttccagtgttgacacatttcattatgcaatgcagaaaaacaaatcacatttaaaaaaatatca

SEQ ID NO: 61926 - DNA, 1036 bp, Homo sapiens
gagagacgcaagtaagagaacatttccctaacatgcccaaacacattccttttcagagtgctgaaggaatttgaaaatgaggtctcagaattaccagcagtaattcctgataaattaagaaaaatgggagagagttcagagacaaagacatgagaaaagattgccataactctccagaaggatggattctgggtaatgaaggccagtatgtttaacactgattcccagaaaaagactttaatatattcagtagcagttagtttaagaacattagaagataattcggtgattaccagatgtcaatgagggctaggtaggtcatttcaaagccttctcaaatttcattttttctttatgatcacctgtcacagtgctttacgtgatgtacatacaaaaatatttgcataactgtataaaacagttgaataataactgtatagcatattgcttatataaactgcacaaatctcatttgaataaaaaccatttataaagtacttgcagtatgcaaaatgtgttgggcaaagggcaggtctgagaggcacacacgaggaaaactaaaacagaacagaagtctaatggtattttcaagtgttataaaatatgtgaagtctgccttgtgagagaaggtagcattggcttgtggaaagagcatagcacaggaaattagaacatctggttgctcatcctggctttaccatcaacttaatgaatgacctggagtaagttacttcacttcgagacctatgctctatatctgcaatattgaaaatgctggataagataatctctaaagccccagaaaaagatggagttgtactctttcactcccaggaacatatactggaacttatgagtagaactttggagagaccaagtttgcctcacaatgagtaatattctagttctgcactgtcgtatagtgacttcagtcactaagctacatgtctctatggagcacttgaaatgtgactggttcaaagtgagatttgctgtaagtataaattacacatcagattttgaaaacttagtataa

SEQ ID NO: 61927 - DNA, 1110 bp, Homo sapiens
atgcagatgtaattctttggaacaattgtttcctttgttgatggattttttttccacagtgcccactcacaattaaataaaacagtaattaaaaccctaaatccactcaaaattattgtttcatcagtcacctccagagatccttctaatgtctttgtggaaagaatgtcttaacagagatgcaatgtgctaagacacaaagccttagatttttcaaacttggagtaataaattctaaatacgcaagaactttttaagtgactagaaaattattacaatgaaataaaaacccaaggctatacgccataggatagcttaatccccttgggaaaaaaaaaagactgtttttttttttttgagatttttatacaaattacaaaaacattgaaaaatttagtgatatatatgttacagacatagaccaatacacttctcttcatgcagacatgaaactcagcctaatttagccatgacatagtgcatctttctgggtatctccctaatggagacagggtgtatttaaatctgatgttcactcatcaattgagtctttgaagcttcttaaactgattcaagaatgagttctcctcccctatttcttcctcctcctcacttccttctccttctctggcattctccactttcctaaaagtaccattatcctgccaacaacacaagcaggcaacttccaagggtaacacagactgcttcttttcaaggcctacttgagccatttctctgtaatttaatttctttttcatctgctctcttcctgttctccttttattaaaactacattattattgttattattattattgattgaaatggggtttcccttgtcacccaggctggagtgcagtggtgagaacatagctcactgcagcctcaacttcctggactgaagccattctcccgcctcagcctcccatgtagctgggacttcaggcacatgccatcactctcagctaattaaaaaaaattatttgtagagatgggggtctcacagcattgaccaggctcgcctcagactcctggactcaagggaacctctcaccttagccttctaaagtgttgggattacaggcatgagccaccacacccagccta

SEQ ID NO: 61928 - DNA, 1031 bp, Homo sapiens
cagctacccaggaaatgcaggttatgaaagcttagaattatgaaatgacacaggttgtgtggttaaacatgagcttatcttttgaaagtttctatttcacagcttctgaggggatgcactgtgcatgacttttggtacctgagttttcaggagactggaactgaaaggaagaattcaccaactacctgttttagccccaggcagcatcatcagagtcatgcttggaggtggaagggaacacccttgtggctgggcccacagaacatgttgaaaacgagttctcagtattgtggcaggaagtattgggtcacgagtcgcaactcacacctttctatagctggctgtctcagctctttgtgaaatctgggtctgaaatcacctccttctcccttcttccctgtgtctgcacagtccaactgccctttgtggattatctttgcatctcgtgaagcacatacctagcatgttcttatgatagcagtgtggtccagatagtgaataacaaccactacagcctattgaactcttattctgtgcattttatctagcccttcttctggaatgtgcctctgcaaaacttctgttttaacatctgtgacaattaagtgatttttttcatattataaaaaacaatacaacaaatattaataacagtgctcattgtatgccaggcactgttttaagtattttatgtatcttgatgcacttaaacttcagaaccaccctgtgatgtagttattctgatccccattttacagatgagggaattggagctcagcgagcagacatgtggctccaaaatcatatagctaatgagtgatgggtcagtgtactgataccgaagccagagctgttaactcataaatgatgaaatagattgaaatgtagttcactagaaggggaagacatctttaggaatttgctattgattcaggttgctccctgattttttagcacaagcgtggcaaggcattcttccaataacctcagctgaaatgcctgcttggaggactcaggtgctccatcttcat

SEQ ID NO: 61929 - DNA, 1082 bp, Homo sapiens
aacaactccaaggttaagacaagttgaataacttccttgggtttctaaacccagtgaatggcccagccaggatttgaattgaggtttatctgctcctaaagcctgtgctttttgatttatgttggtctgccttccagagaaggagaaaaaacctgaatctcagagactcactgaaaaagccccagcattagtaccggtcatggctcctgggccaggacttcaaaggagcctggaactggctgtaactggaaggaggtgggggaatgaacaccttttccatttttccctggcctctctctctcctgggcaagttggggcaggctgagtgggcacaggtcctggatctgcataccagggctggcgaggtgcctttcgctggaagtcctgactccttctcaatgcacaaggacgcccttctgctgccaaagctggctggtggttctttctggaatggcagctttccccatcccccttcaggcttgggtcgatcttctggcaggcaaacgtactaaagagttacaggtggtgcagatacggtttggaaggaatcccagctgggcctcctcccagaagccttctgatcactcaccagataactctagctgcttgcagagtcctgggaatcttagcttctccaggaaaccagcttcaagggcaacaagaggttctgaggagctagaataatctcggaagctgaaactgctttgtccttttgcttccttaggttggaaatatttttgcaataccactgaatcctccagtttttaccccttacgatgggaagtgaatacagtatgaaaagggagtgggacatatgagaggaacgacaggctcaaaatatgaagacttaatccagacacctctgtgtctctgaacttgcgttgtttcttctttggaggtgaagtacacatcgttttactccgggcagaggacttgtgctccttttgagaactttcagctctgtagtgtcgagtcttctggtttccagatccacatcctgccctgggggaattgacatccatcaggtatactgttcttggtctgtttaatcaaactttcatgatgtcggttggaatttcaca

SEQ ID NO: 61930 - DNA, 1057 bp, Homo sapiens
caaagaaattctacaccagagcaaaaagtaatgtcaatctacgtaatatttagtcataagaatacttcacagatcgctggaaacccataaaaactatcactgggatagtggaatgagcttttaaaagggaatttctggcagaagatggtgccctgacttagtatgtgccattatataaaaattactgaatgaataaaggtggcaaaaatccagaattggtggaaatatgcagctatgattgagtggtgctgagatctacagagtggtttgagtggggagtgcctgcattgctaacatctaaccaggaaaaaagcactttgccttcataacttgaatgtccttgctctttctataaagcttttatctagactaagtggaatcgtaatgtacctaatctaacgggggtttttcaaatgctcaaattcaatttggagtcaagataaatgaaaatacatacaacttatctaaaagatgagtttaaaaaacattcccttatagttgcctttttttttttttcagtacttcaacaagcccttctgcttttatgtttctctttgttgcctagcaatacctacaaacttgtaggaatattgataaagcaaggctgacctctggtgtacttctgtatccttccatgtaatcctgaaaactaaaatcagatgttgtactctgtaatgattggttcctctacttataaatattgggaccagtggctttagggacattcactgagaacatttactcagtttaacttctattaaataatacttaattcaaactttttttccttcccatctagcgtcttttattttgtaaagtgaattattttttatttattaagaagtgaaattatgtgcatttctgaaaacattatgttatctcatcaggcttctttgatgatcctgccttggtgctccctctttgtttcctgtggatttacctattcatttgttcattcgtttggcatgtatttattaggcgaaagcttttgctgagcatggcattatatttagccagaatcaaagccatattttgtgagaaaaatgttatattttca

SEQ ID NO: 61931 - DNA, 1046 bp, Homo sapiens
tgtgattacagttggagatgctgcttatcttatttcttgtaaaactcggagggaaggcttccaagtgctttactgctctaggggccctttgtaatcaaatatgcttcttcagcagtaattttagcatctattatcggtgcttcagccctggcagttcggcagccttgcagctttgacatcacttgtggtttgcagaagatcatgcagtgctgtctagtgctcctgataatagtttctaaatgcttagctgatttatactgactggaattgtcccatctcttcctagcaatcgaatctggcaaattaatcatttaaccttttctgtgacatggacaagcctcactgtgaggtcaccagtgtcacaccaagtatggctgcccattgacagaaaaagtttgtgctggaattgtgaatgtgctcccccatctagaagatgtacacgttgtctttttagataaaacaaagacaaacaagggtatattttttcaagtgcacttaatgagagtacaacagaaccaaaaagggaaatctgtgcttctcattcccagtcacgtgctgactccctggacttcattcttttttcaccaaaactcctgtgcacgcagcatggagtaatcatgcttgaatctagcctcacagtcaggccctcagagctgattctgagatgtgaggttcaacgatttagagaggggcctggattattctgatatgatagcttttcattcactataacttgaagtttttatatcacagggatctatcttaaaacaagagatataattaaacagaaactcagtggaaaggggctcttacagtcatataactggtcctccaaggaaaatgcaaaggcgtcttttatctctctccttctcccccagaaatacctcatcatgtccttggcctgtgctgtggagggttccatttaatatcctcatctttcccagctccctagttcctcatgccctatgctcaccagacagacacatcaccttcctaggctccctccactataaagaaccctcaaataaacttcaaaggcaggaagt

SEQ ID NO: 61932 - DNA, 1057 bp, Homo sapiens
taattgtctcagggaaaaaaatcttcaaatgctaaaattagtgggcaatggtatatttgcatagtttccctacaagatacttttcaattataaagagaaaaatagtatcgtggagaaacctgaccgatataacttaaacaaatatcacgattaacatcattaataattgaacaaatcaataacatatgtctcctgatacatcatggaggatacaccatcacttataaggtatttttttgccaaaaaaatgcataactctcattgttttctgtatttcatctttctcacagtcaccacaatctttattagataattgtgtagataattgtttattatttttacacctctctgccccattcctggtccttagcagaatgtaaggtccataaaagcacaaagtaggggctttataagtaacattgaataaatgaatgaataaataaatttatttggagctatcagtttttacaggaaagatccatttagccttggattgtattgaatgaaaaataacagttgggtatcctggtggaaatggatggaggacatttgaaggtacaatgctaaagctcaaattaagctgaagccatgaaaaaaaaaggtgtcttatagaataaagatatatcaagaaaaaaagatgaaatattaatatttgagatgcagggtgagggaggagaaaggaaacacctccacttcagagaggccaaggcaggagttgattttaaatagggaaagttcagctgatcagggccaggtgcttagtgggggtttgtaactgtttaatgcagtgagtctcaagttttaatgtgcataaaaacatcctgggctggagatccctggggcacccttcccagaaattttgactcagtggggcctagaaatctgtggggtttgtgtatgtgtctgtgtgtgtgcgtgtgcgtgtgtgtgtgtgtgtgtgtgtgtggccagcacacccctcctccaccaagtcattgtaatgcaggcaagttatccaggaaccactcccagagggaacatggcatccaaatcagggggatgtcagctctagggtagg

SEQ ID NO: 61933 - DNA, 1099 bp, Homo sapiens
aatgtcttaagtcttgaagtgacattaaatataattagtaaaacagaaacaaaaccatcaaccttcacaaccctaagaaatgccttttggtaacaccacaaaattatttaactagtgtctccccctccaaataaatctgtctttgttttgttcagtttttccattatagatatatcaagacatcatttattaactaaacttccacagaccagcctggaatgcaagttcctatttctgttatgttttctattgtgaaactgggtttcaagctacaaacaactgattctcaaagttttggcaaagaatccatttttactgttgggactttgtttttgaattggaaagggtggtgtgtccaggtacagggagggatgatgtaagtggtccctgtacctggacacacccccctgctgggggactctttagtcttaaacatttcatttcctgttcagttattttttttttttctgtgagatgcatgtcattctttctgctattgttttttagacacataatgaatttactattacccatgtaattgtgccaaagcagtctgcgggaccagactattgtgacatggagaatgtagaggaattattcaatgttcaggatcaacatgatctcctcactctaggatggatccatgtacgtttgaccttttgggtttcagtttttttgtgtgtgtggcatgctattttcctccttgaagaaaagtttagcttcatttaaatagcttcttctttttaattttttcaaatgtaataaaggttgtcatttaagtagtggttctcaagcaaagagaaaagaataacagatattaaaaaaataaaggtcatcatattatagcatatttttcagtgttagactgtgcctaaacctgtcaaatctggatttggagaacgtgtatcttatgcttttttgtatcatctgaagttaaaagacatagaaagaaagcgagtaacatttggaaatcagtgatttgttttagatgattttacatagcctagtgaaggcttagccaaattgttaactgatttggctagacaactgttagtgtgggtctaaattagattattttaagaaaatatctgaaagtgtt

SEQ ID NO: 61934 - DNA, 1045 bp, Homo sapiens
tttctgcttgatatggccaaattagttttttcatagcaattgatggaaactatgatcatacttcttgattacctttgcatagtccaaaagaaacatttgactacgcctttttttttcctaattttcttggaggttctgtggctataacatcagagaacattatattgacgttagaatttacttaaaatgaaaattatttggcaacccctgtaaatatttttgttgttgttgaaaatgaataaatgtgattgtatttgttctgattggaaatattttaaaaatcaggaacaaattaaaattaggaaatctatacttcctccctaaagaaaatcatatggtaaacattatggtgaaatcaaacatatggtaaaaccaattttttctttcctagatatgcaaacatgtgttggtaaaagacataaaaataattgtgttggatctgaggtgatatgttctgaatgtaagcaccgtcaacatcagacacctactcatggacatgtggttgccggattttcttaagatgtttccagaaatgactgatattttatatttatacattttagatgacaaagcttgatatttattgctgttgcacattttaaagttttctttttgggttgctctgtgtcaagagaggttacatggtgttaaatcggtacctgataatgtacccaaatactatggccagataataaattgtgctgcaaacaacatgtcttgtatttatagaggtctctgcatacatttttagagctttagatgatttgctatattttttattcatgtaaaatgtaattccaaataagaaattctgagtgtatatagtctccaaagcagaccatctgtttctgaaaccttcccctgaggtaggtgaacagcttccatgtgtagatgaaatatggctgccattgataaagcttgttctgtgttttcagtgtcatgaaatcccaggctcagagagatatctctgcagtgaatcattgtgtaagatacaagaacaacacttctattcagggatcaggtgtcagagggcctgggatagcag

SEQ ID NO: 61935 - DNA, 1150 bp, Homo sapiens
cctcagcctcccaaagtcctgggattacaggcgtgagccaccgtgcccagcccaatttctctgaatcttagattcaatttgctaggcttttctcaccaggtaatatgtagccaacaaacctcagtttaatgttatatatacttcttaataagataaattatgattttttattaattcatttcatttttaagtctcactaagtttgtttaaactataaaaaagtatttaaactttgcaagaacattaccgctattgagagctggttttagaatacattgaacaaaggttgtgattaagaatgtccagggaacatatttctatacagaagtcaaagtatctgagctaaattttgttagaaaaaatatgcaaaaataaccactcgactaattaaaacatctgaaagttattaatcgtaagtaaacaataaaatctggaaatacctcatttaggcacaaaatatcagtaaagtacaaattattaaagaaaacagcaactttaaaatagatgttgcagtgacccagctgaagaatcaggcaagcttagggactcgcagagaaattcacagtgagccaggagagtatgacctgataacagggtcttaaagttaagttttacttcttagctcaaagcttttcttttgcctcccaatttttccaacttttaaaataattttttaaataagaatgataaaattaaattctttcaagtacttatggtagagagggtatgtgcacttatttacattaaatcccctggataattgaattatccatatcccactgagctcctgattaacaattgtcccatgaatccttccttatagaaaagtgaatgtgaccataattccctattttgttcaacttttcttccatcccaccttgacattctatgtaattattttagtccattgataaaaacaagttaatattttttatactttattggccagcaggggatctctcaaaacaaagaaagtgttttatacattgacagttctagctgggatatttagaaaagaaagaaatgagcatttatttgtgcccggtaggcaggatggaaacaaagaggcccaagatgtggtaaagttaggcaaatttggtataaaacatgctagaatgatgaaactgaagtttaaccagacaccggtagg

SEQ ID NO: 61936 - DNA, 1004 bp, Homo sapiens
acccctttgtgatcctttcttactgccccttctctccaggaaaccactgatctgctttctgtgaatatagattagactgcattttgtggagttttatatgaatgggatcagacagtacttttttttttccttattttgatctggcttcttttggcataattattttgagattaatctatatttttttgtgttccttcccttttatagctgagtagtaggtatataccataatttatccaatcatccatttaaagcatttgggtttttccagtttttgtctattacacccaaagctgttataaacatttatgtacaagtctttgtatgggcatacatgcctgcatctttttaagtgattctatttattttttaaaaatgtagaagttctgggatctagtcctaggtttttctctgaccacttgcgtgatcttaggagaggcatttaactttgccttcagcatcctcaaggtctttgctgtgattttgagtcatcactgccagaaaccaagatggtctttgttgatttgatggttagagaatttcagaaggagagagacgggtcaaatttttcctttctgtttcttttgaaagctctattttctttcatttcacttttttcccatgaatgacaaatttaaatgctgacgtataatttggggcaagaacagaagtggttagataagtaggaggaagagctaatagtggttagataagtaggaggaagagctaatagtggctgaacttaaacatgtctaaatcataggtggaaggcaagaggtgggaaataagcaagctcagaaattttgtgtctctttctttttctcaaactatcctcttctaagtcttgccttttgttatttctccatgaccaatttgtttttaactttggggttaggaggtgaatgggtatgctggactccaaaggtcatatatcaactggaggtggtgggtgggaggtttcttagttaaaagtaattcctttgggccgggcgcggtggctcacg

SEQ ID NO: 61937 - DNA, 1109 bp, Homo sapiens
aggttcagagatcatcgttttgtattgttttcgtagggttattttggagccgttggggcactgttggaactgttcaaaatgactgatgacaagtagagacgagcagtggaggaaacagcctcccaaaaggacagagaactaaaaaattgctgctggagaaggtgaaagtcgctttgggacggaagccaagccattatggcagatgaacctgctggatttgtaaataatttaaaatccttccagatgatcttttactcttaggttttgagctaatgattcaaaacgggggaatataaaaggttttttttctgtatactgtatttttttaaaaaaatggtgcagcgtggccaaacctaccaattgtatgcattaactttgaaaagttgtttgatgtttaagaaggacctgatatgtaagcgctggtcatttttcttctggggtttactgatcagtgtggtgattttaacttcatttagtaattactctaggagattttaccttgacttatatttttcatgacgtttcatgatttgctgttggtttcaaatgaaactacaaatctggcatgttttactgtgaacacttttgttatttgttttgtacccttttttgtcttgtttttctgttttagttgtcttctgaaaaaagagtcgttccctctgtttctgtcctcagatgatgtccctccccctacctgtaacctttctttgacataattgttcatatcaatgaaggtgctgaccagctcaatacaaagttaagcacaagatctaaagctcttgaaaatgcccgtgaagagaagactgaatgtgttaatgaatttaatgagtctggcaaaagttgcaaattatatgcaagtttgtcctatcgcttataaatgtagtgtttcattggatttattttatgctaggttatattaagttgaaatagtctgtgattaaatgtcctcatccatgcacagaatatgaatggcagcaaatctttgtgcaagaaatttgaaacttattgggaaaagcctcccagtagattaattgttcatatcaggagatttagggtaagtcatgggttgaggtgtcagatagtaatatctatttgttttgtacatgtat

SEQ ID NO: 61938 - DNA, 1170 bp, Homo sapiens
tggtcagtttttcctctaggattgaagcagatccgtttctttggtaaagattctgacaaaaatagttagcaattgggatccaggatgtatgcaaaaatatatatatctatctttaaatattagtataacactcagcttggtgagatacttgagccctaggaagcacacaggaattgagactgccttagggaactgcagaatcctatttctcatctcactcaattctgagtggagtgcagtggtgtgtgagcagagccttgggcactcttttgattgtaaaattttctctgtctgtgccaccttttaggcacatatagttgaattcaaataaattgaatgttaaatgcacatgtagatatgataccactgcttttgcttatttaatattcaaaaactgaacacttctttgcacgcatagcattcagcagcactctttctttctgtcctttagcattcccatggtttggcatggacatcggtggaacgctggttaaattggtgtatttcgagccgaaggatattacagccgaagaggagcaagaggaagtggagaacctgaagagcatccggaagtatttgacttctaatactgcttatgggaaaactgggatccgagacgtccacctggaactgaaaaacctgaccatgtgtggacgcaaagggaacctgcacttcatccgctttcccagctgtgctatgcacaggttcattcagatgggcagcgagaagaacttctctagccttcacaccaccctctgtgccacaggaggcggggctttcaaattcgaagaggacttcagaatggtaggtcgggtttgtctttgttaaaacatcaaaacctctcacatgtccataatcatggccactcataccgaagaaccatactactagccttgggactctggacaagcttatgtcaccgctctgtgcctcagttttctcacctatacaagaataaaaacagcttctacctcatagggttgttacatgtaggattaaatgagataatatgtacctggcacttagtaagtgctcaatatagttatcatcatcatttcaattacaattattgctgggtaatacgctaaagacaagatgctaaaatcccttctgaagtatttcagttagaattgaccacagacttttactatataatcgtgatgccaactt

SEQ ID NO: 61939 - DNA, 1870 bp, Homo sapiens
cattaaatgatgtcctacaaagtgattttaatggttaaattaaatcactttgtgttaatgaataattatttgattatttgtttaattagccctctgttgttgtacaataaattagttttcttattataaatacaacttcaatgttttaagttttttttttttttggaatggagtctcgctctgtcacccaggctagattgcagtggcacgacctcagctcactgcaagctccgcctcccaggttcacaccattctcctgcctcagcctcctgagtagctgggattacaggcaccagccaccatgcccggcaaatgttttttgtatttttagtagagacggggtttcaccatgttggccaggctggtctcaatctcctgacctcgtgatccgcccacctcggcctcctaaagtgctgggattacaggcatgagcaaccacgtctggcctattttaagtatttttttaaagctaaatttttggatgcacacataatttcttttagggtaaaatagaaccaacatatcaaagggtataggaatctggagctttttaatatgtatttccaaataaacccatagaaagattataccagtttacattcccagtggtagcatatgagcttgtacccttgccaacactgggtaattaccttataactaaaattcaaactaaggaaatctggtacacattaatttgaaagaacccatgactcaaatttcttttcatagagtaatgttcaacagattgctctgtgtgtgataattatgggtttctttacagtattagggaaacacttttattaaattttatattcactactttcttcaaggtccttaaatagtcattaagttttcaactgtgtttcatgctattaaaagtatggttttggaggtctttgcatatgattatttaggatgatagaatgtgagaactagacagaactttagtgataggttaatctacctccatttaaagactagtaaatgggccagatgcagcggctcatgcctgtaatcccagcactttgggaggccaaggcaggtggatcacttgaggtcaggagttcaagaccagtctggccaacatggcaaaatcccgtctctactaaaactacaaaaattagcaaggcgtggtgacacacccctgtaatcccagctactcaggaggctgagacaggagaattgcttgaatacaggaggttgaggttgcagtgagccgagattgtgccactgcactctagcctgagcagcagagtgaggctccatccccctaaaagtaaaaataaagacaagtaaatagctcaagtaagaaacttgcccacacaaattctgactgttgggacattctcggttgtaagcaacagacacctcacctcagaccagcctaccaaaatggggatttattggttcatgaaactgaaaatgggctcagatacctattgtgactaaccttggacaattccttgatctttctaagtcttggttttcttatttgtaaacaggatgttagactcaacctaacgttccttccacctcttaacattaaatgtttctgtgaatatattatcaaataattttgttatactatcaaccaaatttgtacattgtgaaaggaaggttagttctcagagacaggaaatttttaaagagataattcattacacaattggatttaacaaggattttttttttttttatgagacagagtttgtgctcttattgcccaggctggagtgcaatggcacgatctcggctcactgcaacctccacctcccgggttcaagcaattctcctgcctcagcctcctgtgtagctaggattacaggcatgtgccacaacaccaggctaattttgtatttttagtagagac

SEQ ID NO: 61940 - DNA, 1023 bp, Homo sapiens
tggcacacctgcatggtcaaaactgtggactcttcttttttgtccagggactacttctgatgaagaaagtggcataattaaagctgaggacctcacgcctgtaatcccgccactttgggaggctgaggcgggtggatcacgaggtcaggagatcgagaccatcctggctaacacggtgaaaccccgtctttactaaaaatacaaaatattagccaggcatggtagtgggtgcctgtagtcccagctacttgggaggctgaagcaagagaatggcattaacctgggaggcggagcttgcagtgagccgagatcacgcagctgcactccagcctgggcgacagagcaagactccgtctcaaaaaaaaaaaaaaaaaaatgctgaggaccacacagaaagttgatacttatactcatcttctattgcctctagattgggcagaactgacagcttcttggtgagaaataggagtgatgaccatagctgtctgtaagtgtattttcctcccacctcctctgcacagcgtgagaacttaactgtggaatgggaaacaaatttcatctgcctaccatttcctctccttaacccctgaagcagaaatacacagcttgactgtaggcatgaaggggagaaggtgagctcactggtccctagagtgacgctcatctttctctctgattttcttgtaagggtgacatggagaggtttcaggaccttgggaaagaaaccactctcactgagctactcagggacttaacgaaaagactgaaggaaaaaaaattttattaacctcatggatttgacatttttgggtctcctcatctctagcttcatcttattcctgcttcctcctggcccagatccaagctaagaatacacttcatggtgctaccagaatgacatggcttcctttgcccctgcaagagctttttttttttctttttttttatcttaacctacaaaataaaataaaagcaacagagctttcatgttggtgtttctatttgttgttctaatttcacatg

SEQ ID NO: 61941 - DNA, 1018 bp, Homo sapiens
tgctaaatgatcaaccatgtagacatttaatattaatatcattgctgttatttaattacagaggcttccaagactctgaaataccaggatttccacaaactcatcttgccctgactgggaatctttcggagattggatttcagagtattccccaacctgatcggatatcacctcctcaatggaagcttccctaataccctctgatgtttctagaagcaggacacatggcttgtgtcataagtcttgacctgattatcatagattgcctcaccaagtttagcataccctgtctgagagtgatgctggcaaattagtgaataagaggactgtggaatttatttgattgctaatcttgtgtcaggacatggttattttttaaaaaagaagtgtcctcttttgatcttaactgtttgatatctcagcccttgagtgaggcagttatatgcaaaggagatgagaaggatgagaaaagtgagtacttttccttcataaaagccacatgaattgaacaagacttcagaattcagaagaactacatcaagttcttgggtcatttttttaacccattctccaagaattgaaaaaatgaccttgcaaatatgtgcaagactctggaatcttcctttggcagatgatgaatgagatgaatatttccaggtgcttgccttcagcaccagcacatgtacattctagtactcttggccttgatcctacactgaatctgagggtgcaaggactttagatagaggctcaggacagactggacctgtatgaacttctgaattgtagctagcctgggcagccagttacttggatccctctggggcttctggacaaacaactcttttatagcccaaggtagatggtcaggggcgaccagagagagcaatagattcgttgacttcaagcttaacatgagttagcagtatggtgaggcttccagcaaaatgtaagcactcaataaatgttagctattattactgtggtggtgttagatgttcttccttatactaactca

SEQ ID NO: 61942 - DNA, 1042 bp, Homo sapiens
caaggtaaaactgaagtgtttttgttttttgttttaaagataaagagacttggcttaggctaaattgctatataattgtatataatgaactatacattttatgcttatgcaacttagattttaaggataagactcaaatctcaggtctggaaatatataattggatgtaaagagatcactgtagtgttattaaagttattattactatatttttattaaagttattattaatatatttttaagaaatattcttttcaaaacttaggtgaatacttgattccctggtacagatttctatcttgaaaactttctggtagtaaaactatcaaatgtatttgtgggagtggggatgtggcacctattttaagaatgaatcttttaaatttttaaacagtagtgttgggatggaacacactattaatattaacttgaattttctaaaaagagtttttaaaaaatgtttgcttaggtttttggcccagcaactacacagaaggaattctttcagggttgcattatgcaaccagtaaaagacctcttgaaaggacagagtcgtctgatttttacttacgggctaaccaattcaggaaaaacatatacatttcaaggtaaatattgttttattttggttggaaaggataaggaagcaataataatcactcagtgtttttataatacatacatgtagttatgttgctattacctagtatgcgtttgctctatttttaatagtactagcatattattacgtattgctgtttttttttttttttggcgggggagggacagagtctcactctgttgcccaggctggagtgcagtggtgtgatctcagctcactacaacctctgcctcctgggttcagatgactctcctgcctgagctgctcagcttcccaagtagctgggactacaggcgtgcgccaccatgccaagctagtttttatatttttgtagaaatgggggttcaccattttggccaggctagtctcgaactcctgacctcaggtgatatgcccaccttggccttccaaagtgcttgg

SEQ ID NO: 61943 - DNA, 1003 bp, Homo sapiens
gatttagatgatgattaaaatccagaaaaagtattgatgtgatacagagaattaagcataaatgaccagaagaaattttatatttcattttacttttatagtttgtgattatgggtggttacaaatcttaatatggttgcattatctgaatgtaaagtttcatgtttacatcagaataatagtcaataaaatgttggtaatactgtgaataacaaagtgatggaaaactgagtaatccttagctatcatttccgtttcagttgttgactcttgcctattggtagtataaaaggagctttaataaacaagtaaagtttcctctttcctagtagactgagagagtataacacaaaaattccttttgcagggacagaagaaaatattggcattctgcctcgaactttgaatgtattatttgatagtcttcaagaaagactgtatacaaagatgaaccttaaaccacatagatccagagaatacttaaggttatcatcagaacaagagaaagaagaaattgctagcaaaagtgcattgcttcggcaaattaaagaggtatggaaatattttagtatgtaaaatatgtataattcctgacttcttataaaccctttagattgtttcaccatatattggaatctggtttgtggtggtagtgttttttgttattatttatgttttcgagaaaaataaagcttaaagtgtgaagacatcttttgtatttatattataccaacagcaagaatgtttaaacaatacaaatgtaaatggttctgaaatcttttttgattgttgtagagccagcattgtgctttttatgtaatgattttttaaaattctgttttttaattgtgaaagtaatatgtacccaaaatttaaaatagggaatgtgagaagtaaaaagtaaaagtttcctttaatttcattcctaaagaaaaaattattaatagattgggaagtattgtttttggaccttttctctctctatataaaatccatatacaga

SEQ ID NO: 61944 - DNA, 2014 bp, Homo sapiens
gtgaataaattaaatgtttaataataagggaataattaagtcatttcacatgttttatatagccatcaaatgttgtaaacaatttttaattatggggagaaaaagcttacaacataagtgtggggaaaagaatagaagggaaatattttaaaatattaatagtaaccaaccagagtggcaggattatacatgataatattctttttcatagttctctgtatttttccatgaaactatattatttaactaggaaaaattaaagaattcattgaattgagtagatgaaaggttgtgatttggtagtgacttatttggataggtaattaatatcttgattatttaaccttaatgaaaatgtttttttaattttttaaaacaatcttttttttaggttactgtgcataatgatagtgatgatactctttatggtaaggtttcgttgctcacttatctttgatgtatcgattatatgaagtacacttgaaaagcttttaatttttaaatcacttctaatgttttatttttattattaaaaaatttttaggctgggcgcggtggctcatgcctgtaatcccagcactttgggaggctgaggtgggtggatcatgaggtcaagagattgagaccatcctggccaacatgatgaaaccccgtctctactaaaaataaaaaaattacctgggcgtggtggcgcgggcctgtagtcctagctacctgggaggctgaagcaggagaatccttgaactcaggaggtggaggttgcagtgagccgagatcgcgccactgcactccagcctgacaacagagtgaaactgtctcaaaaaaaaaaattttcaccttgtatttatttattttttttctatagacctcttctttggttactaaggatttaatttctataatgacatagtcggtgatacctggaaaatgatacatatttatatgaaatgtcagtcattgtgatgtttcgtttgtattaaatattacagatatcccttttactggttacaattttaatattgaatttgaaagacacttgtttttctttgtcctttacatttaatttctattggttcattaacatattttcaaaaagaaaggaattataagaagttgtctaactttggttaatccacatattatttacatcttcctttgttccaaaaagtttttaacatagatggtcaaaagattaagcatacttggtttttcaagtgtgagaatcgatttgtacttttgtcacgtttttagtcagttgcttactttcgtgattgttttttctttttcttttttttgtaggaagtttaactaactctttgaatatctcagagtttgaagaatccataaaagattatgaacaagccaacttgaatatggctaatagtataaaattttctgtgtgggtttctttctttgaaatttacaatgaatatatttatgacttatttgttcctgtatcatctaaattccaaaagagaaagatgctgcgcctttcccaagacgtaaagggctattcttttataaaaggtatactaatgaatatttttatcttattgctctgaagttctcttcctgggctttgtgatagctgtaagactaaaacaaatagaaaattgaaaattgtaatgctaattattaacattaagagaagaagataattttgtgctttggaagtatgttttggtatatttattaaacttgaatataaaagggtctattttggtattgtatttgcttgagtatcattaattggatttgtggtgatgggaaaagctgtgtatggttatgttcacgttattctcctgctttgtaacagtgtccaaattttggagctatgaaatgttactattcttccggagtggtttttctaaccttttaaaacaattattcacagtaggaaacacatattaataacatcatgattcagtacctacatgcatgtatatatattcatatgtaatatttacaactcaaaagtttcgttaattatacttttactacaaggaatgcactg

SEQ ID NO: 61945 - DNA, 2378 bp, Homo sapiens
ttagcctggcatgatcgtatgcatctgtagtcccagctactcaggaggctgaggcaggaggatcacttgagcctaggaggtcaaggctgtagagagccatgatcacgcctttgcactccaggctgggcaacagagtgaaaccttgtctccaaaataaataaataaataaataaataaataaaaattaaaatactggtcatgattcaataaatctgattttatgattcactaataaattacaatcttcagtgtttaatagctaggtaattttacaggtttaatctgtactgtactttgccactctttttttccctgagtgtctaattctaaggaattgttactgtattcaattttccgtttggcagactctgttgacaaacatttattttgtgtgtttgtgtaatttacattctagaacattgttacaatcttctctggtgtaacctgaaatagctgagttgactccagctaggatgtgttgttagaagaaagatttcattatatgtcactaggaaaagactttcaaagagattacattgtagaacacattctttgtctcaataaattaatatatatcctctttattttttaaagatctacaatggattcaagtatctgattccaaagaagcctatagacttttaaaactaggaataaagcaccagagtgttgccttcacaaaattgaataatgcttccagtagaaggtaaagaataaactctgtaagagtaaactcgaatcaccgatagtattctgtgttaatttaaacacagctaattttacattaaagtgggcagtaggttctctcgtgttaaattcataaggcataaaaaacatttggtatacagaataacactaaacacgtttatcaatactgtttcctgtcctgacagtagatttattaatttataggaaatctctgaggtatttttactctttctttatgtcagtatctaagctcagtatttttggagttggtaataatggtggccttttctctgggtctttctcacttatcccctgaatactatataaatatactcagtgagggtataatctcaaggggttaaggaaggaagttttgatgggattgggggatgagaggcaaaggaaataagtttaagcagtgagataattaaagcaggctttttcttagagaaggagccctgttcccgtagtcagttgggcatgggacaatacaagatccggatctataggtcaaatgtatgctttgctttaggtatgtattcagagtattggctagctgtacataatatcattttaactaatattatcttttcaaacaaaatgtcgctttattataaatgatactattaatagaagttgaactgtcaggatataatttgagggatttagagctaggcaaaaggtgattttaggcatttgggtatgtaagtgacagtagaacactggcttgaaatatttaacagctaattggaaaatgcaatggtggactgtagttatactagggtataaataagattgatttgaatacttgtctctcctatttagaatgcagaaattaaaaatgataagataacatttgatctttgtatttcagtcacagcatattcactgttaaaatattacagattgaagattctgaaatgtctcgtgtaattcgagtcagtgagtaagttgaatattctttaaatttaattatttgtaattgttttgaagaacttttaaagtactttttttttcttaattcagattatctttatgtgatcttgctggttcagaacgaactatgaagacacagaatgaaggtgaaaggttaagagagactgggaatatcaacacttctttattgactctgggaaagtgtattaacgtcttgaagaatagtgaaaagtcaaagtaagtgtttctgaaagtgttattagcatattaaatattacaatatttaaactttcaacttttttgtttttagaaagttcttttttgatttttaaactgcttcttatgtaatgactgtgtatagattgtgattcaagtacttaagagatcttggattaaagacaatgatagaaatgtcagttgatgccagtaactcatcaggtaaagtcagtattttccatggcaaatctataccaatagacactgtaaatgagaagcttctaatgctggtttaggatctaaaaccactttattcttattaatgcattgtgtgtggttctagatgcaatagatttttacattaattagcattttaggctgagtaaatataaatcagccttcaccatttctatttagggtgtttcatgacatctcttatatacttgctctatactagggaacataacccagttaaatgtggttttctttataatttacatagtgggttattgttagta

SEQ ID NO: 61946 - DNA, 1147 bp, Homo sapiens
tataaattaatgagtatttttggaatgaattgtctgctctgccattcatcttgttcatttggtacttctgggtgattggaaaaccctctgctaagattaatactgaacacttagcccaggaagatagatttttcctctagtttacatgtgtaagtagcttttttcctatcagaatgttcttttagggatggtgattcctgtttgtatgtttgtttgaatagtttttccttaacacttgagtgttcatttgacttaaatttataaaataatcattttctagtggacagttcttgtcttttctgttttaaaagtcacattgaatattttaacaggtttgtgtcccagacactttaaattcctctcaagagaaattatttggacctgtcaaatcttctcaagatgtatcactagacagtaattcaaacagtaaaatattaaatgtaaaaagagccaccatttcatgggaaaatagtctagaagatttgatggaagacgaggatttggttgaggagctagaaaacgctgaagaaactcaaaatgtggaaactaaacttcttgatgaagatctagataaaacattagaggaaaataaggctttcattagccacgaggagaaaagagtatgtattaagaactcatacttctatgcttgtcttcttattctgaagttaaggttaaatcttaaggctctctctcttcagtttttttcaacagtacactgaagtttttgtgttcaactttatattttgaaaaatttcaaacctatagaaagactagtacaatgaatactcatttatccttcacctggattctccacttaccattttatgagtatgtgaatacacatcttttggtctgtacaatttgaaaataagatccagacataatgacaccttacatctaaatatttgaacatatttttctaagaacatgggcattttcatcatgatcacaagaccatgaaattttcatacccaaaaaatttaatattgatacactaatataacctcgtatactgtttgtattgagagttccccagtgttccaaatatgttctttatagccactttgtttttgtctacagccagagttaacacattgcttttgattattgtgtttctttaatcatttctaatctagcactgaca

SEQ ID NO: 61947 - DNA, 1011 bp, Homo sapiens
tgacagattagtaagtgggtgttcttagcaacttctctggtgtatgcaatccttgggctttagacttttacaggccacttttaaactcaacctttagcatttaccagagatctgatccttatgcttcccacctgtgaaatatggatgataccaagctcacagaaagttgtggattaaatgaagcaaatatggaactccccagagtagttcttgatagataataaatgcactaattaactttacttattttcttagtatagctaaacagtgagacgagttaccaaaggtctatttctaaaatgtggaaaggccaacctgatttttcagttaacaaatctttgcaaacatataattttcagtgagaacattatcactattaaaaaggacacagaattacaattgactaaatgtaaagttttattttttgaacagttggacggtatttctcttgggatatatttattcttttataagaattttatcatttacatgtaatagaaactgttggacttaatagaagacttgaaaaaaaaactgataaatgaaaaaaaggaaaaattaaccttggaatttaaaattcgagaagaagttacacaggagtttactcagtattgggctcaacgggaagctgactttaagtaagttatttatttcatgtccaggtaaaaattgagaattttatttagttttttagtttttttttttacttagtttactttttatattaggtggcttctgaattctgatctctttatacaagcttgaaaatagctgttactggtctggtgcggtggctcacgcctgtaatcccagcattttgggaggcctaggcaggcggatcactgaaggtcaggaggtcgagatcagcctggccaacatggtgaaacctcgtctgtactaaaaatagaaaaattagctgggcgtactggcatgttcctgaagtcccagctgctttcaggaggctgaggcacgagaatctcttgaacctgggaggtgtaggttgcagtgagc

SEQ ID NO: 61948 - DNA, 1173 bp, Homo sapiens
tatagctgtaactaatcccatgcatggttatttaaattttctctcttttttaaatttaaattttaattttttgagatggagtcttgtgctgtcacccaggctggtattgagtggtgcgatcttggctcacggcaacctgcacctcctgggttcaagcaattcttctgccttagcctctcctgccttagcctcctgagtagctgggattacaggcacacaccaccacgcccagctaatttttgtgtttttagtagagacggtgttgctgtgttggccaggctggtttcaaactcctggcctgaagtgatccacccgcctccgcctcccaaattgctgggattacaggcgtgaaccactgtacctggactaaattttcttttaatctagaatatacttaaacttagatgtttaaaacaaaaacacaaagtagttcgttttctgtttcttaatgggattaatttgtattttgaagggagactctgcttcaagaacgagagatattagaagaaaatgctgaacgtcgtttggctatcttcaaggatttggttggtaaatgtgacactcgagaagaagcagcgaaagacatttgtgccacaaaagttgaaactgaagtatgttaattgaagtatttaaaaatatccagtgaggttttggtaccagggtttagtgtaccacatcaatgatgagaaacaccaagatagtttagaattaaaacaatgctttgtgtgtagctttattataattaggcatgtttttttagaagtgtaaggcaccaagaatttaaatataatgattggttttgaaaaatttatacctctgttatatatatatatatcttattttggtattgcttgaatcattgtgttgtaggcagatagattcttttttgagatttgtcttacttaacatttttaaataaaaagaattttaaaggtgtaagagacctaagacgtcatttacttgctgttctgattaaaacaaaaatgtttatgtataaaaagggttgcccttgccgggcaactaccgtttcttactcttttaaaattttatttgtttatttatttattatagttttagagttagggtcttgccgtgttacccaggctgatcttgaattcctggcttcaagcagtcctcctgcccagcctcccaggtggctgagattacaggtgc

SEQ ID NO: 61949 - DNA, 1777 bp, Homo sapiens
ttactactaaaaatattttttgacttccatttattttagaccaatattattagaaaatgagcttctcaacaaaaaaagtcaaaacaagtgttaactttatgagtaaagctgtaaattttgttatatatatatattttttatgacagcgtctcgctctgtcaccaaggctggagtcagtagtggcatcacagctcactgcagccttctactcctgggctcaattactcctcttgcctcagcttcctgaatacttgggaccacaagtgtgcactaccacagcggctgcattttttttttttcttttttgtagagatgggatcttgctatgctgcccagattggtcttgaactcctaggctcaagtgatactgcctgcctcggcctcccaaagtgctgggattacaggcatgagccgtgctgtgcctggccttgttctatattctttataaattcttgcagtatagaagattcactgttgggatagagtgactactgtggagtggtttaaagtaatttgttagtttgatgcttcattctaactaggagggcattttctttttctgtcttcccccccccttttttttttaaagacagggtctcactctgtcacccaggctggagcgcagaggcatgatcatggctcactgcagttttccacctcctgggctcaagtgatccttccaccttagtctcctgagtagcttggactacagacatgtgccaccatgctgagggcattttatatacataaatagaattgtttgtaatatctgcattttaagaattagttgcaataactgctctgcccttttttgtgtgaaacaaatgggtagaaaataacacgtaagtggtgcctttgcattatgaaatgtacttaaaaagcactagctccttttcttctctgatgctatgccagttctttactatttagcatatgccacctatttttatcctgagttttagaagtggctttttctgaaacattaccctgttgtggttgaattagcagatttttttttaatgagtagggtgtgcttctagtgctatcaaaatcctttttattgaatgtaacagtaaagtgtcactagagcagcatatgtttcatagttattcagtgatacatatttttagatgcttagatatttattttcaatgttctttattttttcagaatcagattcattgattcaagagcttgagacatctaataaggtaatgctttaagttttattttgtcttgataaggtatttaattaacaaaggggtatgaatgatgactagatttgtttattttaaaaaataattaaacagtaatatagtctcttggtatgcatgggggattggttttattctgttattttttctgttcttctttggcttgagtcttcttatttcaacttgtatttatcctttcaaaaagctgaatattttaaaatatgatcagatataaataattcaagatcttggtatctaatatccagtatttaaagaacaaaaatgtacttagaagacattacacctactgtttatacaattcctatcttttcttgtattttttctacttatgaaaatagtagacactagttgtaccaattaccttaagctatataaatagaaaataaaaaatttcccataatgttcttcctaaatttaaaacaaaaccaaaccaacttgtttggaagctctttagactgttactttatgtatgtatttatagaacacttaccatttaccagatactccttcaagtgctttttattaactcatttaaatgttag

SEQ ID NO: 61950 - DNA, 1015 bp, Homo sapiens
acattgctttttcttctttccaaagaaaataattacacagaatcaaagaattaaagaattgataaatataattgatcaaaaagaagatactatcaacgaatttcagaacctaaagtctcatatggaaaacacatttaaatgcaatgtaagaatttaaccttgtgttatattaataaattagataagcatatgttttggttgaaaggaaataatttaaaatagcttatgcaactaagactaatttattgagaatgttgaattgcttatgcaacattgaactcaatttactgttttccaaatctgaatttttgagaacttagacgagggtgtttgacttctttgaacatacttttccacaagatacgctggcagtgctttgcatgtaaaaaggaggagaatatgtagcctttggacgtttaagcctcagctagttggaaggggagctttgaggagaaaggaatttaggtgtacttagaaaaccagattataatgtttcagggaactataacatgaaattcagtaaaattaggtttttccttagaagcttgtttttattatatgtattgttgctattgtttatatgcttaatagcaaggatattttttctaaaaagttatacactgtgacatgtaaagacttaaagggttgtctttcatacaaatttagataatttcatattcagttcagcttagaatgatcagcttgtcttttaatccatgtcttttaaaatggcttttggttttctttttttggggtaagctccttcaaattattcttttatttagaaatggtaaaatatatggtaataatgtagtaagctgagtaaacttagagccaaacatcttgctttgttgaaaggtgcttttttatgtcttttctatgaccaaaagaagcaggcgtggtatcttataaaaagtgactgttgagtttcctttgtatcttgatagtcaaactctaatacccaccaacattccctgattcatctgaactttagatgggcatttgataccacagg

SEQ ID NO: 61951 - DNA, 1093 bp, Homo sapiens
cttttcaagggaggcagtctgccttaaaaaaaaaaaaagtctaaatgacgtatctagaagctcagtttcaaagctgtctgtaggctgtatatctttgaatatatatcgacttaaagctaagggcaaaactatttttctaggagttgttaatgtttaagacaatactaatctttaagaggctttggctacaaaacaaaataaatagttgagttcatatttttcttttcaaagcacatttctgatgtgacttcagagatttatcttcttaagattctccagttatccccaaatgttacttatttgctagagccatcagttattttaggacgaaacttaagaaataacttagaaaatgtctcaacaaatttgaaaataaaatttttatggtacaccattgaaagtaatttatgtgatttgtacattttttgtagctttctatatgtgaattatttttaacttattttgctttaggacaaggctgatacatcttctttaataataaacaataaattgatttgtaatgaaacagttgaagtacctaaggacagcaaatctaaaatctgttcagaaagaaaaagagtaaatgaaaatgaacttcagcaagatgaaccaccagcaaagaaaggtactacttcagctgccagcagcaggcgtttaagaaagctaatttctaaaccagtaaatagaacaaggcaaacagaggggcattcacttgtctaaggaaaaatcttgagaaaatctaaacgtcttgaatttttattctggaaagttatacattttctagggatgggcatagttaaagcttttatcttaataaatatgcttttagaaattgtgcttttattatttctttcgcagtctatgtaataatttctgtgcttataatagttaaaactcattactttgattttataaatatagtattttctgcctaaatcccagcacattattttgttttctttgtttgcattctttattcatttggagaaaaggatattttacagtaagactttgagctaaatattattaataataaatgtattcaagctgtatttgtgataccaggagacagtctgatgaaagataatacatg

SEQ ID NO: 61952 - DNA, 3042 bp, Homo sapiens
aacttttatgcattttcaattagttgaatccttctgtacagattttcaggttctattaatagttaaatctatccaatgcacagtgtcgtcaacccatttgtcatcttgatcttcacaactttgagataggtggtattattcctatatcacatttgaggaaacagtcgtagtatgaagcagtttattaatggttacagctagtaaggctatattatatgaattcccaaagttttaacatgtcccttctaattttagctatgaaaatttaagatactccatttgcctattgctaatatagtaaaagccacaatataattgtagcttaaaactgttcgttaggatatggaatgtctgcctagggtttctcgtcatctcctcctctctgtcccatattgaaatgacaataaagatttgtggtacaaaatttaaataatactgaaagttagaaatagctggtaatgctactcagaggtaggtagctgccatcattttggtgtacttcctttgctaactttgtattaccttgtgaaataataatttttacataaatgggctcataccacatgttttaaaacctgttttttctttttttctcaacagcttatttcattttttttttttaattagaagtttacttttacatgttttgtatgtttgaatattggcttatatggtgactttttggttttattaaggtttgccagattaataacaattttcttatttttaaagggtctatccatgttagttcagctatcactgaagaccaaaagaaaagtgaagaagtgcgaccgaacattgcagaaattgaagacatcagagttttacaagaaaataatgaaggactgagagcatttttactcactattgagaatgaacttaaaaatgaaaaggaagaaaaagcagaattaaataaacagattgttcattttcagcaggaactttctctttctgaaaaaaagaatttaactttaagtaaagaggtccaacaaattcagtcaaattatgatattgcaattgctgaattacatgtgcagaaaagtaaaaatcaagaacaggaggaaaagatcatgaaattgtcaaatgagatagaaactgctacaagaagcattacaaataatgtttcacaaataaaattaatgcacacgaaaatagacgaactacgtactcttgattcagtttctcagatttcaaacatagatttgctcaatctcagggatctgtcaaatggttctgaggaggataatttgccaaatacacagttagaccttttaggtaatgattatttggtaagtaagcaagttaaagaatatcgaattcaagaacccaatagggaaaattctttccactctagtattgaagctatttgggaagaatgtaaagagattgtgaaggcctcttccaaaaaaagtcatcagattgaggaactggaacaacaaattgaaaaattgcaggcagaagtaaaaggctataaggatgaaaacaatagactaaaggagaaggagcataaaaaccaagatgacctactaaaagaaaaagaaactcttatacagcagctgaaagaagaattgcaagaaaaaaatgttactcttgatgttcaaatacagcatgtagttgaaggaaagagagcgctttcagaacttacacaaggtgttacttgctataaggcaaaaataaaggaacttgaaacaattttagagactcagaaagttgaatgtagtcattcagccaagttagaacaagacattttggaaaaggaatctatcatcttaaagctagaaagaaatttgaaggaatttcaagaacatcttcaggattctgtcaaaaacaccaaagatttaaatgtaaaggaactcaagctgaaagaagaaatcacacagttaacaaataatttgcaagatatgaaacatttacttcaattaaaagaagaagaagaagaaaccaacaggcaagaaacagaaaagtaagctaaatgttattcaaaatattttaaaatacacaaagcattcattttgctatgcagctttaaaaaagttagatagtcatacttaatctggtaaagcgtagcatgtatgatgagtgaagaacttgaactttgtccatataaacctttggaccataggttatgtgaaaagatcagcttataaaaatcatatgaaatattttctgaagaactcattcatagtttggatattccaaatttgtgaaaagatataattttgtaaagattgttaccatttcacatgtatggtcctaagcagttaatgatgcattaccatagaaaagtggtttatgttttttagattgaaagaggaactctctgcaagctctgctcgtacccagaatctgaaagcagatcttcagaggaaggaagaagattatgctgacctgaaagagaaactgactgatgccaaaaagcagattaagcaagtacagaaagaggtaggttatttgaaaagttatgtggccagtttatgataaagattgttttccttatatatcaaacttagacattaatcttaggattgaatagaacatttatccactttataatttttcttaaaattacaagaacagttacttcacgagagaaaatttagctgatttaaacaagctgaagaatgtccaacattaagagaaatatgtaccttatgaaagattagtctttttcttctttaagaattgctaaatgtaagtccttacaaaaaagtggaaagcaacttgtttacagatagtacttaggagaatgtgcagtatgattttttagtttttattataacttaatttttaaaagggaatgcaatcacattattccaaatttgaaatataatagatgtatacaatgagaaggaaatacttcccactccttcgagctgtcaagtttaccttcacagcatcaaatgttaccaatttctttctttttctgcacttctccctccttcccattttcttgtatgaccacttcattttctgtcgtacttagaccttctctaaagattggagcacttttttttttttttttaaactttgaggtagttacca

SEQ ID NO: 61953 - DNA, 1037 bp, Homo sapiens
tttaaagtttttcttgtattcctggattatattactcaataaactttggaaatttgaatcagtatttttctctcagaatatctttattgatttttccttggtaattatttccctattatgtatagatgttatgataattcttttttgagagaacttaaaaagtttgagattcttaaataatggaacaagaaattgagtttttcatatgcattcttcattagagtattaaaacattttctaataatttgaagctatagtgtgtttgatttgtagtatattaaaatctgtcatttttcttttaggctgtaaaggatgtgaatctttgaacatagttgccatgaatcttaaataacaaaaagcagttagtatttttaaaatattccatttgttttataaacattattttgtaggtatctgtaatgcgtgatgaggataaattactgaggattaaaattaatgaactggagaaaaagaaaaaccagtgttctcaggaattagatatgaaacagcgaaccattcagcaactcaaggtaaacagttttgtttttaaagatgatttaaatgcattctcttggtatattttagtgtacaaaaaggtacaaatttgtttttaataacatcctgttttgactttttctagaatctagaaataaattatttaaaattaaataggcaaaaaagaaaaaaaaaagataaaattaagtaggccagtagtgactctcttctaatgaatagactatggaaaagaaaaaataataacttcatagtgaagaaacctagcagataccactttaaccaagtgtttaagaataacattaccattagtcatattgatgctgtgtgcttcctggtttgatgtgaccagaaaggcacataccctctttggtattctttccctaaatttataacctcagactcttcacgaaaaaacattagacaaacccaaatggaggatgttatacttactgcttcaccagtatgaagtataaagtgtcagggtcattaaagacaagtaaagactggtgaatgatggtgaa

SEQ ID NO: 61954 - DNA, 2825 bp, Homo sapiens
aattaatagtagtataccaatgttaatttcttgatttttgataaatgtaccatggtagtgtaatatgataacattaagggaagctaaattctttggaactcttgcaaagctaaaattattttgaaataaaatgcaaaaaaacaaaaagagttgaggtcttacagcaaattccttttaaaaatgatatttaaaaggcaaaatccctttattgtatatggttattttttgcttgatatcaaccaaatggatgaggcaacaataaaaaaaatacatttgttatattattttcatgtttgcttttaaatgaagcaaactaatgaatagtcaggtataaatacatgattttaattcttaaggtaatcataataaagcattctataacaataggattcgagatctccatattccataatgattcactcttaagacttacaaagtgatgagatagtggtgacattagatgagattgggggtgaagtttggattacatgataagttacaattagaactgtaggatatctggtccccataatttaatcttgcctcttaaggcttatttttttccaatcttgcagctactttctaggtaaaaggggtggagagctcttttttccttcattttgagtttaagtttaccagtgaggaagcttttaatggtttttcttgttccttctatgttaaatacacagtagaacttcattttcccttgtttctgctttttgtggtttgtaagaaaacatttatctaaaatgttgagtaagtaaaataaccgggtcataacgtagattaaaagtataggctgggcacagtcgctcacgcatgtaatcccagcactttgggaagccgaggcagacggatcacaaggtcaggagatcgagactagcctgaccaacacggtgaaaccccgtctctactaaaaatacaaaaattagccaggcgtggtggcacacgcctataatcccagttactcaggaggctgaggcaggagaatcgcttgaacccaggaggtggaggttgcagtgagccaagattgcgccactgcgctccatcctgggtggcagagggagactccatctcaaaaacaaacaaataaataaataaataaataaagacatataaagtgtttttttttaatttttttaaattttaattttaatttttattttttgagatggagtctcgctttgtcgccaggctggagtacagtggtgcgatcttggctcactgcaatcttggctcactgcaatctctacttcttctttcccctgctctcaccctacccttttctccaagatgaaagacagttggaagcttgagactggtaccagctggtataccagctatataggagactgatttcaaacttaatattgagccctgttttcaagatccactgttaaatattgtgtttttaagttaatttgcaattaatttatattctttcaatttgtaggagcagttaaataatcagaaagtggaagaagctatacaacagtatgagagagcatgcaaaggtcaggaacaagtttgtacttctggaaccagaaaagttctcttattcccctcgcagggcatgcgatgggggtatgacttgcttcattggtgccctgcagctcaaacccctagggggagcatgcagacgggcaggtcttgagtgtgggctctgaccctgtggcagcatctggggttgagtgtttacagctcctgaaggccccagtgggcgtgttctacagggtgttttttcagcctagccgtccacaggcggcttgtgttaatcagctcaattagaccctctgccttattgcaaggacagagggctttctgtatcccgggattcttgctctagtgtactggaaaaatcggatcacacatgggcgtgtagaaggttttattgagtggagttagctctctgcagatgtatggggagccagaaggggatggagcgggaaggtggtcttgccctgggcggccggactctcctctgactgcccgcaaccaaattccgtgtcatctcacagtagatggcctgccagcatctgctggtatctgctggtgtgttcttccagtgtgttcctctagatgttcagctgcttgtgtgtgtgcctgccagggtctcagggtttttgtaggcacaggatgggggcgtggcaggccagggtggtcttgaaaaatgcaacatttgggtgtgaaaacaggagtgcctgtcctcactctgtgggcacaggcccgagggtggagccttcaccagggaccctgcctttctgtacccagcacttccctgcctgcctcccatatcacttccagtactaaaattacaaaacaggtagttgcaataacaactggttaacatttcctttgaaaattctgaagggaagtgagggcaacataagatgcagcttatcaaaagtgaaaagtagtgattctaatgaataatttgttaacttaaagcttattcttagaaaaataaaataagtagtcaaagcaacattgatttcttgtaatggccagtattttgtgaaaaataaagccagtcaaacttttatgtaggtcacaatgaatggcatagatttctggacgaaattgtgtaaagaataaacttcaaataaaatatctttaaaattaaaatgtgtattctgaacggacacttctcaaaagaagacatttatgcagccaaaaaacacatgaaaaaatgctcatcatcactggccatcagagaaatgcaaagcaaaaccacaatgagatatcatctcacaccagttagaatggcaatcattaaaaagtcaggaaacaacaggtgctggagaggatgtggagaaatgggaaca

SEQ ID NO: 61955 - DNA, 1050 bp, Homo sapiens
tttttctagaaaaagtaactacttgatgttaaaaaaaatagttcaaattgggattgagcttttttagttttaggaggtaaaggttttagtttgattggagaatattaacactgaaaataagtattttgccaaataatggtttttccccctaaatcctaagatttatgttcatagtaatagttagttgtatcggaatagtttaattgtattagaaattgttaattttacctgaaaaaacttttttccattcatccactcttgcaatcatccaagcatccatctttacaccaaatatatatttagtatgtcatatataccagtactgttgtagacattgaggatattgcgatgaataagacaaagtttctgtctatatggaactaatattctattacagttaataaaaatgtattttaattttagaagaacttaagaaaaattggatatctagaggctattaatttctaaaatgttctcccccgatttttagatctaaatgttaaagagaaaataattgaagacatgcgaatgacactagaagaacaggaacaaactcaggtagaacaggatcaagtgcttgaggctaaattagaggaagttgaaaggctggccacaggtaaaacaagattgcttacatttctctaaatatactttttcatttaaaaaaaaatttcctagatttcttcccttgttaaagtagtacgtattttcagtgattgataatggaaaagtatttggtgttttttgaatgtcctattacttgtcattttccactgtgatgaaaattgtttcactaaaattatatgcagtaaaggagtaaggacactgcatgataacttacgaattatatattgcaagttatggatgataacttgcagtgttccctagatgttaagagtaagttttcaactgagtttcacctttgtcaggcttttagcattatcttgtatgttgatctcaataaatactttgatttcattgctttcagaataccatcagagtttttctagagtatatggaaaaatataacatttactaataaaaatgtta

SEQ ID NO: 61956 - DNA, 2821 bp, Homo sapiens
ctatactgtgaatactattcattggattcctgagaagtccctgtagttcctcttcactaagaatttagtaagaactcctaaaagttaaactatagaatagcctcagttccatcttggtctgtgttctttatctgggctctactgatttgtgtctgtagcccatgtcaagtgtatctctacatggtataacttttgcatatgctttaaaacataattttatgtcttcaaatcagaattggaaaaatggaaggaaaaatgcaatgatttggaaaccaaaaacaatcaaaggtcaaataaagaacatgagaacaacacagatgtgcttggaaagctcactaatcttcaagatgagttacaggtatgactttatgtatgtttttatgtatgaatgtatctgtcttcattatatttctaataagaggagaattcagtattttatatttagtaattcacttagatatgggtgaaataatacctggcaaatgttaatatgtaaatataacttttcagtgcacattgaaatgacatggggaagaaattccaagatatagcctattaagtgccagtgaaatatagtgattgggtccttagttttatgtttcacatatttaattcataaaccactgcttctaatgtccttgtgcccatttttctactccttaaacttcttactcatcaaatactgctgtggagaaaatgaccatcaggagaattattttgattactttaaatctcttcaaagtttaattattggaatagaattgtatatctgaacacatataaaactatactatatagaaggtattctattttgtgtgtgtgtgtttttttcttgttcagctttaacatacaacatatgggggaaactttttttttcgtaggatttaccaaatactatttcattttgtacattttattagaagtggcattcataacagaagctgtaggattgaaggaaacataatagttttgggagattgtctgcctctaaattttttaaaattctggctgtgtattaaacatatgctgaaaacaaatacaaaaactactttttttgttacatattatatattctagaatttacccttttcattgtgaaattccaaaagcagttagaacaaaataaatattatgaaaaaagtgtatcaaccgtattgagaatgtttgcattaaaaagtatttgtgtattttgcattgttctaagatgatgtaatcacattagtgtagattataaactttgtaatcctggaatggactgccatactttgtaatatagtgattttagaagttttcttttcgtttttttgagacggaatcttgctctgttgccaggctggagtgcagtgacgtgatctcggctcactgcagcctccaccccctgggttcaagcgattctcctgcctcagcctcccgagtagctgggactacaggtacacgccagctcgcccagctaatttttttgtattagtagagatggggtttcaccatgttggccagggtggtcttgatctcctgacctcgtgatccgcccaccttggcctcccaaactgctggaattacgggcgtgagccaccgcacccagcctagaagttttttaagtggtattattatttttatttcaaatgaagttctacttgggttttttatatatattattaaatgcctctgaacccaaagaatctgtggtaccagtttgaaaattactgatcagcagtattctctgtccagctcttctggatgttcttttaataaatatcctgttgcacaagttattttttatttggcatctcgtaggcccaggaatattttatttttagaaccatccagttagaaatgaccaccacaaacaaagtcttttttattctcttggcatttaggaagatttgagtcagtttaactgtttcagaaatttgaattatttattttttcttaaggtcactgataaaagtatttaaatggacttcatagcaaaattaacttataaatgaaatgcgtttaggaaagcaaaccagttattttattattttttaaataatctgaagctttgatcttgtcattgtttaaagtgaaacattaaagtttttatagaggtgaaaagtaatggattgtatgaaaatgttatagaaacatgtattgactactttgtaggcatgcgataataacttataccatttatatatacaggagtctgaacagaaatataatgctgatagaaagaaatggttagaagaaaaaatgatgcttatcactcaagcgaaagaagcagagaatatacgaaataaagagatgaaaaaatatgctgaggacagggagcgtttttttaagcaacagaatgaaatggttagtaacaattgtatctttgatgtatttcacctactttccttggtgtgttaaatgtattgctggaattaacagtttctacatggttttctgtttttggttttttaaaggcaggttgtcatctttataagataacttctgagccaatttatcttgacattcactaatgttcttgttttaacttgtttcagttgatttagcatgttgggagaataccttattgcttcttactgtctagatactgaagtaaaaaatctcttccttttgaccgttacagagtattccctattatattttaaaactttctgcattttgaactgtagattctaatactgtgtacattttatcacataaagtcacctaaatagtttgtaaaagactatatatatagtagaaatgaccttcagttttacatttactagctgtaggtcttgtaatgattgtcttagcctgttctttttttctaattggcacttagtct

SEQ ID NO: 61957 - DNA, 1055 bp, Homo sapiens
aaatcacaatttatgctatattttataccctttaaggatatcactgtgggccaggcgtggtgactcatgcctgtaatcccagcactttgggaggctggggctggcggatcacttgaggtcacgaattcaagaccaacctggtcaacatggtaaaacccgtctctactaaaaatacaaaaattagccaggagtggtggtgcacacctctaatctcagctactcaggaggctgaggcaggagaacaacttgaacccaggaagtggaggttgcaatgagatgagatggcaccactgcactccagcctgggtgatagagcgagactgtctcagaaaaataaagaatattactgtggtttaatggtcttcagataaaaagctatgtatattaaaagatatagcgtccttgcttcagttaaactataatacatcaaatgatggtggattttactggagagccatttcagtataccagtcctgttcatacttagtcactttccctgtattggaagagaaaagagggttatgtagaaatcagagaaactgaaatagctaacttgcttgtgtataatctttgtcatttaactaaaatcttgtctgtatggtcctagcaagttttaaaagagaaattcttttttcatcagccagtgttaaaatttgggcctctatgtagtggtaggctaaaagctattaacctcttcttactgcagtttcttgattgaagggttgccaaacctaccatgtcctagatgtggagatttggcaagtcagatgaggtttctgatcctgttttctcctttttggaacaatggattaatgtgttgaaaatgcttcgcttttgctctgcaagtggcagttacatttattaatataactattattactatttattaatagttactattaatatttattaatagtattatttatttatatatttttatttatttatttatttattattatactttaagttttagggtacatgtgcacaatgtgcagtttagttacatatgtatatatgtgccatgctggtgtgctgcacccatcaacttgtca

SEQ ID NO: 61958 - DNA, 1051 bp, Homo sapiens
ggtatcagtaatacttatttttaaagtaacttgttttaagcttaaaactaattacaaactctctagcaaaataatttttcttcaactttcttttacttctttgaagagtagtatattttcaagctgatgtaagagcagaaatagtattaactatactcctgaggctctctgtcaggtaataattttgctgagtgaatattattcagcatagtttttctgctacacatgtaacacctttagagattgttttatggagtcttactagttaacttttgttttatatttatttaattttttaaaataacattaaaacactgagtttcatcatctagttggctttttcttgatccattttttttcaacgaagaaggaaacaccgagtgtagttctcaagaaggttaaaatataaatattttattaattttactattggcatatatccctcatgtatatttcagaaaagatttacagattgttgtagatacatcatgtagaaactttaaattttctaactgattttactcaatcttcactgctataataaactaagtacatgggcccccatgaaaatcatttatgcaatcctattttctttttttcttccacatactcttttttttttttttaattactaagttctgtggtatgtgtgcagaatgtgcagttttgttacataggtatacacatgctatggtggtttgctgcacccatcagtctgtcacctacattaggtatttctcctaatgctatccctcccctagccccccaccccccgacaggctatattctaatccagtgaagactccaaagagctccttactgaccactatgtgtggaggtagcctcatggtctcttttcactggcatcctatgattaccatctgtcttttccctgtcatggtgtctgcttcttatgacccttataacttctgctttgtaatttggattctgaggttcagtcatgatcttttctctgcttctcttcttgccccctttttcctgaacttttatctttggtacaactaggatttgcagcagttcaagtcagtga

SEQ ID NO: 61959 - DNA, 1058 bp, Homo sapiens
cattcctgacctctacccactcgtggccaataatatccccttctccctggcaaagacaaccaaaaatatcttcaaacattgccattgtcctctgagttcaaaattgccctcggttaagagtcactgttttaagtgataatgtagctttttacaaattttcttttttgagtctagagaaataaaatattgtcaagaaattaactggtgctaaaattcattatttttaggacttggtgaaatgtgaaaataagaagaatgctacacccagaactaatttgaaatttcctatttcagatgatagaaattcttctgtcaaaaaggaacaaaaggtgtgtcttttaatttgtccaaaattgtagcaattatccagaaatccagttgtgttcaattataactcatttatcttctctttcctatacatctgattcagttgaaatgtaacctttagcatttggccagtagcatctactttatgtgtttacttctgactttaacactctgcctgtcaaactctttttgccattgtctgacccttttatccctgtccttacatacttaaagtttcctacctgagaattcataacctgtctctggcctctttaattcagctgtggccataactatttccttctaacacttctcatcaacaataacaaaaaatgttttgtttattaggttgccatacgtccatcatctaagaaaacatattctttacggagtcaggcatccataattggtgtaaacctggccactaagaaaaaagaaggaacactacagaaatttggagacttcttacaacattctccctcaattcttcaatcaaaaggtttgcagaaaattaattaaatgacctttttttgttagatgttgggtatattttaatacctaattgatatataaactcaacagctgttcagggaatattatacttcaaataggcattgtcctatactaggtactgtgggaagaaacatgtaaaaggatgatagatctaggtgttcgctatgtagtagaagagaaaggcttgtatttaagtaactgatccagagcaggctact

SEQ ID NO: 61960 - DNA, 1011 bp, Homo sapiens
tatgatagtattggagggaaaagagctactctgattagggggctttgggaaggtttttatgggagagatgggatttatcctgtgtattgaaatgtgggcaggagtacactctctagggtgtccaagggtgagaatacagtcatgggttcttagtttctgtttttggttggggcaggaaatccccttcctcatccctgttttctgcttatcactagagacagaaactaaaaaccatggcttcaggccgctaaaagcctaaaacaaaacaaaacaaaacaaaacagaacaaaaacaacaacaaaataaggtgggttggacaagtttgccagtattagtattatggtatatatcctcctagtgtttttttttctgtgcatatgtaaacattatctgtttatgtacaatatgtcaaaaacacattattttcataaatacctattgagtttagctgcagaaacagtatgcttagtgctttttttcttgataatataatgtggacatattgatacctgtgtatatgttaagatatatacacatgtgtgcacatatgcggaaggaatggttttaacacaggtggagtatcagaaaaatgtaggaaatgttcatgcaattacaggcagcaatacacatctggcatgtagaatgtggaaggactatcttaggggtgagatggagtagtgggtttttgtgaggttacctgaatgacagcaataggatgaattagagaccagagtgaggggtatagggaaggaaaggaactagaagcagggggcagttaaattgaatcaaatatgttgtgtgaaaatactttttgtcgaaggcttaccacagacgtttccaaactttgttggttcacagtgcccttaatgtctcagtaattaatttccattttgcctctgcacccaaagaaccactagtagtctcatgcattagaacttaagaccaaacaaccactgaaaattcagcttctgaaaatccagattgcaaagataatgtcataatgaaaagaaa

SEQ ID NO: 61961 - DNA, 1056 bp, Homo sapiens
gggtaaattagggcatggtgttgtaagtaccattctgtcagtcatttttgagcatctgtttgattagtacctgatttcttcccttggctgaaaattgttttcttagttactatataatgtgctttctactttctaagttatacatttgttgccacgaaagatcatttcttaaaaattatttgaggcacttgtctccaaatattttagtaattattttaagttatatctgccttgaattcaatatggagtctaggttattttacttctagaatttgatagtgttgaatcttttacaaagtctgttttttaaataaatttttatagaagatggcatatctgtagtctaagtaaaaaaaattctccaatgtatcatttcagttactaagcacatgaacatgtcttactcattataaacaagcttttatttttattttcacttacaagctttgaaaaactatgaaatttttaatttcagattttaatggaccagaaaatgaaggagagtgatcaccagattatcaaacgacgacttcgaacaaaaacagccaaataaatcacttatggaaatgtttaatataaattttatagtcatagtcattggaacttgcatcctgtattgtaaatataaatgtatatattatgcattaaatcactctgcatatagattgctgttttatacatagtataattttaattcaataaatgagtcaaaatttgtatatttttataaggcttttttataatagcttctttcaaactgtatttccctattatctcagacattggatcagtgaagatcctaggaaagaggctgttattctcatttattttgctatacaggatgtaataggtcaggtatttggtttacttatatttaacaatgtcttatgaattttttttactttatctgttatacaactgattttacatatctgtttggattatagctaggatttggagaataagtgtgtacagatcacaaaacatgtatatacattatttagaaaagatctcaagtctttaattagaatgtctcacttattttgtaaacatttt

SEQ ID NO: 61962 - DNA, 1041 bp, Homo sapiens
tttctgagtagatagttgataattgttaacttggtatccttattgggggtcgattggtggggctttctatttcgccgtcttgctccaccccctcttgtcttttattttttaataatacagttggctttctgatttttttttcaggacacagaagattagacatagaaaattaggaagaagagagagcatctagaagccaaaacagtgacagttagaaaagaaatagaatttagacctagggggacattagaaatacagtttcttcattttacagacgagaaaacccagagccgtaaactttacttaattctgcaaggtcatacaaacaagatgtattgagctgttggtttaaaaaaacaccaataagagacaaaaaacacaaggtaaataaagcagaaaccttaagaattgttgccaactggggcttttaaatttaagaacatacatttatacatctaaaaggttttattgaattttagcattgttgacttgattattaaaatgatgaccctgagtcagtaaggcaagttatcttcgattcttgtttaggagctctacacattatatttagggaaattttccattaaagtcattatatcaacacagccttttaaaagcattaaaatgttttcattatgctatctagaaaaacatagttggtcttcattattcatagattctatatttgtaaatttgctgacctgctaaaatctatttgtaacccctaaattaatgcagtgcttttgtagttgtggatatgtgcacagtggcaaaaatttgaggttcccaatatgcacattcccagctgagattgaataagataaacactctaccttcttgtttcagctattatactgtaaataagtgtccctttctagaatatgcgttaaaatcaagccttgatccacaagggagtcagaatttgcagagtgagtcctgccaaattaaaaggacttgtgaaacaccttgagctttttacagatctacactaacaaagcataaaactaagcctacttaagttgaaagcaaccagctagtagt

SEQ ID NO: 61963 - DNA, 1040 bp, Homo sapiens
atgtaggcaccactacctgtcagtgccaggtacccaaagagagtttaaaatcccatttcctggtctccagttggttttctcctgcagtgccagaacttctgctgcaggcgaaaggaccctccattgaaagagcagcgggagctgtcactaagaggctttcaatctagacaagtaagaagaaaaggagtggagcagcttcatgcatcaaacaatacctcccctcaggtggcatgatcttgggggaagcctctttggacagggagggagagaacaaatccacttcatgctccctggggccttattgttgagttccagcgattgttaacatcaattatgctgtaactacttaatagcacctttgaaaacagggattgctggctttggaaaaaccctggagctttctttatctcctgttggtggaaaagatcaacactaaaattaagattataagtccaggagcagtttcatggttatataactgcttccaggcatgagaggtagatgctgtacacattttaggtaaattgaaaagctgtgggatgttgcagctgaagagatcctcaagattgtgacccccagtctgcatcatggaggcaggtgttgtgaaatgaccaagctaatttcctcatgtacaactgttaggtcctttttgggaaatgtctgtcgtctctaaggattagaggctggtgaaggttatgggccttctgctcacaactttctactaggttatgatggaagtaagtttcaggccaaattttgccatatatagtgacatttagtagcaagcaggcccccagatgatcagctctgatctttgaggttctctgactatatttggtatgcaaggtccatgagaggaaaatgtggcaatgtgtagctaatgttatttttttaaaaattttttaatttgtaacttgcatagttattttttgaaaaataaaaattatatgtatttattatgtgtaatatgatgttttcaaacatgtatatattgtggaatggctaaatcagactaattaacatatgcattacatccacag

SEQ ID NO: 61964 - DNA, 1005 bp, Homo sapiens
ttctagcttccagaactaagagaaaataaatttttgttatttaagtcaccctgtctgtggtatttgtttcagaagcctgagctgactaaaacaacataaaactcacattcatgaaaattgtggactccattcctagctgttgatttttcacctacatagatcagtagtgggtcatcattaccctgggcggctgcatcttcaaatccaaaacatttgaaaagagaggcagcatgagttttcattatgaaaatagatagtattcaggcagcagcaacgcggaggaaacgggaatgaaccgagagcgtagtgaccatcatgagcctccttaacaagtccaagagtgagatgaccccagaggagctgcagaagcgagaggaggaggaatttaacacgggtccactttctgtgctcacacagtcagtcaagaacaacacgcaagtgctcatcaactgtcgccacaacacgaaactcctgggccacgtgaaggccttccacaggcactgcaacatggtgctggagaacgtgaaggagacgtggactgaggtacccaagagcggcaagggcaagaagtccaagccagtcaacaaagactgctatatctccaggatgttcctgcacggggacttggtcatcgtggtcctgcggaacccactcatcgccagcaagtaggggccacctatctgtcgacagaactcactccgctggcctatgaagaccgctgccattggtgttgagaataatagagctctgtgttttttttctagtggaaaaaaaaaaaaggaaagaaaatagatagtattttgagtagaaatgtggctttcgagacaggctatttctttacaacaattttaattctagttctgactccactatatacaaacgatgtgaccttagtaagttacttaatctgtttaattctcagataattattctgtgaaatgggaataattgagtatctaatacatagagtagtggtgagcattaagtaaattaattcacataaat

SEQ ID NO: 61965 - DNA, 1044 bp, Homo sapiens
gcatctggaagtgtctaatatgagatgtcccagataatgtcatttaaagtagaaattgaacttgttcccatttctaggtcctaggccaactgcttggcagtactttacctcttgggtattgctgctgtaggcttataatccctgtgttcttcctctgagcatcttaagatgagaagctgctgttccttctgtgtcatcagatcttcaggtgttactatccagaaattccatattttactgggaggaactcaaggacatttggtgatccttggaaactgatgagcaggcgaggagatatgtgagggagtaatggaaccaaggatcagcagaaggtataatggcaaaagttgcaaggagtagggaagggaagagaacagcattagacagtcactcatcaaacatgcagcgctagctgctgcgtctaattgtctaatggcatgggggtcaggggagcgttgaatcctctcattgcagccaggggaggaccaagtgccatggaaatcaaagaaggaaatcctttgactattccggtttacataatgtttaaaagcaggggctcttgggagtctggttaaaaccatttatttttgttttgattctattaactggctgtgtgatcttggacatatcactaaacctcagttccattcatgaaaagaggataattagatatacctcatttgggagaattaaatgagatgatgtgggtaactcactgagcacagtggcaggtacagttattgagccaaaaccaaactactagaagcagatagggaaaaggaaaccctaatactccctctccaggttttcagagtacttccctgccataatttatgctaccacgacttaagctttctgcactaagaatagagttcattaaagcaaattctcttgtgaggagtggatagagaagagtgttgggaaccagccagttgacagtgttatgagaaagcaggaagtgtgggcttgcttcagccaagcaactggctgaggatttgttttgtacgtctgattattcattttctgtgatacggaaattgccta

SEQ ID NO: 61966 - DNA, 1972 bp, Homo sapiens
ctatatatttttttaattgtggtaaaatatacacaacataaaatttatcattttaactattttaagggcacaattcgatggcattaaatacattcacaaaattctgaaactatcacccatgtcaatttcccgaaagatttcatcatttcagagactctatccattaaacaataactctccactcccctctccccttagcccctgttatcctatagtctactttctgtctctacaaatttgcctattctagataccttatataagtggaatcacacaatatttgtccttttgtgtctggcttatttcacttagcataacattttcaaggttcatccacaatgtagcatgcatcagaatttcattccatttcatgactgaataatatgccattttatgtatatgctacattttgcttgtccatttatctcttgatagatatttgggtcatttacgtttggctattgtccataatgttgctatgcacattagtgtgcaagtgtctgtcaaagtccgtgctgtttattctttcagatatatacctaggaagggaattagttggtcatatggtaattctatgttaagctttttgagttaccaccaaactgtttttcacaaagcttgcaccattttacactcccattacaagggttccaatttctccatgtcctcactaattcttgttattttctgcttttttttaataatagccatcgtaatggtatgaagtggtatctcattgtagtagtgccataattttgatagagtaagagaagcaaggcatagaaaataatacgtatgcttagaaatatcatgattgactatatcccagaagatataatgtctgcttcccagtcctgaggtccaaatagagcaagttacttcaactcaactgactgttctcctctagtatgtgtgattgtgaagctcctattaaagaaatcacccaggagacactgtctacatatgcataagtcattcagaacacatggtgaaccatgggccatgttccttgcagactgatttgccttcagcaaattacaggtttggcacaattcagtaaggcccagcatgtaatagactccatttttggaaaagataagcattacaacccttaactaagcctttttatttaaaatacattctatttaaaatataggccaatttattatttattttttatcaattataagttcaagtttctcaagctaatattttatataaggagtaggtagagtttgcccattgctattatacatgacatatatttattttgtgcagaaatgagatgtattgagatatatttattttgtgcagaaatctatcgggaataatatataatattgttatttttattgatcttccattagcttttggtttgtgcacaaaaagttggttaaataaattcaaaatacctttgtctccttcttgcccaacactcagctactgatgtttgtatagcatctgaaacataatattccatgagtcacagagagtaggtgccccttaatcaaataggcaagcttttccagtgagataaagcatgactatgtcctaactttccttcattttaattagtttcttatcatctgataacacattgagatgtattatgtttttaacattattatctaggagagatcttactaggcaacttgacatgttatctaattattacagaagagaaagactacggattgagtataccaaaatgaaaaataactttgtagaaagcaactaatttgtacttaattcttattcagtaatttcacaccttgatcagtggtcttggcacatgtttttcatgaaggtaatgggaaataatgtacctcaaaattagtcattctctgaatgatattttaaatggtggagaagtcatgtggattcacttggctgtgaaatattccatgttaaagcaattttggccaggctacttagatctttctggaatattgattgccttttattttgttgg

SEQ ID NO: 61967 - DNA, 1035 bp, Homo sapiens
aatgatgctatctctgctcactgcaacctccgcctcctgggttcaagtgattctcctgcctcagccttccaagtagctggaattacaggtgcccgccaccacacccaggtaattttttgtatttttagtagagacggggtttcgccattttggccaggctggtctcaaactcctgacctcaggtgatccacctgccttggcctcccaaaatgctaggattacaggtgtgagccactgcacctggcccgggcttcttaatagcactactcggtgcctaaagataatggaacaatagttaccagtaactcagtaacttggtaatttaaatggtaagttacaacatagacattctaaactttgtaatctctgtaagccaatcttgaaaaactgacttgatgacaaaatacaaacataaagagatgaatgatgatgtcatgatgtgtggagtactggtggaatgtttgataacagagaccaaacaaaaatggggaattatgtctgtaggacagatcataatgctgtaagacttggcaaaatgaaataatcatataactaataaaaagtgtgaattgagggaggaatggtggaaggaagtataagtgttaatttccatgtctttcaaaggattgcattaataaatattaactaaacataaaataggttaattgaaaaggaatcctaagcacagtttacagaacaaccctatgtgttttgttttgaaaactgtattagtctatttttacactgctataaagatactacctgagactgggtaatttataagcaaaagaggttgaattgattcatagttccacatggctcaggaggcctcagaaaacttataatcatggcagaaggcaaagggaagcaaccaccttcctcacaagaaggcaggagaaatagagagagcacaggggaaactgccacgtttaaaaccatcagatctcataagaactctctcactatcacaagaatagcatgggcgaaactgcccccatgatcaaatcacctcccagcaggtctctccctctatac

SEQ ID NO: 61968 - DNA, 1035 bp, Homo sapiens
agactgacactagagttcacattcataaccactcctcaaatgtcctcctactcttgacatctagactcaggatggacctgtgttacaggaaggagaggttgttatatttaacaaaagtgttcaatttttctttttcagttggctattcagttgttgctatcaatcatatcgttgactttaaggaaaagaaacaggtaaaataatatttctaaagttaataagttcataaataagtatttgtaattctgtttgtattggtaatttggaagctacagattagaatatttcttaaatgcacccctttgtgcactactacttttctattttatatagaaacagtcgagctgatgcatatttatacaatgatgatttttgtgaggtaatatgacatagtgttcaggattcttaaaggtgatttgaaattaagttacttttcactgttcaaaaagtgcattgttattggctggactgtaatcaaaatatttagtcctttttattctattgtcatgggcttattaactactttctctcttaaacattactaataagtatgtatatttctctttaggccaacaactgtatcctgtagattatttcagtctaaaaattagttttcattcttcctattcactgatgtttacagttgcttctctatttagctttctttttaaaaataatttttaaaagtttttttgaataccagaaatcaccttgctttctttttaaaaaaaatgcatattttttctgagaacacctcgtaatttttccattatgccttgtgctattaatggatacaatctgcagtaactatttatcgtttgttgtaggaaattgaaaaaccagtagctgtttctgaactcttcacaactttgccaattgtacaggtaggtgttttgttgtttacgaagcataatatctatttattcagttaaaaggtacctaattattgtgctattctctagcttgagctgcaccttactctgagtaccagtcttaacgttttcctcaaggctcagctcttcaggaaacattctt

SEQ ID NO: 61969 - DNA, 1063 bp, Homo sapiens
ctttgggaggccgaggcaggcagatcacgagaggccatcctggctaacacggtgaaaccccgactccactaaaaattcaaaaaattagccaggcatggtggcgggcacctgtagtcccagctactcaggaggctgaggcaggagaatggtgtgaacccgggagacggagcttgcagtgagccaagattgcaccacagcactgcaacctggatgacagagcaagactccgtctcaaagaaaaaagtaaatggaggctggatccagtgccttgtgcctgtaattccaggactttgggaggccgaggcaggatgaccacttgaggccaggagttcaagaccagcctgggcaacatagtgagaccctgtctctatttttaaaaaataaaagtaaatggaaataaaagttttattttcttcctgctcctgaaattcatgcctttcctttgcagaggactgttgtagtgtcttgaggaagggagtgtcctggtgttacttgcagtatggtctggctccactggctttagaattacctgggatatttattaaaatgcagatcattaggccatacttaatgaatcaatggaggtagggcctggttgtctccatttttgatacattctttaggggagttttgtacacattaaagttgagtgccactgttgatgggcatctctctttttccttggtaagcctgattgtctcttcacaatttatcaaactgatacctttgaaagggattcagggaggaatatgaacccctacagtcctattccttttgtgccatagaggcaaagatgtgtatatatgtgtgcatttttatgggaatacgttttctttaaattgtcataggagtctctggccaaaaaaaaaaaaaaaaattggtatggacaactgatgtgaattattatgtaacctactagttttcagagaaaaccattataagattcttaaccccaaggctctattgggcataatttaatcttctaaaatgatatagaaagcgtttcattgtagtgtgaacattaacttttattttgtggttatctaaaagtattgattgaaca

SEQ ID NO: 61970 - DNA, 1059 bp, Homo sapiens
tgaagtaaaattgagggatgtttaattgtgtctagtctttcatgattggtattgcaatgactgtcattgtactaatgtcccctgagcctttgtagggtatatagctacgtaatatatttttagagtctctgcacttatagagacttctctataggagactccacttatacctactacatacctataagtagaattgttggtgtgtgcatttaaaattttggtagccattgctaaaatgcttttcaagaccttatactgatttaaagaccttttgagtgcctgttcattcattctcatgtcagcaaggtagtaccaaacttttttatctttgccagtatgatcgataaaaaatggtgaacagagctgaatttgtttcagctatcattcagagcttttcttcatccactcttattaaattttcagtgactcttttatgagttggacagctgtggcagttgggatggggcagattctttatgagccaagtatttctgccaaaacaacattgcttcccaggcttactaagttactatgactgtcttaaagctagccagcctctgatctctacttcctaaagccctggggttggagtaggagtgactgaagtggggattctgaagaaaaagggcaagatacggtattcctgtcattgccgaaggttggcaccaatcctataggtcattttctccactcttccttactctgccctttcccctggtacatgccactgatgttgtttgtcagcgtagccatcctggaagtttgaatttgtctgtcaagcctgtacacactagcattgtcagtaagctttgtttttaatgtaatacataacagccaaatatttttatcactataaatcaaataatggcaaaatcagagccaggtatgtttcttccagcagtgtcttctggcttgccctctacactagtaaccttttcccagctttatttttcttccctgattttccatttatcctgattttcttatctgtttattttatcttgtatgtggttttcataaacagtttcaaatctctttgagaagaaaatgcagagtatt

SEQ ID NO: 61971 - DNA, 1044 bp, Homo sapiens
tataaaggatatttcttaagaggatagctaataatcatgggtacttataacctgaacatcaattattaagggaacagagcagtcaaaaaagaagaggaagggaaaaaataaaaagcagaggatccttgaggcaccaggaagctaaagagagtcaagagggaacagggcatggcatcacatagacgtggtctatgcaaaattaaaatctgtgttgaagcatgcttattcacaaagagcccagagttacttttatatgaacctaataggatggccatgtgttcagaaaacttttttgtttctccctctgctatagaatttttctcattccccttctacatagttttctcttgttttcccatacccttcatcttctatctgtccattccttcttctgtcttaatttcctcccatttccatcataaggtaatattatttcacaccagtaactattttagtagcaaaaggtcagcacagctgttaactatttgctttgccagtcagatcctaggaggagttcagatgctattttagagtagtggcttccaaaaccctagtctcctgttctcaaaaactggtatccaaggagaaaaaaaagagtttagcaaatacagtcaaaattacatatccaatcctgtcagaatcagaagattaattttttttaagtttttcaaaggataattcccttgctcttttgcctctgtagaatcataactttctcaattttaattctctttggtgctaaggaattggcttgagaattagagggagacagtaagaggagaaaatggaaaattagtatgtgaaaattcagtgtggcaaaaattattagtagtagtagtagtagtagtagagacagggtgtcactctattgcccaagctagagtgcagtggcatgatcatagctcactgcagcctcaacttcctgggatcaagtgatcctcctacctcagcctcctgagcaattgggactacaggtgcatgccaccacacctggctaatttttttatgttttgtaaagttgaggtctcaccatgtttcccaggc

SEQ ID NO: 61972 - DNA, 1036 bp, Homo sapiens
aatcctgggcttgcagctacgtaactccagtctctgcctttgtcttcagtgtgttctccctgtttgtctctatgtcttcacatggccatcgtctcataagacaccagtcatattggattaggggcctaccctattccaatctgacttcatcttaactaattacatctacagtgaccctatttccaaatataagattacattctgaggtactgaggtttagggcttcattgtatcttttgtggatgaggacgcaattcaacccattatgcctagcaatcccactttagtgttattctacagatacactgaaaccacccaaaggctctcagtagaggtttggttaaatacatgctatacctctacaatatgatactctacaactgtaaaacagaggaagttatgagctgacttggaagagctttcatgtcaggacaacaatgcagcagactaccttttggataggaaagaaaaatagtatctcttcgtatttgcttatagttgtatgaagaaactctggaagaagacacaagaaattaataaaagtgattattggaggaagggatagggcagataggattggagatgcaagtagtactttttattgttttcttatgttgctttgtgagtcatgtggacaaattacctgtcttaaacactgaaagggtttcattcatttgaattgaataaagaactaatttttatgaaattaacagggaatcagtatattgtcccagtaatcagctccttactttcttctcgtctttctctaaggctttgcttaatacttggaattttagtaccaatgtatcttgattcaactgtcacacacctgtccttagtagcatctttatgaccattatttttcattagtaaagaaatgtgatcatccacccatgccagaacctttggtcagacatgagaacaaaagctaatcaggcaggcactgttaggaagaggctgttaggaacaatcatttgatgagctttaggcaatttgcatcaaaatggtcttacagcaagatcccaggtaatgagtc

SEQ ID NO: 61973 - DNA, 1029 bp, Homo sapiens
ctagcagccatagcagttcattatggcttatcatttgctattgctgtaagccaaagtaatatgttaaaccacctcattttaaattatgtcttaacttcaagcacagtggtttccctgtttgttttacagaaactagaaaaactgcttttggaattatctctacagtgaagaaacctcggccatcagaaggagatgaagattgtcttccagcttccaagaaagccaagtgtgagggctgaaaagaatgccccagtctctgtcagcactcccttcttcccttttatagttcatcagccacaacaaaaataaaacctttgtgtgatttactgttttcatttggagctagaaatcaatagtctataaaaacagttttacttgcaatccattaaaacaacaaacgaaacctagtgaagcatctttttaaaaggctgccagcttaatgaatttagatgtactttaagagagaaagactggttatttctcctttgtgtaagtgataaacaacagcaaatatacttgaataaaatgtttcaggtatttttgtttcattttgtttttgagatagggtctttgttgctcaggctggagtacagtggcataatcacagctcactgcaacctcaatcctgggctcaagtgatcctcccgcttcagcctctcaagcagcgggaactacaggtgtgcactaccacacctggctattttttttttttttttttttttcccttgtagagacatggtctcactatgttgctgaggctggtctcaaactcctaggatcaagccatcctcccgctttggcctcctaaagtgctgggattacatgagccaccacatgcagccagatgtttgaatattttaagagcttctttcgaaagtttcttgttcatactcaaatagtagttattttgaagatattcaaacttatattgaagaagtgactttagttcctcttgttttaagcttctttcatgtattcaaatcagcatttttttctaagaaattgctatagaatttgtggaaggagaga

SEQ ID NO: 61974 - DNA, 1054 bp, Homo sapiens
gcatccatagagatccccattcccagggtggtgtacctatattgccagtgcttcagatgttgggtactaatgacttatcttcacccttttccagaggattgtcctgggctgatgagagtcactttacctgaagatacctgggaagttttgtctcctctgaggttggcccatggccagtgactgatgcaggacattacagcctggcccactggcctcggtggtacaatttatgctcctgagcaccccatgggattacgctgtgtgtggatttctcctgaaaccacatatttgcctcttctgccctgttctgttttttctcattcccttatagaggactctcagtaagtcacttacacaagaatcctaatttgaaatgctgcttccaggagacctgacttagaaaattggacaaataaagttgatttttttaaatgtccagtaacatgaagatgctgaactttcctagtcatttagggggaaatcaccacaaatatatctggctgatcaggttgaaagttaaaagaaaaaaagatttataaagtgggtattttcaagatggtgtggagggagatacaatttgatgcaagtcttatacttttgatgtcaatttattcttcagaaataactggttaattataaagggtggatggataaggatattcactgcaacaatgtcttaaatgtgaaaatggaaacaacctaaatacccaataataacaggattaaataattcattgtacattaaaagaatactgtctataaagatgtctagaataagttgttcagttgaagttgtaaagctaaatacacaatacccataatgtgcacagaaataatcagaatgtcatgaaaccaggattattggtgatgtgttgcttcctttgttactcatttctgtattggcataatgagtattgggtgttcaagaggagggggaaggaagtatgacagatgttatggggaaaaagcaaagtacaacaggaagacaccttgggggaactaatagaatctaaggactcaaggatggcttcctggaggaaatacagctagaaca

SEQ ID NO: 61975 - DNA, 1134 bp, Homo sapiens
ttcttttaaaacattattagatttattaagagcctcctaataagacacacatatgcacacacacacacacacacatgtaatttagctaacacatttggtaagaaccttcgactccagttagaattgtcaatctagatggggacaactcattattttcacggatgccctagcaaccaggttctaattccccagaccacattctccttcacattgtcgggtcttccctcccggtatagcttgaatccacagccatccactgggcaagccgtggaggaaacctggatgttttaaaattgttgctgaataaaggagcaaaaattagcgcccgagataaggtattccttcttctccttctcccttcattcaccccctccccctccctgtcccccatccttctccacttctcccactcttccccctccccctcctccttctcccccacccgcccttccctcctcccccacccctccatctcctaacctcgcctctccattaaagtcatctggaggcccatgctgtgtgcaggcaccctagtgaccacttctccccctcgcacatgtcttggggtctgggacagcctctgtcctcattcctagcgaatcagcagcgttttccaattttccagttgctcagcacagcgctgcatgtggcggtgaggactggccactatgagtgcgcggagcatcttatcgcctgtgaggcagacctcaacgccaaagacagagtgagtagctggacacgctcgggtttcccaaagcttcattgcttttgtatttggaatcactcccccaagcctgggtgcccttgcaggacccacttcctggcctcagacccaccttgaacctgttgactctgcttctctaggaaggagataccccgttgcatgatgcggtgagactgaaccgctataagatgatccgactcctgattatgtatggcgcggatctcaacatcaagaactgtgtaagtactggaaacaagaaacaccgcttgcaagctttccaatttccaggagcatttcttaaataggtgaaacgactcccacaatggcagtatttgaggggtcttcgatggtctaaatgcccctgcccatttccccaaggacagtgtttatcttggctaggacccagttca

SEQ ID NO: 61976 - DNA, 1059 bp, Homo sapiens
ctggattgttcttgtctgacaagaatttttctactactggcagtttattctccagagcagccttcagaaacgtaggcacatccacaggttccgtctaaagccaaaataaataaatatatatatatatatatatatatagcatgagagttaccgtgagcttgccagcattcaatcaaaccctccacagatatttgctcccctgtagcacaacactggacatgtattactggaaaccaaaaaaaaagcccttacaatgatttcaggttctggttcctttacaactggaactttagttttcctgtattttttccttttcttcagttgaatgattatttcaaggtcttctaaattttcaagctttgatctttgttctagttttttctttttgagctaaaaaagaaattcgtatttcaaaaatatggtgagttctactgacaagcattctggttgtgtctaaactaaatctgcaaggtctgagataaacatgtgaacagtttgagcaaaaacattttttaaaaattatataaatctttgacttcattttagggatttcttattcagatatttatctgggagtctaattttcagctaattgccatcatctttacttctgttgcttgtagaatcagcccttgaccaattgaggacacgatctggtctctaagtgatgactttgtaattaatgccataagcaagtcttagatttttaaaggatttttaaaattatgctcaaaacttggtttaatttttgagcatgataaaaagaatctaacaataaatgttaagctctgaaatatcaatgtcattctctttcactaagcagagccttctaaaacagactgtccagggaccacagctaactaaagcaaattttatctgtgttagtaattaaggaaaattcacccagaaacacagattgtgtcaacacagatagcagacagttaaacaatgatctatggaccacagaccatgttattgagaaaaagagatctccgttgcttgggattaactacatggtgtgtaacatcaggaattcactggacatgtgtatctttcaat

SEQ ID NO: 61977 - DNA, 1050 bp, Homo sapiens
taatatgagcaaagtgcattgcctgtgcccgaaacatagttagcctcagcatatgctattattattctaattcccctgataagtattaatggtattactcccttagacttttcagttactgtggaaatgaatagctgaggtgctgacgaggtgctgatgaggcctagatacatactccactggacccaaaacaattgaaggatcttttaatacttctcagtccttactcttataattgtttgcaaagcattgtttagaaacaattccaatatacaatttctctgtattactttgtataaacaaagtcataatactaaattcctccttattattaaactgttcacatattgtgctttgtggaatcacaggatccatgccttatttatcagtgagccctttcacagcacttagcagggtacctggtatgaagtggatattcagtaaatatttgattgactatgttctttatagaaaaggtttgcactctactttgttttcttgctttcttgttgcaaatctgtaatacttacctattcttgattgccatggactaagaactgtggacaaagcaaagcaacacctgcccccatcaacaggaatgtacgctatttatatcaatacaaagtgcacacatatagggatatattcagttaataaaagtgattaatggcaacaattcctggacaatgccctagaataaagaatatagctttatcaaaatgataagaatgaattcaggatcctcagacctgttgcatctctctgtgcctttgtgagaaactaagcagcccacaaagggcactttgggagttgacctaagatgtatgcatgactaattgttcaacatctgcctgcctccagacagatcttcccatactgttcttatagtggagtcaggaagaaggaaacctaaagaaatcccagaccctttgtaccagctgcatggctgtggctagacatgagtgacagtacatgctgaatgatacgtaggggatgaaagacagggaggaccatagatggagccaggtgtctgactgaaccatgggatgg

SEQ ID NO: 61978 - DNA, 1050 bp, Homo sapiens
ccgctttgtttacctactcaagcctcagcaatggtgggcgcccgtcccccagcctcactgctgccttgcagttcaatctcagactgctgtgctagcaatgagcgaggctccataggcgtaggaccctccaagccaggtgcaggatataatctcctggtgcgccatttgctaagaccgtcggaaaagtgcagtattagggtgggagtgacccaattttccaggtgccgtctgtcacccctttccttggctagggaagggaattccctgaccccttgtgcttcctgggtgaggcgatgcctctccctgcttcagctcacacttggtgcacggtgcactgcacccactgacctgcacccactgtccaacaatccccagtgagatgaacccggtacctcagttggaaatgcagaaatcatccatattctgcgtcgctcacactgggagctgtagactggagctgttcctattcagtcatcttggaactgtccctggaagtattttaataacgattggtatagctgtaccaaaagacacagacaaaatgttgaccctggccataactgactgcaatgtaggctgggaaaaaacattggcataactgtacagtattatgagatggaaaaaaataagttagtgtacaataggacagccataattatatcaataatgtctaaaattaataaatcaagacggcagtttaaacatttaagaatatgcaattaaatgtcagaagaaattgctaaaattttaagtagtttgcctttgggagtgactggagaggtgaggcagggtattgctgtttctctttcttttcttttcttttcttttttttttttgagatagggtcttgctctgttgcccaggctggagtgcagtggtgtgattatagctcacagcagccttgacttcccaggctcaagcaatacccccatcacagcctccaaagtagctggaaccacaagtgcaattcaccacacccggctaatttttaaaatttttgtagagacagggtttcaccatgttgtccaggctggtctcaaacccctgggc

SEQ ID NO: 61979 - DNA, 1058 bp, Homo sapiens
agacgttccaaggaaatagaaacaagattttctttgtctggattcattttgccatttaggaaagagttctcctggttctcaagatgtttcattcattcaataaatattgattatctactaagtgccagacattggggaagtgaatccacatcagtgaacaaaacagacaaaaaatacgtgccctcacagagcttacattctaatgggtagagataaatatataacatttttacttttcaggcaatgagaaatactgtggagaaaagtaaacccagagaaggggaagagaagtgtcagatcacgtcattttatgtaattatgtttccttggatttccgtctctctaaattgaacccacagtccttacagtggcccagaagagcctgcgagacccatcctgtctccctgacctcagtcccatctgctcattctcaaccacactggcccccttgctgggggaaccttggacatcagcatcgttcctgcttaggacactttcctttctctctgtgtagtcactcatccttttgataactataagaccaacttccttacctgttttgtggtctttacccagatgccatcttctcactaatgcctttgctgacaccttgttttaaatttcagtcaccctccttacctacccctagtacccctactctcctggaggtcaccccaaaccactatttcagcatgaccattggcaaagcagcatcactggctttctctctagaaggcagacctgcctacgggctgcagagttcaagcttgtctctgtccttcgatcttcttgggagttttctgtaaaggccctgattagtggcagcaccatgggaatctccctggcctattcagtagcattgaatcaatcctgagtttaattagcagcaattgccaggatgacgttttggccttgtcataccacggggcagtacctcttaaggattggatgtagttttgtgcaatgaagagcccttcttcagatgggttatttctaccccatggtctttggctgagtgtgtttcgtattagtcttcttccttttcttgccaggccatt

SEQ ID NO: 61980 - DNA, 1026 bp, Homo sapiens
tctagaatagcaccctttggtagagataaaatgtgagccatgtgtataatttaaaattttctagtagccacactaaaaaagaaacaagtaaaattaattttaataatacatttaacccaatatctctaaaatattttcatttcaaaatgtaattaatataaaattattgagattacctgttcaggttatgtctgaagtctagtgtgtattttatacttacattacatctgaacttaaactagccacatttcaaatgcttagtagccacatgtggctagtgacttctctattggcagtccagatctagaatatagattagtattccccatcactgttcttgggtactggtgctgctttgactttaagcaattagcataactttactctttaatgtatgcacctttggatgcttgagccctacaactctttcatgagcagcctagcttagtatagcttctgggaagatagggtcctacccttagccttttggctgatccaggtgaggacttgttctgggcatgtcacatacctctctatttggtcaagcctggtagacaaccaaggattgccaacccgttgagtacaataaaccttttgaactacaaagatcagagctccatgtcaggatcaggcttttaaaatccctccactctcatttctttctttctttctttcttttttttttttttttttttttttttttttgcctctttcccaaatttcagagacttatctatcatccctgggaaaagagcaaataccagcaatgttctgaaggaattcagcttctctgtcttctacttcaacttggcataataaggcagtcctctcttcccaaagattattttgacttgagaagacatttagaaacccttttggggacaagaaatttgggaagaaggcaaagtattcaattgtacataatagctctaggccaagcttttatatctaagctttttctttttttaaggttttctgatactgtcttttacccacattttgtgagaattgtcatgaaggcagtgt

SEQ ID NO: 61981 - DNA, 1033 bp, Homo sapiens
tgaatagtaatttgaaattttgagaacttaattttatcatttgaaaagtatttggttttaatttgaatatatacttatttataaacgagtataatttatatatacacctataaataatttggaagtatttttatatattctgtccactttctaacatagtctaattactaattgtaatcatttttttggctaaatacagctagtcctgaatctttcatttggatgtcccaatgagcctagaaatcttaagctatgttaataagtttccaattttttttttttttttttacaaaatatttccattgctgagttggttggaacattttaaagatactaagttcttcttcaaaaactgttaggaaattttttaaagttgatttttgttttgattatcaatgtatgattgcttaactttaaaatcaactttgatttatagctaacttagttttgtttaaattatacagatgatacttcaaaagctgacaaaccgaaagtagatgaagaaggtgatgaaaatgaagatgataaagattatcacagaagtgacccacaaattgctatctgtctagattgtttacgaaataatgggcaatcaggggacaatgtagtaaaggtgagtgaacaagtactatggtatttttatgatcagtttatagtaaacccttgataatttgttgacaaattttctaatgcttcaaaatgtttgctttcaaagttttaattaacataattaaataaaatgccattctttgacaatcctatgcttagaaatggttactattcccacaactgaactgtcttgggccaatgccaccatctagtggctaatgcccagaatcacacctctgtttctccttttatacctttgctggaaattcatatgcatggtttctgttttttagagtggtgaccaacttagacttagagaatttcatgtcactggtagttctagcccttttattcattctcttctaattttatcctttatttctctatttttatttgcaactcaacaagatttccatgtcagagc

SEQ ID NO: 61982 - DNA, 1071 bp, Homo sapiens
tagatgagattattaaagtcgtgtgtcacataacaatgttctagtcaatgacagatcacataatctgaaggcagtctaatgccttttctgtttagatatgtttagatgcatacttagtgttacagttgtctacagtattcagcatggtaacatgctctataggtgtgtgtatcatgtgagcaataggctatatcatataacctaggtgtgtagtaagctgtactatctagatttgtataagtacactctgtgatgtttgcacagctacaaagttgcctaatgaagcatttctcagaaaatatcctcattgttaagtgacacatgattgtgtttataaagcaacatctgtagctgaaaagctgtttgtaagccagccagccctttctcctctactcctgtcctgtggatttggtactttccttaacagccttctatatcaagcctcaggccctgtatgtattgcctttgcctttataaacctccaccgtccccctcacctccgagttattatccttcccaccaccccaccactccccagaattaagggatgtcatgcactctctgaactctttggggctggtatatgtctcagttcatattaatttcttttgaaagggaaaagaaagagccttcaaaaggtgtacagatactattgccagagtagcaacttcttttggcatagtgtttggaaattaactatttttagttaaagttgaagaagagtagagaaagatcaacagaagatgaatgaggaagtaggtggagatgagaaagctctgagaagctttgatttccctattttttctcctttttttatagttttgtagttaactctgagtgaagaatcccttcttgagtggtaaaatgttatactggtgagctatatgaataactacttactcttaagttgatatttgtaacttggaggatatctgtgtgacattctagtgagccatcaaaaaacattttttgaaataatgaaatgaatgtgccctttttttttgctttagagactgcatttattcatttacttttttctttttttttattacactttaagttttagggtac

SEQ ID NO: 61983 - DNA, 1037 bp, Homo sapiens
gaaatttaagattcagtctgttcctcaatagaggttgaaagtaggaactcatgtattcaaataaaatttaaaataaggttgaaaatatttaactatatgttaatagcagaacaggtactctaagtgtttgtctgtttaaatatcttgagattattttatattataatcttacatataatctatgtgattatatcatcaaaaagaccattgaagcccacattaggtacttgtgaaataagatttttggttagttattgtaattactacgtttttctgctgtttgcaacgtttattgaattcgagtttaataaatgtatggtcagcctctgcctagagagtcaggtctattatttattaggttgaaataaatacatatctattatttaaaggttgaaatattttgagtatttctttccctcaaagaattcttagtgtttttccctgtgttctctatttgtacttatcttcaatctggaacagctggttgagtatcccactactattcctcaacacccccagcccactgtttgtaggctggccacattccaggccatcatctttagtgttctcctgtaggactcatagataacgtatacaaaactcagtaatagctgtggtccaaatttcagaaggtttgtaaagtaatgttctttaacgtttaatttagtctggagtttggtgtcgtattaaatacccagtaacttcttgatttgattctctaatattaatcattttgccattgcacaaaatgatgcccgttttttttctcatgaaagtcttaggttgtaagatttctcttgtatgagctgatgtggggcaaccagtgttttgaggattgacttttattattctatcaatgtgtgaaaatgtctgattaatttcatgtcatctcaagtataacgtgtcaagagcacaattattttacaaacaagagacttattagaccaaggaatttttttctatgttgtttaagcttttatgattacaaaaaaaaaaaaaaagaaaatcaggctgggtgcagtggctcacatttgtaa

SEQ ID NO: 61984 - DNA, 1079 bp, Homo sapiens
cacccttacacatagttatattctgatctttacatttttgaatatactgccaacccctaccacagcccttattcttcttacattggcttctagtgttttacttaatgtttctaagcaaccagctaaaattggcaacagtatattaaaagaaagggaaaacgattactgcttatcagttcagcacagtgttcataagttcgctgaatgaaccctaaatgatagattttcactgataaatatattttggcttttttcactgtattatgatattctgtattgcagaaaaagttgcatatgatagaacaaagatttgcctctatttataatgtcagtttgaggtctaattaatccctcatcaccatggttattgattttctctttttgaattatattttaagaatcatctgtgagaacaggcagaaagcctgtctctggaaacaatgccttgatattcagggacttgagaacagctgcagtctgttatttttcttttcttaatagctgaatgtcgcatcctgtagtttggttttcattcactaatctgagcaaaggattctgcctttctttctaattcaagttccattaacatagtgtgttaacattctgcatgactcttcagtttaagttaccttttcaactaaaaataaatcccatctgggcttctggtttctaaacttaccctataatcctcttggccttggcattactatttctcttatgtaagaatctctccactctcaggctctgccaaaatccagttcttttactaattcaaatttcactcttccacctcaacatggtattaataaaatgagtggatataaaactgtgtatatatgctctgtgtgtgaataagttaatttatatttgaatgaatctgtttgtatttaattgtaggtgtttatagccaggttgggaaaaagtgtgtgggaagggataagaaagggtaagtaagcctggtaaagaggaagaaaaactctataggagccacaaaaaataatagtaataagactggtgttgaagagaggagatgactatcatttatttattttctgctgctgagatgcccttttctttcc

SEQ ID NO: 61985 - DNA, 1068 bp, Homo sapiens
ttttcatttattcttgggatgtttgatagtaaataagatttttagtatttggattattaaactagaatggtaatattatgttaataaacatgttacgcttggattcttgttcattactctgtcctgtcgggtcaaggaaagtgaaattgttttccagttatataaaaattctgttggtcatcaaccaccaccatatatgtttgtgcatgttgtatgctacacataccagggatactcttactgtaatcttatgtcattgatgctctctagagttcttaaatgtaaaatcagtactactataagtgtcagtcctgagtcatcaagtctgattttaactattgaaacagatctgtaaatataattaacatataaacgtcacctaatttggtaatcctaattaccttactgttttcttttgcctacagcctcaagacgttcagaagacagtattaaagggaatcattaacagcctgttacgagaatggaaagggtaaactaatattttcaatatttagctaatcagtatagatgtctaacttacacatcatatatctttaacacatgtgtatgtattttactctcagaaaagattttagttgagttataataacatagatgagaaaagaattataagccatttacaacaaagctgtataacttgagatttgtgacctctcagtaggatctatagatgggcataaaaagatctgtgaattcttttaaattgtatgtaaagttttttctatgcagatatatatgcttaacaaaaatggaatgggtacttacatcagtaacctaactgaaataatgagcattaaatttagccttgggcttcctggtagccagagtgaaatttttcttatttctattatagggacgcctaaggccagctactaaaatatttttttctctcagaactaaatattagattcttatataaggaatcatgggcaatttaattggtaatgttttgaaccatgaatatgcataatataaaaatgtacttttaaaaatacatatttaaatttatattaaaagtatattatttaaataataacttccattaaa

SEQ ID NO: 61986 - DNA, 1804 bp, Homo sapiens
ttttaatcaaggaacacccaggttttttgcttttaattggatgatagtgattggtaccatttatgaaggcactttttatgaaggtgctttatatacattttctttttcgatactcaaaacaacccttaagatagagaatatcattcccattttacagataaggacattgagaatcaaagtgtaaggaacatgcctaagggcatatagctagtaagtggtagaattagccctcagacccagatctgtcttaactccaaagcccatgctcttttcactgtatagccgcagtgtaaatgaaagtctctgttaattaaataacaaataggttattgttattttataatctcaaattttgtttcctgaatttaccacgtacttattaagcttagtgtctttccttttacgtgttaacagaattttaacacaattatctttaatatctttttcagaatcctcagtttaataacacatctacgtatgtcatctatgctcacttgctacgacagatagctaccttagtggaagctgaccatcatttcctagttcactggtttaaaaagtaaatcattctatgatattaagaacttttatagtctcacagttttaagtttggtattagtaattttacaataaaatatatttaaatattttcaggtctttagaaatgatgcttatattcacaatgcttcaaaagccagttacaaaaatctactttagtactacataaaggataattaaaaatctgtttttaatgtaagtaaccaatttgtttgcacaagctgttgagaatttctgtctactgccttcactttttatatagcacattcctattattggttttttacgtatctcaaagatggtgactggatttgctcagacactactattttaatgtgtgtctttttattttctatctgtaaattcataaatttcaccattatttaaatggcgctttctccttacctaaaaatgtcattgtaaaatataggctagccatcaatatcaatttgtaaaagcataatacttttttcacagaactatacccacatgaacaatgacttctccatgactgataaaagtagaaaggcaaaatatttccaaaagaaattttaaatgcagtaaattatcattattcatagtagttatattctataatgtcaccacaaacatggaattaataaatacagaaccattgcttcaaggggaaatacagggttaggttcctgtgagcctctgatcacatttttgtcagccaatcagtatataactttgctttatgagtgttttttttaaagacacacttcatttaatagaagtcattgattcattatcattgaactcacggctagcagcactgtaactcatgcctgaatgaagcttctctaacatacatattttctctgtagggcacatcacaaccttcttgttaggaacactagacagcattttagcactacacttggccattttgaaattgcaaaatcaccaacaaaaagcaccaaaatgtgaaaaacatgaagctaaatggattgcataaaggacacttgcaaagagagagtattgagctaaaacaaggcagaacatcactttgacctcagctggaaatgtgcatgtcaggagactaacatctttcacatgtccccaaatgaccatgaaaacacaagtattgatttggggattaacaattaaattttaccaagtaggcaaatttggaaatatagaatctgtgaataatgaagactgaatattgaaagtctttaaaatgtttgttactaactttatagtaattttggtgtttatttct

SEQ ID NO: 61987 - DNA, 1857 bp, Homo sapiens
ataatttatcctcaggtcatgagatgttcaggagattgcatttaattgtagaggaatctgagtaaagagatacagtgtggatataagtaacctcaaaaccccagattagtttgtaaattggttaaactttccagggaccctctttatcagaattggcctgaaacatagaatgggcttctggacacatctcatttcacatctgaacactcagaactgaataagaataagaatttaagttctgggcaccctagtcccagatggatattttcttggcaatgtttactttacaaagatactttttccttccattttaatataattgtaatgtgttgtagatacaaccacaaaacagcgccaagaattattatgcatatttcactgacaacaacatcttttaatatagagcttcctctaacaactgtgccacaacactggtgtaccaagaatgagttacattagggttttaatcctaggatcctgtcaacccttgggtagccagcctgaacctagaggggaacaggagccctatggcaagtgatctctggccatgagcagcttcatctgttcatttcagtgtatcattcacaaagtatcatttctcttgtgcataacaagggaaaggttgagaacccctgtcctaaagtacatagtaaaactaatatatatcttactgagttcattgcattttctttttatttccaattttttgttagcattaatgattcaaaataattatataccagtactgaagaactctcaacttttattaacaattttgtcccatggtaaaagccatctcactttcagtttacactaaggctatatccattttcctaataatgccttttttctcagtggtcacagttgtaccacctgactatgctcagagggattccagctgtaactgatagattcactgtagtcactttgaatggcaatctaactccagaagtgtcattgctgccatattcattctttctaaatgcatttatctctgtgtagtttgtggcttttgtgcatagcatagaatgttctagcccaggaggggttattttcataacctttttataatgtgtaattacaaatacataccatttcctattaccacaccattaaatataatactaaatgtaacatacatttctgatttatttttattggtcttaaatatattactttactttttacatactgtagttattgttagattttttcatttctggaactcacacatcagaagtcaccatataatgatggattcttatattaattttgagcacctgggttttctgtactacttaaccaacacttctccctcctggttctggtattggccatgttgttcacaggtgatgatatacaatgaaattatttgtatagacaatgtaagtggttagcacacattcagaacctttgatgtagcttctgcagagaataaaggcattgcacatctagtaatgatacattcttcacatggctgtgagaattaaaagaaattatacacatacaatcattttgtatatggtaaaacacaatccaaaagtaatgttttatattgctacaaggggtaccttagattcccttagtataattttgttaaaaatacaccattttgctttttctttttttcacttgttgagcaggttttccttctgtcagtacccattcgttatttctgtagctgcaaaaaaaatcattattcagagagactcagagcaacagatgataaacatcgcaagggtaagtcagctataaaaacatatttatgctgactataatcagtatagtaaataatttaataaataatttaaatgtcttgtgaattgttctagcataatcaggaatgttaaaagcaaa

SEQ ID NO: 61988 - DNA, 1063 bp, Homo sapiens
cctgttgtgatcttagataaacttttctagggaaatcattgaatactatcaactaaaccactcctttttacatgactttttgtaatcaaggaattatattatgtaaaataaaggggaaataaatgaaagaggggaaaggaaatatgtgatactaattagaaagtcagtgttaaatctgaaagaagtatgcaaaaaatagactgatgcataattcagaactcatttgttgtcatggattttatgttaatgcttaacatttagtatgcatagcttatgggactagctgtttataacagcatcaccttggatattcgtttccctccctgctgttacaagaaattattgagccctcccatcattcctagtgatcaaaatataccagtaggcatctgcaatgttaccgtggacgacttatgtcaaattatgcctgtaagtataaagttattaatatcttgtcctttaatgcgaaatcatcttttttctacctgcacagtctctcctcctaatgctattcttacttttaaatatggtttccttctacctttataactcatctccttttttcatctagctttttctttccttagagacacatgtcacccactttgcagtgctcctaagcttttacaagatagagaggcagtaattcgaatccaggctctgtcacttactagctctgtgaatttggacaagttatttaacccttcaatttagtttctttatgtgaacaatgggatagtttttattaataatttttaaatgatgacaattatatcaaatctgtgccagcctagatttgtatgaaaatttgtggttttaaaggaatagaacatttattatgtaaaatatagaaaatcattctaatcatgctattatttacctttttctaataatttaaaataaaactttaattttttcataaaaattaaattgaaaattttgaaatattggatcaatttttctatttttaaatctttatttatggataatttcaattataatataatgtaagaaaatctttcttttttttttttgagacagaatctcactctgtcacccaggc

SEQ ID NO: 61989 - DNA, 1039 bp, Homo sapiens
ggtctgaatattgggcctacatctttaccagctctctatccctgaacaggttacttgtatatttacatgtctatttttcctcaccagtaaaatgagaacaaccacttttaagttgctttgaggctgaaattaaaggaaacaatgcatgtaaatgcactcagcacagtgattatcatagaccaaacactgagtaaatgctgattctagtagttttaagtcttttaattcagggggctctcaaaatttagttttaaatcttacaaacttctttaaaaatgttttccttttctgtagtgtattcacatttttattcattgatttctctgacagctgttctgatgctgtgaagttcataaagactgaaggaaagagtcttaagatagctgtaagaatcctaaatgatgataacaacactatcagatagtaggtgggggagatgacaccaaaaggattcagaagataatttttacatgtgcatcaaggggcatctactgtccccaaaatgctcttttttaaattactttttaatactaaaaaccggaataatagtatcattcattatattatctactcctcggctgctagatgttttgtgtatatcactcttttaatctttttaaccatcagtcctcaacctttttggcaccagggatcggttttgtggaagacagtttttccacagaaccagggaggagtggggagagtgggaggtggtggtagttttggatgaaactgttccacctcgggtcatcaggcattagattctcataaggggcatgcaacctagattccttgcacgtgcagttcacaatagggtccttgttcctatgagaatctaatactgccgcttatgtgacaggaggcagagctcaggcagtaatgctcgcctgccactcacctcctgttgtgcagcccagttcctaacaggccaccaacaaccatacccatctctggccctggggttgggaactcctggttattaaacaacctgattaggttattaaacagcctaattggatggtttaccctatattgttga

SEQ ID NO: 61990 - DNA, 2122 bp, Homo sapiens
aactttaaaatattaagtttttaaaaaatcaaatatgaagtatgttcagcaaaggcataattttctaaaaacacacacagaaatcgcttgagtgaggaaaagtccacatggcagagacaggtatggtccagttcctcttttatatagcactttatcattctccacaagtagtttgtcacaggcattccactgggaaagcaaagtacagtgaagaatgaatttatggtatagttgaacccagtggcagattgtacactgctagcactgctagcacacagtagcaaagcaaacagctacattatctttaacataaggcatgtagccatattttcatatagtggtatacaacacagtatcattgcaaatgcagtttacagggatttttgatatactggcttgggacctataagattcttctcagcagttgctgaaaagcatgtaaataactacataatagcctgagaataatgggattttgatagtgccatttattgttaaagatttatttttacaaagtaaattcagggttttagatgtgtacacagcttttacaaatcaataaagatgattgtacaagagtattttcagactaattggattcaaggttatattcttttaagtgttgttagtctgcatgcacattggcagtaaactagttacttgtgtactctgtaatatttgtataatgatcatttcttcttaaggctcaagatattagaaaagaaatcagacctaaataatcattgatgaagtatgtcagttacaagcacaaaagaatataactgcttttataaatcttttgaatcatgtacaagacttatatctacattttttgatcaccagttgtaccaaaacactaatttttgaaaaagataggttaaagtatttgacaaaagtgaatacaataataacacttgtgtcaaaatgatatagcttagtataaaaataaaattcaacgttttggccaaaatgtttgtttttcactggattctgaatataataaattcaaagtaccctttttttagagtttctaataaagtagtatgtaaaaagaaactgcattttaagtcagacagtaaatgttttttttaatttacagcaaatgaagcagttttattagcatgttacaaatattgccaaaccaagacttctctaccatactttaacagctttccttcagaaaactctgaagttatatttgcaataataatgaaaccagcatttagtaccagcatatggttcatatgcaaataatactttccccaaaatctttctgggctaggctattttcttgctatgcttcctgcacccaaccagcagaattcttccagggtggaggaactaatcagcttgttctccaacagttctgaagccaacccacaaatctttgaggaaaaggggtcactttgtttactattctcttggagatggaagtgattctgctcttccatttgggtatattatttcaagggtatttcttcttaaaaatcttggaaagcctaagagagttaaaggcatcctggttttgtttcattttgctctgttttaaatccatatgcaaataaaactgcttctctcttacactgcttgaactagaaaatcagctttttaatgtaggttaccacttataagcacaaaagaaacatgtataagaaaccagatttaagtgttttaaataaaatgtaaacagtttttatttggtagagatgactcatggaaaaattgtgttggcttggtctgcatgtttaatgatgtgcttgtatatcgattagctgtgtcacttttaaataagaagtccacacaagcaagccaaatttttagatgacgaagtccataaataactagagaatttttgttatctgttgttaagttgaaatgtataatcatttatcactaaattgcacattgcctttatttatttgtgctctgtttttggtttacagtgtaataatacctcatttaaaaaataaaaaccactactgttacattttattaatttaaaaagctagaaaattcatgtagttactttttttacatatataatctgttaatgaattattgatttttgtatctgccacagtaaattaaagcattacacagtatttatcagtattttttaaac

SEQ ID NO: 61991 - DNA, 1067 bp, Homo sapiens
caaaggagggcattgggaaattcaaaccaaacacaaatcgtggccacccagggagactgcctgggttattgctctgttatctagaaccacaagggaccaagattggggtaccaaaccccacactggtgattctgagcagggagcttggcaggctgccagctgaggtggatgaggagcaagcaggttgcaaaggaagtccccccaggatgggcaaatctgggcccacccatcttctgcctgccacccctcagtggaagcctggcagagagtggatggctgtcagaagatgctgatggccctgtggcaagccccagcatgttcccgttaaagatcaaaggaaccatcacagaactggagagagaagaccatcttttgctcaggccctagctcatcctgtgaccttggacaagtaacctcacagagcctccatgattcatccattaagtagggtgagtatatgtagtctacctcctttctggcactttaaatccttgagtccatgggctcccagggtctgtgtacatcctcctggaagttaatagcttttcctgtcgtttttctttttgatttcaataacctaaaaagatttccacacaccaactttggttcccccagaggaccatgttatatggagaactgggttagttagttcccggtcacccagaatcacaagatgtgtcgtggtttcacggtttcagacgcagcatttgtaagcatgccaaacaaatgaatgaaggtgggcttgtttcctacggctgctataacaaattactacaaattcagaggcttaaaaccatacaaatttattatcccacagttctggagatgaaaagtgcaaaataggtcttactgggctaaaatcacggtgtcagaagggctgcgtcccttttggaggctctaggggagaaacagcttcctgccttttccagcttccagatgctgcccactggccttggctggtgacccctttcctcatcttcaaagccacagggtgtcatcaactctcctgcctccctctttcactcacaagggcctctgtgattacctggggcccattcagataatcc

SEQ ID NO: 61992 - DNA, 1045 bp, Homo sapiens
tgacagggactgttaaagtcaaaaatgtgagttttgagaagaaagttcagatccgtatcactttcgattcttggaaaaactacactgacgtagactgtgtctatatgaaaaatgtgtatggtggcacagatagtgataccttctcatttgccattgacttaccccctgtcattccaactgagcagaaaattgagttctgcatttcttaccatgctaatgggcaagtcttttgggacaacaatgatggtcagaattatagaattgttcatgttcaatggaagcctgatggggtgcagacacagatggcaccccaggactgtgcattccaccagacgtctcctaagacagagttagagtcaacaatctttggcagtccgaggctggctagtgggctcttcccagagtggcagagctgggggagaatggagaacttggcctcttatcgatgaattaagcaacaatgtaactggtcttgacttgtcatattcccccatgcaatcctaggtctgtattgctcaattttaggaagcctttgctactccatcagtaggtttagatttgagcttttgagacctggctatggaaaagaaagacacttgagaatttagtgttggggtctgtacagatgatgctacccaatttggctttgaaggatcaagtaacaggttgaaaactatttttataaaggtaatactttttcagttcccttcttccttccctctcaatccactagctttcatgttgggcaaggaaaagttgaggaaggatggctgatggtgatggaaagctgtgttaatggtatgaggaatgtgtgaaaagtatacacaaagggctctgaagctcaagtcagaggagtgggaggtctgatcattgttggtggaaaaacgtaaggttattttgtgtttttaagttggttttacaattctttcctggggaaattatttctggaggggaaaaagatccattctacgtatccttgtggagaaaagctaaataacctttaagaatgtgggtggtattggagaaagaagatgaattatagctc

SEQ ID NO: 61993 - DNA, 2229 bp, Homo sapiens
cttcgcgccgcctcgctagccgaaacctgcccagccggtgcccggccactgcgcacgcgcgggacgacgtcacgtgcgctcccggggctggacggagctggcaggaggggccttgccagcttccgccgccgcgtcgtttcaggacccggacggcggattcgcgctgcctccgccgccgcggggcagccggggggcagggagcccagcgaggggcgcgcgtgggcgcggccatgggactgcgccggatccggtgacagcagggagccaagcggcccgggccctgagcgcgtcttctccggggggcctcgccctcctgctcgcggggccggggctcctgctccggttgctggcgctgttgctggctgtggcggcggccaggatcatgtcgggtcgccgctgcgccggcgggggagcggcctgcgcgagcgccgcggccgaggccgtggagccggccgcccgagagctgttcgaggcgtgccgcaacggggacgtggaacgagtcaagaggctggtgacgcctgagaaggtgaacagccgcgacacggcgggcaggaaatccaccccgctgcacttcgccgcaggtaaccggggccagcgtcccctcgcctcgctccagaccccacctgcgcagccggggcccacaggtctgaaaccagtgctcctccgcctcccgacctttctccaggactctggtcctggtgatctcgctctcttccagtggggactaaggagattaggggtagggtgagcgtgccacactcgctggaagttttttgttttgtcttggtttggtttttttgccaggtgttgggggtggtttggggttttggctttgttttgttttacagtatcaacaatacctgtaccaacttccggtcttgttaccctagaaggcctctacacacaagaaagagtaggggacgtagttgatagaccttatgatttaaaaggtcagttacctccaaaatttttcgttcttgcaagttccatttgggttaaggtcttgaaggactttgtaaaatacaaggatgtaatttaggaggagtagcttaataggacgttgacacattagcgttaattggtttatcagaatagccaatcattaccaagtttctggagtgactagaacgggaaataggcaagtttgggagaactgaaacctgacttaggctgggtgcgggaagccttagacacacacacatacaagttgggcggaaagtggtagtataagagaaaagatagtgcaagtactttagcttgaatctagaatttaagttgggactaaccttgcttcattctgaaatttagatcgtttgaattacattattttaatatttattaggttcactttatgatttaagcatattaaatttagtcgaaaaatttaaaagagccatagatgggatattcagcttattcccataaagcatgcatgctgttcacttgtaggaaagatgatgactgtttctaacttcaggtgagtcatgcgtgattgaaaatgggagtacctcctcttacctctgacaatcctggttttttgttttgtgtatttcatgattgtttaaaacaattttttgaaaaatcggggaataccttttaaagtactcctgttcttttggggctagattgatgaagagaaaaggagcagtgagaaatatttcctctttcacagatattacttttacactttctaccaattggagatttgttcgctttaacctgttccagattttaaatgtaaatactaccaggaggtatgcttttttgatcaattgcacctttgttggatttccattggggagtcttttaaaaagaagaaagtttagggaacctaggtgggagaactagaaacggtttgtgggcaatggaaagagaaggaagaatacttaagtcaaacacacctagttagcctttttgcccgaaatttcggtggtaagtgctgccgttcttcagctaatttaggttgtcctgtttgaccatgtagtcaacatttaaacaactcatttggcaaactgtcacgatcaactgatacataagccaaagggtagggttacttagattctgttcacttgatctgtgggataaaaataaccaagaaagatcttagttgctacctttcaagaatttggtgtattagtgagttcatatctgaaaatagtaatatttagaggtgtaagattatgttattagatcctcagtgaccttgttccttctctgccttcccacctt

SEQ ID NO: 61994 - DNA, 1166 bp, Homo sapiens
ctatcagtcaccagactggtttcagacatcttaatgactagggaatcatgttgatacagacattgacacagaagtctgtgtcttggaatgttggtaactatgtggatataatcactttacccattctacccatatcgatcgcctcagctaaaacttcagtttcagttatgtctttctctttaactctgatttcatgcaaccctcttctctttccagccttattttgacagaaggctactacttgaccttcctttagatcaccaatcctttgggacagatatcttcccagttgacactgtctctcataacagctagttattttactccagctatttctgtgcacatctaactctcctttctgggggagttaacctgtgagtcaccattttgattacttcagatatgcttattactgctgaagaatagtaatccttattctaaaatgcttgggtacatcaaataactttatagaggtagctttacaggtttttctttattttgattctttttctcttactctccaatttaagaagcctttttctaaaagcacttcctgcaggtgggtgctaagtggttgggatagcagaaccatagattagggcaactgtagataacctacttggggaggacagtgtgatcagcaatgcccaggaagtgatcaggaaggaaggctgaagtcagggctaatgacagcaagagctgaccttcccctctgacattttcctacttggcttctgcaatgccattctttctcttttttttttttttttttttatattttatctaatattttatttactgatctctctgaaacatgccaaaattcatatagctaagggaacttaccatgctaaaatgttgttcaacatgacaaatttatacaaaacatatttcaatgtagtgccttcatttcattcttgaggaatcaacattacatttaggtggtgaaatttaggatacaaatataattatcaaatatcgtacttctagtttactggaaaacataacagttgtgacagtaacacctaacaccttggttaattaaagacagaaaatgggcaggggtgtcacagaagtatgcaaggatttgacagttcaaactaatccatagcccttctgagaaactacagatggaaaatatgtagtaaatatttctgtaatatggt

SEQ ID NO: 61995 - DNA, 1010 bp, Homo sapiens
tagtaaagggggggtttcaccatgttagccaggatggtctcgatctcctgacctcgtgagccgctcgcctcggcctcccgaagtgctgggattacaggcatgagccactgcgcccggcattttctagactcttagttccatgaaggacaagagccatgtgcatcttaattcatcactacttccccagcatcctttagagtacatggtacagagcaatttgttgacatttgctgaattaaggtatcacagtatatgaaaaggagtctgagaagtaaagctaagaaagaatggcattgcaggactcgcgtcggttggcgactcccggacgtaggtagtttgttgggccgggttctgaggccttgcttctctttacttttccactctaggccacgatgccgcagtaccagacctgggaggagttcagccgcgctgccgagaagctttacctcgctgaccctatgaaggcacgtgtggttctcaaatataggcattctgatgggaacttgtgtgttaaagtaacagatgatttagtttgtttggtgtataaaacagaccaagctcaagatgtaaagaagattgagaaattccacagtcaactaatgcgacttatggtagccaaggaagcccgcaatgttaccatggaaactgagtgaatggtttgaaatgaagactttgtcgtgtacttaggaagtaaatatcttttgaattagagaaagtgttgggacagaaagtactttatgtaactaagtggactgttcagaagcttagaggtcattttttgtaattttctttttaatgtttactttagagagctagggatgcaaatgttttcagttagaaagcctttatttacttttggaaactgaacaagaaatgcatctgtcttagaaactggagattatttgatgttaggtaaaacatgtaattgtttctctggcaaatttgtatcagtaatttgaaaatgagatattaggaaaaaccaattcttcttaaatttagttcatctttcc

SEQ ID NO: 61996 - DNA, 1464 bp, Homo sapiens
tacatagacaaatattagctgtgagcagatctttttttgttgcttcttgtagtcccccagtttagcagaaacattctgtgagatagatgtgggaaaggaattctagcaagagttttgtcactgtatcataaggttgtgatttacatatttaagttttatactttgaacatctgaaaatgtatacatactaaatacgcagaactctattgtagagtgagaaacatttgaactttgagctttcagtcacttattttgtattctttctttgaggttagcagtagtagtaccacccaaggcactgcttaggtaccactgctgcttagtggagagtccctctggctttatcattaaggttagttattgatatatttctgatcacctttccattaattagttcttgaattgttgagtctgttattaattttcaacctgaaacattttagtatggatggtacttatctaatttgatatcttttccttgttgaacttacgtgtggacaatttgttttcatctaggttttgggcggaaagacgtagttgaatatttgcttcagaatggtgcaaatgtccaagcacgtgatgatgggggccttattcctcttcataatgcatgctcttttggtcatgctgaagtagtcaatctccttttgcgacatggtgcagaccccaatgctcgagataattggaattatactcctctccatgaagctgcaattaaaggaaagattgatgtttgcattggtaagactgtttacttttccgacttttactaatgttgtaactattctgaatctgaactgaattaatctgttcatatcatcaaattatgtcaagctgaatttaaatatttaagaacatcccatgatttaatctaactactatttactgagtgtctttttgtgtgtagtactgagcctaaatttctttggagaatggactacaaagtgcctattatacttgcattctcttgggagagaaaatatacaaagagccagataaaggcatggtggaagggaacagagagtgttaagaggataatgagcacagtgacttggcaggatcaagtcaaggccctacttcctggagtctttccgtgagaaagggaaagtctttccagtggggaaagggttaaaaaggtaggtggggatttctctataaaaagctttaaataccaggttaaggagcttaatattagtacgtgcaggcagtgtagaatatttaatattttttgaggaagggaacactgtgataagagtacatagtatgcagtcatgctccacgtaactccatttcaaaatggatgacatacataagggtggtccataagatgataatggagctgaaaaattcctgtcacctactgactttgtagcagtcctaacttcatagcacgaggcattactcaggtgtttatggtgatgctgggttaacctagtgtactgccagtcatataaacgtatagca

SEQ ID NO: 61997 - DNA, 1078 bp, Homo sapiens
ttttatgaagagtaatctggtaggggactgggtaggatggatggcatcaaggataccagttaggaaactgtaaagtaacccaggtgagaaatgatgctactgaattatagggttataggagagaaatggcaggataagtaagaaaaatatacagtatgtgagaaggctttttgagaatttgtattaacctggtatttacttttgtgagacagattcaaggattttggactcattgccaccttaactccattatttcctgatgtaaaacagggacagttgaaatccttaacagatagaaagccagttcagtgcactagagaaagtccaggtgttctatgctagacttaagttggacctcatggtccccagcatcccaaatcactatttatgtcaacttcaccagcttagttgaaatgaggtcatttataaagatgtgaaatggatttcctagttacctctgcccaattctccttttctgtatgttgtcttaaattgttcctgccctacattcaaatacatcatttttaccacataacccaactctggtacctcagaatcttagacatataattaattagttttaataatgtagagttttccagttataatctgcactatccaatatggtagctaagggcttgcaatgtctgaattgagaggtactctaaggggaaaaagcatgccacatttcagagacttagtacaaaaaaaaatgtaaaatatctaattttatattgattataatataaatgtaaatattgaatttttggatgtattaggtgaaatctgttcaaattaatttgaactgtttctttttttcatgtagttactagaaaatgttaaattatttatgtggctcacattttatttctgttgaacagcactggtatatataggagtagagcagaatggaaattcaccctatcaaagaacaggagctgagcttcctttctgcacatatttgcctgtcttcctccagctccttatttagagagtatactggaatagcttcataataatacaaataataatacagcacagagcaaaacacaagactttctctttttttttttttttt

SEQ ID NO: 61998 - DNA, 4651 bp, Homo sapiens
gtgtgattttcttttttttttttcttaaaaatcctacatatctctgttcccaggctatctatagctttagacattttatttctgtcatgatgaacagtctttctagcataagcagtgttcttttggaatgagaaaacaagcttttaagcacacttgccttttcccttacacactcttatctatccttagtcacttgtcaccagctatataaatagcaaaggaaaatctgcattgaactgagggggaacttatttaatgtgtctttaatgcattaagtaatagaatactttatgtattatttttatatttaaaatgtaacattcccattctgacaagatatgaaaggtctttaaacaactttgagactttgctggaccagacttcttgagaaaatgatttactaaaatcaagttgttaagattaccattgaacttcaaaatagtgttgctattttgcagtgctgttacagcatggagctgagccaaccatccgaaatacagatggaaggacagcattggatttagcagatccatctgccaaagcagtgcttactggtaagtctgtatactctggttattccaggaagcctgtaaagaacaaccttgccaggtaggaaatttgcctcctatgattaatgacttcagctagatttttaaaatagtgtcagttcagtagctatccttttctacgtctagatagctgacattttattctcctctaagaaaaataaagctttctttttattttctaattgctgtttaagtatgtcattgttgccttattgggggtgagggtgatagataattgtatgttgctttagtatattcaggacattttttaaatacccctgagtttttcagataacttatgcctgccctttacatgcaggttgagtatttctaacccaaacttcaaaacacttctggtcttaagcatttcagataagggatattcaagctgtactattttttttaatgtattttaattttgatggaatgctttcaaaaaacactggccattccgttaacttttcagaagaggattctaggcacactcatttcagtaccatgctagttgtactctgctgtaacatatttatgtccttggaacctattgctatgcataaggctatagtttagattgacaagctttcctgagttgtatccacttcacatattatctcccttgttaatgtgctttcctcttagcaactcagccatgttgtttaccagattcttacctaccttgtgatgactagaatcatacctaatctaaagtcaagagccaaaggggctttgctgtgagctttgtgcctggattttgtgatatttcttctaccattgctgagaaaatttagacttcttcatgagaagacttcttcatgaaaagacttctagaagtgtgcactgttattgtgactatcaatcagtgttcattttctccttcactagtccatgttattccatgcttttatttttgttttttaaatcttgggcctcaaaagaagcattgccttggcagtcagtatgcagttcacattgtgggtttggatgtcattcagcaaatcatattaatttaaattttgttggttttatagttttgtttgtattcatttgtaaaagtaaagcctttaataaagaaaagaaataaaagagttcatagttaatccttttttatatttgtatatatttaaagtagcattaaataaacatgatattagtgtcaaaaaatctaggttcataaagatgttaatgattatgtttaatcagtgatgctatagattcttttgtcatttctataatgttggtatattgagttttgtttgttttgtttaggagtttgcttttggggtgtgtatgtgtgtgcatgtgtgtgtatcaaggcctcactctgtcgcccaggctggagtgcagtggcacagtcacagcttactgcagcctcaacctatccaggctcaggtgatcctccaacctcagtctcctaagtagctgggattgcaggcgtgcctcaccacacccagccaatttttgtattttttgtagagagagggtttcaccatgttccccaggctagtctctaactcttgggctcaagcgatccacccacctcagcctcccaaagtgctgggattacagacatgagccaatacacccggacatttttaggtttggaacaaagttgtagatacattttgtttctctgttataaaaataacatactcattttaggaaatttgaagggaaaaagggaaaggtcaccaataacctatgacccaagataaactttgttaatattttggtatattttcttttgggctttccttttcctgagcatattgattttatatagttgaggttgcctttcattatataaaatagaatctttttttttaatcccatagcaaaggtatttcatgtttgctcttcatgcaaatatttttaaactacacaatattctgttaatgaactattttccatttattggaaatttgtttccaaatttatctactttataattcattgggcatctttttgcataaaactcattaatttttctttttaatttctatacttttttttttttctaattcacaggtgaatataagaaagatgaactcttagaaagtgccaggtacgtactaatgttataaatatgtgacaggaatacttcaccattaactttttctttttttttttttttacagtaagcaaactttaaaaagaatttttttttaatggttacagtacttatcttgaggaacatctgatgaagaatgcaaattactaatactttttttgtattctaggagtggcaatgaagaaaaaatgatggctctactcacaccattaaatgtcaactgccacgcaagtgatggcagaaaggtacttccttttgcaactgagtttgtgcttatctcctggtaacatgaagataaagatgtgtttatcttatgataaattgaaacatatttgaagagagtgctgatgttttaagtgtttcagtattttcagtatttcaaattcttaagcctagtaaaactttattgatgataaacagttatttgcttcctatatgcaatagtgaatttataaacttgtatactatgccttcaatatgtatgttggattttgtaaaaccaaattgataactacttagcgaagttataattggattttctggttttatatttgggttttttccctctcacacattttattcaaccattatttgaatttcattaatatatttgattaatatttcagtcaactccattacatttggcagcaggatataacagagtaaagattgtacagctgttactgcaacatggagctgatgtccatgctaaagataaagggtaagcatttgaacaaaaacaaggactttttaaatgttaccctcttcttaaaacaatctttgtaaccttagaaaaataatattttttactaaataacattaatatatattgagcttttacaatgtacaggttgctctgagggcgcaggaaattataaaaccttaagcccacagctcatagaaggtttacattacacttcagagggcatgaaaagatacctaagaatacaatgaggtctctaccaagtgttgagtcatagagagggatagcactgcaggagttcccaggaaggaactctcagtgatggttgactggagtggttgggaaatccctcagaatgaggtgtgacttgacctggactgtaaagtcaagtctcaattcaagaaagcagagtttgcgggacattagtctgtaagacaattgggataagtgggggctgctacagcaaacgttaaagcacatttaaaaaacagtgactagactagctttgctggagcagatgattcacacaggagacaaatgaagtttaggattagagaaataggtaagaaccaggttttggaggactgggtatttagcctaagtaattcaaagttcaccctgtgatctgaaacaaaggggatgattattctaaaagaagttttaggaggtgcgtttgaaagcaatgtgttggctaaattggagagagaggagactagaagcaaaagcagcaattaggaaagtgagcattctagaggtttaagcataatcaggatccataataatggtggcagaagaaatgaaaatgaaggcatagatgcaagagatattgcagtgtaagaatgggtaagatttgttgaatggatacaatgagcgaggaataaaaggaaaactacatttcaagttctgaatgagttagatccagtgatacacatacgaaatacaggaggcaaaattgtttggagggaaaatgttgaattgacttctagaactcttagtttttttatttgtttgttgtattttttattttattttattttttttagacggagtcttgctctgtcgcccaggctggagtgcagtggcgcgatcgtggttcactgcaacctccacctcccgggttcaagtgattctcctgcctcaggcttctgagtagctgggattacaggtgcacaccaccacgcctggctaattttcatatttttagtagagacaaggttttgccgtgttggccaggctcaaactcctgacctcaggtgatcacctggctcggcctcccaaagtgctcagattacaggcatgagccaccacgcc

SEQ ID NO: 61999 - DNA, 1040 bp, Homo sapiens
tacagggaattataagtttaatataccattattgaagggtaagcctagagagggagccagataattgcgtgtgccacgttaataagttggaaccatctcttgaaagcacagagttaatggtgaaacttaccttttagaaaaatctgccttttagacttaccttttagaaaaatctgcctcagcttggagcataaagtggggtgggagctatttcaataatgcaggggagaaataacatagacccaaactaaggcagtggcagtagcagtgaagtataaaggaacatggatttgaaagagacttgggagttcaaattcttaggacttagggttcaaatggatgttactaaattttgaacatttttattagaacatcacataatccatttgctatttaagtataagtaattaaataaattttaatttataaatttccctaggcctaagaaatctatactgaaacaggattttcccccccttctcattgtagtgatctggtaccattacacaatgcctgttcttatggtcattatgaagtaactgaacttttggtcaaggttagtgctcttgtactctcctaattactttctagagttatataaaataacttgaaatacattagtatgtctgggtttctttttattttctgtgttcttagtgcttaaaaaagtagaagtatttataagcattataaaatataggtgactgatagctcagcatttgactgctttgagatttttgagataccatatgttttgttttgttttgttttgtttttttgagacaaggtctcactcttgcccaggccggagtgcagtggtgcaatcttggctcactgcaccctccacctccagggttcaaaggattctcctgccacagcctcctgagtagatgggatttcagacaggcgccatcacgcccagctaagttttgttagagatggagtttcaccatgttggccaggctggtcttgaactcctgacctcaagtgatccacctgcctcggcctcccaaagtgctgggattacagccatgagccac

SEQ ID NO: 62000 - DNA, 1144 bp, Homo sapiens
ctatttttatgaaattgaagaacagatatatctaatatgtggccagaatcggggcaggaattgtctataaaaggagcatgaggaaacattctggggtaatgaaagtgtcttgtatcttgatttgggtgatggtatcacagatatatacatttgtcagaattcatcaaagttgtatgtttcactgtatgtcagctataccgcaagaggagcattcattcttggaagagatgcaggttaaatctaaagcttcgttcttaactgttcttaaaagtagaaaagttaagtagacccttgttggtagggctagcaatcagctactgttttttccattgggaaaaatgtatactcattctgaaataattggctcaaaaagtgaactttgggaacataacctgttttagcctgtatgatgttaaattacacagtacgaataattctgaattcttttaaaaattgaacattaaatatatgctttttgctctccagcatggtgcctgtgtaaatgcaatggacttgtggcaattcactcctcttcatgaggcagcttctaagaacagggttgaagtatgttctcttctcttaagttatggtgcagacccaacactgctcaattgtcacaataaaagtgctatagacttggctcccacaccacagttaaaagaaagattagcatgtgagtataaaattatgaatgttcaggtaggatattatatcaataaactgaacattttttctttcctgtttgtttttagaaatgtttaaataatagaatatttttcttagccatgggcatccactgttgtttagcatatttaataatttggaagtttctacttaagatgctatgaaaagaaaatatgtttgtattaattttttcaagtcaagttatatgctttttatatgtgctgtattagacttattagatggtatgcctttgaaatgaaagcatttgttttgctttcatctttgatatgatttttctgtttaatctatgaagcttatgaatttgtgaagttaaagcttcataagattgccatcttgtaaacagtctccagatcttaacatctgatattgttggcacctgggccaagttcggttttctgtctatagctgaagtagatgtagtgagaaataaccacctagt

SEQ ID NO: 62001 - DNA, 1785 bp, Homo sapiens
tcataggtggcttttgcaaatatccaacttgtctagttcccagttccctgatggtttgagcaaagctgtctgctatagccatgatgtcagtgtagagatcactatttctttacagagaaaaatttttgtgcttgaaatattctaaaacctctccagtctaggaagatattgtagtactccagatatcccaaaatgaattacgaattaaaacagaccatgaatctgccgtgggctaaacctgtgtatactcttgaggccatatgtctatacagttgcaccgtaacttaggggaactggagtaccactgtctgttttcaggggttaaatttggagaatatctttagagcctcaatctggctattttggaagattattttgaaaataatttcaaggaaaatactagatgtcttttagataaggcttttcaatttgaactcgttatacatgtaaatgctttttcttcatctagatgaatttaaaggccactcgttgctgcaagctgcacgagaagctgatgttactcgaatcaaaaaacatctctctctggaaatggtgaatttcaagcatcctcaaacacatgaaacagcattggtaatgtttcagatttaagtttttaaaatacaataacgaagaacgtgctaaactaatcataatatcctacttttagaactagcatttttttgagtctatagttttaaaaaattactgcctatgcaaatattttttaaaaatttaaacagtaccaaaaaatagacaacctcaccctgcagaagccaatgctattatcagttcgagaatcctcagaaaaaaaaaattattcatattctgacatgtattatatgtaatgcttttattatcataagtgatacatatagtttgcctttttaggggttataaaaatgaatgcttaggttagaaaatttggaacccaatgaaaataatgaaaaataaaataaataccaccatccagatgaaaacacttggtgtagtcccttccttcttcaaaattagatctagaatgtgaataaagtattttagaggttacttccctgataggggtaataataactgtggaactatgacaaagtagatgtgagtagagaagtctaacgaaaaacagaaaagaatggaagctaatagggatacatgataaaagataagagagggaatggtaaaatcaggggctaccttaaaattgaaaggtagaaaaaaagaaacttaaaggtagaaatttaaaaggaagaaagtaaatcctgttgcgtgagttgcagaatgtgcttcaggtgagagaagataagtaagttaatgtgtgtagaagcagatttaactgatggtagccttacttacctaatatcttttatgagaagttttttgccttatgccataatgtaaactatgaaatttatgtagaaacctacctataaagcattttggacctttttactgcttgtaagaaacttctaaatttaaaaaaaaaaaatagcaaagctgtagactaataagaaatgctagtacaaaattaaaaccacaacagcattaaaactgtacaaagaaacatggaaagactgacatggaaaattctggtcataactactgtgaagcaactcgtttttgtaattaaccttaaaacacactaggagttgtgttggtgagtagttatggtgcagtagcagtttcttacaggttcccagagatttacaggccctgctccaagatggtgcagaggagtagggtgtaatttgaggtggatgtgatttttaaaaaaagtctttaaaaaaccatgtc

SEQ ID NO: 62002 - DNA, 2570 bp, Homo sapiens
atcagtgctattaccaaacagaatccagagctgatgagtgttctgttatttccctttttttgttttttgagatggagtcttgctctgtcgcccacgctagagtgcagtggcatgatctcagctcactgcaacctccacctcccaggttcaagtgattctcctgtctcagcctcccgagtagctgggattacaggcacgtgccaccacgactggctaatttttgtatttttattagagagggggtttcaccatgttggccaggctggtcttgaactcctgacctcaggtgacccgcctgcctcggcctcccaaagtgctgggattacaggcctgagccactgtgcccggctatattctgttatttcttcatgtaaagaaacctcaacctttgcaagggtgttttcttaacctttaaaatattgcatgaacacaatgctacttggaaacagttttgaaaaggatattggtcacattaaggttttcatcacaccagtgctagctttttcaaagatacaggacaactgtaaagtttgattggaatatgtaataatagatattatctgataggtaggattttcaggttctgtcagaatttggtaattgttgtaattcaatcaaaagtcaagagcaaagttgcgtcaaaagtaaaacaaaaagattaaataactacttgattgttcttgattggaaacacgaatgttcttaaaatcagttatgtatagtccttgattaatgctgcaatttaaattatttagcattgtgctgctgcatctccatatcccaaaagaaagcaaatatgtgaactgttgctaagaaaaggagcaaacatcaatgaaaagactaaagagtaagtatacatttaatgattaaatatcattgagattttactcttttggaaaatatattcactgtctggctgattttttctctctaagattcttgactcctctgcacgtggcatctgagaaagctcataatgatgttgttgaagtagtggtgaaacatgaagcaaaggtatacttcctttttggtaatctttggtaatccaatgagttattttttatttagcaggtgaaatgcctgacttcctaaactatttactttctcataagtattacttttttttccttataatctatgcttaagaattgtcctgcaggtaaccttttctatatctaatttttgctagaacatctatgggtttattcagatacacattcctgtatgtcctccctcctccattccttttaaccacagcccacaggttaaagttattcttaaggacttttctgacctatcatcttttctaatcgtcttttctcacccatatcttctaattcttggttgtcatgataacttctgttatttaccccaaccaccgtttttgtttctgttttaccctcttatttctgtaactaagccaaaggacttgaacggaaggaaatatattatttaaataatttgactaaaaacataatagctccccatgttggtaagttactgttctttagttggcatttgtgcacaaagcattttattcaccaaatatgctttcatcaaggctagaaatcatctcttacccagaaacttttaaaagtactactcagtaaaagatatacatagcatctcagattggaagagatgacagtagtcacctaattcagcagtttttacagtttttagccacagatccttgcctccttcaaacaaaatctttagttgaaattcagtatactctataacagagaaagaatagatgtgctgtagatgaagggagaggaatagacgctcttctccttggatggcccctgaaacgcttccataaatgaaatttgcagaatagtttattcttacctatcctttcttgagtttccattcattcaaggaacgatttagagttctccaatttctttttgtgttgcctctctgtgtcttaatttctctttgatttgggggaattcttgataatgtataatcttgatctttcctattgtaaattattgaataaaataaagtttatttctgcttgactgcttggcatatcttgtctctctgttctatatctgtttgttgattgctgttttcatacttgtggtacattacttgaagaatatctggatacatattgaattagagttgtgacactcaatgaaacaatcttgactagggtgaccaaccattcagttttgtccaggacttcacgttttttgggaacacaggactttcagtgctaaaaccaggaaagtcctaggcaaaccagaacaagtggtcaccctaatcctaacacaaagtggtacccaaatagtttttttttttttaagtgggtatttttcacatttcagcgagttagggtatgtgaataaatagtttgattgtcctaagcattttaaatccatttttcaggccctgtaagcatggagactagctattcatactctagttttaggttcattgaggtcttgattatattcacattcacatattatccgattccatgaatatgaattggtcagtgtctcaaaacacactagtgtccgcaggattgattactgaggaacttaatttcttag

SEQ ID NO: 62003 - DNA, 1380 bp, Homo sapiens
agtattccactatgtgactattccatagtatgtgtatctatatattttaggtaataaataagggagaagattaagcctatagaaataagcattttaatgctaatttatctctggctttgttactattgtctatctcggggttaagctttacatttctacactttagagatccataaaaatagatgagttcaactttcttaggcagtgtctagctctaaatatctgtgaatgctttaatgataaacacaattactattcagcatctcgcatttaacccaaaattgagtcttccttctgatggtagccttcatgacttggtaaatttattctctagatttgagcaaaaatacttgctttggcattggataataggcctcataaaagaattgagacttaaaagtagtaaaaagtgttaaatacatgattgtatggttttaaattttgcattgcgggctaatttcaattttttctgctttgttaaggttaatgctctggataatcttggtcagacttctctacacagagctgcatattgtggtcatctacaaacctgccgcctactcctgagctatgggtgtgatcctaacattatatcccttcagggctttactgctttacagatgggaaatgaaaatgtacagcaactcctccaaggtattacatgcttcaatgaaattgatttttttaaattaacctttaaaaatttttcacatatcaggtattataggtaggagttggtaataagaaaaattgagaatttttgtttatttcttcttaggttattatacttttaatcagctgaatatcctcagttcccaaatgtcattaagtgataattatgatttttgttccagtagcattttctgcccagtttcttaagttaaatagatggctttcaagtttttatcgagaaagttttgagagtaagataaaatggttgctatttatttttaaagaaaggaatttttagatcctacatattcaaggcaggtagaatttgtataaggtagccaactatttggcttattgaaacatttagcaactgaatacactcatattcattacgtcttaaaagatttagatcaaatatctacacacttggcatagatgaaacatctcagcccagatatctggtcccataaattttaaagtatttttgtctacatctctacttttattagaatttgatgcagtagctttgacatctgaaagctcagatgagaaaaatgtaatagattaagcttttctgtctttaacagtaaatccttgatgatctttatgcctttgttctgggaaccacgttttgagaaacactgcttgaacagatgaaagcagattgatacaacctcctggaatctaccaaaactgtgaacttacaag

SEQ ID NO: 62004 - DNA, 1222 bp, Homo sapiens
ctaccttatgtctttagaactgaaaaaatctgagaaccaggaagttccagtgacttgttccagttcagatagctaattaatgacagaaccacagttagatttctgtttgctctcttaatttaatacttttgcaccattccaatggcttgcttatagagcaggccatctttagtcatctcctttatgttcctttatattgcttacatcacattttataatcattatacacatttacatattttgcttatatgtgttgtatttcaaagagttttaagagaatcttatttttcactccccaaccctcaccccccttactaccatggagatctcgtacataatctaccaaattgtaaaagaactttgctttctgatgagatgccttccataaagcttggttccatcttccaaatagaggttagtcactcttctctctctctctcttttttagagggtatctcattaggtaattcagaggcagacagacaattgctggaagctgcaaaggctggagatgtcgaaactgtaaaagtaagatacagtgttacgtttctgttaactttgggtttttattttgacattgttatttaatctgtactgttacaatgaagagcctggtttatttgtatgggccttgccttaaaaggtcaataatacaatcttaattgttctctacaaatgagtagctttaagtaatgaaagagaaagacttcactttcacctgcatcccagtgaatattacattcacaaatataaataaattcgggtaataccaaatgggttttgcttgaagaacctattcatttgtccctttaacagaataaagtttatcaaattattttatattactgtttacgtatgacacataaaacaagaaaggggaaaaacagtgtatcacttctgtctatagatttcttctgatttcttcatttcttcaccccatctacctctagggatccagggcttagtataataataaatacaatgttgccacttctctttcccagggcttgcaacttcaggtcttacctgtttctccgacaagagtcttccccagagtaacccttcttactgttttgactcttgctgtagaaatatgtatgtaaaactgggcccagtggctcacacctgtcggtaatcccagcacttcgtgaggctgaggcgggtggatcacctgaggttaggagtttcagaccagcctggccaacatggcgaaaccccgtct

SEQ ID NO: 62005 - DNA, 1018 bp, Homo sapiens
ttttttttttttgctgtttgtgggaagggagagatacagaattgtaaatgctcattctcttacatatattaaagaacataaaactatatttagtaaacatgttaaagactaaactttgtttttataaagatagagggagtccagaggaggggatagataaagaggagatgaagttggggggcaggaaatggacttagggaacacagtaatgccattggattcaggaaaacctgtgctaggcatcaggctttcttccctcccctctgcttttaaaatcacttgatggacatttatctccatcagccattcttcttatctacctccagacagatggctctgtacgaatcactgggacaagaacatctgcgtattacctaatgaacacttaactattgtgctcagttgtgtttgttcactgataatccaccaggctggatactttattcgacacatgctattagaaaacctatctcagagtggacaaaattaaactgacaggtaaagagtagaatggcctgtgataactaccaaaccaagcagcacctggtacacgtgttaaaaatagtcatttctaggaacctgacttgagacccactgaaataccatctcttgaatggggccctgaatctgtatatctagccagatcttatttgggaagcacagaagagctttttaccaggacaatgattaaaccccttgaggtaaacccactgatagtaggctcctttattttattgagcttaggttatccctgttttgggagtaggttagtaaaaagggggaaagagtttttactaatatggatatattctttttgtttgtttgtttgtttgagatggagtttcactcttgttgcccaggctggagtgcaattgcacgatctcggctcacagcaacctccacctcccgggttcaagcaattctctttcctcagcctcccgagtagctggcattacaggcgcccgccaccacgcccagataattttttgtatttttagtagagacggtttcaccatgt

SEQ ID NO: 62006 - DNA, 1814 bp, Homo sapiens
agaccaggcacggtggctcacacttgtaatcctagcatttggaaggccaaggtgggaggatcccttgaggccaggagttcaagaccatcctggccaacatggtgaaaccccgcctctactaaaaatataaaaattagccaggtgtcctggcatgtgcctgtagtccctgctgctcgggaggctgaggcaggagaattgcttgaacccaggaaacagaggttgcagtgaactgagattgcgccactgcaccccagcctgggtaagagagctagactctgtctcaaaaaaataataagacaaaaaaaaagggcatggatgagaggaccagagggattcccagtaaatgacaaggtgaaataagaatactaaatagtttctgagaatactgatttaatgagacaagaaaataagtcagacactttgaaaattcctactaaatgacttgaaacaagaaataacaatatgtagatgtagtatcatgtatgttgtgttttgtccttcagaaactgtgtactgttcagagtgtcaactgcagagacattgaagggcgtcagtctacaccacttcattttgcagctgggtataacagagtgtccgtggtggaatatctgctacagcatggagctgatgtgcatgctaaagataaagggtaaatgccaatgattgttatggactctcttccttacttttacttgacctttttaggaaaacctggaaatataatatgttttatttttcaagaaagcctgtttcctaacattggcctaaatattaaatagagcttcttaatttcaattaagattttatatggttagcattcatataaagactttattggcataatgcctgagaattttataatggccaaggagattataacattagtgtgatattgacttttaatgtagtaaatttttcagtttccatggagggttttttaattcttccagtttatcttgaagttattttttattaaaaatatacaattctagacgttgcatatatggatgaatgttatagtctctgcatttaaaacattttttaaatgttctcccctgactcaccaaaaagaacttatttctgccttaaatagatttaggttctacaaagtataatcagtataattccttatgtagttcaagaattatctttcatcagttatatgtaattatttaaattaaaacatgttcttctgtggcattattgttcatttattacttttcagaggccttgtacctttgcacaatgcatgttcttatggacattatgaagttgcagaacttcttgttaaacatggagcagtagttaatgtagctgatttatggaaatttacacctttacatgaagcagcagcaaaaggaaaatatgaaatttgcaaacttctgctccaggtatatttaaatacttaactgtaaagagtatgaattacatagcatatgtttatggttttctaaataattctagtataaagttaaactagtaagcaatgggaagcaatgttacctaattctgtacctagattttagaataaatataataaacattttatattttaatccacaagtatgtttactagcacctagagttatttttgtctagagccaactatcatgtgatagttctcttattatttttagtttttctctttggtacttttatattcatcaaatataaaaatatttgatgaattatttacttacaagccagatttatttagcattgataaaatggatgatactggttcagtacagataccagtggatattttacaataacaagaatacagagatttatactttatttaaatgttcatg

SEQ ID NO: 62007 - DNA, 2294 bp, Homo sapiens
tgagaaaaagctttacttccactggctatcaggagtttctagtccatgcaagacaaaatatgacttgacctttgattggaagttgtgctgtgcatatttatgttagcttttatatctttcttgtagcctatctagaacacttaacattactgtgtccaagttgtctttgtaagtcacaaataatttgtatgcataaaatatttctgtccacttctgcagcgttaaataccataccttgagacctagaaagacttttagattaatgtaatattttatggtagttttataattgtattcttctttacttgatctttttaaattcttttgctttaaatcctttagcaaaaggataaaaactataatagaaataagttttatttcatggctttaacagcacctaagttcctctactagacttgcagagatgtgtacctctgagttctctctagcaaaaaagcatgctcttgtggccttctggggaagaggactctgaggcccactctggtttgacttgtatgtgattgcagacctttgacttgcagcctctgagacccatgtacctgagttcaagaagtggtatgtaacacccatgaaggcagagactttggtaggaaggttttcataggaaagatacaagcaaatcagtcaatataattttgggaatctacaaagctaattgataacacaaaaagcttccaacttgaggcaagggggaaatgttttccagaaggtaaattgttaatagagtccaatgagctatttcagatttatacaaaatctctttttttatgttttcagtaatgtctatgccttataaatacatatatatatgtatacatgtaatgacttttttatgttaacaagtggaagtattatgacataggactaaaaaagaaaaaacaagtaaagtaattttacttcttttctaaattagctggttataataatttagaagttgcagagtatttgttacaacacggagctgatgtgaatgcccaagacaaaggaggacttattcctttacataatgcagcatcttacggggtaagttcttccgtgttacctttaaaaatttgtggaattttaaagtgaaagtcagtattgcagctcaaatggaatgtagtttgatgttctcattttacagagaagtaagtggcagagctaaagaagttaaataacttccaaatttcggttctgaatctgttctaagcttgctgtgtgatatgcggtgtattgttgtttgttttattatctgccttaacacctgtctcttattttcagtgagatgttggtgattgtgtttatttgttggtacccagaaaatccactggggcaccaacggggtagatggaatctgtacagattcagatgcattgttcctgacttatcatagtccaatgtgacattcaaaattgaccatcttcaatggtatagtttgaataattgaggaagattgctgctttataaattgacatttagtagttataacatttgaataaattagaaattattgaagtcatattagtctagtttcctgctaaatagaattcttaactcttttctagatagtttctcaagttattgaaatgtccactgtaatttttaatcagctactcataagttgtgatgttggggagaaagagtttttcttttcatttccagaataagtttgaaaatgtggaagtaggtacgtaactagtttcattttaagaaagtaaagtgtgacaaaataatatttcagactgtaacgggtattttcttttacagcatgtagatgtagcagctctactaataaagtataatgcatgtgtcaatgccacggacaaatgggctttcacacctttgcacgaagcagcccaaaagggacgaacacagctttgtgctttgttgctagcccatggagctgacccgactcttaaaaatcaggaaggacaaacacctttagatttagtttcagtaagtgatgggctttttgaaaaatctcagtgcttttctgacttgttaaaattcacttgatgttattataaaatgtctttatagtcaatgtgaatggcaaaatctgggttttagcctgattttaatgtaagagttctttagtattaaaatataatagaattataaagtaatataattatccttctgtagaatagaattatcaatcagttattatatactgagtattttggaaataggaaaaagaagtacatgatataactgcttacgttagttaggaaactaaacagacccaggccctcagaaaatgctgttacttatagtgcatacagcgcagatgg

SEQ ID NO: 62008 - DNA, 1071 bp, Homo sapiens
ggctcactgcaacctccgcctcccaggttcaaatgattctgctgcctcagcctcccgagtagctggaattacaggcatgcgccaccacacccagctaataatttttgtattttcagtagaaatggggtttcaccatgttggccaggctgacctcaagtgatcgacccacctcggcctcccaaagtgctgggattacaggcataagccactgcacctggccccattctagcagatttgattaaaatgattatcttttctacccacctcctctccaaaaaactttcagttttaaggaacaaatacattgctgaatattttccaggaaatacaaacaattcagtttgctaaagttctgtgtaggttgaattacttctttcagagtaactacaataggactaaaatctcttaccttttaaaattgatatttctgtaattcgttgtgcttctcagtcacagtatcagaattagggttttgttcatgctttgccatatttaaattatattttgacaatatgtgttttggaagagatgttctcagttatgtcttatattttaataacagtttagctggatacaggttgaatatcccttatcggaaatgcttagaaccagatgtgttttcggcttttggatatttttttcagattttgaaatattatactcaagcattatacttactgttgagcatccccgatccccaaatctgaaatccaaaatgctccaataaacatttcctttgagcttcacgtcaacattttaaaattttcagatttgggatgtttgacctgtattaacctgtttgcttcactttttaaaatgaataatcctccattgtgatagtactggcacaaattgctgggttttctcatatttttaaatatattttattaggtataatagcattttaaaacttgcttatggcagatgttgtctctgacacgtaccctaggcggatgatgtcagcgctcttctgacagcagccatgcccccatctgctctgccctcttgttacaagcctcaagtgctcaatggtgtgagaagcccaggagccactgcagatgctctctcttc

SEQ ID NO: 62009 - DNA, 1104 bp, Homo sapiens
ttgaagaaggaaaggattaccgtgagctaggctcatcagggaatgcttcatggaacgtgtgtaagtaaaacaggattttaaagaatggcttcaatttcatgaagccatagtgtattactgtattaaaggtaaaagggttactttgaacagtgatgcagaagtaccacttggcatagtccagactcagcaggaaccattgaaagacattatataaatagggttggatgtagagtgatggtagaaaagtattatggaaaagataaaatagaatacctgaatgtggttaatttgaaagtgcctttttgttttgcgttttagttctgctcaggttcttatgctaaatggaaataatatttttagaaatgtttaaaataatctggagtaaatgtgtgaatcttacatattatgaaaacaccaatatatgaatgtccaccaaataagtaagcattctaagtagtttcctcctcttttgtaagatcactttggatgtattagttgagatggggcacaaggagctgaaggagattggaatcaatgcttatggacataggcacaaactaattaaaggagtcgagagacttatctccggacaacaaggtattttattttaataattgctgttgtcagtttaacagtttgcataaaggcaaccctcagtgtactaagttataatttaaaaatatgagagaatctgtttaataggaagaatactaatttaggattcaggaaactgggattaagtcttagctgtgctactgacttaaacttactgagctgctgctgttaacgatgtgaacctaagtaaaatttctggaccattcagaaatttgggaattgttttagctcctgaaaataaggaagttagtttgagattattttctgaagttattctagctcttaaattgtattattttaaaggtctgaaacttaggtatcacatttcttatggtaatataatagataataactaagtgttcaggctaacccttaaagtactatagtagatctcttatgtagataaaattttaagcgcttgggatgaaaatactggaaagcaataatgttgcaactgaggaaattgaacaaaacaaagttgaataatat

SEQ ID NO: 62010 - DNA, 1096 bp, Homo sapiens
ggaaagtgggtgaagggtacataggaactctgtactttcatcctttctaaatatctaaattatcacactatgaaatgtttttaaaattgatagtaagcggccaggtgcagtggctcacacctgtaatcccagcactttgggaggctaaggcaggtggatcacctgaggtcgggagttcgagaccagcctgaccaacatggagaaactccgtctctactaaaaatacaaaattagccagtcgtggtagcgaatgcctgtaatctcaggtacccgggatgctaaggcaggagaatcgcttgaacccaggacgcggaggttgtggtgagccaagatcacaccagcctagcctgggcaacaagagtgaaactctgtctcaaaaaaaaaaaaaaaagtttaaaaaaaaaaattggtagtaagaatcagaaaaattaggtggttatttttggttttgatgttcattgtttattggcaatttatttttctaccttcaaattttgtttcataggtcttaacccatatttaactttgaacacctctggtagtggaacaattcttatagatctgtctcctgatgataaagagtttcagtctgtggaggaagaggtatgttcatataacttcaatagtaggtttgccgtatatatttagttcactttgtatcctcttgtttctttttcttcctttagtttgcattatataattttcacctataaaatctgttttcaagctgattatctaatattactagagtaatattactctagaaaatattactcatgaatttataagactcatattctttgttttttgtgtttgtttttgtttttgtttttgtttttgttttagtagagatggggtttcgccatgttgcccaggctggtcttgaactcctgagctcaggcagtccacctgcctcggcctcccaaagtggggcaccatgcccagccctcatattctttgaataacaaaaatattaaaacctgttttgtattctcaaaaatagaatcagacgagtcaagaaccatgttccccaaatcagaaaataacacaaatgctaatgcacatatatttcaaaccatttttctgacagatgcaa

SEQ ID NO: 62011 - DNA, 1353 bp, Homo sapiens
agactacatctcaaaaaaatttaaaaaaaaaaagaatgtgaaagtctacttgggccacttggtatcttcaaaaaagcacacaggcataggcatcattctaagacctaattgcatttagctttgctatctaaagtgaattatgagcctcttggttttagatttttatggatttgcagtctggcatttggtaactcttacactgatatttcaagtactctgtttttctagttcaatctgtgtccttattttagcacataaaccagcactctgttagaaacattagttgatgttagcagttctttattctaaaatagctggctgacagttaacttgttaccctttttcgttttggctttattatggttgggctatatatttaagaattcagtttctaagaaactagttttttactttttattctaagataaattttaaattattgttacccatctatatgtgtttcagggtctccttttgtgaatgcaattatccacaaaggctttgatgaaaggcatgcgtacataggtggtatgtttggagctggcatttattttgctgaaaactcttccaaaagcaatcaatatgtatatggaattggaggaggtactgggtgtccagttcacaaagacagatcttgttacatttgccacaggtaagagatcacttgttctcatttattttggtggtaatcagataagaactagttgcatttttgagggcaaagcattatgttggacagtcttaggaatgcaagctaggcatgttttagattgcttttggccctctcaccaattgtaataatagctaatatttattaaatgatccgtatgggccaattataatttaagcacttgacctgtttggctaatttaatcattagaatatctggtgccttaaagcatactgagtagaaagtaacattaggcatgaaagaggctttattgtagcccttgagtattgtaggactctgtggactctaaaaatctagtattcaaatgctaaaatggcattatttgtcaaatctaattatttgatggcagtgcctgagcctctcttccactgtgatacgatcctaatcctcaatttgcaatattactataagaacttgaaattaaaacattgatcctttttgaaaggaaataataatcaaataactactttgcactttttttttccacttttaattacctgttctaactcacttgttaaaaatcatttaagtaacttgtccctaacttataaaatccttataggcaaaaagtaatgccacttgaaaaatccagtaagattaattcctgagatttattcgacagttagggcactgcttattgaatatacagagcagtagtttat

SEQ ID NO: 62012 - DNA, 3319 bp, Homo sapiens
tcagtgagagccaaaagtagttctagagcagtgttgtgaactgggagtaggtatcggaatcaccgcagttactaaaatcagacatgattttagtcttatctgatacttatgaacttagtattcatcttagacttgctgattgaaaatctgaagaactgtactcagggtaaagatgttttgagaaaatgtccctagatgattctgatctacaacagtaatttagaacctcctccctaagattaggaatacttccggaaagtctgtttatctttcaagaaaatttttgtaccattatttgaatttatctttctcttccaggcttatcctgagtatttaattacttaccagattatgaggcctgaaggtatggtcgatggataaatagttattttaagaaactaattccactgaacctaaaatcatcaaagcagcagtggcctctacgttttactcctttgctgaaaaaaaatcatcttgcccacaggcctgtggcaaaaggataaaaatgtgaacgaagtttaacattctgacttgataaagctttaataatgtacagtgttttctaaatatttcctgttttttcagcactttaacagatgccattccaggttaaactgggttgtctgtactaaattataaacagagttaacttgaaccttttatatgttatgcattgattctaacaaactgtaatgccctcaacagaactaattttactaatacaatactgtgttctttaaaacacagcatttacactgaatacaatttcatttgtaaaactgtaaataagagcttttgtactagcccagtatttatttacattgctttgtaatataaatctgttttagaactgcagcggtttacaaaattttttcatatgtattgttcatctatacttcatcttacatcgtcatgattgagtgatctttacatttgattccagaggctatgttcagttgttagttgggaaagattgagttatcagatttaatttgccgatgggagcctttatctgtcattagaaatctttctcatttaagaacttatgaatatgctgaagatttaatttgtgatacctttgtatgtatgagacacattccaaagagctctaactatgataggtcctgattactaaagaagcttctttactggcctcaatttctagctttcatgttggaaaattttctgcagtccttctgtgaaaattagagcaaagtgctcctgttttttagagaaactaaatcttgctgttgaacaattattgtgttcttttcatggaacataagtaggatgttacatttccagggtgggaagggtaatcctaaatcatttcccaatctattctaattaccttaaatctaaaggggaaaaaaaaaatcacaaacaggactgggtagttttttatcctaagtatattttttcctgttctttttacttggttttattgctgtatttatagccaatctatacatcatgggtaaacttaacccagaactataaaatgtagttgtctcagtcccctccaggcctcctgaatgggcaagtgcagtgaaacaggtgcttcttgctcctgggttttctctccatgatgttatgcccaattggaaatatgctgtcagtttgtgcaccatatggtgaccacgcctgtgctcagtttggcagctatagaaggaaatgctgtcccataaaatgccattcctattttctaatataaaactcttttccaggaagcatgcttaagcatcttgttacagagacatacatccattatggcttggcaatctcttttatttgttgactctagctcccttcaaagtcgaggaaagatctttactcacttaatgaggacattccccatcactgtctgtaccagttcacctttattttacgttttattcagtctgtaaattaactggccctttgcagtaacttgtacataaagtgctagaaaatcatgttccttgtcctgagtaagagttaatcagagtaaatgcatttctggagttgtttctgtgatgtaaattatgatcattatttaagaagtcaaatcctgatcttgaagtgctttttatacagctctctaataattacaaatatccgaaagtcatttcttggaacacaagtggagtatgccaaattttatatgaatttttcagattatctaagcttccaggttttataattagaagataatgagagaattaatggggtttatatttacattatctctcaactatgtagcccatattactcaccctatgagtgaatctggaattgcttttcatgtgaaatcattgtggtctatgagtttacaatactgcaaactgtgttattttatctaatccattgcttaatgagtgtgtttttccatgaatgaatataccgtggttcatatgttagcatggcagcattttcagatagctttttgtttgttgggaagttggggttttggggggagggggagtattagtacgttgcatgaaatagcttactttataatgatggaattgctttttcttttgtcttgtgatttttttttttgaagtgaaatttaactttttgtgcaagtagtactattatacccatcttcagtgtcttacttgtactgtatcacattccataccctcatttaattcttaataaaactgttcacttgtttttctgggtagcatggtaattactggaatagtataaatgtgttgaatggtctttgagaaaatgaattaagattacaataaaccacaattgcaggaaaacaatgtagttctgagtctaatagtgataaagaatgcagtttgaagtttgaaatattgaatattgtagctgtacttgctcattaaaatgaaagtagctgtgagatgctttcaacatttagtctattcagcacaactggtaaaccttaaagctcattcctgggaaattaatcttcttaacttataaaaaggaatatatttttatttctgtgtcatatgaaaacattcttaataagtttccaaatctcaaagttagtggtatttattgctattaaaagaaagagtaatcgcatatgtatattagacttcagtatgttaagtttccttgtgtgtgagcaattccctgatttccataataagagaatgatggtgcaaataattcttaagtcttttggctttgaaatacatttcagcagctctgtgttcctgcttcatttagggtaatatggaagtatttgctgctatttcaagtatgcatgccagtctcgggtgtttattgtgatccagttgtttgcaggttgatgaggcaagaaagcatgcagatttcccagagctcttatagtcag

SEQ ID NO: 62013 - DNA, 1042 bp, Homo sapiens
ctgcctttctaatctttctccagctgatcatttttctttctataccagttaccacaatcctagaacatgccaccatctctagtccaagacacctttagagagacgcttcccttttgtcactgtaaagctacatccaatcttttgaaaatacacactcaaccctaggaaaggaagtactcatctccttgaacattgtatcacctgataagtctcatagtaagtttatgtatcaatgtatttggtatttggacatgtttagtacaagacaggagcctctctccttttcctgccttccatggcatctcatttcaatctgttcttcgcttcagtcatattatttactgatttgaagatttgaacatgaacatggtaatctttctaattaatacctttagttgtttcctattgccttaggataaagtccacattctcaaacaaacatatcttaccaagtcctttgtgatctggttcctgtgtcatctttttagattcatcttgtgtcaacttctctgtacttccccttcaccttcttctctcttctatcctccaccctccccagaattcattttgttaccccctactgtttatctttggaacacttcttagccccatctcaggtatggctagttctgaccttagtgtgtttttttgtttgattttttttttttttgagacagagttttgctcttgttgcccacgctggagtgcaatggtgcgttcttgactcaccataacctccacctcccgggttcaaacgattctcctgcctcagcctcccgagtagctgggattacaggcatgcaccaccacacccggctaattttgtatttttagtagagatggggtttctccatgttggtcaggctggcctcgaactcctgacttcaggcgatccacctgcctcaattttttgatctaagcttatatattaccttgttcaggacattttctctggttttacttcatctgagctatttgcaccaatacatattcctatcagtcataatatttatattttgtaattggttaattgttctcttac

SEQ ID NO: 62014 - DNA, 1097 bp, Homo sapiens
ggcaagatggtgagacccttgtctctacaaaaataaataaaaaacacttagctaggcatggttgtgtgcacctgtagtcctagctactctggaggctgaggcagaagaagtccttgatcccaggagtttgaggatacagtgagctgtgattatgccactacattgcagcctgggcaacagagcaagacctcacttcttaaaaaaaaaagtttgtgtgtgtgtgtgtgtgtgtgtgtgtgtgtgtaacccatgcaacccaagtaatgatatgctattttctttcattccacactttggctatatggtcaaattaatatttttaaacctcatgtagaacctacttccgaaagttctatggaagattcacctactacagagcgattgaattttgacagatttgatatatgtagattgttacaacatggtgcatcactcctgggatctgctggtgccgaatttgaagtccaagatgaaaaatcaggtctgtagtggttctgagaagaaagtctaaaatttgttttttcagactaatttgtcactgtggtatgctgttcattagtcacacgtaaactaacatgtcatgaaatgtaaattaactgaagtttgcaggtggcgggggatgctatgaatgggaggtaacccagcagtatttggtttaaagctacaatatgagtattttttctcctttaagtgaatatgtgcatcattagttgatacatattaatatttcagcaacaattttattatgtagtatggaaattataaagtgttccccaagagccccagtttaatatattataaaatcaggattagtatagatcgtggtagtgttttcacaattctggaaatttgagagattgattgttttgtttttatcacatatttctgatattattgggtttactcatgctggtgtccaacgcaaaaactaagagtgaaaaataagacttggataggtattcacacctgtaatcccagcactttgagaggccaaggtgggtggatcacctgaggtcaggagttcgagagcagcctaaccaacatggcgaaaccctgtctctactaaaaatacaaaaattagccgggcatggtggcga

SEQ ID NO: 62015 - DNA, 1378 bp, Homo sapiens
agcctctcgccttcagcccctggagtagctgggactacaggtgtgtaccatcatgccctgctaattattttttatagagatggggtctccctacgttgtccagactggtctcaaactcctgggctcaagtgatcctcccacctcggccacccaaagtgctgggattacaggtgtgagccactgcacctggcccaggaatgaatcttattattttatatatatttactaattaacagttggggaatgcgggaatctcagtgaaaactcccagaatgttttgttaactagaccagtattttccaatgtgattaggtaacagagtttatgagatgatcatgaatgaatatggttggttttattggcagaagggatgctttgtgtatttttttattttgatagagtttgatgtgcacgtattagaaaacttcttaactgatttggagaaaacgtatttcttttctgttgaaaggtgaagtggatcctaaagagaggatagcacgccaacgaaaattattacagaagaaacttggccttaatatgggagaagcaattggaatgagtactgaagaacttttcaatgatgaggatttggattataccccaacttcagcatcctttgttaacaaacaacctgtaggtaaaacgtttggttatttgattgcaagtaataatacaaagggtttgcttcattttgtttatgtaattatagtttaagaaaatgttatacttagctctgttcattgctgcttagtgccaccataatttagcatctttttttaactggatttctgatgacagattctatagagttagaagctcaacctacctcccagacactggactgttaagttgtagtagaccttttaggcactactggtattgaaagattctaattgctgcaattgctctttttttggtatgttctttgatgtagggaaaagtaattttttgggagagtgagagatagtaagggctattatagtcagatatgatagtagaagtgtttagtgttatgatttattcttttttttttaagtgagaaataagacaaccgagaaagggtatataatatgaagtaaaaggaagttttttgccaacaggacacagacatttccatgccccatagacaaccattttcaagttacttgtgcatcatttctgaaacttgtgtgtaccaagtgcatgtgtttgtgtgtgtgtatatatgtatatgtgtgtgtgtgtgtttgtgtgtgtgtgtgtgtgtgtatatatatattccttttaagccatgtttaccttttctcacttcatacagcttaatgtgtcagtatattcagattgaccgcattctttttggacagcttcatgctgttttgttttgtggctgtaccataat

SEQ ID NO: 62016 - DNA, 1740 bp, Homo sapiens
gaaaggaaagtgtaagatgtaactagaagataaagaggataatagaataaaaatgcaataatatgatcacagtatgggtaattgaacatggtgtaagaaaatgaatgggcaggtgtattagaaagtgggctatacagatcagattaattgggtgcgggataggcaacactaatttggggtttgcaaaatccagatttatatatcatggacctttgggggaagttgcttgaggttcatcgttgccataggtcattacagctgcattgcttatatatgtgcccatggttcttgatcaagactgcagcagaacatccacaccagtgaccttaactgtttgtggaagtataaatttcagttgaatcttttggttaggcacagaagggatttttaggcttgagcttaaaaatctaacgcacagactttatagtgtcttctgtgaatggaaaagagcaaaaagagtagacagtaagtagttaagaggaaaggggcatatgagctaagttggactatagcatgctggaccaatcacttaaggctataatttatttatttatttttttcagcagatggtgatgatcagtttcttctattgacatttattctcataactttttggtgatattatttttattttgaagtcttacctcttcaaggccttctctatgggttaggatcatacatttgtgcctcataatgtagcataaaaaaagttaagaagcatatgtgtatctgttgggagttggaataacagagaaaagggaggaaaagactgaaattatggtacagtcatacaacaaaagagtgtgaacctgtcaaaaaagaatgtgatcgatgtatatatactgaaatttatagacttggtcttcttctgaggctgagactataggtacttattttaatttcaaaagttccaactcagcattcttttattcttttagactcttcaggcagctgaattgattgactcagagtttcgagcaggaatgagcaatagacaaaagaacaaagctaaaagaatggccaagttatttgcaaaacagagatccagggatgcagtggaaactaatgagaagaggtagtaatctttttttgcctattcacttaaaacaagagggctctgtggctttaatctgtgtctgcttgatttatagaaacattctgctgacatatttagctggggagtactgtttggattctcttactcaattgtcagagagtattcattgtactaggaactgagaccacttccccagaaaaatccacatgtacagacttttttcctactaattatcagttttgaatgagggctgaggatctccaaaggggagagcattccaggcagaagaaacaagtttaaatgccttaaacatggaataatcaagaaacaaatagaagggcagtatggccttctatactgggatgagtgcacaggagagtgatagagaatgaaatcagagaggtgtctaaggaccacaagttaagaatactcccttagtaaagtgggaggtattgtcacgatattacctcacctgtgccttaagctggggctatgctaaatagccaatgataatctaggctagtttatgtagtcctgttgaagaaaagaactgtgtgggtaaagtcactgtcctctgtttcttcataagttactaaaagtgatcatctatgcatggcttggagcagcatttctcaaagggtggttcaaaactatttccttcaggtgctcttcgaggaccttgt

SEQ ID NO: 62017 - DNA, 1018 bp, Homo sapiens
gtcaggagcttgagaccagcctggccaacatggtgaaaccctgtctctactaaagatataaaaaattagccagacgtggtggcacgtgcctgtaatcccagctacttgggaggctgaggtaggagaatcgcttgaacccgggaggccgaggttgcagtgacttgagattgcaccaccgcactctagcctggcctacagggcgagtctctgtctcaaaaaaaaaaaattgcttataaatctttttcaaactaatatatcattgaaagtattgaataatctattgagagaaattttatcagtaaaaatatatcttaattagttaaaaaaattaaatttttaaaagcctgattgctactactagacctagaaataaaatttattaagttacttaaattgttagcataaaatagaccttttgaactagtagtaattctgtttttcttattcagacaaatgaatggcctttggaaagcttttgtgaagaactttgcaatgacctttttaatccctcctgggaggtaagatttcttcattacagtttttctcagctctattttctgtgctaatgaagggaacaatgtcaagagcaatatactttgtcagagtccctattcttctctgtttgtctcaggactcagggcacgtcatatcattgacctaaatagaaaactataaattgattttcacctttcatatccttcagtcatattctttagtgaattgtttatttcttttcgttctttaaattataatccaaaggcttgcatatctctcccaggcagtaaaaaaaatacttcctttcctttggaagtggacaattttgattgatcaagagcagtagtttccaagccagctttttagcctcagaaatctttagagaacatcttgaacagttcccaatgtgtagaagagaagagtgaagttcctctgcttgaagttgaggattggtagtttcaaaccattgtttctcccttctgttggcctctgtgtaatttaaaaaacatttatttagaatacc

SEQ ID NO: 62018 - DNA, 1654 bp, Homo sapiens
gcgtggtggcgggcgcctgaaatcccagctacttggggggcttgaggcaggagaatcgcttgaacccgggaggcggaggttgcggtgagccaagattgcaccactgccctcaagcctgggcaacagagtgagactccatctcgaaaaacaaacaaacaaacaaaaacactatacgatactttctttcctctctcttgctgtggatagtgctgaatgaaggtagaggataagggagtgaaagcaatgtggatttatatctcaaaaggattttagaatagctgttttcttgcttgatttttaaaaaattccatataaccaaaagcagtctgaaatgtatatgtgtaattcttcttagatagttgaagaaaaatacattcttgtaaagttccacttagtttattctaatttcttaaaaatccagtatccctatttcgtatagaagaaaaatcaaactttgtttcttaaacatttaacatctgacatttgcttctttgttcttttcaggttcgacatggtgcaggcactggacttagggaaattcttaaagctcatgggaaaagtggtggtaaaatgggtgacagcactttagaagaggtaagtgtattaatgcaacaattatcaccaagtattaatagttggcatctttttccaatgtagggaagtaacgagtatgtgccgtgaagtaggaatgagaggtaaataagaggaagagatatgaaaaggtaaatatcatacaatggattgaaaagtagagtaagatgaataagaggctagttgagaggtcagtgagcaacataattggtattgcctggagacactggtaatagtataaataatagatatatgaccggtgtgcttgatatgagaacaaccttaagtaattagtttcttaatttctcttggagtgcgagtaacataatacaatccatgaattttaagaattgtgatatagtatatctgaattgaattaatgatcaaaggggatatgagatatgtttaatattaaagacattaattgggactattctactttttggttgttgttcctacagctaaaatctgtccccattttttatttttgattttggacctaaggtgtcccccaagtccccagtacaaagtatgatctttgtttttaaaaaaattatgttaaaaaaatgtgtgtgtgtgtgtgtgtgtgtatatatatatatatatatatatatatatattatattttaacagatgattcagcagcatcaagagtggttggaagacttggttattagactcctttgtgtttttgcattagacagatttggagactttgtttctgatgaagtaagtatcatttaagggaggctttgcccaatcaaatttcaaattctacaaaatacgttttttgcaaatatgagttttcttcctttttcgtctgtaggttgtggcaccagttcgtgaaacttgtgctcaaacattaggtgtggttttaaaacacatgaacgaaacaggagttcataagactgtggatgtgctgctaaaattacttacacaagaacaatgggaagttagacatggtggtctgctgggaataaaatatgctttggcagtccgtcaggtaaatatttcaagttttgaagcttatgtgggagagttttttcccccttatagtttattt

SEQ ID NO: 62019 - DNA, 1755 bp, Homo sapiens
aggctggtctcaaactcctaagctcaagagatcttcccagtcttggccttccagagtgctggggttactggtgtgactcatcacacccacccctctagtctcattttttgaaatgacttttttaaagatctggctgactttccaccttattatcaaaatcagaacacaaagttagaagtacagtaagcagtattttaagagcttaaaaactaaattttttttatgatgattagtaccattttaaatgcagtaaaattacatagaagaacatgtcttgtgtctcgatgctctgttgttttcactgttaagttttttacataaaatagttgtggctcttttattttctgaattctacccattatgagtctggtcaggcagggaagtatcaaagtagagttgaatggcattaaaaagaaggaatagagaattgttaaaggcaaatagtgtgacctccttaactttactcaaaattgacaccgtccaaggtcattggaattgcatgtgttgttgaatcagtagtgacccctgggataccatttggcagggtttgtgagtattttgtgcaaaattgataacttttcttgaaaactgatcttataggtgcccttcattataaatacattgtgggatgctcttctggaattagatgatctaacagcttcaacaaatagtattatgactctcctttcatccttgttaacttaccctcaggtccaacaatgcaggtaattatttctaattagtggaataaagtaaaaagtctttacatacctttcgagataattcagcctaaacataacaatattttagcacctttaagaataatattatttaagctggagatgccaaagactaccgttttcagaaggccttgtcttttttactctagccattcgggcagcagcttacaaagatcattttttttttacccttgagatatttcagttatataattcatcgtcttgttcgtcttataattgtttacttagaaatataatcattgaatagtatttccagttctagtcctagaacgtagaattttagctttatttagtaacatttagttaacagaattatcatcgaacatcagctttaaattttctaaaacttgcccctctgtgaactttttttttgtaatgttcatgtcttcaactcttgttcttgatttcagtaattacttatcatgaaggaaatacataataatgtaatataatgtccaaaggcagagatcaaatgaagccaaaaacatacatcaaaaatttagtgtcaccaattttcctgtcctgatatatgaatctcagctcagcgaattaacatattccctaccttttagactggcccttgaatattgttagagataagtgtccttagagatagagaatagtgtccttagagacagagaagaaaaaattattatgcaactttaaaaaattcacagatgagaaaattactcttcttgtcctagtgagggcgttcagtgaatgttcatataaatgcttatatgtggtttctggctctatgagtatttcccatgaaacccatagatgtataaaaaaagtagaaaatatttcaaataatactgacctactggaagtactttaatgctaagtttagattagttggatagcctataagtaggaatagcaaaataagtgcctataaaagcaaaagaagagaaaaattgaagtggtagtacatttatggggtttcctaatttttgatgtttctattactaatgaaagctgtacaaactaa

SEQ ID NO: 62020 - DNA, 1067 bp, Homo sapiens
aggcctcctgggaggaaccacaaaagaccaaatacagtggcatattattttttgcttatgtctttttctgtggagccatatatttcaaatgctgcttatgaattatttcctagttccaggtaacttttacaaatgacttacgaatgtgacaggaatcctgtggcccaagttagtctagacttggctttgtttgcttccccatttaaaacttaatctatgagaaggaagaaatttgagttttcctaacttagtaatgctacaccaggataataaatgtcaaagttgctaccataccaccacttgctcatttgatatgtgacagagatggcaccaaagggagatggaaattatgtgtatctacccgttggggttagccatggggaagaagtaaggattagcaatcctgatcatgtaggctgactaccagctaggatacatgtcccattttcctaagaacaattacattggaaagtcctaacttgataaaggtgactcatagcattagtgccatagaagaacctgatgttagtatttctacccttctttttgactgcatttgctctggctcttctgttgctacgataacagttgtgaatgacattgttacatgaatgttcatatgaaaactgtattatcttttaagaatttattcatcaaaaaagtcacatggtgtcagcatcactagatcccatgagaatatttagataatgtatctacagagttacaacttagaataagtaagattaatttgtgtcttctttattagtattcagcagtcactgacagttttagttccacgtgtctggccttttttgcatcacactatatcatcagttcgaagagcagcattggaaactctgtttacgttattatcaacacaggaccaggtaagaactgataactatagcagtcttgaaacttatataaattaattttataaaataaacctggtctttagcttacccttgctgtatatccaaagatcaggacaatgttgggcctagtggtatggtaaccatgtagatgaatataatcactgtaagagcagaaatattttaatattttgt

SEQ ID NO: 62021 - DNA, 1018 bp, Homo sapiens
gtaagagacaaggcctttgctctcctgtagtgcttaaaataggagactagacaggagaagacaaataattaaacaagaataacttaatgaggtaactctgatatgggaggtagaagacactattggatcctaaatgagatgggtgatggacagggaaggcatcatgttagaagtgaagtttaagctgaaacctgaagggtaagtggaatttagccaggggaaaataagggtaagagtcagaggagggaatagtatgtgtaactctggaggcaggagagagcagaatggcactaaataagtgacaggaagttggtttggtggagggcaacatggaaggggggtatagatagttagaagtttaaccttcattttcaggtacagtgaaatgtccatagtcttatttctgtttgtcatcaactctccttattctgagtctccggaaggcagatcagaggaagaaacgccatttccatagttttgccttttccagaatgtcatatagttggaatcatatagtatggagccttttcagattggcttttttcacttagtaatatgcatttaagatttctctgtgtcttttcatgacttgatagttcattttctttttagtgaataatactccattgtctagttgtaccagtttgtttatccattcacctaccgaagacatcttgcctgcttccaagttttggcagttatgaataaagctgctataaacatcttgtgcagatttttgtgtggacttttttgcctcctttgggtaatatcaagaagcacaattgctggatggtaagagtatttttaatttttgtgagaaacttccaaaatagctgccccattttgcatttctaccagcaatgagtgagagttcctgttgattcatatcctggccagcatttgttgttgtcagtgttctggattttggccatgctaacaggtatagagtggtatctcatcgttgttttaatttgtattttcctggcaacatacgatgtgggccatcttttcatatgct

SEQ ID NO: 62022 - DNA, 1501 bp, Homo sapiens
aatttctcttaaaaacactgtatttagtgcttaaaaaaagtcatgtggagggcaggggctgttaggtactttgagctagttagtagaatttctctgatggacatttctatccagtgagcttgtaattgtttgaatagcaatagacagtttgggattccttattctgggatttctggacacacattagatatttggtgaagcactatttggttgcttgatttgggtgggcctttgaattgttaggaagttccttaaattgaggtttgtaacccaggctttaggagatccctgaaccttggaagcaaaatattgttagtaattatatgtttttctgataacatagtgtacatagttttcatcagagttttaaagggtccctgacccaaaatagattaagaacttttaccttaattttgtagtgaactccaagtagaagtttctaggttggatattatagtataattcattacttggattattggtgagcatatagaacttaaactctgatcatctagcacaacagcagtaacctgattattttatagattttcttgacaaagcagtgatgtatggtataaccagagagatgttgctggttagaggatggttccatatggaggatgatttcaactttgaggaaaaattgttgttaatgataatcagactttttccagcttcccagtgattatatgttgttatttcttcagaccattggtataataaatatggtgttgttgcctcaaaatcttgtcaaagtttatcacctgtttagcctttttaatgaaaccatgcagtcttttcatggtagtacttttgttatttgacatataattcttcaggtaagctaacatccaagaattatatgctacagcttttaattctgtttttgttttcagaactcttcatcttggcttatacctatactgcctgatatgctccgacacatttttcagttctgtgttttggaaagcagccaggaaattctggaccttattcacaaggtacacagcaaatgtatttgtgttccttttcctagtaacttttgtagatttttaaaatttttcataattgctgttctgttggtcattcatatctcatggagatttgaaaagtctggagatctgcataatgagacagagaactaggcttcttacatgtagcatgtaatagttaagttttgattggccatgcttcttcctcttattatgtgacttacacaggtgttttaagcactttctgatagcctcaatacagaaaatgaaatgaggaaaagattgcttttctctagccctcatcttgctgtttatcaatatgcttatagatcctgcaaagtatcttttaggatctgttggtaatatagagtctaattattgttgaaacttgtacttttttccctacttagagtgatcatatgtgttagaatcattaaaggaggagccgtttgatatatttaatagcatttatggggggaaatggcacttttgtacctttataatctgtt

SEQ ID NO: 62023 - DNA, 1104 bp, Homo sapiens
ttggcctctaaagtgactccttgttaacaaccttggattaacagtggtgatcttgccataggctagtcctagcccattaaatgttaggcatcaggaaaggtaccttatccttattaagtaagatcatgaatcaaaacttatactgttttaaatttatactaggttattaccacctttgagtttagcagagaatattaggagctatttttaaatgtgtgttgaatataggactgcattaatattgagtcttatgatatatgcaaaggatttatttcagtgacttactgagattttgacaattttgtattacttttataggcatgtttttttaaaaagagaattgtgttctttttttaaaaaaaaactttcctttgcatgactttttttttagtgcacaaacctattagaaaacagtactgtatttcaaaataagcctctatattgaatttctaaattaatctctgtgctatttcctacttaaaaaaacctcagtattcctaaagataagtgttagagtttatttttattagaaaaaattcactttcatgtcccccttttaccctgcaggtttggatggaactgttgagtaaggcttcagttcagtatgtggtagcagctgcttgcccatggatgggtgcttggctttgcttgatgatgcagccttctcatttacctatcgatttaaatatgttgctagaagtaaaagctagagccaaggtaagtgtagagggacatagtgtatttgtgtgttcatcatctaattattaatacagtaaccatatttttaaaaatctgtattgccttaagtgtgatttaattaacataagtaaggagaaaccgttattttattaggaccctgacaaaatgaatagtaatgtttatccattaaaattttgtgaaaagaactgtattttactgggattattttaaaaatatcatatttttgttgttgcctattcagttttaatggttaatctttattgtttttttttcccctccctctgtaggaaaaaacaggtggtaaggtgcgccaaggccaaagccagaataaagaagtacttcaggagtatattgcaggtgccgacaccatcatggaagacccag

SEQ ID NO: 62024 - DNA, 1831 bp, Homo sapiens
aaaagtaataaagacaaattaagtaaaccaatttccattagctgttaggattatttacaacagaaaagtgaaaattttcgatgtataaaaatccaagagttacagaaaagtgtccaaattatattgaagattatttctctcccatttacttttaactctggacttttgtcttagaacccctactcatacttccaactactagttatgctcatacttaatatttgctgttgactgtacagtctgttaagaaatatccctattaaaaaccgcgtatatgtgaaagtagtccagaaactattggtcatccattcctctatatgtcactcaggtatcactgaaaactacaaaggatgaggctttgagtattagacatccatctgtgtgggtagtagcaaaggcagaatttttggtcacaggaagaataacatctctgtatttaaaccaaaatcttcatgtttccaaataaaccattcccttccagcctctttaaccgttaacttctagggagatgtatgattttgtataagacatacttctgtaaatcaaagaaactttctactggctttgtttattccattgactggaattctggaaatttaactgtctgcacttgctgtgagagttacttgttactgcctgttagcagtttgtcaaagctgtatctaaaagtaattgagccatgctccattgcagctgacacccctgcttggcctctggaaagaagcaaagctcatctgtttttaggcaggagttggtgtgctggagaggcagtgatgctatgtttttgtgcctctcagacttagcagcaagtgttgacagttaggtttctggacactcacagagcttcatggacttactctgtgaagcccaggctgataactgagatgccacagaacccctcatggctcaccactgaggccatttcctgttggtttggggcaggcaacaaccagagagagtgggaagggttagttaaatttggggatagataagtagcttttaaaatttatatccacttttacagtatggcatgtgaagcttagggttcaactgttatctaataatgagtttttaaataacatttttaattagtgcttgatagatttcttttctgattttttttttttttaccataatacactttaaaatctgtgatatatatacacgtgtaaactttggataggtagaaaatgaagttgtaatagttctgtgtgcatgttctgtagtcattcatgttaaaattttacaataatttggatgtaatacctttttttctgtgcaattaactgttgtttggagaagtaacagaatatagattcagtacaagtaagaatttagaacttggtagtctacaaatgacgatttctgtatctataaagttaatgttcatacagttaccctatttgttttctgttgtattttaggagtgtaaagctgttaccttagctgtgcagccgcgtttacttgatatcctttcagaacatttatattatgacgaaattgccgttccattcacacgaatgcagaatgaatgtaaacaacttatatcatcattagctgatgtacatattgaagttggtaatcgagtaaacaacaatgttttaacaatagatcaagctagtgacttggtgagtaaagaaataactttcttaattagagatagaacatgaaatataggttagaaatttgtcatgacatgtttatcacaaaaacacattagtttgttgagtctgtatgtggcttggtagcctgtcatctctacccttgagaaaggttatttcattgtataggcttttcttgaaataagagaataacaaagaattttttttaa

SEQ ID NO: 62025 - DNA, 1054 bp, Homo sapiens
tgggaagttttagacattagtttactgagtactaaaacaatattacatattgtggaaaccaaaattgaaacagaaagcttgctgtctaccctttaggagcttacagtctatttggggttgatatgattaatgatttttaatttcttttttttttaataggtcactactgtttttaatgaagccacatcatctttcgatttaaatcctcaagtgttacaacagttagatagtaaacgacagcaggtccaaatgacagttacagagaccaaccaggagtggcaagtgttgcagttgagagtgcatacttttgctgcctgtgcagttgtgagcttgcagcagcttccggagaaattaaatcctatcataaaaccattaatggagacaattaaaaaagaagagaatacactagtgcaaaactatgcagctcagtgcatagctaaactccttcagcagtgcacaacaaggacgccctgtcccaattcaaaaattattaaaaacctctgtagctcactttgtgtggacccatatctaactccttgtgtcacatgtccagtaccaacacaaagtggccaggaaaattctaaaggtatatacctaaacttttatttggggtagagaaataaccttttaaatttgtttttgtttacttatgggtataatttaagcacaaatccagttcatgttagtgttttttcccattctgagagaaaaggcttgattataacaaaactctttgttacatgaatttgcacataatacttaccagtcacaaccctgtaagttcaaaaaagccattcatggaagatctgatagctgatataaggtgactgaaatctgtaagacaggtgttcacccttacctttgccttcaaaaccatcattatatggtttactgtatcaagctagaaaaggtaattgtatcaaatgttatttaatgaattttttttccttaaccaaaggagcaaccctattgactgaaaaagtcattataaaatctctcgtttccctaatttagtgcatgttttatgagattagtgaacttttagtacttttag

SEQ ID NO: 62026 - DNA, 1051 bp, Homo sapiens
attaaacataattttaaaaatataaatatctttttggggggacagatttatggaccgtaattactgctgaataagaattattaatcttggggttagcttaaacagatgatcttgtactatcccttaagtgaatgtaaataaggacacatcacttcatctatcttctctctagctgacaagtttctttgaggtagagagaaggaggaaaaaaaatgtcacttaggactatctctagaaacagcacatatccgtctgttccttatcctcaaccccaaaaaagtgttttactttggtcacaaaaatctagttaggtgttgtaggcccctgtaaatttaattattgggaaatgtttataattgagacaaacatgtctaataattgcttacttggttaatgataacattatgaattcttagatggtgacttttaaattcttttgttaaaattttaaatgtattatgattttttctgaaattctgtttttatctaacatttaattttaaggcccagaagccttacctggtacaacggagaggagctgaatttgctttgacaactatagtaaagcattttggtggtgaaatggcagtgaagttgccacatctctgggatgctatggttggcccattgaggaatacaatcgacataaataattttggtatacacatatttttatgagtccagtttttaacaaattttaatgtctattaattgaatatatccttataaaataaaaatgcctctatgcctctacctgtttattccagaccagctggtaagttttaaaatggaaacttggtttaaaaaaaacacacacctttattttataaaagagatatttgggttgggcatggtggctcatgcctgtaatcccagcactttgggaggcccaggtgggcagatcacttgaggtcaggagtttgagaccaacctggccaacatggcaaaaccccatctctagcaaaaatacaaaaattagctgggcgtgtagtcccagctactctggaggctgaggcaggaggattgcttgaaccctgggggtggaggttgc

SEQ ID NO: 62027 - DNA, 1101 bp, Homo sapiens
cagagcgagactctgtctcaaaaaaaaaaaaaattgtttttaaagagatacttgaaatggatcactatgtttaagttctttggttgctctacatgtagtaccccagcacttaaattaaggtcatggcatttaattttaacactaagaagcaaaattgactctcctatgctagctgaaaaagtgctaaaagtttttgtgtgctctagattttgaaaaattatttgccagataatacagacaatatattttaacagatggaaaatccctcctggataagggagatagccctgctcaagaattggtgaattctctgcaggtttttgaaacagcagcagcttcaatggattctgagcttcatcccttggtaactaactaatgcaagtgtaatatttcttcaaataaaacaagtggtcttattaaaaagtcttaaggtttgaaaggtacagctttgatgtcatccttattaattgcatttttctttgctgtggtataactagattcctcctttactaacagtgcaactcctgtgggctttgatgtagaccaggctgcttgaatttaatagaaaacccaacctggaagcttagaatgtgggggcattgaggaaaggactctgatgacacaggagccagatgtaaataggaaagaaaactgcagccctgttcatccagatgatcctaataatacagctccaagaaaggaaaagcatatataatgaaatctgtttcctagataagtacaaaggtgaaaggagtcacctgcctaaggtgaagctggtcagtggcaaagatagaacactggtttgggatttttttaaaaaactattaaaatgtttcttacaaaagaattaggacagagggaggaggaaaatagagaattatctggtttttttcatagaagaatattattcttttcatatctctgcaataggaagctgtctgcaatttaccccattttgaagggtattagcccagttctctattgttatttaacacaaaagggagaatctatgagagggtggagaagaatggatttttttttttgtacatagtaataaagtatgtccttttacttgttaaaagttttgctgatttactgtta

SEQ ID NO: 62028 - DNA, 1063 bp, Homo sapiens
cagctcctcaacagattgtactttgataagcagcagaattcacagtttttttcctcacagaatgttaaaaaagacatgcattaaagggttgagatttattaaaatcgatcatttttactgctctatcaaggtattttttgtcttttttttttttttttttttttttttgagatggagtctcgctgtgtcacccaggctggagtgccgtggcacaatctcagctcactgcaacatctacctcccaggttcaagcgattctcctgccagcgtggggtagctaggactacaggtgcacaccaccacgcccagctaatttttgtatttttagtagagagacagggtttcaccatgttggccaggctggtcttgaactcctgacctcaagtgagccgcctgcctcagcctcctgcagtcctggggctgggattactggtgcgagccaccatgcctcgcttatcaaggacatttttaagtaacactggctatttgaaaaaatgctaatgtatagttctaagaaatatgactactagcacattttggtgccattgccttgattctttcagaggtacacgcagttttctccatggtaacttttgtaacatctacgcagatatcaacatggtgattaaaagcaaataatgtttttcttttattatgaaatagttgaaaaggtcttagagatccataggggtcgcgcagaccacattttgagagctaataccctagggtatcagaacactaaaattgagaagtgccagtaatggcatttaattcaaaattaaactatgcaactttatatgcctctttatcaaataatgcatagtgtgggaaaatgaagttgtagattatggtctttcagatattccatatgtatttactagtagactaattgtagcacctttaatgcttgtcaatttctttaacctgatttgtcttcaagtctttgtacaattttcagaattcttttttctgtgtgtttgttttgtgtttatttgatctaagaatgaaaactgtgagtacgtagtttttaataactttaaaaaaatcattttaggcaggcatt

SEQ ID NO: 62029 - DNA, 1347 bp, Homo sapiens
caagtagctgggactatacatgtgcaccactatggccagctagtttttttttttttttttggtagaggcagcgttctcattttgttgcccatgctggtcttgaactcctggcttcaagtgatcctcccaccttggccccccaaagtgctgggattagagatgtgagccaccatacctggccttaaagcattttgtaaaatcgatttagtaaaatcttgtgtttagtgtcttatacccatttatttctcttttgcatatagaaatatttttgttttgtgcaaacgttgtttataagaaaatgtttttataagaaaaaataaatttatgatgtattcacatttatgatttttctctctatcaggatggtgtgaactggttagcatttcttaataagtataaacttcatggaattctgtgtgatgacatgggtttaggaaaaactttacagtccatctgcattctagcaggagatcattgtcataggtaatttaagatgttattttaaaataaggtttccggatttggagaaatgtaaacaagctggttaatttattgtgttttgctattgtaaagggcccaggaatatgcaagatcaaaattagcagaatgtatgccacttccttccttagtggtttgtccgccaacattaacaggccattgggtggatgaagtaggtaaattttgctctagagaatatctcaacccgttgcattacactggacctcccactgaaagaataaggtaagagttgtatgacaataacaaaatatttcatctgttgtcataattaagataaggaacagtaacatttattaaagtgaattctaattagctcttttggttgtatgacatagaaacttcacttatgaaaagtgaatgtactttgggaagatataatcagtgaggctcatcaaaattgaggaattttaaccattgtacaataagttgagctttcctagagctggagaactatcaggaaccaaagccattttgtatgccccttttgggagtctgtgaccatagcatctttttggtgcttctgttttattctcattttctacccactttcctgagagctctcctttgagccatgtgcaggggaatattcctgtagtcctaactgttcaggaggctgaggcaggaggattgctttagcccaggagttcaaggccagcctgggcaacatagtgagttcccctctcttaaataaaaaagagttcccctttgctttgttccctttccttccctctccacagaagtacttttgttccactatggctgctttagctgccgctgcagtcatggctgcactaaattttagcattgtttcagctttaccccttccct

SEQ ID NO: 62030 - DNA, 1165 bp, Homo sapiens
ctggccaggcactattctaagcagcttttcttttatgtaaaattgtgtattatgtatagaaggagcaggactgaaaaaaaaactaaacaaaaaattgtgcattatgtattctcacagtcactttatgaggtaggaatactgttgttccaatttgcaaataaggagtctaaggcatggggtctgggtccaaggtcactcagctaattaagtggacagagtgaggctttgaatacagtcagctcaaaaacttgcactcttgagcagtttactatagtgcctctttgatagaattcattcatttgtaagtgatagaaattcaactcaattctcagtttcaatattcagttctcaatattcaattctgttagcttaagcaaacagaaaattcattaattcactaacttgagaatttcaggggcagattgttgcttcaggcccatctagattactctcattcactcttcctccccttacataacttattgttactattgggcttcagtctacagttggtagataagatgacaatgggcagtctctggcccatattctcttagcttggcaactgtagtaaacagatcttccctctctctcatgaatatatcagtactggagatgactgactggccttgtttgggtcatgctcccaaaacaacctttgtggttaggggattaagtattgtgaatagcttaacctggttcaaatgcttcatttccttggtgattatggggacacatgattggtagttcccccacatcacctagaacaacatggagtgagaaaggaatagtgcccctaaggaagagatgttggcaaataaagttgaaatgtccaccatattttcagtctgatgttcatctcttttctaatcagactgagtagggcaacacagccagatcatcagaagagtagcccttcagggtcatgtatgtagagtaagcagaagggaatgctgggcttagtgggcagattgaaagcactttatacaaatggtagctattaagaacttttcagggtctctgttttctaattttattcatttctaaataaaggttacagcaccaagtaaaaaggcacaatctaatagtggcttcatatgatgttgtgaggaatgacatagatttctttaggtaagaattaattttttttttagaaaaattaata

SEQ ID NO: 62031 - DNA, 1104 bp, Homo sapiens
tttaaaacttgacatatgttccccttttaggctagcagtaacattcttgtaaaatttggtgtcttgaaacatacatacagggtcttgatcatgtaacttcatttaaggaagatttttctcatttacttctaagagtttctttttttcttttttaagactcaatttttctaagattttcttttactggtaatgtatttattttcctgaacagtagaaaaattgagtcttggactatttgacttgtatttttcatattttggcagccgaacttaatgtgttcatacttgttttctaaatgtaattttaaaggaatttaccaagatggagtggataacctgtaattcctgtagtgaattagagatatcacaatttgttttcattaatgagggctgatttaaattactgctgttattggcctttgctggttatgtgttttgaacaattgaaaataaatatacttaaagcttctcccacgggggccattttacaggttcagctctatgaagattttgctaagtctcgtgccaagtgtgatgttgatgaaacagtttcttcagctacactttctgaagaaactgaaaaaccaaagcttaaagctacaggccacgtattccaggtatagattacattctactttttttttttttgagatggaatttcactctgtcatctaggctagagtgcagtggcatgatctcggctcactgcaacctctgcctcctgggttcaagctatcatgcctcagactcctgagtagctgggagtagaggtgtgcgccaccatgcctggataatttttgtatttctagtagagatggagtttcgccatgttggccaggttgatctcaaactcctgacctcaagtgattcacctgtcttggcctcctaaagtgctaggattcaggcatgagccaccacgtctggcccatcccactttttaaatgttgaataatgatttttaatgaggcactttttatatggaataataaaatacggatctatgtatatttgtttcaatattatgtatacattcttgaaaataagttaaaatacctatttaatatatcttaataagcactttaatattaaaattaaatgtataaaa

SEQ ID NO: 62032 - DNA, 1092 bp, Homo sapiens
gcaccatgcccggccagaaatttttacactcactgaagtttgagcaacttttgtatccaaaatgatccctggttccagaagcatctgtctgcattaccaggtactttgagtgggaaagggttttaaagaaaacaactaagacgctcaatttgccatgggaagctcattgtctggtgggggagacagatataaacagtacaatttatacgcgttgtaaatgtccgcatagaaactgcacaagaatctcaaatgagacatttgaactggttcttgaagaatgagtagaagtttgccgagcaagaagagggagaaaggcattctaaacagcataggaaatagcatagggaaagatacagagataaaaatatttgtgatatgcgaaattgactcatatatactttttttttcctcttgaaggcattacagtacttacgtaaactgtgcaaccatccagcattagtcttaacacctcaacatccagaattcaagaccactgccgaaaaactggcagttcagaattcttctctacatgatattcaacatgcccctaagctctcagctttgaaacaagtatgtatgtcttttaagtgttaaatgtgtgttgtaccccaggaatataaattcttggtaaatttgcttttcttaaagattactactgtgtttaccatttatttttaaatttggttaaatttttgatacagctttttgtaaaaatgtggttaaaatatatacagcacaaaatatgccattttaaccattttaagtgtgtaaatctgaggcattatatttacaatgttgtacaaccatcagcattatcttactgctaaaatatttccaccacccaaacagaaactctatattcatcaagcaataattcttcattctcccttgttctagcccctggtaatctctaatctactttctctatgaatttgcctgttctaaatatttcatttaagtggaatcataaaatatttgtcatttgtggcttattcattagtcagttttatggatatagcacatttcattcatccatttctgtgtcagtggacacttgggttgttttcaccttttggctattatgaataatgc

SEQ ID NO: 62033 - DNA, 1029 bp, Homo sapiens
cagtagtagcaaccctaacactctcaccttctgtcgtccctgaatgaaagtctagcctgttctcacacttctctgtccccatactttaaaggttcatagttgggtttatcttaattataattagcatttaattatatttttgcaagttagtccttacctgatgttactaaattcaatgcagtttgccttattttgtatttatgaaattcctgaatagctttggaatgccctcttttactaaaaacgttatacatattgagaggatatttttctcagatgatcatgtaagtatccctattgtggatttttaaagcagcattttcatttgtgctctttaatttttattaacagtttctgttataggacttaagaatggactaattttatttttgttatctacttttaggtttaataatgatccatctatagacgttctgttacttaccactcacgttggtggcctgggacttaatttgacaggcgctgacacagtagtatttgtggagcatgactggaatcctatgcgagatctacaagccatggaccgggcccatcgcattgggcaggtaaaagtcaattttacctcacagatgttaacctgtgcatgaaaatatactcccccagaaagataggaaaccttggtttagttcttgctctggtgttaacatacatgtgttatgaccttggacagatcacttaactcttctgtggtatcacttcctcatgcattaaatgaggtgctagcacttaggaaaacctggatcactgttcatccctaatattctgtgattgctgcacacattttgagctcatgtggccagacaaaataaaaatccaaccctaattaggtagtataaaatagtacaagtctacaagccctctgactcgttggaacctcaaagcataatatgtgttacggttgcttaactgtttttcttatccagaaacgtgtggttaacgtataccgattgataaccagaggaacattggaagaaaaaataatggggttgcagaaattcaagatgaaca

SEQ ID NO: 62034 - DNA, 1587 bp, Homo sapiens
cctcctatctttagtcactttgtacaggatgatatccatgagtactttagtgtttgtatatgttttttcttttaaatagaacttgtttttataattgatttaaaatagggctttttttctataaaagccttaatgagccataattttaagaatataagaataatgactatgatattggtcagtcttagaacatgaaaatgtcagacaatgaatttaatcgggcccttggtggaaacatttatatatttaatgcagatgcatagtgtttttcaaatctttaacatcattttttcaacttttaagatataatatcaactattctaaatacaggtaatggtatatttaaggctaccataacatcctatttagagggtggttttttttaatttatctaatggctacgatatagccagattcaaataacatatgtactcaataggtttcaatcatatatataatatattttttgtaactatgaacatacacagttttccagaaatagattttacactgtttagaattccaacacctacagtggaaagactgtttattgtagtaatgcatggctgaagcataaaagggagagagaatttctttatatacacaaacatacatgaatatgcatatctatatgcatagatgtacctatcctgcacccaaaaaggtgcctggtattggcactaaaatcatgtagttatactgggcagcaataataattgggcatgaggctgattactcaatggtgagggtaggtatatgtagatagatgtgcatgtatgtgtttgtatatataattttataagtttcacgcataaattaatacatgcctgtgtgcatacatatgtatgggatatatttgtatatatatgtacaggtaataaacatccccaaggtttgtggctggccatacacataggcatcagtttaacaaccatcagacctcagctgtacaataacaggtgttttgtttaattaaaattatactgttctgcagcatttagacatttgtcacatttcattagctttgacaaccatactgtaacattaaacctagcattccacaagagaataaatataagattgaaactgtaaaatatatgcaactgtgtgttatttgtaggaaatggtcactagaaagagcaaaagattattcaggtatacaggttttttttcattgtttaggattttaactcaaaactttatgtagaacatttcagtatatttgagttgaatatttttttattaactatttatttgctagttccataaaccagctctttaacatagcttatagtaattgatattttcttagaataagtacagagcaatatatcattaaagggctatgaaggggcaaaagaaatcacaccataaaagttagtactttttcccaatctgaaatgtcagatagagctagaagtcagatatttaggctgtttaaactttctgagagtttaatcaaaaggtgtgtatttctagaaggatgactagaaaaatgatgtgtggttgcttctgaatgggaaacaggagtcagagctgacaggaaaacttagagtggctataacatttttaaaataatcttttgag

SEQ ID NO: 62035 - DNA, 1360 bp, Homo sapiens
gatgtccttgtactgtcttaagttagtgttgcttgtttttgttttgttctcccatgtttagttgcaattactggctctcaagctatagtttgttttcaaaaaggaaaaacaaaatagttttttactggattaaaaatgcttattttagaatcctcccctttttgaggctttttggtaataattgcttttttccagcccaggtgtggttttgtttgtttttttctatgtttgtgggttttttttcatctgtacaagaaattttgttatgcactactactttttgtattctagacagttttcaaaagttggcagatttttttttttgtttttaaggaaaaaggcatgctttctgactgacatgatcttttgcaatacctcaattttgaaatataggaaagaaaatgatattttctaagtaagtttattcagaaaaatatatattaatttaattctgcaagaaaatgatttaacagatgggtaactttatttttttcatgcttatttgtgttttttgaaaatgaagaagttagagctttataactataatattaaagatcatatctaacctacagaaatctacctaattatgtgaaagaagcaaaactttttgaagaagcacccctctttcatgtattaaaataacactgagatttttttaaaagctggaagattgtacagcataaagctaaagtgaaggcaaaaaacattgtcctgaagaataggttacaaaaaataaactccatttggtgctgaaagttgtgaatagatggtggaaactactttcccttaatttgtatatttctaatcaagtgttgattgtgcgcgactgaccaggattgtgaaagagttcttctgtttgtatttttttaaagagaacttttttagtttattaaattataacatgttcccttttgttttgtaaataaatgtgcccccaagttgttaatgttatattaaaagagagggtccttcaaaaaaattattttttaaaacacagaggtgttctgacctgcaacttgactgggaagcccctgggtaacacaggtcctgctgtggcctttccttggtgtgacacttgaactagtcgattttttgaaggctataacctaacctcgactatttgttgttatgtgcaatactgtttgtactgtttgtataaaaaatagaaaaaaaaaagaaaagaaaaaaggcataaatctttattgcagatttattttcattgcaaactttagacattgtgattcactgaaatcatttttctactgtcaaatatgtaccttttcttcatgctggtattttttcaatagtaatgtagcctttgtactgagacaaattttcattgttatttttagaaagattt

SEQ ID NO: 62036 - DNA, 1050 bp, Homo sapiens
gctggatgatcagatgtgtgatgagtgccagggcacacgctgtggtgggaagtttgccccgttcttctgtgccaacgtcacctgtctgcagtattactgtgaatactgctgggcgagcatacattcccgagccgggcgggagttccacaaaccgctggtgaaggagggaggcgaccgccctcgtcacgtcccgttccgctggagctgagccacgggccgacccagccacaagtactggagtagataacaaggagggaaaagagagggcactgcctcagggcttacagtgttctggaaatctgtgcattcgttctcgatttttaaagaagaattgggtctttttattattattattattatttacagtcatattactgaactcagtgtccagtataatgcagaattgcagagtgtagaatggtactgatttgcactttgattcacacctttgtctgcttggtaccttaattttttatacctgatttgtcactcgtgacagtatgtagactgccattctcatcagcggccgtcaggctactgtctgtgattcttttgtttgttgttgtggtgttgttctgattgttttgaactggagcatgcacttattttcagaaacttagagagttgcccctaggacaagacttaccaaaggtaatactcgtgagtaggtggcagatgtagcaaaaacttcacaacaattcagcaatcattagctcgggtcacttagagtaaggataacccttcatgaaaataagcctttagttgctctctattttgacttgtaaggatacctcataagctggatcttttatttttccttcatgtttgatttttgttttgccgaggattttggttagatcttttagtattatgtaaatttatgctgcaatagcttttgctgctattaaaatggtattattaataccataatactctattcaggctaggatatcaattaaacacaaaaacccaacaacacacttttgtgattttagggatagagtcagctgccgaacggagatcagaatagacttcagaaagcttcggtgg

SEQ ID NO: 62037 - DNA, 1031 bp, Homo sapiens
aaaagtgccactgtaattttcaaatttggaggctgttgccaaattttggagtagtatgagtttggaaagtctgtacccaaagaagaaacaagtccccctccacacacacaaaaaatctgtacctggccaggtacagtagctcacgcctgtaatcccagcactttgggaggccaaggtgggtggatcacgaggtcaggagatcaagaccatcctggctaacacggtgaaaccccttctctactaaaaatacaaaaaaatagctgggggtggtggcacgtgcctgtaatcccagctacttgggaggctgaggcagtagaatcgcttgaacccaggaggcggaggttgcagtgagccgagatcgcgtcattgcattccaacctgggcgacagagtgagactgtctcaaaaaaaaaaaaaaaatctgtacccaatttggtaggatcagatatctgagaggtaaattctcaacctccagagagcctctgctactggcatgccagttggagagaagctggagtgagctgggaaggtttaaggtcacacactgtaggagaggattagaaataaatttttctacataaaaaggcagagggatagtagtacatgttgaaatagttatgtccatgcaggttaagaagctagagatgaacacgcagagtttatatactttggaagaatcgtgtcactggctctgtagggaaggagaataatatgccttgtgggacaagccttcagctggacaggatgtctcttgagcagggagtgagcagcagtaggggtcagatggaggtgttgtggtgacaatgccattactcttgagtgttttcagtagaaacacatgtattatccttggattgaaggacttttgaaaataattagtagaattaatctgttttggaaatgtttatggggaaactagctttcactgtttgtgttttggcaaattctgccttattacagttttcattttctgagctcaagtgcagcagttttattgtagcttggtgaattctgaatggcgactgccaatca

SEQ ID NO: 62038 - DNA, 1042 bp, Homo sapiens
aaactgaaaaaaactggctgtgtctatggaaatcctgcagctaatgtccatttttctagacctactgtactctgccaagagggtatctcttagagaagcagagcaccatcatcagaaatagcaggcaaaagcacaccagcttattgttggcctttttaaaaacttttttgaagctttttgtgtgtgtgtgtttgtgtgtcaacaaagctttgttaaaatatcattcacataccatacaactcaccaatgtgacatgtgcatgtcagtggttttcagcatgtttacagagttgtgcaatcatcagcacaatcaattttagaaaatttatcatcccaaaaagaaactcagtgcctattccctccagcttccccatcctaggcagccactaatctattttttgtcttgatagatttgctggttctggacatattttgtctggcttctttcacttagcataatattttcaaggtttatccctgtggcatgtggccagcctagagctttgtagaaattggaaagcaggtggtgcttgtttcctggctacttgttagttgtggctaaggccaatggtgagtccacttgccctcattaaggataaccagatgtatttagtggaaattccatagatgtgttctaaacttgcttctgtgagtaattgtaaaaattaaacaaggtaatatcaatgagcacctaacttagttcctggacaaagtccctttgtcccacttgaacttcttagattttagtaagaatttgccaaaatgaaacaacagataatttgtaattggtactttgagtttaatgtactgattcttcctctacccttttgtttttgctctccccaaggctatgcctttctgctgttccaagaggaaagctcagtacaagctttgatagatgcctgcctagaagaagatgggaaactctacctgtgtgtgtcaagccccaccatcaaggacaagccagtaagtaatacatggccagctgttgcttttccagagcacatatgctattggaatagctgacctcctctttctgataa

SEQ ID NO: 62039 - DNA, 1029 bp, Homo sapiens
agtaaatcttggagatcaggtatcctcattcaagaggaaaatgaataagagatccagttcagagacctacagtgagtgctctccgctgcaggcagggattgatgagctgcttcaactcttaccacccaccactctcaatcctatactctaactaatgaactctgctcaccgttgtccaagtgagttgaccctttggcctttccatgccgtggcctgtgcaccttcctgaacttggaatgcctttactctctggaaaagtaatcagcctctgggtcagatatggcctttgctctttggtgttccctgatgtttggacaaatctgctccctttttttctccccagtgtcctgtaggagatacctccaacatagtgcttttaatgttgcttattagttattgacagtctgattttttctggatcagggttcttctttggcttgttcatctttgcaacctcagtacttagcatcatacctggcatctcctagatgtttttggtacccttgaattgaatccaaaaaaagtctcctgaggcaaaccagataagtcctctgacctgaaagccaaagtcagagagaatgtttgggacagactgcctgtaccaaaaaaagtctgaactcaggcagctctggctagagcagtgccctttaggtttctctaggaaggtcactggtaataggaagcttgattttgtgagaggagagagctgcctgtctgtccaggccatggacctttccttctagggttggtctcaatccaaaaccagccattccttggtctgccattttatgaatgctgcagtggttcaggatacagctccacaagctgaatttttttttttccatttgtagttggtacttgaaacaaatacatcactaatagtattagttgattttaagaactgttgattccttaaaaaaaaaaatacacatctctttttagaatgggagaccttgtagttttttttccacaaatttttatttaaaaaaagtcaaacctacaaaaaagctctaagaataatacagtgaa

SEQ ID NO: 62040 - DNA, 1029 bp, Homo sapiens
gaactgaaatggaaggtggaaatttggcagactgaggcagagaggatgttttagaagaggatatagcttgggttgggacttgctgacagtagttagatagggctaaggctgtgagcaggtgagaccaacagaggatatgttaattgcagagttaggaatgggaagccagctaggagggtctggtgaaattttttgaaaactgagagcaaagacctgggttgtctttcaaaggagaatggacccacttcagtcttgagaagactggcacagaaaaaaactcatttgaaacagcattaagaactgatcagaggaatgttaaagtccagggaggcgaagaaattaagactatcaaagctcaggcagtatatgcacaaggccagactaaagcttcatctgtctgtaggagagcatcacctggattgaaacagagttccccagttgtttgctgactgagggagtgtaacaggcagtggggcataagctaggtttgtggactcagatgtgggcatcagcatttactagctatatgacattgagcaagtaatttaacctttaagcctcagtttacttatctgagttaatactactcgttgggttgttaagaggattatgtgaggcagtgtgtgaaagcactaacacaatacttaggcttattaggtgttgaataatcttagcgtccttggtccttgcctgtgacttaaatgtaatgctcagtaatcataaaattacccaacgagtttgaccagttctctcccacacccccagtctggtctcagtttccttggtcaggtgcttgtttgaactgactgtgactagaactgacagattggcagacttcacaaggacctctttatatagggaatgtgtgattatgtaaacagcagattttaagtccaaatgccccaggtcactgccctggactgcaagactttgctaagaacacaggaagtagattaccaattttgaactctgaggtggttctacgctgccggcttgttttcttgtccattcccaactattcccacccct

SEQ ID NO: 62041 - DNA, 1002 bp, Homo sapiens
actcttgaaatagctgttgaattttttcccccaattaggaaaacattttaatgttgatcatccttttgtgtattatgtttccacttagagactcttcccctgaagcacactgattgtttcatggcaccgattttattgacagtgagaccctggaagtctgttgtggatgagcctcctgctaattttcattattttgaaaggaaagatctagggttttgaggaatgtcagcaatggtaaaggaaaagattatttagggtcagattttatttgtattccatagccctgtggttttatagatcttgtaaaccccaaacctgggaaacctagtggctaaagaatggcattgtacaaaattatctttatccacatctgtatattaagtgacttagcctgtttgggagcagagggcaaactagcaaaagacactccatatgaccttgcttccctgatttttggggaggctcatttgataatttatgagtgcatgaaaatatattgctttgttcatagtttgtcatttctgcagaatctagggaactttactggtgatattcatttgggtgtgttcctagatttatatagaagaatgttttgggttaaaggttttgtttgtgttacattctgtagatatgcttcaaggatacatttcatttcagaaaaatggctttttgatacgtattattgtgtaatattactcagcacaaaaagatgaagtgaaaatacttgtccttcctgtgcctcataaatgaatcaaattatagcttaacctgaggaaggcaagtggcttccttttatgtccggtttgttaggtttcattgtcagttgtacttctccaattctcactctcttcataacccacaaaaataagttaatatagagggctgttgcttgttctttgttttttttttttttgtttttatttgtttttttttttgagacggagtctcactctgtcgcccaggctggagtgcagtggcgtgatctcggctcactgcaagctc

SEQ ID NO: 62042 - DNA, 1061 bp, Homo sapiens
gctggagtaagttaatgttttttttttgagacagggcctcactctgtcacccaggctggtgtgcactgatgtggtctcagctcactgcaacctctacctcctggactcaagcgatcctcccacctcagcttccccagtagctggaactacagatgtgcatcaccatgcccggctaatttttgtattttttgtagagacagagtttcaccatgtttcccaggctggtcttgaactcctggactcaagtgatccacctgcctcggcctcccaaagtgctgggactatgggcatgagccaccatgcctggccagttaatgtttctttactgtagaacttttcgtagccttttattttctgaggtggaaaagcataacgtacgcattattttcccagattatttcatttccccttccccagctctcgttttctgagtatctaatgttactagtgttgaaggtaagaggtgggtttgggaacactcactgggaaatgctgatttgcgcatgtgcctgacactgagtaggcatgtaattcactgagtgtgggctatggaataaagcaaacctgtcagctctaggagaacgtcactggatgtctttggaaagctctttttgcctatagttgctgcaaatctatttctttcacccccagtgatcaaaacaaacatcaagggatgagaatttactgtctattgtttgttgctgccaggctaaaaaagatgggtggcatgagatgacagattttgttctgtttctttatagctaagctggggaaaactgaacaaaaaattatttggtcttcttatttaactcctagcattaaaacagtgtcttttttacactacctgggttgttcacaaaataaccagagttatattaataactttaacttttttgtaaaagaaatacatgttcagtatttttctaagggctatttatattctgttttagagttggctgttgtgacacaaaaacctaggtttcagggaaataaagatagtatagactaaatggggaagacactgctcttttttttttttaagagtatattaatttatttta

SEQ ID NO: 62043 - DNA, 1032 bp, Homo sapiens
ccagaatagacaaatctattgagacaaaacggagattagtggtcgcctagggctgagaggttgggggaaaaccaagagtgactgctaatggattaaatggatcaattgtgtgatatgagaattatatttcaaaaaagtcgtgtttctttaaaaaaaggcttgaggcaagaaaaggcttactttgaggaagcctagaatgactgatgcttggtaggtgatggaggagtatgtcttaagatgagtttggaggaaggaaagagaatctgatcttgctggacattagctcctggtaaggattttgaacttggtccaagtacaagaggaaatctttgaagctttaaagcaaggtcaaatgattggatttatgtttttaaaagagcacgtctggttgctgtttggagtgaagtgaaaagagaattgggttgccttgttaggaggtgatgtcaggcatgagatgaggatagttaggatagggtgatggcagtggagttggagagaagtgaacaaattaaagatagatcttggagaatgggatcaacagtagtgtttaacagatggtgtcaggttgctgaattaaccttggagggtaaataagaaggaagactcaaaaatgattttgagattctggctgaagtgattgggtgaattgtaatgccacatattgaaatgggactgggagagaataagtttaaggtagatatcaaaagttcacttgtaaacacattaagtttgtgatgcctaagaaataccagatattaatatgaagtaaatctatttttaggtaagatttctgtgtaataaaagggattctcctgttcctggggatctgaaatcctgccatctagttaaactctctcattatgcaaatgagaccataagtgaaatgttttttgttcaaagtcacctactggacactaggctggaacctatcttgacttctagggaatatgtatgtattttatgagggagtcatgcctcataattcctttttcttaaacccccaaagtgactgattgctgagctacttacaag

SEQ ID NO: 62044 - DNA, 1093 bp, Homo sapiens
taaattgtttttggaatgcatcccctttcgtaagttatgtaaacagtaatagctatgtaaattcagaagagatttttttcagctgggcgcggtggctcacccctgtaatcccagcactttgggaggccgaggtggggatcacttgaggtcaggaattcgagaccagcctggccaacatggcaaaactccatctctactaaaaatacaaaaattagccaggcgtggtgaccagcacctgtaattctagttacttgggaggctgacgcaggagaatcgcttgaacctgggaggtggaggttgcaatgagccgagatcgtgccactgcactccagcctgggtgacagagtgaacgagactccatctcagaaaaaaaaaaaaaagatttttttcattgaggtttgtagtacaggaggaatcagggaaaaaaatagagcttgagctggataatcctttctaatatttgagtagtgggaaagtgaagaagttaaaggtgtggagtgagggcaagtctgatgcctgaggaaaagtggaaagtagtagaaaatgagattggcctagtggtatttcaactatccggctgaaaagtctgaattattttcctatggaataaatagtttttttgtttgtttgttttttgttttctgtttttttttgagacggagtctcgctctgtcacccaggctggagtgcagtggcatgatctcggctcactgcaacctccacctcctgggttcaagcaattctcctgcctcagtttcctgagtagctgggactacaggtgccctccatcacgcctggctaatttttgtatttttagtagagatggggtttcaccatgttggccaggatggtctcaaactcctgacctcagatgatctgcccaccttggcctcccaaagtgctgggattacaaacgtgagccactgcacccagtcagaaatagttttctttaatgcttaatgtaatacactgtaaatgtaactccaaattatcttcctttttcagtataagctagttgtgtgacatttcacagttttatttatttttttacttatttattttgagacagagtcttgctctgtcgcccaggctg

SEQ ID NO: 62045 - DNA, 1026 bp, Homo sapiens
agatggtgtttcactatgttggccaggctggtctcgaactcccgacgttgcaatctgcccacctcggcctcccaaagtgctgggattacaggagtgagccactgcgcccagcgacttgtttaatttataaaatgggacaaaagctacctacttaatagggctgtgagataatgcatatagcatacttagaacagtgacaggcacatgttaaatacttgaaaaatttattactattaaatccagctgagggaagaaagagaggactaatgcagtggaggtgagctgttctgtgtacagctaactgacaacatcttcactggttatcttcaaagaaaaagagtcaataatgggctgcattatttatagatgttctaatacttcttggtgtgtttgcttgtaaaaacaaataatgatgctttcctgtttctctgtattgggaaacaaaacttataaaaaaaggtctaacaggttagttgccacttgcaacttttgtcattgaatgataaattgtggcctggttttctgtatacataatttctgttgatgaattccactgtagatttttctgtttttttctatcctttttgttctgtttttgcagacttcctggttaatcacttatttcagcaacgtttactacttctaaaacaaaaaggatgaatggtatgcatcaaatataagttgatgaggcatggatggaattaattttaatgagaactctcagaggcctgaagtttgtttaattaagcctgtacaaattctatcatgccattcacatgtcatatgttttcatctcttgagcattaagtgaaccctgttaggttagtatctgtgaactgctaggtttaaaaatttatttttcagtactcttgagatagcatcacagaaatctttttgtgttctccctaatattatggtagccaccatggtacagatgcctatatgttctgtatttagtactgaagaaaccatgaagagagaattatcccctaccctttttttttttttgagatggggtctcactct

SEQ ID NO: 62046 - DNA, 1048 bp, Homo sapiens
ttttagaagtatggcttatatttctgtaattctggagtttaaatgtgaccatgaattgcagtcaaaatggcagggtataattcactttgtgctggggagatttggtggacttcaactaatttgccatattataattagctctagactaggagatttaccctagttgttgggctttaacatagtgttctactgagtcctgagactgttggaaaaagtagtggagatggccatgtttgttttgtgtttcatttaaaatctgctttaaagacccagtcaggagttaagtgtcaaatcataaaaatagtaaggttctacaaagtctaaaaatttaggacatgtttatagcctgttcttaagattccagcttcaatgaaattgatatattatgcctgttgtttctacattaatcttatgttctcctactctaccattccaggaaccgaaataaggtagattgctacaagtatggattttaattttggtaatttaaatcattagacagaacaacttatttataaattacccttttcaaaccgatcatcattgtttctgtttgttaaacttaatgaatctccaacacaacttatttcactttacaattcttattcattgacttttgttaaagccccatgtaaacaccactagggaaatctgttaattatatgaaactgagtttcctaaacttgctgagcaagcactaccttgacagagcctcaggagtatcttagaagaaggagtgtcttaggatgggagaagttagggtacttaataaggttttggggcctggggttactcataatgtggttttagggcagaagtaaacaagatttgggtggggattggtaaaatgtataaactggcctagttgctgaaacttcggaatgcaggaatttaagcagagttaccatgaactctgtctatagcagtgctgtccaaagaaatagactgcaagctacatagatcattttaaattttctagtggcacatttgaaaagtaaaaagaaacacttgaaattttttaaattttatttattttttgtagagatgg

SEQ ID NO: 62047 - DNA, 1130 bp, Homo sapiens
ttaacgtccatgtagtgcaggtgctgtcaggtagaattcattttaagtaagattctctttggactccattcagagggacttagtgaagttttctattaggctaatgcatcttggtgatgtacctctcagcaacagagctcaagaacagagaggcactccactggggggaattatatatgtgaatctttctatatttctacaagtcaaggaagcctagatatgtattagtttggtgcataagtaattgtgggttttaccattatggcaaaaaagtaatggcaaaacccacaaattacttatgcatcaatttaataaaaggactagagctattttctttatgttgtaaatttgggtttaaatagcattgctgtcaagaaaagtttaggagggacttttgagagcacctattctagactactatgctcattttacagaggataaaatcaaagtcccaacatgtgaggtgacgtacccaggttcaggttgataatttctgtcataagcaagctttgacagcagattgcctggatttaagtctccactttgcaagttattggctttgtaatcataaacaaattatataaacgtgctggttctcaatttcttcacctgtaaaatgggaataatattagtttttggccttgtatgagttaaaatgtgaaactaaatataaagtgcgtagcacagtgcctggcccatagtaaagtatcccataaacgtagggttatgattattcttactgtaatggtgaccataggctttgcatgatcttgtcataatacggattactgatttttttttttttgagacaatgtctcaccctgtcacccaggctggagtgcagtgtgttatgttggctcactgcagcctccacctcccgggttcaagtgattctcctgcctcagcttcccaagtagctggaattacaggtgcccgccaccacacctggctaatttttgtatttttagtagagatggaatttcgccctattagtcaggctggtcttgaactcctgacctcaagtgatctgcctgccttggcctaccaaagtgaattgccgatttttcatacagtgcattctaaatatccccaaacttcagtgtaatgccatttgttcttttttcctgtct

SEQ ID NO: 62048 - DNA, 1003 bp, Homo sapiens
cacgcgccaccacacctggctaatttttgtatttttagtagagatggggttttaccatgttggtcaggctggtctcaaactcctgacctagtgatccacctgccttggcctcccaaagtgctgggattacaggcgtgagccactgcacctggcctacagtgttactttgatttgactttagtttcttagttctagagagaggcttcacttgctacttatagaggactgtttgaaacctatcttcatttgctacccagagaatagaatcttatctgcatatattcactgtaatggggtagatatttacaaaatttcataaatcaatatcatctgtcaattttgctttctccttataaatatggtgggagacccattacttttcattatccttgcttacattcctctctttggcttatgtatccctgggccatgcaatggtcgagggcagagaaactttctgtagcttgttcctgaagtatcaattttataagaaaatgtatatgtaaagaattattttgctttttaaacaagcatggatttcatagagcagcagttctcaaagtatggccttgcagaccccagggttctctgagaccctttccacggaacatgtgaagtcaagactatttcataatagtagtaaaacattatttgcatttttcactgcgttagcatttacactgatggcaccggcaacagtagataaaactctgcaccttagcaccattcaagacattggaaccaatagtagtaatgatcatagttttcattaccatgtgcatgcaaaaagaaaacaaaacaaaactagtttcacttaatgtccatgattaaacagtagaagatactcattttattaaccttgacttttagatacacatatttttaacaatctatatgataaagtgggcagtatgcatacttctgtatccaaagtatgataatagatacaattaagatgcaaactgaactggttgcttttttgtggcacactatttttacctga

SEQ ID NO: 62049 - DNA, 1032 bp, Homo sapiens
gcggtccatggaccggaacctcgggccgacggacgggaacccgggccgcgatcgccgcctccccgcctcaggctcctcctcctcgctctccgccgcctccgccggactcccgcaggccctgcaccgccgccgccaggctagcggagctgccccgggaagctgggtgacgggttcgcggctgccgccggactgcggcctactccgccgcctctcagtgctattgtccctgggcctggccttgagcgggtccactggggaaggccgtgtgcgccggctccgcggaagatgccggaccaagccctacagcagatgctggacaggtacgggcagctgtgggggggaccgggagccgccgaccctcgctctggccctgcccgcgcccgccctcgaggctcttggtgagcagaacccggcgtgccgggaggagttccacggccagggggccgtgagaggggcaaaaagtttggagtctagacctgggggaggacagagcgagcggcctgggtcgtagactttgggtgaaacttagctaaggagtggcgtctggtttccttggaaccccgttttgacctgagagggactcctgttaatccacaaaattagttttccttaccctcttcccctcccccttccccctccccaacttgtgaagtgtttgtcagcgatgtcactggcaagaaccgggttatctttcaggggaatgacccccttataattttaagtctctgtctgagaaccaatgataagcattcttttggaaagcctgataggctgatttcattctcccactttccctgaacccgcaccccccgtcccccccgccccatcccgtccccacctccgaactgtaaggtcagagtatccgcaagggagatttaacggtcagaccagagtagaggttatggaaaacagccaaatgagtccaacgctgaacatttagtgtacttgacgatcgttgagttcattgaagacgtttcagctcgtacaggagtccagttgcccattcttggggggccccagtcggtaaaactc

SEQ ID NO: 62050 - DNA, 1406 bp, Homo sapiens
atcactcgtgtaatactttgtttttccaagttcaagggattggtggtggtgaactggggagaacactgaatttaatatattactgtgcttactattcctcaaagaattattaggtcttataacaaaaacaacttgaggtttgtctccttgcactctggttcattagagaaggtgaagaattactgaaaagatagaggagattacataaaaacaaagttcagaaaacataagttctgtagaggaagacaaggaaaaacagaaaaagtagaaactgctctagtgggaatgtattggttgttttgtctccttagtcttttaatataggacagagattctgtaatataacatagcaggctcatcccattaagtaagagctgcagtatagaggaggctggagtcctaaagatataaatgtcatccttttctcttttaatttacagaagttgctgggtttgttttgctactgatgaagatgatagaacagctgaatgggtgagaccatgcaggtgcagaggatctacaaaatgggttcaccaggcctgtctacaacgctgggtggatgaaaagcaaagaggaaacagtacagccagagtggcatgtcctcagtgcaatgctgaatacctaatagtttttccaaaattgggtaagaatatctttaaaaacaacacagatatagttgatgttattatatataactttataagttcattttaaaatgaaccacctcttttttttagggtgtgaatttctatattccctttctcttgtttcctctctgaatgtcagacatttatttcttttgctaacagtttacagtatccttaatatatccccaaatttatccatttgcctgtgtattaactgtctgtttgatagaaaggagaaagaacttgcatacctgtgtggatataattgaataacaaagctctaataaaaagctgacttttaaaaaaaaaactaacttagcttaattatctggagacggtgtaagagaaagaaagcagtagtatgttctaatacttctccttaattcttccttttaaggaataaaagtagagaaattaaatatttaataagatgtgacgttaaactcatctttggaatccaatttatgtggtttctttcatgaaccctgctatcccttttctgtgaagtggcaggtaagaaataaccaaagatctttgagaacaggcctagcatggaaaaaaagtatagcagactgcttacaagaagcattctaaggctgcttctttagcagcagtataactaaggctgatatttagtgagcctgttccattacagccatacagttataaattggtgtcaatctcttggtttggtgtttataccatgccagttgttaaacatttttttataacccttgactgtaaccaagaggtatagga

SEQ ID NO: 62051 - DNA, 1145 bp, Homo sapiens
ctaaggagagagatagagggccgggcgcagtggctcacacctgtaatcccaacacttcgggaggctgaggtgggcggatcacctgaagtcggagttcaagaccaatctgacaaacatggagaaaccctgtctctactaaaactacaaaattagccgggcgtggtggcacataactgtaatcccagccactcaggaggctgaggcaggagaatcgcttgaacccaggaggcaagaggttgcagcagtgagccgagatcgtgccattgcattccaccctgggcaacaagagcaaaactccgtctcaaaaaaaataaaaataaataaaacatatacagttcttctggggaattttgttgcaaagggagcaatgaaatgaagcagtggggcaaaaaggctcaagaaaataatttggttttaatttttttttttaacactgaagaaataatagcatgtttgtttgatgaggatccagtaaagagtagggagaaattatgtaggatagtgggagataattgctggagctgtggccttgagttggtgaggggataggatcatctagtgcataagtgaggggattgacttcagatgggtggaatattggttgatgagtacatgtgctggagagcgtcgataaatgttctcttatggcttcagttttctgattaaaaaattaccaggccaggcatggtggtacatgcctgtaatcctagcactttgggaaactgaagtgggaggattgcttgagcctaggagttccagaccagcctgggcaacacagggagaccccatctctacaaaaaaaaaaaaaaatttaaataaagaaaattagccaagcatggtggcgcacatctgtggtcccagctacttgggggctgaggtgggaggctcgcttgagctggggaggtcaaggctgcagtgagccataatcatgccactgtactctagtgtgggtgacagagcaagaccctgtctcaaaaaaaaaatcgaattatcaaccatacgaaggttgaagtgctgaggttttatatatacttacggtctttaacttctactactagcatttgagggatctttggtgactaagatgacttttattgtgctttctgaaggagttataaacttaacccagcaaatttgtatgtctt

SEQ ID NO: 62052 - DNA, 1391 bp, Homo sapiens
ccatctcttgaaggccggtcctacctcttggctggctatgcttaatctcctagaaggaagatcaggaaaacagttgttttgctggaagacaaataggacttagaattatatcccagttccgtagcccagtctaaccaaatcaaataaaggaatagaagcaacaatcagaggtccccgcccctctattgtaatgtaatcagtctgggtcagccattttaatttttattcctgtgtggtatgaaatggcttgggaactttgtttttcccttgaatgagacatttcttataaataaatcaggactgatagctttccagcttattttttaaactttttatttctgtgtattcttttgaaattaagcattttctattaaaaaaatagagcttaacatgcaacacctcatttgaaaaagaagtaattctaatatatgctatctgtttcacaggttgtaggtcataaagaaggtctggatgttatggagagagctgatcctttattccttttaattggacttcctactattcctgtcatgctgatattaggcaagatgattcgctgggaggactatgtgcttagactgtggcgcaaatactcgaataaactacaaattttaaatagtatatttccaggtaaggcactgaactgtggttgtaaagtgcataccaaattgatcttgaagaacaataacatgcttttttagccatgtttgaaggtagtctaactcttctgatttattagcactaacgcactgcatttttttcctctagggataggttgtcctgttcctcgaattccagctgaggccaatcctttagcagatcatgtctctgctactcgaatcttgtgtggagcccttgtctttcctactattgctacaatagttggtaaattgatgttcagtagtgttaactctaatttacaaaggacaatcttggtaagacggctttaacattacttatattaccttgcaaaagagaatgaagtgtatttgtttttaaaaggtggggaactgtataaatattcggtctgtggctcctatgcattaagcctctatttgagcctcactatcattcaatagcttgagtggaaataaaaagaggagaaaccactgcagcagttctggccttttggaactatgttgtaggtgctttctctcctggcatatgcatgaatcatcacacctgtccctcttgccagtgggattacagtactttacgatcagaccacctggttcaaatcccatcacagaaattgtcttgctgtgaaatctaaatcaaatgtctggactttttgttcctgtagtatggtgatggtaataatcaggattattgtgaggattgtataagtactagcacatagtaagcactcatgttgtttgctattattgtta

SEQ ID NO: 62053 - DNA, 1013 bp, Homo sapiens
ccataaaaggagcatttaaagtttacttcaaacagcagcaatatttacgacaggcacaccgcaaaattctgaattatccagaacaagaagaagcataaaactgacttctggttgttctgcagttctctcatccttatgaatctgttgtgttgttttgattccatcattaatgcacttgtggagacttgtgataagctgctgctcctatattttttaagaaatataataaagcacttagggcaggggaaatcatctcggtaatcatggaacctaaggatgtgatttgttttcattgtttgtatgtactacttttatggcagtcatatgaaccattatcttagcatggtaaacctgggttttgttcatattttctccagacagaaatgcaaagatcaaactgtgcaaatattaaaaaaatgcacatgctgttttattcaaatgcctcttttgtacatgttcatgtttagtgttttctcagaatcagcaactcaaggtactatgaggatttttctcactgacataatttgattacatactaaataagaggatatgttaatatgaggaaatgtaaattaaattagttataaataaataaccaaaaatgtatgtaaacattcaaatgattatctgaacaaatgagattttgtggtgttttctttaacccatgtgatgtcctccaaaatgtgtagggtaaaaattcacagggcttccagatcactttttcaatattaaattttatttacataatgttgacatctcatacttcatgaagtaattttgactcatgcagtcgtgtgtgtgtgtgtgtgtgtgtgtgtgtgtgtgtgtgtatttgtgtgtttcagtgtttcatcaggtccttccatctctgggagttttttcaacccatatttctagaaattacagctgccagtttatagtagtttgagcagaggatgatttgcaaaaataaaaataaagttattttactctcctcttgcattgattcagttattgagatattcgttgatcac

SEQ ID NO: 62054 - DNA, 1044 bp, Homo sapiens
acattaatgcccttgacagggagtagctgcttggttttataggtattagggctcatgaaggccggggaacaactctaatccttttggggcaggagggagggtttttttagggttgcggggagggaactgcaagtgcctgaggaccagagtggcctctagccccgaattgaacacttttaaacctaaagagccttattattattagctcgagaaataccacatgccagtcttcccaggaaggtgacctgcctgaccatgaagcaacaaaagagcataggcagacttaaagttggatagacctgggttcaaatcatagttcagctttcaataactgtatgtatgattttggctaaaggatttgactttctctcaactgcagttttcttaatctttgaaatgcaaataatgtttatctcagaagactatttctaggattaactgagagattaaaggaacagcagcacttaggctcaaaatcgcccctacaaagcagtagttgtttcttaattgctaagtaatctgtttgcactctaggaaaagtaaatggagaggtaaaagaaaggcattggggacaaatgaaagagatgatgtagatttttcggatgggtgggtatattttattttccagtttattttcatatttctttactgtgttatttctggaaactttaatgttttaaacctcttttataaaattcaatgacgactactagaattcttttcaaaagttaacttatctccaaagtggctgaaaatattgtttaccattacatgattatgaaatgactgtgaagaatataaaattaaacttagtgacttaattagtcactgccttgctaactttgctgtaatttttttaaacgtcttgtttttaatatagcaaactatctcaatactggctggattaggttaaataaagaatttttatgttctctaggtgtactttgttaaatctcaaaacattctgtacatacataattttttttaatcacagttatcgagatactagtttttgtaagtaaaagtaatctgaatttaaaaaaa

SEQ ID NO: 62055 - DNA, 1315 bp, Homo sapiens
aaaatgaatgatattcctatagaatcttccttccctattctgtaaaatagtcacttgtccgaagaaagttaaaagttagctcttttctaaaagcctcctagcttgacatagaaggcttcacaacatttagaaaggtaataactttttaaaaattgatcctcaaatttgctttctacttgatggtttcatgtaaatcagtggaaaacattacatttggcagatgataaagcaatgtcatcttttattagtgaaatgctggttatataaggcatggttttaatctttttataaaatttgaacatgttttttatgccaactcgtaaaatgctagaaaaccctacttatttacaatgctagaaatacagacttaccttacatcaattttgtcctaaaccgaatttctcaggattactgtggtttctttcattctgattgaattatattgacctacttcttcatagttggtttgcagtgttccatgagttttacttttcctcatcaacatattgctttaacacaacatatttatttaacacgtacaaatagggtcaacttcagatcctactgagtgtgtgacatgcttttccaacatcagctttttgtaaccacctgtataactttttattacagtgaaattgcagtcagtatgtgaaccaaaatatcttgcccctttatgaatttaaaaggcagccaatacaaagccacctttttggaaatataaaaagtaaagccttgcattcttatatagcaggtcttcataaaactctaaaatcccttgttgctaccagtctaatcttgccttaaatgttaagttattttttgaatatataaatataaacatataaacacagatgatgactggagtagacttttaaaaaaatatttttttcatgagatactattttaggtgaaattgttactgtagatttaacagctgttttgaaatatttactgttattaaaacttgcttcaagagaaattgtgaatatatttccatatacaagcactagtaacagtaagtggccctgtcatccactaactcaggcaaagtaaagaatggcatttttgaaggacattttacctccccatatgatttgattggctaggactttcttctgtaaagtcataccttttcacatcttaagtttttacatttgccattttccaaatctcaattttgggcaagaacgatatagtcacaactatggggctgctttcaaaagcggggctccatttctactgtcagatcaatgtggtgctgtaaccatctttttatccctaccttcaagaacctccttatatgaagcctgtcttt

SEQ ID NO: 62056 - DNA, 1034 bp, Homo sapiens
tagaaacttcctcagaagtgagacccagaggcaccacagctgttggaggtggtagatcagggcagggcagctgaaggagataagccaagagcttggttttgaaaaggtgttgaaggaaggtagtgcatgtcctcatgagataacatggaagtatgacttttagttagcttgatctctagagagttgcattctgaattaattggttcaggaatggattatctaacaagaaatacagtaggagagccgtgttcatatgcggaacttggatgttaaaggaaacacagctaggactgtcactaagggatgaaaatgagtccagcattttatattctgggagtaactttagcatagattgaagaggattaactcacagagagtgaggagtgacaagatgggagtttgaataatgaataggatttttttcctaagaagaagaaaaagtcatctccaactttgtaattcttcagagagctcttctgctctgtccttaggaactgaaaccatcttaagtgctcatatttctttaagaggtgaatactctaaaaccttaaactagattttatttgctcagacaggttagtttttgaaggattaaaaatgacccaggtctcaaatgccacggtcatgactggctgatgtctgtgtttcaggctatatcgtcttcagcgggccacgtcgagctaatggcatacagggcttgagattcatcatccagtcagaaaagccacctcactacctagaaagcagagtggaagctttcttaattaccatggaaaagtccatagaggacatgacagaagaggccttccaaaaacacattcaggcattagcaattcgtcgactagacaaaccaaagaagctatctgctgagtgtgctaaatactggggagaaatcatctcccagcaatataattttgacagaggtaaggtaaaattagggctccaacatttatggcattcaagtaacatttgattaaggccattctacaaaatggtattcattttgtaggtgatattccgttacctatttgggg

SEQ ID NO: 62057 - DNA, 2325 bp, Homo sapiens
tgacagtaagtagagatgttgtaactttgggaatggactattttgacataacagtgtgggtgattacaggtgggctgaatttggtatagttttacgccaaagatttacttgggaacctctcctatttacagaattatgattagagataggtaattctgccaaaaaaatttttggtaggagggccaaataagtaaaattggagataggcaataattttgaagagaatgatactggaattgacgggtacttgaatgaaggggaattaggaagtaaaaatatcacaaaggtattgactatgagtcatgaaataaaatacatttataaaaatggaaactggaattataatatttaattggaaacccataggattctttggcagaaatagttttaggaaacccacaggtgcagataacatgtaatcattacaagtatatttttataagggattaacaaagacttttattgaatttatatattggggtttacaatgttgggttacttttacattaacagtggcttcttctgataaaaactcattaagcattattgtcaatattgctcaaaactgtgtaatagaaggtatattaaatgaaggaagagaagctttttttggccaagcttgattgtttggttgttccctatgcatgaaccatctgtgctgccttttccccccagctattttatcctcccaaaatggtgttctcctttcccccttcttcttcatgggccagtgcctacatcctacttctccttccaggcctattttataagctacttattccactaaactttttctaaaactcccagctagaaataatcacatctacctctggacttgcagcacaatttttctgaacctccctattcaagctacttagcacttctcttgtgttgggattgaagtgcatctccatcttcttgttagactgtacattccttaaagccaaagtctgtgtctagttcatttgagtagcttctaaagcaactggaacatattattacttcaggatacctttgttgaatgcttagagatacgttgagcccagctctgctgttgtgcatgaccagtcatcacagatctggtagtggtttatttccaacttttgccagtttattcctcagtcactaaaaccaggacaagactcaggatgtgctgatcccactacaattagagaaagactcaggatattctatgcaagagccataacagttgacttcaaagtgaggccagtgtagaaacaatatttcaaagtgcaattcatccttcttacttcttttgactctacttccctctttctgtctcctttcctaggatcttaatctcttttgcctcctaagtaccctcccaaatttctccatgttcaaaaatagcccagttcacatctcattctcaaaatgctaagtggtaggaaatcatgctgaattagccagctgatcagatgtgaatctttaaatagttcttcacttaactctccatggaaaggcacttagtatttaaaagtaaaatattcaggcctgggtggtggctcattcctataatcccagcactttgggaggccaaggtaaaaagattgcttgaagccaggaatttgagattaggctgggtaaaatagaacttgtttctacaaaaaatttaaaataaaaaaaattagctgggcatagtggcgcacacctgtagctacttaggaggctgaggtgggatgatcgcttgagcccaggaggttgaggctgcaatgagccatgattgtgccactgcactccagtctgggtgccagagtgacagactgtctcaagtgaaaaggaaaattttcaagcattataaaggagatgttttatttatctttatttttgttattattttttgagacggagtcttactctgtcacccaggctggagtatagtggcacaatatcagctcactgcaaccgagaagatgttttagaatatatatgaaaagggccaggcagccgggtgcagtggctcacacctgtaatcccagcactttgggaggctgaggtgggtggatcacctgaggtcaggagtttgagaccagcctggccaacatggtgaaaccccgtctctactaaaaatacaaaaattagctgggcatagtggcaggcacctgtaatcccggctacttgggaggctgaggtaggagagttgcttgaacccaggagatggaggttgcagtgagccgagattgcaccactgcactccagcctgggtgacagagccagactccgtctcaaaaaaaaaaaaagaaaagggccaggcgtggtggcctacatctgtaatcccagcattttgggaggccaaagcaggcg

SEQ ID NO: 62058 - DNA, 1052 bp, Homo sapiens
tctgtactttagttaatagtattataccaatgttaatttcttagttttgatggttatgaaagatgttaacattagggaaaactaggtgaagtgtttacaggagctctgtgtactatttttgcaagtcttctgtaagtctcaaattatctcaaacaaaaaatccctcataggtagcgctcactatgtcttcttacacctttgcagatgtaacccttcctcgccttaaggccttcatacctcagctcctgtcacggctgcacattgaagcccttctccatggaaacataacaaagcaggtgggtggttgaggttttagcaatcttttgtggatcattgcaagatattttttccctctagtctttctcaagattgttaaccagcatggtgtgataaggaacacattagagtttactcaaccctcttgctctgtggaggaaggtagagggcacagggaaagtagaatgatggtgattaactgaggacctaactttcatggctgcctcctctgctgttttctaccttgtgcaatcataggaggaaatgggagtaattatccctactctgtatagggtggcataattgtatagtagataagagcacgtgctgtagaattagacagcctggattcaaatcctggctctgctatatactagatctgtaatcttttgaaaatgtcttaactctgtgcttatctgttttcttttctgtaaaattagagttacagtagcacctacgtcatgtgtggtaaggattaaatagtacatgctaagtacttagcacatggaaagcactacaaaatttccgtggcagtctgtctcaagatccctcagtctcggccgggtgcagtggctcacgcctatcatctcagtactttggaggctgaggcaggaggattacttgaacccaagagttcgagagcagcctgggcaacataactctacaaaaaattgaaaaacagccaggtgtggtagtgcatgcctgtagtcctagctactcaggaggctgaggcaagaggatctcttgagcctaggaggttgaggctgcagtgagtt

SEQ ID NO: 62059 - DNA, 1034 bp, Homo sapiens
tttccttgtatactagaagaaactaccatcagttttcaaataaagattccatattttatatggctacctatttatgttgcttgcttatggagactttggggatggctttatagcgtagaacctaaagattccaaaagacttccctgaaaactagggataactttctgagggactaaagatatcccatagtgaaggcacttatagtccatgtcagatgctgaacaaatgtagcttggacaaagaaaaagcatgcacttttatgtaaagatcggagaggaataaaccccattcttaattatataacttcagaaaggggaaagaagggaatatcctagtaatacagtttatagagaattgaaatttgattataactggacttttgaaatgatttttaaaagatttataaaattaatgaacgcatgtctctttcactagtatatgcgatctcttaacaatttccgggctgaacagcctcaccagcatgccatgtactacctccgcttgctgatgactgaagtggcctggactaaagatgagttaaaagaagctctggatggtgagactttctacttaaagcttaatgctttcttcatttttttcctaaattcattttggtttattctgatattgactgtttatacttttaaataacttgtagttctattaaagctggctgtgtatatgttttataaaaacagtggtgggcaggatggctatagttaacagtaacatatacttttaaataggtagaaggaagatattgaacattcccaacccaaacaaatgataaataaacttgagatgatggatatgcttagtaccctgatgtgatcactatacattatatgtatatataataacattatatactctatgaatatctacaattattatttgtcaattaaaaataaaatgtaaaaaaacagtggtggctttgaagtggtttttgcattcaggcaggttagccacatttactgttttcaatctggacctacaccagttaattattactacttttagatttctgcagaagg

SEQ ID NO: 62060 - DNA, 2947 bp, Homo sapiens
ttgctgccaaacaagccaagcaggcacctgcctcaggcctttagcagtagctatttcttcagcctgggaagttctccactccaccccttagatatccccagggctcactcccttgcctccttcaggtctgagtccagatgtcacattgtaagagtggccttgactggccatcttatgtaaagcagcagtctttcttccctgctgccatcaccccatcattccctattccccttaccctgcttaattttaccccatagcactgtcaccaactaatatgtcaaatttaaatttattattatgtgtcccctctagctagattatcaactctgaggtcagggaatttgcctgatttgttcactctttatttccagtgcctagagaagagcctggcactgtagtaagcatataatacatatttgttgaatgagtgagacctttactttcttctgataaaaggtaagcaaggttgtatagtcaaaggagcaggtcatttaacttgcatttgaatcccagctctgctgccacgaactcaggggacctgaagaaaattatgtttcttatctgggaaatgaagtttagttgatcactgtggtggtttagttcttgtactctataattctttcttctttgttctttctcattaaaatatttttctattttatttttccctagttttggctgctgttatatgatagaaattatcaattattttactgacagttctctagctttactgttttggggaaaactcagggataagctaacattttcacaggtctcaatttttctaagttcatgtaattaccacagacacatttcccagtcctttattcctgtccaccaaggatgtgactttattggagagagagggaagacatgcaaatgctgtatctgttctgtcggccgtgctcctcccattagcctaagcacagccatgcattttggcccgttcccactgctcacataccctgcatttctaacttgtcagttctgccacaccatctggggtaggcagttccttctccttcttcactactaccagtgcgcacgcacacacgcacgcatgcacacacacacacacacactcacacacacttcaggcttctttttcagacatcttcttttttttcctcataagaaatagcctcaagaattcaaccatatcctcaggaaatcatattaaccggtgttcaatatcttgatccatctcaaaaggccatatcacattgagaagtaataaaatcagctattttactgtcaacattttcttccagcccatttgcttatgtggaccccttgcactgtaacatggcctatttgtaccttgagctcctcaaagactcactcaacgagtatgcatatgcagcagagctagcaggcttgagctatgatctccaaaataccatctatgggatgtatgtaagtacccacgccttagagccttccactcatcaacattttttatattgatttgatggaagcattttttgattgagggtgtgagtttaatttcttttttttttaatctttatggctaatcatattttctcatttaatttttaagttagcttttattctaagtgttcaactacataccattcatattatgcaaattttccttgatttctttttttttaaacgtctttcatcagaatgtcatatttttctactcaaacaaaattggaccctgatttaggtttagctcttacccattctgtatttgaaatcttggtctttggcaaaggaaaatgaagtcttccttttgtaaaacctaaggttggcatatactatttccctagaaatccagatcatgaggctgcatatccatactcttcggtcatgtttcttcattaccatgccactgcttgaggtatcaaagcatttcttttgtttttctttttgttagtcgctacatttatgctgatcctctccattgcaacatgacatacctgtttatcaggttattgaaggatgatttaaaagagtatacatatgcagcacgcctctcaggtttgagctatggcattgcatcaggaatgaatgcaatacttgtaagtaaaatgaaaaccaaagaaaaggcaccaccccgtttaagcattatgttgagcttgggaaaactattaacttcgcatttttaaacaagaaagttaatggtttttttccttgcatctttttgatgatcaaagaactcaaattagtgttagttccactaatgaatgatttaataaagtttagtgcatcttgtgaacatgtatgtgtgctacgtttatttgcatgctcttctgcctgagatgtttaacatattaatcctgaaagcatattgttctttctatataattgagtatattaacatccgtaagtagaagatatccatagttgttgtggtgattgaattttacttataaataggcaccctttatttctgcagacagtagtataaagtttctatgttcagatacatctgacattttaatttaaaacttattttgtagcatgcaccattacctactttatgtgtgttttaaaataagcatttattaaatccatctaagaaataactagatcctttctttggaatgtgtttccaagcttgcttatatctcaattccgagttaacatcccttttatggcacacattcatcttcacttttcttgaaaatatattgcatattttagtaaaaatgaaaacaagagcattttggggtactcgttgtttaaattcttacacaaaagattgtaggaattttaaattttatttattttccagtgacttttttttcttcacataaataaattctctggtagcttttgtttaatgtataagaatgtttattaatctaaccattcccagagtccacagaagtttgaagctcagagatcaaaattagctccaaatagaaaagtaatcatctgttttctcttttttctgttgatttttagtagcata

SEQ ID NO: 62061 - DNA, 1031 bp, Homo sapiens
gtctgtcttcctagaggtaaccactgttctgtttcttgtacattttaattgaaattttcatgtgtgtgtctatatcctttccatcttttcagaaataagattatattatgtgtagttagctatggtttttaaaaccctgtgatccatatttaagcatatagtatctggttacaaaataacgtatttttaaaattaacacatgaaccagaatttaggtatcccagttgaatcctattctcttttaaaagttagtttagggtcttctccacttcaccagcacagctgctgtggatacagctgtttttgttgttctctttttttaggagacagagtcttcctctgtcacccaaggctggagtgcagttactgcagcctcaaattcttgggctcaagtgatcctcccacctcagcctcctgagtagctgggactacaggcgtatgccaccttgccaggctggatgtagcattttaggacactccttggaattattttctgagcctgagccatagtgctttgagacccaaaacttggattttctggcttttcacttccacctgagaaaggtgcatagttgcctgtggggccgacctctgtgatatcctctcttttgttttgatgattttgtttttgtgaattgtgccttaagtttttgagctgctatttgccaaaagaaggaaatctgtcatcatgtatcataccttaaaaaatttaatggcagaacatttattcagattttccagttggagaatatttggatagctgtagaactttgtctttgattttaattctctaagtgactacacattttatccctatttttgcttttttatcagctttgataaaattgttggcttttggctgggtgcgatagctcacacctgtaatcctaacattttgggaagccgaggcaggaagatcgcttgagcctaggagttcgagaccagcctggacaacacagtgagaccttgactcaactttaaaaaacaaaatgttgactttgttatcagtacattagttatatttactgtgc

SEQ ID NO: 62062 - DNA, 1065 bp, Homo sapiens
ccagcagtgacttagttgggtagttctggctcagggcttgtcgtgaggttatagtcaagctgttggccaaggtttcagtcatctgaaggttcagccagggctggagaattctcttccaagttcagttatgtggttgttggccagccttaatttttcaccacatggacctctctgtagagttgcttgacatggcagcaggcttcccccaaagtgagtgatccaggagggaaagtgagtgatcaggatgcaagccgcggtgtcttttataatgcagtctcagaggtataccattaattctgtcatattttgttagtaaggcagaccaaccctggtgtagtgtgggaggggaccacccaaggctgtgaatctcagcaggcaaggattgttgtgggccaccctggaagctggctgccatacgcttgcaagggacttctgcctctgccttcctcctagtgtccagaaagacgaagacaggacagttggtattggcttctctgatctgtctcttccttcactgtacccccatctccctaatacaggggaaatagaaggcagatttcactctgctacaggagtctgcagtctttgtctccagcttcctacctgctgactcttgagtatgcttcaaggcccatgggacagcaactccagaacaaaactctaactattgcttctgtcctcctcctcttgaagagtgatttgattgaacatttttgctgaatgcgcctctatttccctaaccaaattgtttctccatcacaggatacagctatgagcaaactttggttcaaacaagatgataagttttttttgccgaaggcttgtctcaactttgaatttttcaggtatgtaagatgaatctagcttataaagcttataaaaatcaacaattacgtttccaggagttgtctgttcttcttaaacatccatgtctagaaataaaaggaattagagttatttcacctagaaaaggagaggctgaaaaaaataaataaataaaagtaaagaaaaggagaggttggccgggcacggtggctcacgcctgtaatcccagcactttgggag

SEQ ID NO: 62063 - DNA, 1079 bp, Homo sapiens
ttgtatttttagtagagacagggtttcaccatgttggccaggatggtcttgatctcttgaccttgtgatccgcctgcctcagcctcccaaagtgctgggattacagctgtgagccaccacacccggctgggaattttttaagaacacatctatctgggaactcagtagtgaaattacttactaagtgtttcctagtccctagtattcagctgttctggaaacctaagataccacttaagaaatatggccaacgtccccagtgccgaaagtcacaaatgcaggaactaagaaccgtaaaatctgcaaggctgtgccacaccagctagagatcaaattactgaatccagaaatccagaattattgacaattggtttttttttttaaatagacagggccttgctctgttgtccaggctggttgctttttactcctggccagttgctttttttttttttttttttttttaaataatgaaaagccttataaattaggttcaacaatcagtggcctgtgatctgtcccacttagcttttggaactagaacaggaaacagatccagtctactacaggttgtgtgaatcccaacctaaatctcaactttgttttttctttttttttttttagacagagtctcgtactgttgcctgggctggagtgcaatggcgccatcttggctcactgcaacctctgccttccaggttcacatgattctcctgcctcagcctcccaagtagctgagattacaggtgcacaccaccatacccggctaattttttgtatttttaatagatatgaggtttcacaatgttggccagactggtctcgaactcctgacctcgtgatctgcacatcttggcctcccaaagtgctgggattacaggcgtgagccaccgcgcctggcctcaactttgttcttaaccttgtgcttgaactactggttcacttaaaagttcacatgatcatctgggagaggtgtgggccagttcttaagaagtactgaaagccgagcgtggtggctgatgtctgtaatcctagcactttaggaggctgaggtgggcagattgaggggagtttgacac

SEQ ID NO: 62064 - DNA, 1076 bp, Homo sapiens
gcccagcacattcttggatattgtttatattgtcctgagtcaggttctttaaattcatatatacagtatgagtttacagggtttttttgtttgttttttctatctctagggttgccatagtttctaaatcttttgaaggaaaaactgatcgcacagaagagtggtatggaacccagtacaaacaagaagctataccggatgaagtcatcaaggtagggttaactcatctatgaataagcctgacatgtgaggaatcacaagaacattgctccctagatccaccaactaaggccccagagtgtggaagactgatgacctagtgttatctgtaccatcctaagagaaatcaacaagtagatagggagctggagtttagccttttcatgaagacatggtactctagccaccttctcatgtgtctatcaaaccaccagggttgtgcctcatgccataaaatgtaactaaagtgcagagtacatgggcacaggcaccagaaaggcaagaagcgatggaagtaggaagcatgagaaaccaatgcaagggctccaaagagctcacagtcttgctgtgaacacaggctgagagcaggctctaggattcataccatcttcacttcaggaggtgctatgttttatgcctcatgttatagcaccgttctttttgtcaacataggagaattatgattttcagaaaaggtatgttaaaacaatattttgtcccattcatcagtagtcaggattttgcttgtgaatgttacctacttatctagtactttttctttctttctcttttggttctcattggctatgtgcctttgagactgcgtcccttattcctgggaaaagaccagaaaactttactcaggctagattctagttaaactcaagtaatggacattttaaaaatgtacctgtgtaatgacatacaaaaaaaggaattagtttaagaaagaagatcatcactggtacttcacagatctctgacatattcatgatacagaagatcattgaagccctccagtgtgtgaaaatgtccatctctctaaactgagaggaaagctgatcttccatgaatta

SEQ ID NO: 62065 - DNA, 1055 bp, Homo sapiens
cggatcacctgaggtcaggagttcaagaccagcctggccaacatggtgaaaccctgtctctactaacaatacaaaaattagctgggcaaggtggtaggcacctgtaatcccagctacttgggaggctgaggccggagaattgcttgaacccaggaggcagaggttgcagtgagccaagatcgcaccattgcactccagcctgggtggcaagagcaaaactccaactcaaaaaaaaaaaacaaaaacaaaaattagccaggcgtggtggcgggtgcctgtaatcccagctacttgggaggctgaggcaggagagttcttgaacccgggaggcagaggttacagtggtagacattttttggtcttgtccctttctcccctagtagcaggaaggcctgtgtatttgtagtagacatatttgatgctagtctctggcagggaaaaaaacatagagcacaaatgtagcaagcaataataaaagtttcttgggtatgtgtgtcacgtttttaaaatctctggatgagccagcaggttttattagtcattcctgttaattctgcacctgagatactcctaggaaggagtactttttttgcctttttggtttttttttttttaaagagacaaggttttgatttgtcacccatgctagagtgcagtggtgtgattctagcctactgcagcctcaaactcctgggctcaagcaatcctcccacctcagttttccaagtagctggaactatagctgcgtgccaccccacctggttaattattacaattttttgtagagacgggtcccactattttgcccagattgctcttgaactcctgggctcaagtgagcatcctgcctcagcctcctaaagtgctgggatttcaggcataagccactacatccgcaacttctttgctttttttaggactgttttttaactgactgtttttaactgaccttgttacatttttttcccctagctactcttctttttaaattttagtcagtagcaacctagaggaatctctcctgcgagcactttttcatactaaaaataatggac

SEQ ID NO: 62066 - DNA, 1033 bp, Homo sapiens
tttcttatttagcatgttttctagaactggtagtggttagtgacagataggccagatcaggaacacctacagctggaagattagtcggtcatactgacaggtgagtcatcttgctttaggatatctaccgaaaagcagatgacaagaccaagtccagtcagccaggtagagtattttgtctagaatgaataaaaaatagacagtagttcagactactagcgttgaagttggggaggttcaacaaggggcaggtatttggaacagagattgggattctcaaaatgaatgagtatcatcagaggggagttttgattgcaagtactaggctttcagctgtgaggccaacattcagaggctagaatcaaacctctgggggtaggtgagaacaagcaggaacagatattatttgaattgggacctaattatttgaattgggaattgggacttaagggagaagtggaaccaatagcaggactgactttacaccaagttgcccaagctaattggctagaattccttgacccacaagattcaaaataggattggtcccagcctgtggttgagtccactggtgagggtgtagtgattccaacttcaatgattaaaaggcagtagaggcggagtgtccctgatagtgctacacagggatggcttagagttccacttgttcagaacttcttttgctcctctagtcttgtcattttttgttcacttatcttttgacatcactttacttctgccttccctccttgaacacttttttcttttctttttttttttgagacagagtcttgctctgtctcccaggctggagtgtagtggtgcagtctcggctcactgcatgctccgccttccgggttcacgccattctcctgcctcagcctcccaagtagctggtactataggcacccgccaccacacccggctaattttttgtatttttagtagagacgggatttcaccatgttagccaggatgatctcgatctcttgacctcgtgatcttcccgccttggcctcccaaagtgctggga

SEQ ID NO: 62067 - DNA, 1025 bp, Homo sapiens
gagatcttggatacatcatttttttctttcaatgtttattgaatcacttacgtgaaacctcagagttgacagtcctgaaagggggacttgtgaaaagttaactttatataatgtcatgaatactggctgtcatttaatttccttgaaccctgctcatctgcaaagtggggatagtgctttatctgtatgatgtaaaatgatttagcaaagtcaaaaagtgttgtacaaacacaaggtaatgctatattaaagttataccatataataaggatgtgctttttcatttttgtaagaaaaaaccatgatttaaattataattcttgctgctctagagccagtaattgacccagcaacacttcgtaggagtgcatttgctggagcatatgttttacttttgaaattgcatatttctaaatttgatatcttatgcaattaaatacctctttttactctcacatttaaagagaaagcacttttcctctacaggattggtctctgtgactgttaacagttgtaactgtagtaggtcagtgatacatggtgcaaaacagcctgggataatattgccagctgccagaccagactagggtggctcaagggtaagattaccttctttaatacccgctgagacaagtttaacattgcaaccaggtagggaaataaacaggaaactcttaagaatgaaaggaaccttagaggccatttaatccaactcctgttaggtatacacttggccctccatatccgcaggggattggttccaagacccccatggatatcaaaatccaaggtgctcaagtcccttatattaaatggtgtagtatggtactgtgtatctgttctgcagtatcccagctaagtagttaccagcttcagtttaacttcttccaaggatggggaactcattaaataccaaggtagccagtttcatttttgccagtcctaattgttagacaattattttgaattttgagacttgattacctgttcaaaggtgtttacctattattactcaatgatcattg

SEQ ID NO: 62068 - DNA, 1169 bp, Homo sapiens
tggttttgaggtttaaaaaatatattaagggtcaaaatttagaagtctttttcaatgaaaataacatgtgaaattatttagaaattaaatttctggtttgaggtacccagtaggttacaatgtttcctacgcagtttcttgccaatattttaagtccccatttattgcctaatccttaattactcaagaattgattatgatacagaaaatcttactgaaaaactagacaaagttactgacagctgtgaattcattagagattgctgagttgatcattctgcctttaacagcaaatgctctttttcaactctagataatttactgaggaattgaaaaacgaagaaatctttccttttccattcagtgaacaacagagaaagttgtagattaaatatttgtataacgtaatatgttaagttattcatgcctgacgtagtttagtgggggatggcgagatatagttcacataatttaaatggtttaaagtgatatatgcactgatacacataattgcatatgtagaaaatcctaaggaatctactttccccttcaaaaatctggaaccaataactgaattcagcacagtcacaggttgcaaggtcaacatacaaaaatcaactgcatatctatatatagcaacaaaaaaatagaaaattaaaagaagtatttataatagcaacaaaagcataatattactaggaatgagtttaaccaaagataagcaagacttctacataaaaaactaaaaacagtagaagagagcaaatattagccgagaaaaatgaaagaagacctaaataaatggagaagcatactatagtcatacattaggagacttgatattattaatatgttagttctctccaatctgattcatagactcaatgtaatcataaccaaaatcctggtaggctgtttttctttttctttttattcatttatttagagacagggtcttgcattgtcacccaggctggactgtagtggcgggatcatagctcactgcagccttgacctcttgggcttaagtgatctcctgcgtcagcttcctgagtagctgggattatgggtgcaagccactatacctgtttgtttattattatttttttttagatggagtttcattcttgtcacccaggctggaagtgcaatggtgcaatctcggctta

SEQ ID NO: 62069 - DNA, 1056 bp, Homo sapiens
tttttttccacagccgcttcctaaatgtttgtctaatttgtttcatagaaatttaggaggaaattctgttcataaaaatgtgtgtactttatattttaaaaatcctgtaggtgtcagcattttaatatcgaattttcttcattaacaagtactcagtttttaaccagaaacattcgtggttttccccgaaagaaatgtgattttgctctctacaatggaagtatgtttggggattaacagtatatttggcagaatcatcaaacaatatgaaactgcttaacaatgtggtaggaaagagacaacgatttagggctacagaaaatttttccaatggagtaaaatttaactgaagagagaaagggtgtacagtaatgaatttaatgtgttacagatctgctttaataaactatgtagtagctttgtatattttatttatttatattttcctttttaaaagtattatcccctagaagaggtgctcacagcggaatatttactggaagaatttagacctgacttaatagagatggttctcgataaactcagaccagaaaatgtccggtgagtcaccatacagattttactattatacactaaattttcaataatgattagaatctgaaaaaatttgaaattgtgaataaaatgcttttaaacattttatcaagcattacaaaagtagagaatagtataatgaagcaacaccaagcttcaaccattgatacatggccagtcttttttaatctatacccatccctcttcagtcatcccccttccaccctaaattattttgaggcaatatctctaaaagatgaggacatttttaaaaacaaatataattttattatcataaataaaatagaataataacctgtcttaacctggctttattctaactcaaacgcccaaagtatcagcccacctatctgactcatataagcaaatgaaggcaccctctttttcttaagccacagtaaagattacaatctcagaatcctcctgattgaccagtggttaacctggaaatcaaaagtccaaactcttatagtagcagag

SEQ ID NO: 62070 - DNA, 1050 bp, Homo sapiens
cgggataataaaatcaatctcacatttattaggatcatgaatcaccaaaaacatatcaatatgttctggtctttacatgctaaaagtagttttggtagctgtagtcttaatagactgttgaagctgttaacctgtacctgaagataagcattcaaaaccattaatatttagctgcatggttcagggggtcaaacatggactatataccgactgtaatgaaattccactaggagagtgctgagtcatttatttctttgtggtcagtgtatcattttctgtggcaattgatttgctcttaaatttgggattctcccatgaaaatcattcttcatagtttagaaatattttcttcagtaggagtcgtatatagctaatctctgtgatttgttttctccagcaactttacaaaatagtacccattaaagatattaggaatctctatgtgacatttcccatacctgaccttcagaaatactacaaatcaaatcctggtcattatcttggtcatctcattgggcatgaaggtcctggaagtctgttatcagaacttaagtcaaagggtaagtctcctgggcagcatcttctgagtgtccaccacatcttttcactctggctctcattttctcctgaatagtgtcctatgaaggaacattgttagatgtgaccattttgggttagtgagtgagatggtggttgttggcacgctgttgccttttttttttttttttcttttttagatagagatggggtttcgccattttgcctaggctagtctcaaactcctggtctcaagcgatccgcccatcttggcctcctaaagtgctgggattagaggcatgagccaccgcgcccagccagtagtctactcttgactgggaattgatttgaggaatcttcaggaaagcccccacttctgcaccatcttaaactgcttttctgaactgatttttttttcccaatcttttcgcaagaggttcattctgatatcttaggaacatacagtatgaatttttaaaatttttcttatcttcaaggaagccacatatgcaa

SEQ ID NO: 62071 - DNA, 1027 bp, Homo sapiens
ctgtaatcccagcactttgggaggctgaggcgggcggatcacgaggtcaggagatcgagaccagcctggctaacacagtgaaaccccatctctactaaaaatacaaaaaattagccaggtgtcgtggtgggcgcctgtagtcccagctacttgggaggctgaggcaggagaatggcgtgaacccgggaggcggagcttgcagtgagccgagatcacaccaccgcactccagcctgggcaacagagcaagactccgtctcaaaaaaaaaaaaaaaagacacttttaattccgtagagacgactatagtttaaaatgttgctggtttgtactctattatcctgtttattcacttaacattcaaataaatttgagttattctgtgtattagaactttatttttaaagttcatcttaagcaatatcagtgataattacaaaactttaaaagtccacatattttgctttttctaagaaatcccttttcttcccttccaggtaacaaatatactctggagactagaccaaaccaagaaggcattgatgtaagacaagagctactgaaattccattctgcttactattcatccaacttaatggctgtttgtgttttaggtcgaggtaagaacccttacaattttttatagaattggataatataagtttttaatgttggctttttcacagtgttagaagatggatataagatagagctgcttatttgctcagcatcttttgaaaatgatctacttgttagagaatacataggtggggatttttatgtttaaatcattgtgttcccaaaagaagtttaagtggagatctgaaaaaaaatacaaattactacagtaataggtgctctaagcatataaaagcaaggcaagcccagcctgggcaacatagtaagatcctgtctctaccaaaaaaaatttttttaaattagtgggatgtggtagtctgcacctgtagtcctagctgctagggaggctgaagatcgcttgagcccaggagttaaaggctgcagttaaagg

SEQ ID NO: 62072 - DNA, 1028 bp, Homo sapiens
aaacaagaacaacctggaaacttgggtgataggctacttctagtgagtatgaatgcatatgattactttgtgactaggaaaaggttaatgagttaaggttaaggttacttgctaggctgtttcttgcacattctgtcttcactggatctgttaagcattctgggacaggaatcttagtactgtgcagcactactgagctaaagactgagtttgagagcgccatctggtggctttctgtagacatccaatttcatgaaagagggactttcccagtgcccctatatcagatattataaaaacacaagaaaaaaaaattaaaccacttcaagaacatactctaccatagttttatctctgcagaagaaagacaggatctcacttagtagtgtaagtagaaccaataataaaagttattatgccaggatcttaggatatttccagtcaagatgccattttggagagacaccgatcattggaatttcatctcccagtccctaatttgcaaggtattatttagagaatttgactatttgtttttgacttacatattttaccctacttgaattagttattaagatttcatgagagctgttagtggtacactacatacatcgctggagagttataaaaatagcattgcatcctttttttaaccagtctagatcacatctatgagaattcacatcacaaatttaatggtttggcccaaaatagtaaatttctttccacaagtaacttggcaagttctaaaaaaatccctcagtgactctgttcaattaattatggagtacatagggaattgaaaattaaaataagcatgaatggaggccatgtggatcttattttgtcttttaagcactcataatacctactatctcatagggattttaagaagtggagatatagatacagatatagacatatttttttgagacagagtctcactctgttgcccaggagtgcagtggtacaatcttggctcaatgcaacctctgcctcctgggttcaagtgattctcatccctcagc

SEQ ID NO: 62073 - DNA, 1034 bp, Homo sapiens
gtctcaaaaataaataaataaataaataaaaagaaaattttacctcttaaaactgtgaatccagctctttcttcctctccggcatgtggggaaactaatgttcagagacactaagtaacctgcctgaggttaccaactaattagcgtcaagagcaggcactagaaaccagtcttctgactactgatttactttctaaataatatcattttaggtagcttgtgcttaactttctctgattatatagttggagttgtcatgctaacaagaactacaaatcacctgtacttactaactttcagcataggacaatgatttattatatacgtgttttctctttcaggttcattgtcggatcctccaaatattgctggcttaagtcatttttgtgaacatatgctttttttgggaacaaagaaataccctaaagaaaatgaatacagccagtttctcagtgagcatgcaggaagttcaaatgcctttactagtggagagcataccaattactattttgatgtttctcatgaacacctagaaggtgccctagacaggtaatgcagaataccctatgaattatccaactttgtgtacttatcacattaataataataattattatttccacagagatggcttcataatttaacaaaaggtattttaaacagtgtttttccctgtgttttctgaaaaagaaaaaatgagtgatgtcatattttaaatgagccttcaggcctacaaaatattttattgaggtatagaattttcagcagccctttccattctaactggtgttacatataaagcatgtgatgaggactaacctgtgataatgtcattgatctcttttcagacatacttctgttccagaatgctaaaccttaaatattctctcctcgttcatttccttgcttctcaaggatgcttagtagatacagaacgttttgacctgctgtttcaaccgtggggatattttgaaagtgttttctggagcaagctccattaggccgatttaatttcttggtcaaccgtggggata

SEQ ID NO: 62074 - DNA, 1039 bp, Homo sapiens
gcctcccgggttgaagcgattctcttgcctcagcctcccaggtagctgggactacaggtgcacgccaccacacccatctaatttttgtatttttagtagagacagggtttcaccatgttggccaggatgatcttgatctcctgaccttgtgatccgcccgtctcagcctcccaaagtgctgagattacaggcgcgagccaccgtgcctggctgaaaataattgttaataatggcttttcagtttcaagttgcttttgaattttccaacagtgacctactaacatagccccaatatgttagtattatattttatgctttgtttttcaagaaatgatttttactataaataggagaccattagcactatctgttgtaaagtactatgtgatttttaaaaccagtattatacatttagtgtgatatgttgatctttaaaattccgtatctcctctcctctaaagaagatctatcagcactgtaagagagggcgagagaaaaaaaaaaaagatctaggggatctaggggacagtcttagtagcaacaaacccctttgatttatcaattgttatgcagattggaagaatagttataggtgatttcagagaggaaaatataatggtgaaagcaaactagattttttttcctctctcaatctctagagattttaacacagaaaaaacttatctaaaataattgtatgcctatttcttccccctcttacttacgtttaaatctagctgtcagtctttaaggaacagtcagatctgtttagttttgtcttgtaggtaagaagcagatgtgctcatagagggttatttttcctctgtagttccagatatgtttttggctttacttaattatatactggcagtatattaacctgccagtagtagcagtttcagtttttttttttttttgtctattaagcaatctccagtatagacaaaagttacatctaccctactctcaaaaaacatgcgtaccccagactctggaaagtcccttcactgcactaattgcaaccaacatccctacatga

SEQ ID NO: 62075 - DNA, 3539 bp, Homo sapiens
ttaatcctgccatgtattatggttcttagctaagggattcctttggtagattagaagcattgcagactccccctactacctgtgttttatatgcagaagaaggagtgaaaaactgaaaactttccttggagcatttattttgacctagtttaatttttgtttcctggcttttgttatttgggattgtaagggaagaagaatggggctagggaaggactgtgagggtgataaacaggagctggagaataaaccagtgtatgatttccttcagcaccacctctgtccctccccttcccacgcttcctctttctctgtagttccagctttaccacaatcagcttgcccttgggcaagtcacttaaccacttatcttttcttttttttctttttggttatactttagtatgcaagcactgactgagcttttgtttctcatttggagttgaagaggatgactgcgaacagctgttacgacccaccacttaaggagaatggaaggattaaatgaacagtttataaagcctatgacactttaaaaaaatgagagtgattgttaggattagatttgtacaatggtattctatctttttttttttttttttgagatggtgtctcgctctgtcacccaggctggagtgcagtggcgcaatcttggctcactgcaacctccgcttcctgggttcaagtgattctcctgcctcagcctcccaagtagctgggattacaggcatgcgccatcatgcttggctaatttttgtattttcagtagagacagggtttcaccatgttggccaggctggtctcaaactcttgacctcaggtgatctgcccacctcggcctcccaaagtgttgggattacaggcgtgacccacggcacccggcctatatcttacatttcctaacagccctgaaaactccatgtggaagaaggatacttgtgaaacacccttggtacccaaactacaagaaactttctatagttacctctgtggcacaaggtctaaaacagaggttttattcacttgcttaaactttataacgtttctataaagtgttctgtgttaagcttgtcacttttggaatgaacaaccattgataggcatgcatcaaactaaaacaacatttgcaaaagcacttctctctagaatgatactactttagaatttctttaaattgcaaccaccctacttcatttaagggtttatttgttgatcataaactcctttccagagggccaggacatagagttacgatagctgatattctgcctggcacaaaggcaaaacatcaggggtgaataagtttaacaggattttattttgtacccaactttatgatctagctggtgtatgaagttaggtgtacctgttcctataactgaagagctttgggtaggtggttccctaagacatgttgttattttttagttcatgtattattaatagtacttggggtatatggtcttaagcattaatatgttgaggcatccttgggctcataccaccactatcttgtcaccctctgcttatttacctctaccttctgcaaggaactgggaatgttatgtggtgtggttttgattccatgccttttctctctgggctcctcctccacatgcatgagtgctataggccttgacttccacctatggttttgggagtgggtggatggattccacagaagggaggttttggtttgtaattcactattaacgtgatcactcacctgttcaggtttataggtcattatttctaaatcaggtctgactttaaatttgtgagagaccaatggaggtgagtaggaagcaaaaagcaaagtaaaatttcccaatctgctactatattgatcatgaaacactttaaagagagatgagaaagactgaaaggtcacctgaataaaagattctttgcagagtaaaatttactcttggtgtggaatttggaaatgaccttatatttggggatttgtttttgcaaacctgaaatttaggcctttacatgtcttagtccatgatcttgacctggagttcctgttgtagttcattagcaccacgcttcttgtttttccactgtattcctcatgctttttcctcattgtcaggcttcgctcacgaattcccttctactttgattgattgtccccttgccttttatttggtgtgcttctactccccctcctagacagggttactcccatagtgccccagggaaagttttgtcaccacacttaaaagataatgacctgggctgggtgtagtgtctcatgcctgtaatcccagcactttgggaggccaaggcggcagtctcttgcgcccaggagtttgaaagaccagcctggacaacatggcaaaaccccatctctacaaaaaaattacctagagactaggcacggtggcccatgcctgtagtcccagaactttgggaggccaaggcgggtggattgcttgaagccaggagttcgagaccagtctggccagcatggcgaaaccctgtctataaaacaaaacaaaaaattagctgggtacggtggtgagtgcctatagtcccagctactggggaggctgaggtgggaggatcacctgagcccgggatgttgaggctatagtgaaccaagattgtgcctgggtgacagagtgaaaccttgtctcaaaaagtagaaaaaaaagataatgacctgtttttatatctgacttcatcactagtctaggttccttcaaaacaagggctctggtgtactcatttttgtaaccatttgcatagtgtgatgcctggaccttaatagacttccttaagtgtttgtttggatgtggaggggaggctggacacaggactgggagttaagactgagtttgattataactttttgttgtatgatcttgggcaactgatttattaaactccttgaggttcagtttccttgtatgtaagatgaggggatctagcccacctggggatcttgttaaaatgcagattatggctcagtaggtctctggtgggttctgatattttgcatttttaacaagctcccaggagaagccagtgtagccagtccctgaactgcaaaggactagataacatctagtggctcttccagcttttatcttctgtgattatagtcattgttttaaattctgagcagaatgacaaaatatatgttgtaattactaaatatctctccagtttatcagagtgctgaaaagacagttctgtgccttatgaagtttccagtgtatgacaatgtccctagaattgaaagtaattttattgctcctaaaattttaactttaacaagttaaaaatataaatgtctgggaaagcatttgagttaacactagctcgtcatctaaattgtcagtatgcttgcttattggagaacatttgccataaataaaattactcttgaaggctttatgctaatgatctgaagtagatagacaggtgatcttatgagtataaatacagagacaggcaagctgttgatgaattcatcatcagaggaggaagagttcccagtcattgtcttcacttctccagaaggt

SEQ ID NO: 62076 - DNA, 1075 bp, Homo sapiens
tgtttggtataaatattgaaaattgttgaggggagaatttattcaaagtttaatcattttgcttttatctatgttatacttagctattagttactggaagtgtcaagttttatttttagatcttaactagagtctaaagtaattactaaaagctagttttcaaataatatgtaatgagtaaagtcctgagttaaaagatttagcatactgaattaacttagttgactgatgctgtacttacatgggcctcctatttcttgtggccaagatagcatcaacagaaataattgaaataattgtctcgagacacacctgagaaggtttaattatgttaattgtactactgttccttagtgagccttcttagtttagcacctctttggtatgggtagctgctttccagtattcaagtggtactatttccaggatgatttttggcggttgatatttgtaatatcagtaattcatgtatctcccccttccttttattttactgtgttttatgatattttgaaaagctctatttttaagaacttttaattgaaagatggcagtgttcaacttaatgcatttttacaaactgaacgtacctgtataaccagcacatgacctggaaccccaaagcccccttcattctcctttccaaatccaatcactactcccactcccaagggtaatgactatcctgggatgaaagcatagcttgattttacttgctcttctgctttgtataaatggaaggttacagtatttactcttttgtgtctagcctctttcactcaaccctatattagtgagattcatgtttattgtgctttgttctatattattcctttttattgctgtatactttccattgtgtgcatgtacaatttatcatttcactgttgattgtcatttgatcatttctggtttgggctagtttgaatagtgttgctatgaacatataaatgcatttatttgggttatttatctgttactagcattgttaggtcatagtgtgagctttagtgtatagtgccagtttttgaaaatggttgtacccataccaaattgcatgtctgtagcagtgtgt

SEQ ID NO: 62077 - DNA, 1007 bp, Homo sapiens
ggccaggctggtttctaactcctgacctcatgtgatccgcccgcctcagcctcccaaagtgctgggattacaggtgtggatcatataattctttcttgtgggagatatcccatacagtgtaggttgcttagtggcatccctggcctctactcactatgtgccattagcaccttcagttgtgacaataaaaaatgcctctagtcattgccatatgtcctcagcgagggttggtgagtgggaatagtcacccattgagaactacttactataaacactggctcatctatagcaattataaagggataattatttacctggtttcctaatagtcttataaagtataatcctattatcagcctacctaatgaatgtttttgacctccagagatgacaaataacatctggaattcacataagtatgtgttaagaatgctggtaataacatggtggttatggaggtggttcatttgcaccttagccactgcgaccataataatgatgatgattttataataatcaagttaccattcatggatgactactgtgtaccaggaactatgccttggtgaagtttatataaacatattttacaggagaaactctgtgaaaggttgtctgagtgtgatgcaactataggtgcccctgtcaatttaatgagccatgtatacatttcatctgactctttttttttttttttttttttttttttttgagatggagttttgctcttgttgcccaggttggagtgcagtggcacaatcttggttcaccgcaacctctgcctcctgggttcaagcgattctcctgctcagcctcccgagtagctgggattacaggagtctgacaccacgcctggctaattttggtgtttttagtagagatggagtttctcgacgttggtcaggctggtcttgaactcccgacctcaggtgatcggcctgccttggcctcccaaagtgctgggattacaggcatgagccatcgcgcctggcctcatctgactcttg

SEQ ID NO: 62078 - DNA, 1003 bp, Homo sapiens
gctttttaagacctttgcccatttagaaattttttgttgttttgttgcagattttaatatattctggatattaaccccttatcagatattttttcccactccacaggttgccttttcactgtgtcctttgcacagaaattttttattttaatataggtcagtttatttatttatttacttatttacttagtttttgagatggcccaggctgacgtgcaatggcgtgatctcagcttgctgcgacctccacttctcaggttcaagagattctcctgcctcagcctcccgagtagctgggattgcaggtatgcgccaccatgcccagctaattttgtatttttagtggagacggggtttctccatgttgttcaggctggtcttgaactcctgacctcaggtgatctgcctgcctcggcctcccaaagtgttgagatgaacttttaacttggtggagtgttaaacagcatggtcattttgtgtctaaagacttgggtttgaatcctagctcttctattttatacctatgtggttccaaccaaataacttttctgagctttaatttccccatccagtaaagaatgggactaataggatctatataaggggtttattgaatatattatatatatgtataatatataatagatttattccctaaacaagtatatgtgccacaagatactgactgagtattcagtaagcatctgttctgacatactggctttgcttctttctaagcttaaccccttcacttacgtactagattccttactctaggacaaggttcctgtaaagtttccttctctctttctctttcattatcagtttttctcctctctttatgtaaatcttttgtggcttagatgttgattgattgattgattgattgagagatatgtagatacatagatgggagtttaattatagaagcgttctgtactttaatgaggctgtctcttggatttaagtggatagaattggttgcattgattttcatccatta

SEQ ID NO: 62079 - DNA, 1037 bp, Homo sapiens
aaagaggttaacttgctcaaggatacacagctagtaagtggcttagcgagatatgaattcaactgggctcactcaagaacctcaggggttggccattatattgtcttcttcctagaggtagcacgatatctttagtagagatggggacgttaaaacagggagattttttagaaagaatatacatggtagttgatgatattgagtctgaagtgattactggatagccaaggggagatctgcaggaagcatttgaaatatgactggaacttggtaagaaggcctgagctgatttcctaaatctgaagatagagttgaagacacggacatggatggatataggaaaaataatctatgtttagatgcggtgggggagggggcagccttgacaatgctcacatttaggtataagaaggaaacatagttggagaggttgggagttagagaggtggaagatgatatcggaagtgaaatagtctgaagttctagccaaagagattttggggagaatagggtcttgagaaaagaacaaataccatttctttctttcttttcttttttttttttttttgagatggagtctcgctgtgttgcccaggctggagtgcagtggtgctcactgcaacctctgtctcctgagttcaagcaattctcattccttagcctcctgagtagctgcaattacaggtgcccaccaccatgcccagctaattttttctttttttttttttttttctgagacagagtctcgctctgtcacccaggctggagtgcagtggcgagatcttgacccactgcagcctccgcctcctgggttcaagcaattctgtttcatcctcctgagtagctggaattacaggcgcccgctaccacgccggctaatttttttatatttttagtagagatggggtttcaccatgttggccaggctggtctcaaactcctgacctcaggtgatcaacccacctcagcctcccaaagtgctgggattacaggcatgagccagcacacctggctactgttatttcttgatctcttaa

SEQ ID NO: 62080 - DNA, 1373 bp, Homo sapiens
gagtctttgaaggaaatattgaattggatgaacaaagaaggagagttgagaaaatattttattttttggagacaggatctcactgtcacccaggctggagtgcagtggcacgatcaaaactcactgcagccatgaactcctgggctcaagtgatcctctcacctcagcctcctgtagctaggactacagacttgtgccaccatgcctggctaatttttaaaattttgtagaggcaggatcttgctatgttgtccatactgatctctaactcctggcttcaagcaatcttcctgcctctgcctcccaaagtgctgtgattacaggcataagccaccacaaccagaagagaaaatattttagatagaaggaatggtattagcaaaggttcaaaagtagggaaattcacaatatcagcaaaggaaagtgaaattttgtcttattggatatagagaacctcagatgctttttgagcaattcagtgacatatgaaagctgtatttttggctaattaatctggctgttttttgtaagcactgtttgaaacgcaggcagagactgatgagggataaagaaggtagtacaaatgacaaggaaagaagagtgtctgcagaagacatgtgcaagaaggattcagcagagtttagttattgattgatgtagggacgatgtgggagtcagagaagcctgaggtcttgagcgtgagtgactttgagtctagaataggaggggccaccagggtagggaaaactcttgtcggggagacccagctctgggaagaagttcagctaggtgagatgtttgtcctgcctggcaggtggcaggttttccaaaggcataccaagagaacgaaccactgcttgggtacagcagtgggcacagtcttgtaggcacttttgggctggctgttaccctcaggtcccgtagggtagtggacaggactgagcggtccttaaatacccaagggaatgaaatctagtttgtagattggtagctcagggactagttcaattgaaagatcagaaccacattgatgaatactgacctactactggggtttcttatttgttttgcttaaggataggaaatggatccagagcctagaacaagtctgacctgtgctggggtctaagtggattcagctgtaacgctcttgctgctgctgacgatgttaaccataaaagatttagtagctaatatttattgaatgcttattgtatgttatgcttttttgggtggggggtagtcatcccctcaagcatttattctttgttacaaacaatccaattaaactcttttagttattttgaaatgtgcaattattattgattatagtcaccctgttgtgctatcaaatcctaggtcttttttttttt

SEQ ID NO: 62081 - DNA, 1218 bp, Homo sapiens
ctctgtcgcccaggctggagtgcagtgatgtgatctcagctcactgcagccttcatctcttgggttcaagtgatcctcccacctcagcctcctgagtagctgggactgcaggctcatgccaccaccccacaactaatttttgtatttttggtagagatggggttttgtcatgttgcccagggtggtctcaaactcctgggctgaagcaatccccctgcctcccaaagtgctggggttacaggcatgagccactgtgccaggcccagtatatgtttcataaacactggtttcctttctgtttttctgttggtattttatatctcctaaacatgtagccagaggatcaggctaccttttagccaggatgacaaggctagagcactttccctccacaggggtagatcctctatagatatgttaggttctggagccttctcatttggcttgtcttcagtctgttttcactgttctgttagtttagacattatttgaatgtctactctgtagtgatcacacactgtgtccagtactatgtaaatgcaaagataaccataaatcttgtcctcaaggagctttcagtaataaacagtaaactgctttacctctgaccttttactagacacctccacttttatgttttgttgtttctttcaattaattttgaaaaacaacttagtattttatcaccatactgattacttttttaaaaagtgggactcacaaaattattttattcttctcaaagaactgtttagtttctttttgcctattaaaagtgtaactttttttttttttgagactgagtcttgttctgttgcccaggctggagagtgacacgatcttggctcactgcaacttccacctcccgggttcaagtgattcttctgcctcagcctccagagtagctgggattacaggtgtgtgccaccacacacaactaatttttgtatttttagtagagctgggatttcaccatgatggccaggctggtcttgaactcctgacttcaggtgatctgcccaccttggcctcccaaagtgctcggattacaggcgtgagccactgcgctcggaataactttttaaagtaggactcacaatctgctttctgaagggaaggcatcacactctgcctgacacatagtaggtactcagtacatatttactgcataacttaattgattaatggtcttttttcaaaacaatttttttctgtaga

SEQ ID NO: 62082 - DNA, 1282 bp, Homo sapiens
ctatggtgaagccaacaaattgatggatttgttagtgtgagcagccgaaactttgcaatttctaataagttagagaagtctgggtaggaaactaatgacttggcagtactctttcttagagtacacatagtccctaaagcttctctgagaattttgataactttgaggaatgtgtgatctgtatgaatttcctatcacttagtcctgacaatgtgaatggtattcatttggtaacttaattttatacgtccaggcaagatactagtttaggggatgccaaaaataatagactaattggaaaagctttagccacatgagagcaattcactccacttgatgctcttggcctacctcagtataagttggttctaccttagttttgttgaagttttaataatactgtacattcatgttggttatatgcattgtgtaagttttagtatagttggcaaatgaaagcattaccagatactacctgggagttaagtttcctaggatcacagatttggtcttctgatcacttggaagtatacttagagtgggctgtgccaggggaagttgaggtatccttcttaaataagtagcaacttggtttatctagtgataagggggaaataatttcctgtttggcactttctccaaaatatatgatactcaatgggaaaaatgaactcaggtcaagattatgtctctccctttggcccagacatgtattgagtatataattgtcttattgatgctactctgtggactgtgatattagttttcccataattcctcttaggatgacatttattaggcaatgtagtttaacagatatttaagaacctactgtgtgctaagcatggtagttgttgctggggaaacagtaaactagacagtatttctttctgtagtgatctgaggtttagtgggtaacacattaaaaaaaaaagataagagaggtgatgtttagaaaaggtgtataaagggtgctgtaggaatatatagcagacatttaatgtggtcttggttggagcaggtgggggaggcacataggatagaaaggacttcctgaggaaataatcatttcaactaaatacctactcaggcatttccgtagaatgaggactcttgatccagtcggcagtgtagaccttctgtgtctattcactcatttaaaaatggggctaataatattaccaacctcacagtgttgtgtggacaaactgagtgagcacaatgcaaagcacttgaaacaataagtacctggcacatagtaagtactcaacttattagtcat

SEQ ID NO: 62083 - DNA, 1069 bp, Homo sapiens
tgaaaaataagtttggcatttttacaagttaaaacctgttagtggctgggcacagtgtctcacttctgtaatactagcaccttgggaagctgaggtgggataatcacttgagcccggaagtttgagaccagcctgtgcaacacagcaagaccccatctctaccatcaaaacaaaacaaatctattcgtatctgctctaagaagctgccagaattgtaatgtcttaacatatctttgaacatttaaaaaattatatttgtgaaacttgagacacttataattttactgtctgctttagcaatatcacttagtcctgatttaatctccatcaccaacaatgtggtcaaaatttcgcatttttcttgacaaatgtagttagtgaaaatgtcattgataacctgagaactaagagctcttgaatgactttgtgtatttctttttatagaccatttaatttggcagagcggaaagctagcgcccattcaatagtagaatgtgatcctgtacgaaaagaagttagtgtacgaactggaggattggctgacaagagctcaaggaaaacatacacttttgatatggtaacatatggtgcaatttctttattatccactaatgtaaaataattttaatatacatattttacctggaaaatggtgtatacttagaaatttcagttgtctctgaattgtcagatggcttctagtgggctgaattatgaattagttaacatacgaaaaacaaaattattaaaatgagtaattttgaggttgatttttttttttttaatttttttcgttaggtgtttggagcatctactaaacagattgatgtttaccgaagtgttgtttgtccaattctggatgaagttattatgggctataattgcactatctttgcgtaagtaaaagggtgttttttctgatttatgaaaaagcttaaatgcttgtgttttttgttgttgtttgtttgttttttgagacggagtttcactcttgttgcccaggctggagtgcaatggcgcgatctcggctcactgcagcctctgcctcctgggttcaagcaattctcct

SEQ ID NO: 62084 - DNA, 1148 bp, Homo sapiens
cagcctcctgagtagctgggactacaggtacataccaccaagtccggctaatttttgtatttttagtagagatggggtttcaccgtgttggccgggatggtcttgatctcctgaccttgtgatccacctgccttgacctcccaaagtgctgggattataggcgtgagccaccgtgcctggccgaacttggctttttaagtagataggttccattggtttctatgtaatgctcagggatgaagatggctaagaagtgtgacaggtttatggagggtgtgaagactactgtagaacagactgttgtaaatgacttctctaacattaggttagttgtttctttttttgttttgttttaacttgctttgccatacttatgtttaaatatattataaaggaggcccatgtattttaactgccacagtaaatggcattcttcctttatattagtccttattataatttcaggatcccttggctggtataattccacgtacccttcatcaaatttttgagaaacttactgataatggtactgaattttcagtcaaagtgtctctgttggagatctataatgaagagctttttgatcttcttaatccatcatctgatgtttctgagagactacagatgtttgatgatccccgtaacaaggtaattcagtctttgagaatgaaatgtctctgaattttaatgtgtgaggctttgagaagtcagagagagagagagagagagagagagagagagagagagtgtgtgtgtgtgtgtgtgtgtgtgtgtgtgtgtgtgtgttttaaccaatctaatggatgttcttttggtattttggtcagagaggagtgataattaaaggtttagaagaaattacagtacacaacaaggatgaagtctatcaaattttagaaaagggggcagcaaaaaggacaactgcagctactctgatgaatgcatactctaggtaagaaagccatagtctcttccctagccccattttcttttaagaagaattaggaacttggagaaagtcaaattggggtgggtcagggtatgtgggtcacgtacctagagtttgtgttataaggaggggtcattggtaattggcttgagatttatatggaaggaaccaatattggaagaatgttgaaaggaga

SEQ ID NO: 62085 - DNA, 1735 bp, Homo sapiens
tatctgcttatcagtttctctgagctacaaaattattgttaggattagaagtcttatttcttttctggcttgtagttgaaaatttctataaaatgccataacaattacagttgcaactctaaaaaagtttgcatttaaagaaagaagaaaaatataacataaaagtgattaagatcatggaattttggatgatttcaaaattttaattaaattttcacttaatggctttccaataaaatggaaattttattctgtggttgattataacttaatttcatgtagaattttgagaactgaactaaagactaggtaaaatttctttaggtacatttcactaaagtataaaatttctatttttccttttttcttgtatgtagacttgtataaaggtcactttttatgaaggtatgtgacaaagaggagaagctaattaattcagttttcccaaattagagctaacttcaatgcttatttgtattaattgcctaatctggattaggaatgggtagataatggtagaaaaacatgagatgaatagtattattattattattattatttttgagacagagcctctctctgtcccccaggctggagtgaagtgatgcgatctcggctcactgcaagctctgcctcccgggttcacgccattctcctgcctcagcctcctgagtagctgggactacaggtgcccaccaccacgcctggctaattttttgtatttttagtagagacggggtttcactgtgttagccaggttggtctcgatctcctgacctcgtgatccgtccacctcggcttcccaaagtgattacaggcgtgaggcaccatgcccggtggagatgaatattataattcagatctatagtttacatttatgtttttccttaggtcttcctccttttctgtaattttaaataatttaaataattttataaaaatgatacttggctgggcgcgatggctgacgcttgtaatcccagcactttcggaggccaaggtgggtggatcacttgaggtccggagttcaagaccagcctggccaacgtggtgaaaccccgtctctactaaaaatacaaaaattagcttggtgtggtggcgtgtgcctgtaatcccagatactcggtaggctgaggcaggagaactgcttgaacccaggaggcagaagtttcagtgagctgagatcatgccattgcactctagcctgggcaataagtctcaaataaataaataattaaaaaagatacttaattttttttttaagtaacatgaaagtacaaagaagaaaattgaaacttaccagattctctgtcaattgtcagtgatattaacaaacataataatgttcaccaaatgccattggatacagaaagaatgtctttggtcatctgtataattttttttccccctaagataaaaagcacagtatttgttttgttttttgtttttttgtttgcttgtttgtttttttgtgatttttttttttgagacagcgtctcactttgtcacccaggctggagtgcagtaactcaatcatggcttactgcagccttgacctcctgggctaaagtgatcctcccacctgagcctccagggtagctggaactgtaggagcgtgccaccacgcccagctaatttttaaatttttttgtagagatgatggtcccactatgttgcccaggctggtttcgaactcctgagttaaagtgaccctcctaccttggcctcccaaagt

SEQ ID NO: 62086 - DNA, 1050 bp, Homo sapiens
acaatacatatgaaagaaactacgattgatggagaagagcttgttaaaatcggaaagttgaacttggtaagcatccaccttaatactactgtttcactcttaaacaccttatagagcagcttgaaattttgtccttgagacaaaatttttgtggtcactgggtgattagctttgtagtgggagaagaaatttgttaattacagaaaaaattattttgctggcgatttaatacattatgtatcctgtgagaatgaaagtctttgaatccaaatccaatagactcactttttatttttatttttaaaattaaaggttgatcttgcaggaagtgaaaacattggccgttctggagctgttgataagagagctcgggaagctggaaatataaatcaatccctgttgactttgggaagggtcattactgcccttgtagaaagaacacctcatgttccttatcgagaatctaaactaactagaatcctccaggattctcttggagggcgtacaagaacatctataattgcaacaatttctcctgcatctctcaatcttgaggtaagccctttgaaaggaagctgcaagtgtagtagctgtaattcttatttggctattatatattttaaaagttcatttactaggatggacacagtgactcacacctgtaaacccagcactttggaagtccaaggtgggcggatcacttgagcttaggagtgcctgggcaacatgccgaaaccctgtctctaccaaaaatacaaaaaattagctgggtttggtggtgtacaactgtggtcccagctacttggggggctgaggtgggaggatcacttaagcctgggaggcagaagttgcattaagctgagatcatgcaactacactccagcctgggtggcagagggagaccccatctcaaaaaaaaaaaagtatgtgtataaaaaaaaagaaaagtatgtgtatacacacacacacacacacacacacacacacacacacacacacacatatagtagggaaaaaaagttcatttagtagcttcattttttttttttt

SEQ ID NO: 62087 - DNA, 1050 bp, Homo sapiens
aaggtccctctctgttggctggagtgcagtggcacattcactgtaacctcaacctcctggccttaagtgatcctcccaccttagactcccaagtaggtgggactataggcacatactactatgcccagctaatatttatttatttattgtagaaacaggatctccctatgttgccaaggctggtctcgaattcctgggctcaagtgaccctcatgccttggcctccaaagtgctggaattacaaatgtgagccatcattgagtttaagaatagtctaaaggaaattatcctaagggtcgagactctgaaaattgaagagaagggaaaaaaggattgaacaacttcctttttaaaggttgggcatagtggtcttaatgactagattttaaaattagatataactataaaatattacttgtaagttattatataacatattttagataacagaactacattattctcacaatatcttcagtaattgacctttcctttccatgacaggaaactctgagtacattggaatatgctcatagagcaaagaacatattgaataagcctgaagtgaatcagaaactcaccaaaaaagctcttattaaggtaactgtgaatttttgtagagtaatgtaatcttgtttgacaaatgtgaaaataagaaactgaagtgggagataatagttaaacaagatttgttaaattgcccatggaaggctttttatatagtgatttaaactaaatgtcttacatgttaacatatttttttctaatgctagtatgttgactttaccaactttatcaactgagttggtactcttagcaaaattttcatttatttacatttacaaaatttatttatttgcatttttgaggtataatttacatgccataacatccacctaatgtaagcatacaattcaatgatttatagtgcatttacagagttgtggagtataaccacgatctagttttagaaaatttgttatcactatccagtttccctttgctcctttacaatcatgtggccactgacctgctttctgtctacagatt

SEQ ID NO: 62088 - DNA, 1080 bp, Homo sapiens
gagctacaagatgagatttaggtggggacacagagccaaaccatattaaggggttacatcttcaagtggcttactgagtccttttgattaacctagtaggctttgcttagcttatttccttgtcttatttgacaagatgttccgtattcatcttgaatattttctgcctcagtcctggaatcagatgcttttataaggaatcctggttcattttagtgtgaattactcctaccaacctgggtactggaggttgtggtttttcttgggaagtccatatttctagaatgagtgtatttaaaaaggagctttgaaagactttatttctaaacaaattaatattgattaaaaagtatggttataactttttatcatacttctttaagttttaaaagacataaaaaggctaactttacattttatttgttgcatgtccttcccaaactgaatgaaaaaagtactaaactgacacctacaacattcctcttgtgtaggagtatacggaggagatagaacgtttaaaacgagatcttgctgcagcccgtgagaaaaatggagtgtatatttctgaagaaaattttaggtaagcccttggctatggagttaatttccaagaataagcatttctgataacaggctatttgaagtaaaacttatgtagcagtaagtaaaatctttatatccagtgccgataaatacttcattttgtgtgtgtgtgtgttttcttttgagacaaggtctcgcactgtcacccagactggagcacagtggcacaatcttggctcactacgtcctcagtctcctgggctcaagcgatcctcctgcctcagcctcccaagtagctgggattataggcatgagccaccacaccctgctaatttttgcatttttttgtagagacagggtttcaccatgctgcctaggcttctattttgttttgacattaacaagtagctatcaaacactttttaaaaatcttttactaacttttaatttttaaatcattaattcatgtgaagtttcaagaagagtacaagagaggtttcatgtattcttcacccagtcttcctcagtggttatctc

SEQ ID NO: 62089 - DNA, 1051 bp, Homo sapiens
cgcgcctggctgtagaagatccatttttaataaaaagctaatatatttcatcaaaagactattagaattaactcttctcttacagctcttttctagcttttcctttagtcaacaatatctctagctaatacgttaagggaatttgtattcacggaagaatctttgtcatttaagcataatgtgaaatagaaaattgttggttgttatcaaagaattagatgagcaaatacaggcattcatttctgaaactgactaatactcaagaaatcagagacccattaaagtgggtttggaagacctgtgagctttgcgcttgagaaaagcattctctattttactttttatgacttcttttgactttgacttcatcttctgatatttttgttgaatttagaaatttttagtttctaaaaactcttttctgccatccctgtctctccttttgaaaaatatagcatccttttattttatagatctattccttatctcagaaacattattaatgttattaaagttttcttttatgtttttctttcctttgggatcttttttttccctgttgtgatatctgtcatttgtatttattttcttcaaatgtctagtgatttttggctggcaattaagatggattagaagctttgtacatgggtgaggattatggacctgtaagttcactatagatgaaaaagtggtgatctcagtcttaagtctgggcttccatcagatatcattctttgttggattttttttcttttgttctagccctcagtcttttctgagaagatttgcccagtttgcttggagatttttctagctgctgctattttttgattagagtgggtatagggggctgaggattccatcattttgtatgtagatttacacttaaatgctcatttctagtccctaaaccttctacagtccatgatgtctagtgaaagtgaacctggaaattctgctgcaattcctatagactagtggctgtcaatggaagtggtgttgggggactggtggtggtgggtggttttgtcccccagaggacatttggcag

SEQ ID NO: 62090 - DNA, 1052 bp, Homo sapiens
gttatgcggtggggtgagagtggtgtttgtgcgtgttgcagcagcagggggtgtaattgctctgtatacatactttaagtctcagtttttaacccctaatcttaccccttccttctaagatacctgatgccttcaagtcccacatttttccagcattctgtggggcatatttatattctgtatccctgattatagacacttaggttgcattccctcctctctctactttgagttatagtccgtcctctgttagctttctagcttctcaaatctggaacacacatgcttttcccctcataggtagggattcttagtttcagaattgagggcaagggaaaaatatttcatttataaaacaaagacaaggaatataatttgttctttgtaatttgtatttattgcttattgacacaggtatcaagtgacacttgggtatcaagtgatggtgataaatgttggaaatgagtttgtgtagctgtcacaattgtgttagaatacattttataggagttagaaaaaaatattaactgttaaactcatattaaactttattttagagtcatgagtggaaaattaactgttcaagaagagcagattgtagaattgattgaaaaaattggtgctgttgaggaggagctgaatagggtaagcacttaaaatgatatttactgttatgtgaaaagcaaatattgaaagaaaattttagaatgaaagatctaatattttttccttcaagattttttttttttagacggagtctcgctctgtcacccaggctggagtgcaatagcgtgatctcggctcactgtaacctctgcctcccagggtcaagcgattctcctgcctcagcctcccgagtagctgggattacaggtgtgcaccaccatgcctggctaattttttttgtatttttagtagagacagggtttcaccatgctggccaggctggtcttgaactcctgacctcatgatctgcccatctcagcctcccaaaatgctgggatgacaggcgtgagccactgcacccagctccttcagatttttttggaaaa

SEQ ID NO: 62091 - DNA, 1041 bp, Homo sapiens
aagcagttttgttaacatgtttatcagatgaaggaatacagatattgggagagactggatgttaaataaaagtaatataactagggtaggcaagaggcctgacctttcagggccaccctcatattaatacctttatttatttatttttaattattttttagagacagggtcttgcttgatgcccaggctacagtgcagtggtgtaatcatatcttactgcagcctcaaacttctggtctcaagcaactctcctgcctcagcctcctgagtagctggacttcaggcatgcactaccatgcccggctaattattttatttttttgtagagatggagtcagtctcgctatgttgcccaggctggtctcaaactatggggctcaagtgatctcctgccttggcctcccagagtgctggggttacaggtgtgaaccaccttgccaggccacattaacactgttatattcaaatccattgacaatgttgaaggaaactgaagaattaatagtactacaccagacctattatttaatctcaaagtgttgagtaagattacagaaagaaacaggatgacatatttgtgttaacctaccgggtaacttcttacaacttttgcatggaaataatttgtttcatttttctaatcttatgaactagctagatatcctaccagccagctcagcgttttttaaattcttatatttaggttacagagttgtttatggataataaaaatgaacttgaccagtgtaaatctgacctgcaaaataaaacacaagaacttgaaaccactcaaaaacatttgcaagaaactaaattacaacttgttaaagaagaatatatcacatcagctttggaaagtactgaggagaaacttcatgatgctgccagcaaggtttgtcccttgtgttgatttgtactcatattaagtagagaatgggtagaaaaaattttctgtgcttaagcattaaatattctgtttattcaccccaaatggtatttctgtccatttaaaaaacattattttactatttcatccatgtt

SEQ ID NO: 62092 - DNA, 1029 bp, Homo sapiens
ttggacattcagaaatataaaaatttaaaaaatcatctagactctagtctcactaagccaagcactatactttttggtattgatttccagttttttttttcttctgtaaacttaccataattctgtatattatttttagttagagattaattgtagaatattctaattctttgtgtactatgaattatagttatgggtctgatacacttacaaatatgttaagggcttacagagcactatagaaaattgtaatgtatatttaaatatttccttgctttgtagtgagccagttcttttaagctcgttattacaaattctacaacaagggtatacttttgtcaacttctttgaaatggtttgaacggtatttaatatatttatgtcaaagtttacatctttctgtttttgtttgttataggtaatctgctgtcttccagtgtctctgcattagataccattactacagtagcacttggatctctcacatctattccagaaaatgtgtctactcatgtttctcagatttttaatatgatactaaaagaacaatcattagcagcagaaagtaaaactgtactacaggaattgattgttagtacatcctttaaaatatttttgaagggttgcatttgataagtatttgataaaatattttgaagggttacatttgataagtctttataaacaatgttaactgctattctttcttcctgagctttactagacacagtcatagacacgtcactgtgagagactacatatatatatattttgttttgttttgttttgtttgtttgttttgagatggagtctcgctctgtcgtccaggagtgcagtggcgtgatctcggctcactgcaagctctacctcccgggttcatgccattctcctgccttagcctcccgagtagctgggactacaggcgcccaccaccacacccggctaattttttgtatttttagtagagatggggtttcaccgtgttagccaggatggtcttgatctcctgaccttgtgatccacccgcct

SEQ ID NO: 62093 - DNA, 1090 bp, Homo sapiens
gaggctgaggcaggagaatcacttgaacccaggaggcagaggttgcagtgagccaagatgttgccactgtactccaacctgggtgacagaatgagactccgtctcaaaaaaaaaaaaaaaaaaaaagaatggagaatggaaatgtaaattttaatgtgaatgtttagctaccaaagtatttaagatatcatttagaaaggtttacagaagtggaaatattctttttaaagacctatttgtttatttctgaaaccagaatgtactcaagactgatcttctaagttcactggaaatgattttatccccaactgtggtgtctatactgaaaatcaatagtcaactaaagcatattttcaagacttcattgacagtggccgataaggtaacaaatgctatgttcttaatatctcaaaattgatgtgttgtttaagaaggaaactcatttttgtttcttcaaagatagaagatcaaaaaaaggaactagatggctttctcagtatactgtgtaacaatctacatgaactacaagaaaataccatttgttccttggttgagtcacaaaagcaatgtggaaacctaactgaagacctgaagacaataaagcagacccattcccaggtatgttgtttagcggacttggggagtacagaaagagagttttaggatgatttgatatgacttgataattaatctatgttacacaatctgaatactgtaaaagctgaaacctgaaaataccatagccactgttgcttataacagtaattattgtagaacaattgagaatacttctcttaatatttgaagttttgctacatctagaaccccatgcagaaccacaatatgacaaaacagtccttttctcacatcaagatgaaagatgaatctggaaaaacatacctttagagaagaatggttataacatttaaagtgaaaatgtatctacattaaaacctgctaagttgtttctaggatggcatggatagttgtctttcataaaccaagtcctactttctcttatttctgtctcactgatagacatttaaaacatagtaaatcgatacaacttttaattcttattgattataaa

SEQ ID NO: 62094 - DNA, 1234 bp, Homo sapiens
ttaaacataacatttgtaatgttcatgatttgttttacatactaggcaagggaaactgcttaataacagaataaatgactgattgtccaatttagggactagacaagaggctgtagtagatgccctgaagtaacattgcctagtaagaggaataaaacaagtagacagattttgaaagcatcataactggaggagggttgtgaaaggtttcatgagcaaagatgatcctttcaaaggtcatttaatggcaatgctgtgaaaagacagtggccaaggcatccattctcaatgcagaagatttactaagatcacgggccctggagccagactgtccacgttcagatctgccacttaagagctgagtgatcttgggaagttatatatcctttgagtcttaattccccatttcaacagtgtcattctcttttcctataggaaatctaaggatatagtcaacaaaatgacttttcacagtcaaaaattttgtgctgattctgatggcttctcacaggaactcagaaattttaaccaagaaggtacaaaattggttgaagaatctgtgaaacactctgataaactcaatggcaacctggaaaaaatatctcaagagactgaacagagatgtgaatctctgaacacaagaacagtttatttttctgaacagtgggtatcttccttaaatgaaagggaacaggaacttcacaacttattggaggtaataactttgtaagtggaacttactttggggagaataataatcagaaagttaaatattcttggctaagaatagatttcaaaacaaatgatattttaagctataatgacttaaacttttaagtataatatttggtatgcttacagatgatctcgttttgtgctttgttatatgtcttctcaatcttggaattaatttaacatttgtacagtttctttcctgtatttatccttggtttctgacttagtagtttcttcaaagaagggcaccctgtcttttgatatgtaataccttccacttatatatgctttttttttttttttttttgagatggagtctcactctgttgcccaggctggagtgcaatggcacgatctcagctcactgcaacctccgcctcccaagttcaagcgattctcctgcctcagcctctcgagtagttgggattataggcacctgccaccacacccggctaatttttttgtatttttagtagagatggggtttcactatattggc

SEQ ID NO: 62095 - DNA, 1032 bp, Homo sapiens
aggtgggcagattgcttgagcccaggagtttgagaccagcttgggcaacatggtgaaatgccatctcttcaaaaaatacaaaaattagccaggcatggtggtacatgcctgtagtcccagctacctgggaggctgaggtgggaggatggcttgagcctgggaggtcaaggctgtagtgagcactactcatgccactgcactccagcctgggcaacagagtgagacttgtctccaaaaaaaaaaaaaattatggaaaaggtaagggaaaatatgatgttgaataaaacactggcaactttaattttagtaataaatatttatttgcatcatttacaggttgtaagccaatgttgtgaggcttcaagttcagacatcactgagaaatcagatggacgtaaggcagctcatgagaaacagcataacatttttcttgatcagatgactattgatgaagataaattgatagcacaaaatctagaacttaatgaaaccataaaaattggtttgactaagcttaattgctttctggaacaggatctgaaactggatatcccaacaggtactttaaaagagaaatagaattgttaaattttttgaagtcgaattcaactctatgtagtgtcagatgttcagaaaaattaggtcctgccattgcctgacagaaatttaacatctcactgtaatcaactcaaaatgggaaaactggaaccttaaaatagttttaatcaagtgtcatgatacaggtggtatcacaattcagtataatttcacatactttcagggagttgactttgttaataggggattttttaaaacaaatacaaacctagcactgtttgtaaaaggacattttaataccacaaatatgggagagatgtaactgactaaatctagtttaatgcaaagtttaccacattgtgcattttgttctgtgtccctctcattttgtcatagactattgccatttaggaatccctgttttaagagatcagggatcaccatggaccattagcatttaggaatcaacatttt

SEQ ID NO: 62096 - DNA, 1595 bp, Homo sapiens
gaggatcgtttgagcccaggggttcaagaccagcctgggcaacatagtatatgtatataactagttaatatttaaccaccacaccacatttatagtgaaatgattactcctatcaaagtaatcatgttgggaaatctactcattccaataatgctgccatttttttcagaacactataactccttttagagcttataacacatcttttatatatcctcagagatggtaaacttcatgttttagagagtaggatgaatcttgaaaacagtaaagtctgtcatcaaattagaaagtattgttagttgcaaacaatgtctgacaggtagcaagactgatcctcatatatggcaattatatttttatatttttagaagacaagattaattaggaagttttaggtttttttaaaaatatttacatctcatactttaatttttacctcttatctaatgtccgttaaaggtacgacaccacagaggaaaagttatttatacccatcaacactggtaagaactgaaccacgtgaacatctccttgatcagctgaaaaggaaacagcctgagctgttaatgatgctaaactgttcagaaaacaacaaagaagagacaattccggtaaatttaaaggatcatattttataatagaactcttttatgaactcttgatgtggctgacttcatgtgaagaattttactgtttacccctcaatcttaccccgcctctcattaatgataggcctagcccttaggcttgtttcttttaatcttactagtttttaaattatgctagtagataataatagccaatacttaatattgtgcttagtaacattgttatataggaacctctactctctataaaaatatattaggaattattttcattaatttgtagactttctaataattttgttgaggtttaacttttatattataccatgggcattgtgttatactcaaagctgctgttactcttgtgatgacttttaagcccttggacttagtcactcatccagtttcttcttttaggatgtggatgtagaagaggcagttctggggcagtatactgaagaacctctaagtcaagagccatctgtagatgctggtgtggattgttcatcaattggcggggttccatttttccaggtatgtcatatcagataacccttccacatctgatgtaagtcattcatttactattcattataaaggtattgttcgtggtgagcagaacaacaaaaacctttcaattattccttaggatggcttgttaacgcttatgatttgaattatttacaaaaatctgatattgataaggggttttctgtagaataaatgaaggcagaatttgacttaatctacatccttagctgataatctttagctattgtatttattccttttctgcttgctatatactcagacactgagagcagtcatttctcttccttctacctttgacatgtaagtcttggaacctatctctgcccataatcagactttgaaggcaaagtgattgaaaagattgagagactggaggcctcttaggttatattagtgatttctcctgcctgaggctcttctcttgtaaactgt

SEQ ID NO: 62097 - DNA, 2459 bp, Homo sapiens
tatgtgaatactcactcaaagccagtagcactccctgattgtaacaccaaaaaagtctctcagcattgccaaatgtcccctgtggcagcagaatcactccctgatgagaaccactaccctggagtaaaatctataactatgtcttagaaaataacacagaaaattaatatttctttcactctactccttccattagtgatcaaataaagaaggcatttggcgctacttgccaaattgttggctcaaacttgtgctgaaccttttttggttttctacacttaagtttttttgcctataacccagagaactttgaaaatagagtgtagttaatgtgtatctaatgttactttgtattgacttaattttcccgccttaaatccacagcataaaaaatcacatggaaaagacaaagaaaacagaggcattaacacactggagaggtctaaagtggaagaaactacagagcacttggttacaaagagcagattacctctgcgagcccagatcaacctttaattcacttgggggttggcaattttatttttaaagaaaacttaaaaataaaacctgaaaccccagaacttgagccttgtgtatagattttaaaagaatatatatatcagccgggcgcggtggctcatgcctgtaatcccagcactttgggaggctgaggcgggtggattgcttgagcccaggagtttgagaccagcctggccaacgtggcaaaacctcgtctctgttaaaaattagccgggcgtggtggcacactcctgtaatcccagctactggggaggctgaggcacgagaatcacttgaacccaggaagcggggttgcagtgagccaaaggtacaccactacactccagcctgggcaacagagcaagactcggtctcaaaaacaaaatttaaaaaagatataaggcagtactgtaaattcagttgaattttgatatctacccatttttctgtcatccctatagttcactttgtattaaattgggtttcatttgggatttgcaatgtaaatacgtatttctagttttcatataaagtagttcttttataacaaatgaaaagtatttttcttgtatattattaagtaatgaatatataagaactgtactcttctcagcttgagcttacataggtaaatatcaccaacatctgtccttagaaaggaccatctcatgttttttttcttgctatgacttgtgtattttcttgcatcctccctagacttccctatttcgctttctcctcggctcactttctccctttttatttttcaccaaaccatttgtagagctacaaaaggtatcctttcttattttcagtagtcagaattttatctagaaatcttttaacacctttttagtggttatttctaaaatcactgtcaacaataaatctaaccctagttgtatccctcctttcagtatttttcacttgttgccccaaatgtgaaagcatttcattcctttaagaggcctaactcattcaccctgacagagttcacaaaaagcccacttaagagtatacattgctattatgggagaccacccagacatctgactaatggctctgtgcccacactccaagacctgtgccttttagagaagctcacaatgatttaaggactgtttgaaacttccaattatgtctataatttatattcttttgtttacatgatgaaactttttgttgttgcttgtttgtatataatacaatgtgtacatgtatctttttctcgattcaaatcttaacccttaggactctggtatttttgatctggcaaccatatttctggaagttgagatgtttcagcttgaagaaccaaaacagaaggaatatgtacaaagaataaattttctgctcacgatgagtttagtgtgtaaagtttagagacatctgactttgatagctaaattaaaccaaaccctattgaagaattgaatatatgctacttcaagaaactaaattgatctcgtagaattatcttaataaaataatggctataatttctctgcaaaatcagatgtcagcataagcgatggataatacctaataaactgccctcagtaaatccatggttaataaatgtggtttctacattaacctgcttgctccataatttcttatctggcaatgggtatatttagagggttaggcaagctgcattcacattcccaaaataaactatgcaggtaccaccaaagaagaaggagcctagtaaacttgcaggcttttagttgcactccaaggggctatcctaggtgcaaggttagtgagaagtaggccctcacacagcctgaagtccagctttaagtcatctcattccatgactgtttaagttatctgagaatgctgatgcaactaatttcactgcctcacagaagcaaaaataaatctccagataattttaacatccagaaccataaattagctctaccaattttcat

SEQ ID NO: 62098 - DNA, 1044 bp, Homo sapiens
gatggggggccctggccgaggggagcggggaggtggtttgcgctgagaactgttctcgaacccggggaacttcagaacctccttcagggcttgtggaaacccagccctgttcctggagttctgatctgttaggactggactgggctgggaccgggaatttgtatttccaacaagagctgaggtgacgccaaagctgcgggcccggacaccacccctggggaaccactgatgtgagcgcacggggtgcggaagaagcaggtgggaccggcactcctcctcccacctgctttcccgggtaactttggccagcaagaggctggggcggagggctgagaggagggaaaggcgagggggaacagaggaacgaggggcttatccaggctagtgggagtgaggtttgatggctgagcagagggcgcagggtggaggaaggggcaccatgaaatggagggagaatggggtgctgaggttaggtgggtgtgggggcccaggtttctgattgttcagggtattgctagtctgtgccagctgcttgcctagctgagccatcaggtctctgacattccaggaaaaccatgacagagatctgttggggagaggcctggaaatctctctctagccttggcctccatggaggaggcctctagttgtagagttgggtacttctggctaaggacctgtgaaggaatgacccgacccctggcctggcttctagggctgtggcgcccccagatatggacactcagatgaagacagtgaaaaagtcattgctgttagggagttgtcacatccggcttccttagattctaagaaggcccctggaattgcaggggaattaagatttctgagaaaagcagtactagtccttaagcagagaggtgtggatagacttggaagtttgaagatttgggttggtgttttagttcttggcctcaaatcatttgtagaacgaagatggtctagttgaaccatatgaaccccttccagctctcaaattcccaactcagttcatgccgtccttattgttctccctactccccatgt

SEQ ID NO: 62099 - DNA, 1061 bp, Homo sapiens
tgtccatttcagttttttaaaattgccattagaaacatttttttcatttgtctttttactgtagttatacttttattttttgctgtgcaaaagttttttattttatgaaataaaatttatcagtctttccctttttagcttgtgaattttgagtcataggaaagttttccagattccggagttataggggagtccacccatgttttcttttggtacttgtatggtgttttttaatgttgcatctgattctgtttgcattttcctggggtgtggcatgaggagtggctctttatcttttttcacgtggcaacccagctatcctagtacctcttattaaaatgtaggtctttttcatgttgatttgagatggtgccattatcatgtactgaatttttatacgcagtgatactgtatgtgggtttcttggttctgttcattgtctatatgtctattcatgtgctatgcagcacttttaattttggaagcttcgttgttttaatatctggtagggctacctgcatctcatcgcttatctttttcagggatttcctggtgactcttccttatttctctaaacaaacaataaatttctctagttctagaacactcaaagtatttgattgggattgagctataattataaattaattagggagaacaggcatgttgatgatattgagtcttcctatccaagaacatgttatgtctttcaagagagttaaacttttccataaataaattttagaattccttaagattatgtgtaggtgttttttctcactattttaattgggccctcccttccttcctccctcccttctttcctccctccctccctctttttttttttttttttgagacaggttcttgctagagaccaggctggagggcagtggcatgatcatgactcaccttgtagcctcaacctcctgggttcaagtgattctcccacctcagccttccgagtacctgggactaaaacctttagtattttctcattaggagagctctggcttttgtgctgagggatttatattttatcatgttaaggaaacattcat

SEQ ID NO: 62100 - DNA, 1066 bp, Homo sapiens
aataagtaaaatggagagtaagtaacaggaagtgaggtcagtgaggtaacaagaggcaaaattatgtagggtcttatgggctgttgtaagataaactgggttttgagcagaagagagacatgggctttgccttaggttttaatgggacaattcccattagctatcatctggctgctgtattgagaacagactgaaagggaacaaggatggaatcagggagaccagttaggaagcagttgacaaatctacgcaagacatgttgttggcttagtccagggtgataccaatggggaggtagtttgctggagaaggagaatagtcaagggtgagtccaaggttttttgcctgagcaactagaaaagtggggtttactgagatgaggaagactatgggaagggcaggttttgtgaaaggagatcaggaattcattttcggacatatttgaggtgcttatcagacatctaattggagagatatatgagtttgaggagaggtcagggcagagataaaaatttagcaggtgtcagtgtgcttatggaatttaaagctacaagtcaagatgacatggagatagaaaagagaatatgtccaagatcagagcctagttctaactcagctcttacagaacctacattttttaaaaaattaaaaaaattaaaatttatatttgacgtacattagaatgtaggcatagatgccaagaacctaaattcttttttttcttttttagacggagtttcactctgtcacccaggctggggtgcagtagtatgatctttgctcactgcaacctctgcctcccgggttcaagcgattctcctgcctcagcctcctgagtagctgagattacaggcacctgccacgacacccagctaatttttgtatttttagtagagacagtgtttcaccatgttggccaggctagtctcaaactcctgacctcaagtgatctgtccgcatcggctcccaaaatgctgggattacaggtgtgagccactgcacctggctgccaagagtctaaattcttaataattggtatcctatattgttacctcttgtattagag

SEQ ID NO: 62101 - DNA, 1058 bp, Homo sapiens
gggtttcactattttggccaggctggtttcaaacttctggcctcaaatgatctgcctgcctcggcctcccaaagtgctaggattacaggtgtgagccactgcacccgctatatgctatttttatgatgtaaatttagcttagactacaaattatattgttaaaactgttagcagattttattggctaaaaaaattgtagtattattattattattatttgagacagagtctcactctgttggccaggctggagtgcagtggctgaatcttggttcactgcaacctcagcctcccaagtagctgggattacaagcatgcgccaccatgcccggctaatttcagtatttttggtagaggtggggtttcaccatgttgggcaggctggtctcaagctcctggcctcaagtgatccatccaccccagcttcctaaagtgctgggattacaggtgtaagccactgcgcctggcctgttttttgacttgtgagaatagcttttctttttttttagaatcaatgaaattctactcagcttaatctctgatggaccaggtatatttacgtaaaaactttgagtaaataaaatgttggcttattatgttaagtttcagggttgagaaacctatttccttatagtcatgtttaataatacctctttgccaccgtcaggtgcattgtaatagccatgaagatgtcctctaagtttgaatgttttgtccctgtctgataataaaccttaaaaattgggtactgatggaatgagcaagagccaaattcagcttattcccctactgggctatgtaaaatagagaaataaagggaagtagaggtcagccgtttgttactgctactgtcttcgtttttaaggctaggccgcaactcttagttcatataagtattgtgttcctaatggccacctccagaactacctgctttcctctattcatctttctgtcctactatccacttataaatgtgtgtgtgaggcatcatggtaggtattggaactataaagttggaaatgacacaatctcagcttttgaaggatcctacaatctgt

SEQ ID NO: 62102 - DNA, 1155 bp, Homo sapiens
tgtatttctcaagtttgagaaactttatagtactacatttcatcaattgtaaggcatttttttttccacataacatttcagaatataggatacatcttaaagatgatggtgttatagttttaagtggtggtgttttttctttcttagcagtctgtaaaataatactgatagtgtctttaattcagtgcaataatgaccaatcatatgacatagctgcgtaagaacaggaactttgtctatagccaaatcatgaaatctgtgtatcatttttacccaaaacaataataaggtatctagttatccatagcagttttctgtaatctatcatacatattaaaaatatacaatttctctccttggttaccttaagttgaaaacagtccacagtgataataaacatactacaaagaataaactgctgaagaaatgccaaaacaaaataaagaaggttttgcgtttatagtgtatgctttctatgggggaattgaataaatgttgtaacacaaagttcatgaatcttcttgcctatctttaactttacattatctaatggtggtctaatagtttgacctataatttttttaaaaatggtttaattttcagatcttaactgttcaggatcttgttgatttttcccctgtttatcgatgtttgcacatttattctgttttggtaagtatgttttatatttatgtatatatagctttatattatttaaaaggcatgtatgtattttaggccctaaaaattgatcatatgctgtaaatcttcacataattctttgtgaaatatccactctgtgtaaggcacttacattttttgtttacttatcatagtgtaatttcaagtgatataccatttcatgtatattttaagaaccttgtaatagtatacttccatttctccctattgcctttgtgctgttgttacatcacagttcttataagttacttttacatgtgtattccatactacattgctcttatttttgatttaatgttcctttttaaaaataactgctttattgagatctagttcacatacgaaaaaacttacccttttagagtatacaattcggtggttttagcatattcacaaggatgtgcaaccattaccactacctaattccagaaatacccattacccacccctcca

SEQ ID NO: 62103 - DNA, 1067 bp, Homo sapiens
tggcatgcatctgtagtcccagctactcagaatgttgaagtgtgagaattgcttgggtccaggactttggggctacagtgagctataattgcaccactgtactccagcctgggtgacaaagtgagaccctggctcaaaaacaataataaaaataataaaacaacaaagttactatcccatgatggagtcggaatttaggaataattttgtttccttataccaagtcctctatgatttttctgtggttgttaattggataaatttaaattatgccatatatgaatattctactttatggaaaatgtcccttttgcaaagttaaattgaagtttgtgatttaataaatatgggtctttgtagtttatttaaagatataaaataatgatggggaaaattattttagtaaactgtgttaaattatttaggatgttaactaaccacattcattatttattaagtttaataatatcaatctttgtttttagctcaacagaaatagacgatatgcttagaaaatcaacaaatctgctgctgaccagaactttgagtagctgtttactgaaccttattagaaaacctcatataggtttgacagaggtaggttaaaaagacacatatagtgaaatgtttcattgtatgaaacaattattttaaattattgctgaacgtcattctgtaaaactagcttcctgttttaaatgtattaatataagcagatttgttttcaaaataaaaacaccagtgtaaattccagaaatgtgaggatcccaggcacagtggctcatacctctaatccgagagctttgggaggccaaggcaggaggattgtttgaggtcaggagtttgagaccagcctgggcaatatagtgagaccctgtttctacaaaaaatgaagactattagccaggcgtggtagtgtgcaactatattcctagctactctggacttgagcccaggaggttgaggctgcagtgagttacaatcataccactgcactacacagcctgggtgacagcaagaccctgtctctggaagaaaaaataaaaaaatgagggaaaagggttcat

SEQ ID NO: 62104 - DNA, 1044 bp, Homo sapiens
gatttaaatttggttttaataaaatacccagttttatatcaatctaaagttaaccaagtactttagctctgtaagtttggaggaggggagcttcttgaatctggcttttaaaagcttgttatgcatcttctcttcctgcctatattagaggcatcccaaaaaagcaaaagaaatcataaatagtggtctgagtgcagataggaaatgcagcgaaagataggagcaatcagactctcaattttctttgcctggcgatagaagggaagcaggttgagtatttatgagatgattgtacatagttctgaggtttagggttctcttatccagctgccttctggaattactgcctctcttcagttgtgtagtgaactatattcatctgcttagattcagtaaatgtagtgagacatgaatgagggaactgattatgaacactggggcaaaatgcaaaatggtaaatacatatttttatattgctttgagaaaattgacttacaaatgatgtcattaaggtgtgttatctttagttctgtaggtcataagcatttaccatcttaggtacctgcccctaatgttaatgaagttaaagagaaataggtgttactgccatgaattatacatgttaaatatgacacccctttccactggttagtgtttcacctttttttttttttttttttaaaggcaaggtcttgctctgtcacccaggctgcagtgcagtggtgcaatcgtagcttactgcagcctcaaactcctgagctcaagcgatcctcccacctcagcctcctgagtagctaggactataggcacaagccaccatgaccagctaaactttttattttttggtagagacagagtctcactatgttgcccaggcagttatttaactcctggcctcaagtgatcctcctgcctcagcctcccaaactgctgggattataggcataaaccactgtgcctgccatgttttacataaaaaaaattctgttaatgtttaatacccatttttttctcccttacgtaaaaataactacactaagttaa

SEQ ID NO: 62105 - DNA, 1008 bp, Homo sapiens
caaagcactggcagatattccatttcttctgtgatagtccaacttaattgctctcagtgaatcaggggttagatagaggtggtcttctgtgttcttggcaactttcgtttttctacttctgtttctcctaagggtcctcttagagttgtgagaacaagtcaggaattaatatctcataaagtattctatcacataaagacaaaaaaaggtgataggttagaaaggaactaagaaaagatgtgatgtgatatccagtcaaataaatagagtactgccagaaaaaaaaaaccaacagttttcctggactttgaataaatggctaaaatattaaaccaaaggtaaatgtaaaataatatctagaattgtaagaacacttgttttattatctgtttcttgtctttgttgttattttgtcccatgtcaggatgctcgacatgcagcagaaggagaaatatataccaaactgaatcaaaaaattgatgaatttgttcagcttgctgattatgactggacaatgtctgagccagatggaagagctagtggttatttaatggaccttataaattttttgagaagcatctttcaagtgtttactcatttgcctgtaagtataaaaattttcaaaaattgttttatgtttgcttactaaagtatattttagaatttagtttgaggtttccttgcttaaaccaacttcttggagtgcatgtttctttctccattattataaatccatttgtaaggaattataacttagccaaattgtttgaaattttaatttattttatttttaaccaaaataactgtaactctctttccaccaaagccaaggcaaaaccctgaaactgacaatatagacttaaatagaaataatctctaatagaaataatttacatagagttaacacaattgctcgtctccctctcccgtctccctctccccacggtctccctctccctctctttccacgtctccctctgatgccgagccgaagctgcactgtactgc

SEQ ID NO: 62106 - DNA, 1081 bp, Homo sapiens
gaaccttgtcaaagaactgatgtgttctaaatttgcttattcagtagacataagtgctaaagctcttggttttttaattctgactagacaacttgatgagagagacaaaagtttggaggaggatttgtctaattagtatggatgtaaaaactcatgcctaaatcttcaaaataaaaaattatggtcacatttatgtgatagatgaatgcctctaaattagcaacaaacacagaaagaacttgcttgttttagagtatattcccttttgctactttaaacactgattctgctgtgattagaatacattttccttttttatttgattgccttgctgacttccttctcagactaacaacaatgatcatgcagccatgtcggtaagtagatataaactaaagctagcatgtacattagaaaataatgaatttcctgcaggcttatttttctctgcttaggtatttaaattaaaggctaattactttggcaacatccttgataaatttttagttttgtggaaacctaaatttgaaggtaatattagttgtttgtgaagcagtcaagattctctgagactagattgtaaaagcactgcactcacctcaaatgcatcttaatattaaggtgcatttggaaacttctctgtggtctttcctcatctgtaaaatgaggtatgtggcaacatataccctacagatttttgtgagcttaaatgaaatagtatacctaaaatgtttagaaaagtgcttggcatataataaatactcaaaaaatattagttgttatcgttacttgtttcaaagatggtttatgcttttcctgaatgctttttctctactaccctgatcccaaactgcactcgtagaagtctaacccagtgcatgacccagtgtgattcatgacccagtgcaggtatttctttctcatcccagcccagtattggtcttctgaattgccttagctcttaccttttttacggctttatcgtattttgctttttttccgtatttgtctttttcacctttacttgtgagctcttgacagaataagaactaacaagtattctttgaatgtataaatattg

SEQ ID NO: 62107 - DNA, 1021 bp, Homo sapiens
gttgtagttatttctgtgggaatcaaagtggtatttctatgacatattttgatatccatttttatattatatccattgttatgagttaattccaggtatacaaaaatcaacatgaacaaaccattgacaatataatatatccctgtattggaaagagttaaaaaaactttgagacaaaatatttgaaaaatttggaaatagtcaaggtccactctttgaaatagaatttttttcttattaagctttttcttaatgttataaaacagttgattttcactactagatgttaattttttaaaatcttgcttcttagttgaaaatgaacatatttgtatttcgtaactttaatccttttagacatttactaagttgtctaagttagccaagttctggctaatcttggtgagaaatttaatttcataaattataagtcttaagtttgtatatagcatagcatacttaaatattttcctgatgtcaaacattgcagaaaacaatattttgaattgccctcggtcagggcttagttggaagtagtagtaatgaaagggcttttaaaaggaaacaacacgagagttttagtaggaagccagtggattaggaaagacctatataaaatgcaattgaagctgtagaccttaatgagagttacttcattcatgttaactaacagaagaaagcaaagccacgttgtgttaggaaggttgagactgtttttctgtgttttttttctattttaagttccagggtacatgtgcaggatgtgcaggtttgttatataagtaaacatgtgccatggtggtttattgcccctgtcaacccatcacctaggtattaagcccagcatgcattatctgtttatcccaatgctctccctcccccaaccccagggaggttgagactttgactgcactcagtctctgagtcattttttcccccatcataacccgtttcacagaacatgttattcaaatgtgtgcctcagcaaatgaagttctgcttgtactagactctgagagtc

SEQ ID NO: 62108 - DNA, 1038 bp, Homo sapiens
gtgtttccatctgatgaaatacctcattctttcagtatgtgtattttaaaatttaaatttaaaatttaaaagagctacaatttataacattttaaaatacacatactctttaggagagctacaatttataaccttttaaaatacacatactgaaatgaaattaaattcattaatttatgaatttattcattcattaatgaattaaaaatttaattcattaaaatacttcccttcttttgcttctgaaaaagactgtttcatattctcataactgaaatttatgtagcaaatgatgatagtgagtttgtataaaatgataatattttactgcgttaatttaggtaactttaaaaagccatacagaatcagaattaatgaagtcacttatcagtgttaggtttaatatccaaattgaccatgattttatttcgtttttccttttttctttgacaagagttagactttttaaacaaaaccttttatcaatgtaaagaataatatgttgtacaatatatttgagtctgtgtatttctttttacttaagtaaaaaagtagtttattgtacaaagttaaccttttgtgggaatataaataaagaaaaatggactctcctggaatcattaaggatgagtagaccaatacggaaagaatgtgatttcaagagcacattttaacattaaatgtacttgagagaatgaaagcagcattgtaaagtgctttcaaataattactgttgaaatcaaacctttttttaatagacctttgaaataagaaaatggtaagacacaaatgaaaacttcaaatgaaaatttaaatgggccaaattagtttttaagtgttctacatttctcttacaattatattagagtagatcatgaaaacattactttcaaaacaaaccagttttgagccataatctaataaactatgttgtgtttttaccttgttattttatgatatttcacaggaaacagagtgtctttagcctaatctatgatagtaaattattttggaaatttgtcttgacatacaagcaga

SEQ ID NO: 62109 - DNA, 1055 bp, Homo sapiens
acatggagctgatttgatggagaagcacattaaactaaaatgcactagttgttccattaggtcaaaatgacatttccattaagtattctgaagcctattacattgtaattaaatgacatgccattgatttctcctttctctgcttccccacttctcattcatattgatattattctgcttggggaatggagctgcatgtctcccagactaattcctcttgagtttgggggatcttggatcatgctgggttttgcattgtttgttacattcctttttggcagttcatcagtatctgtcaaatatattgtttgcatcggcttttatctcttaagttttcgattgagaaattgacattccgtttcacatatgcagtttttcactgtgcatagtgtctaaatgcaaaaaactcattcaaaaagttgtttgtttctagtctgacttttaatgtgtgatttaacaaatgttgtaataagcatcttgaaaatgtatttatgttctttattacctttttcacaaatcaaccctatgtaatatgtttttgtactaatatattgtaacatttctgtttgggagattttggtcacgattttgtagctttctggcctttgagataagtaggaaaaatataattatcaaatatgactgggtaaatatttgttaatgcaaacgaggcaaaacatggcatgtcttccaaaagtaattatttctgatgatattcatagatctttgaatcctatcatagtagtcattccatcatgaaatcacatgattgtcagttgaaggtagccatcctaggagcagtattatgcaggagaactttacctaaaagagtttttataatattttaaacctctagttgaaatgcaaaacctgtttaaaaaaataatttatctttgggaggccaaggcgggcggatcacaaggtcagatcgagaccatcctggctaacatggtgaaactctgtctctactgaaaacacaaaaaattagccaggcgtggtggtgggcacctgtagtcccagctacttgggaggctgaggcaggagaatggtgtgaa

SEQ ID NO: 62110 - DNA, 1048 bp, Homo sapiens
caaagggtattttgaattttagctgtaatttaaatagcaataatagtaaattatactgttaacttcctttattctgacttggttaattagctaaaggagagattaaggagcattaaatggataaaatgttctgtcagtatgacttattttatgtcataagtgtcattttaatatgcatttctaaagtgctttcagtatttcaagagatctgaaataatagtttttaactggtattttaattttcctttgtgcagttagagctttaatgatatttatatcctgagaaagccaagtaaactaagaatattaatgttaatttctatgatataaaggtataaccactcagaatacagaaacaggaaggaaagtaaccactattgtaccaagcataagcaacaaaaagaatgccaggtgtatgatttttctgattctttatgatgtatttctatgtgtgtttatttgtttgatttttggtttgattgttttaaacaggggaaagttgctcagacagcttgcatgtcagcctgccagcatctgtcaacatccttaatgcagatgctactggacagtgagttaaaacaaataagcatgggagctgttcagcagtttaacttagatgtcatacagtgtgaatgtaagtactatattggtttattcttatgtattactaggaatctatgcttaaattatatgaaaaaatgtatttagcaggatagttcagaaaggagggagaaggcctggttcagctaaacttttagcagccttaggagtagggctaacttcctgaaacaggaagataaaaatatctcagcttcacatttagggcctctagagagaggcactgaagtggcattccagattggtatatttaaaaacatgattcattttccccattattccttgtctggtcattcttgcctttttctaggactctcctaatgtttgtcataaatgaatgaaatgattctgtcattcttacttgccctgtaagtaactttttagatacttgctagaagaataagctcaggaccttgcattccaaatgaaa

SEQ ID NO: 62111 - DNA, 1087 bp, Homo sapiens
ggcggcatgcgcctgtagtcccagctactcgggaggctgagataggagaatcacttgaacctgggaggcagaggttgcaatgagccgagatggcgccactgcactccagcctgggtgacagaatgagactccgtctcaaaaaaaataaaaataaaaataaaaataattaaaaggcatgaacagacattcctgcatcatcctgatttttctacttagaacattttacttattgtctgcatgtaaagttgacttcttaccttggtgtctgccttttattgctattagctagaggtgggattttttaatagcacctattctttaccaaagcaaatgtttcaaaatatgttgacagccatggaattggtatcatttttaaatgcttctacaatcgttcacctaaggctaaaaagggtcagaaagctttacttgattgaagtacgttactgttaaattttagtaagaaaaccctcctaaatttattgtgattaggattacagtgattaaatggcagattagaaatttaaaattattaaaacacttgaggtaatggatgtggagaactttctcagtagtggaaattgaagtttataaataatcttcatttgaaatgattatgtgtaaatattataatgcatttataatgagtagaaattaatttatcagttaaactcttgtatattttgtgatctcatttttattctttttttttctttcttttaatagtgtttgccagctctgagcctgtgccaggattccagggggataccctgcagctagcattcattgacctcagacaagtaagatataataatgtacttcccatttgttgccctctaactcttgccctcccctcactttttttttttattaatgctacaggaatgcctgtttgccttgaaacaacctatcttaagaaaaatccttccttggtaactatgtatttggcacatctctttgaacctgtaatgcattcagtacctcaacttcatagagcattctcatcagtgaatattcaatttatttaatagtcattacctgctaagcacattactaaatcataactttgtagcttgctataatgacactt

SEQ ID NO: 62112 - DNA, 6611 bp, Homo sapiens
gagaagcaaaacataaactggttaggaatccttataagacaatgagttgccggctgggctgttatcccagcactttgggaggccgaggcggatggatcacaaggtcaggagatcaagatcatcttggctaacacggtgaaaccccatctctactaaaaatacaaaaaattagctgtgcgtggtggcacatgcctgtagtcccagctactggggaggctgaggcaggagaatcccttgaacatggcaggtggagtttgcagtgagccaagattgtgccattgcactccagcctgggcgacagagcgagactccgtctcaaaaaaaaaaaaagacaatgagtcgtgtggaaataattggtatatcttcaagtcaggtttagaaggagactgaaaaagccattcttatctccaaattatgtctgtaaagtatggtacatataaaatatattcatatgtacttttgtttgcagtcagtgctcagatattacgtcaaacaaggaacactgttataggtgacctagatctgtagatgattaaccttgctgagttgggaaagatagtagaaagtgaagaaggtggtctttattaggtcatttgactatttaaaaaactgtcttctctttatcaaagaataaaaaaaattttattttttgaaatctttaaattatcactggctaagtaaatgactattattttacagtcacctgtgatcctatatttatttgtttatttatttatgagacagagtctcactctgttgcccaggctggaatgcagtgtcatggtctcagctcactgcagctctgcctccagggttcaagcaattctcctgctttagcctcctgagtagctgggactacagacacgcaccaccatgcctggctcattttttttttttgtatttttagtagagacggggttttcccatgttcaccaggctggtctcgaactcccggcatcaagtgatccgcctgccttggcctcccagagtgctgggattacaggtataagccacagcgcccaaccacctgtgatcctattttaatcaagtgttttaaacctttgatatttgacatacttccccaaatttcagattctaaaattgtctttttgaactcaaacttttggatattccggaaagggcccctggaagctcaagagagacatattagggcttattcgatataagaaaatcatgtgagaaacattgtcaaataagaaatggtatttaacttgctttgaattatatttatacaaatattcatgtgttccaaaattatattggattcctgaaattctgatgtcttgatatatgttatcagtcataattattatgttattatatgtcacaaaaataacaaaattcccttgtcaattggtgtcttttaccatggctattttctttttttttttttgagatggcgtctcgctcttgtcaccaaagctggagtgcagtggcgcgatcttggctcactgcaaactccgcctcctgggttcaagcaattctcctgcctcagcctcccaagtagctgggactacaggcgtgtgccaccaagcccagctaattttttttgtatttttagtagaggtggggtttcgccgggttggccaggctggtctcaaactcctgacctcaggtgattcacttgccttggcctcccaaagtgttgggattacaggtgtgagccactgcactcagcctaaccatggctattctaagtcttttgtcatctacagaatattaattgtttttcttgattctcctcaaaaagcagtttacaattggctacagtccaaaatttgcttcttggcatacagagttatataatggactccagagactcaaaagggggagggtgggagaagggatgagagataaaaactacatattgggggctgggcacggtggctcacacctgtaatcccagcactttggaaggctgaggcgggtggatcatgaggtcaggagatagaaaccatcctggccaacacggtgaaaccctgtctcttctaaaatacaaaaaattaaccaggcatggtggcaggttcctgtaatcccagctacttggggggctgcggcaggggaatcgcttgaacctggggagatggaggttgcagtgagccaagatcatgccattgcaccccagcctggcgacagagcaagactctgtctcaaacaaacaaacactacatattgggtacaatgtatactacttggatgatgaatacactaaaatctcagacttcaccactatacgattcatccatgtaaccaaaaccacttatatttcaaaagctattgaaataaaataaaaggctgggcgtggtggctcatgcctgtaatcccagcactttgggaggctgaggtgggcggatcatgaggtcagaaggtcgagaccgtcctggctaacacagtgaaaccccgtctctactaaaaatgcaaaaattagctgggcgtggtggtgcacacctgtaatcccagttactcaggagtctgaggcaggggaatcacttgaacttgggaggcagaggttgcagtgagccgagattgtgccattgcactccagcttgggcaacaagagtgaaactctgtctcaaaaaaaaaaaaaaagaaataaaataaaaataaaaattttaaaaaagaaatacattctttatgcagaccatcacataaccatctttgacataaatcacacccccctatatgtaaagattaaataagacctcataaccaacagcaatgtacagaccatgtttacatcttaatttgaacaaaccagttataaaaaaaagggagggggcaggtttgagataatcagggaaatatggatattagatatttggtattaaattatttttaaaaggtataataatgacatggtgaatatgttttttaaatgccttactagaggcataataaaatattataggtaaaatgaaaaagtacacgtacataagttatacatgttttcaaaaaaacattagaatatacaaaaaagtagaaaaatttactcatagtctttctacccaaacacatcattattggcattctgttttatttcctgctggtctttttccattaatttttttcctcatccatgctcctacccttaccaaaatatgattgctggcatactgtcctcacaattccttctttgtatttcagatagtgtttgcctcttaaatcttaaaaaggaactttttttttttttaccagatatttcagagccataaaactcaaatataatgtgtgtaacttgttttgatcccaattcagacaaatcagtgggagaaagcagggaaatgtattctgtggtttgttttaaaatactttaaaaagaaaaattattgatagtagctgaatctgggaggtgaggatgatgggtttattgtgctatttactttcatatatgtttgaaatttttcataataaaaataaaaatattaaattaaaaaaataaaagaccctgacaaatgctcttacatacaggtgtctggtgactttggaaatcataccactggactaggtaaaaaaacttccaggactctaattaaaaagctgatacattcataaagattgctaacccaacatcaagcaaaacaagaattacatggaactgaactgatggtggactaaaataatttattattattttatttttaaatgttaatctatgtatttatttattgattgatttatttattttgagaccagattatgagactggctagtttttgtatttttggtaaagatggagtttcaccatgttgcccaggctaatcttgaactccagggctcaagcaatccacccgcctcggcctcccaaagtgctgggattacaggcgtgagccaccacacttggcccaaaatgattttttgttgactttttatttaaaacattgctgattctttctatgttttgttttccagagccaagaaaattttttcttctaagctattcataacttacagcaattagttaaaatatacttatgaacaaaatcaaaacatttacttttctctctagatgatttctccagaatttagaaactatccataaatattctagttttatgacaatctaattatttacataagttccataagaatcttttcttttgtaacaggacacattgaaaacactggttattttaccaaggatttgactaaaatgtcatgttttcatatatgaccagactgctttgagggattgaggttgactttataaagccaataaagtttaaaaacaaaaaaacaaaaaagagactggccctgtaccctatccacacagttcccttataaggttcctgaccttgggataagtaaaaaatgtcactttctggcaggcctgagaacctcaagatacttcaaggacctcgaaaagtgaaaatttcacccagttcataccgatattagaggcacagtctgatggcaaatgctcagcttgctttcctacccttgaggcttttaaaagtctaatccaaaattccttattaaaagttccagtgaagtccgtttttaaaaagtccatatggtgaatcactattcttgctgcactatacaaataatcaggccaaatatggtaagactaaaatttattttacaaataaattggtcctagtataatttgtatttgatttttttaaaagggggactagaaaaaatacatattaaaggaaaaaccatagtatacatgtattagattctagccttgtccattatttttgagtttttattatttgcctgcaatttagaacaaatcctaaattcttttttagctacaagtctccaaactaatgttttcacatttttctcacttaaaatcactaaaaattaaaactgcttttcttaaagccctaaagctagaacttaatataaacttcaacaaaaatcaccagagcaacttacatattaacagcctttatgcctacagatatatggactgtgcaaaaagtttgcttgaatacctgattcaaaccataataataataataataataaatgtgtcagattgccactgcaacctgaagatgcttcagagactccaataattagcttatagactactccagacatggaccattgtttttcttctgtttctgtagagatgcctcttattaaaaatatgtttgcctaccttacatatagaggcctagcttcgagggcccatctgcaatgctgtcttctaaaataagacacagctgtttaattggactggcctattccccaaaataagagactgatttgatgagatcttttgccattgagttactaacttgatttgtcttttcacagccactaactcagcttttaatatgtgaaacttctagggaagttttagacagggaaatgttggggctcagaaaccagtactctaaaatacagtgctttgacatgctgaacggaagaagcagcactgaggtctctctggcctctttcccacccccgcccactgccccaccatctctcaatactttgtctctcccaaagtacaggataaagttgttctctaaaattccctcatctgcttgaagtttggacctgtcaaggaagaaaacggttacctctggttccttcccttgtattagctaaactcatgcaagaagaaagactgaagtctgtcaacacacctgggcagacttttgtcacataggctcaacagactttgtcccagaccattgtatgttcttcattcccattaagttcccctagaaatcattcactaccctcctaaaatcatccacactttccccatctccctttcccataagaaaaaagatacagggtcaggcatggtggctcacacctgtaatcccagcacttgggaggctgaggtaggaggatcacttgaagccgggtgtcaagaccagtctgggcaacatagcaagaccctacctctaaaacaaaacaaaacaaaccaaacaaaaacatgtaaccatctataccccattgcatagtggaaaaatcactctgcgattctctctcatgcatgctaataaatgtatatggcatttctcctattaatttgccttttgttagttgatgtttcagttaaacttccaagggtgagggagttttcgctttatccctacaactctcaacttcattccggtttaccagaagagattctttctgttgacagtagatccatttcctttagaaggagttccctctgttgcagtgctatttccctgaacaaggtgatgtactattgaaaacaggattctttagcaagttgaaaacaggattgattgtatattcatttcccagttagtttaaggtcacttagtggggtaagtttcctactggtgtaagttgcaaggacgtaaacatattctccaatccaaaggacagctttaagaggagatgatttgagaataattctcattgtatatgaataatctgtttatagaaagtttgaaatttctcatgtgatattttctcagttgtatatgaatttttatggtggtaattcgtttatgtgatgttaactagtttataatctcattgtaggattgtgagtaggaccacatagtttatgaaactgttcataaggattctgttctttgatttttccggatagatagatggttggtttaatggagattaaa

SEQ ID NO: 62113 - DNA, 1023 bp, Homo sapiens
cctcaaggccttacatgatttggctctgataatcctcctaatttcatttgcccctcttcctcttgcacactacattatagccatactattaccctttctctttcctaacagcaccttaggactttgctcttgctcttccctctgccaggaatgctatttccctatatttcccaatttcactcagttatgtgctcaaatgccaccgccttaaagagggtttccctgatcaccaaatctgaagtggcccacctcacctccagtcactatcacattaacctgttttatttttctcataccatctaaaagctatttgaaattccatctaaaactatttaaattagcactctttgttgtggatctccctccaacaaagggggactgtgagaggagggatcctgcctatcttgttcaccactgtcttctgcacttaaaacagtgcccaaagcaggtgctcaaacatttgtcgagtaaatgaagaaacatctgaaaatacggcagctcttggtgatctggcttaatctggacagctttcagttttgctggagtagtggtgtgtagctatctatttttaggtcacatatgctgcctttgagatgaaaacattagactttcttctcagaaaaatgcacatacaaaattctgcttgaacctcctaaaaccaacccatggttctcaagttggaacccctgacgtaaaggcatgtaatgacctttgtgcaatgcaatctacgttgttgtttgctgttgtttttgtgaccctcgctctgttgcccaggatggagtgcagtggtgcaatcatagctcactgcagccttgactcccaggctcaagcaatcctcctgactcagcctcctgactagctgggactacaggtgtgcaccacaatacctggctgattttttgcctcagcctcccaaactgctggaattacaggcatgagccaccacacccagtctgcaatctatgttacaacaaattcctgtctgtggagacgaaggctaaggggggaaaaaatcaatagaaa

SEQ ID NO: 62114 - DNA, 1116 bp, Homo sapiens
attggataaacaaggtgtagtacatccatacaatatattattatttgtcaataaaaaggaatgaagtaataatgcatgctacaacgtgatgaaccttgaaaatattatgcttaagtgaaagaagccagttacaaaagaccaggtaggtctttttgttttgtttgttttgttttgtgttgttttgttttaaatagaggcagggtcttgctctgctgcccatcctggagtacagttcattgctcactgcagcctccaccttctggactcaagctagcctcccacctcagcctcccaagtagctagcactacaggtgtgcaccaccacagccagctaatttttaattgtatgtcgaaacagggtctcaccgtgttgcccaggctggtctcaaactcctagtctcaagccttggcctctcaaagtgctaggattacaggggtgaaccaccatggtaggccagaagaccacatgttatttgattcccatttggggagtgattgctaatggctatggggtttctttcaggggctctaaaattgattgagatggttgcacaattctgtgaatagagtcaaaaccattgatttgtgccctttaaatgagttaactgtatggtacatctcaaagctgttaaaaaaaaaaattttaaagttatataacaagaaatagaggtttaattatattaaagttataaaaacaaaaatagacaaaaatggtaggatagctacccaagaagagagctggtataaagtaaggtaaattctcatatgtgatagctgtaaaataataaactcaaaattagaaaaataagcctattagggatagtgagataatcactagaactaaaagaggagttaaaggccagacgcagtggctcacacctgtaatcccagcattttgggaggccgaggtgggtggatcacttgaggccaggagtttgagaccagcctgggcaacatggtgaaaccccgtctctacaaaaaacacaaaaattagccgggcgtggtggtatgtgcctgtagtcccagctgcttgggaggctgaggcacaagaattgcttgaacctgaggccaggtgcggtggctcacgcctgtaatcccagcactttgggaggccaa

SEQ ID NO: 62115 - DNA, 1102 bp, Homo sapiens
ggggcgcgcgtgcggctgcgcgcccggggccgctgggggcagcgaggggcccccgcccgactgcggctgcgagcccgacctcagcctcgcggcgctgggccgtctgcgctacgtcgactgcgtggtcaaggaggtgctgcgcctcctgccgccagtgtccgggggctaccgcaccgccctgcgcaccttcgagctcgacgtaagtgcgccgtgccagcccatggccagcctcctgcctcctgccgcctgccgcctgccgcctgccgcctgccgcggcggcgcccaggtgggaggagggcggagggattcggacggcgcggtcacctcttttgccctcagagcctcagccttccgtcctataaaatgggctgagccttgttccacctccccggatcccccgctgagggacgcaaagcctggcgagactgcaaggttagggatctcgtacccttcagcttttggcagcggttcggaacggtcaattcaatgagagcggagttttagaataaaaatactcttctatccgtgcagcaccccctcccagccagtgagtgtggatggagaacaaagagaacccctcagtatgtcctgtgctccacccctctggctccctcacaagatgaaggaacccctcattgcgaccggtccagggttctggctggggccagattccaggggagggggggattaaaataccgggtagacgcttcatctctgatcaggccggtttgggctgagcaaggttgaggtctagaactgactccatctccgtatgaccttgggcagttccctcttcactctgggcctcagtttactctctgcaaggaagctgtcttggtcctttccagctctgacactccatccaggtgggtccgggctgtgggggtacagtggtggcctcaggcagtggtgctctggctgtgccaaactgtgggtgtttgcctgaaaggctgtcgttgcagtcccctgagcaccatgcttggtggctgggtggctccagataaaaatgggcattccacagtgaacatttgtggcacattgcgtgccagggttcaggaggcatcaaagggactgggattctaccctggaggggctccacttg

SEQ ID NO: 62116 - DNA, 1073 bp, Homo sapiens
caggctggtcttgaactcctgacctcaagtgatctgcccacctcagcctcccaaagtgctaggattacagccgtgagccactttgcccagccagcatcctgtgttctaagcacctattgtctttacccaaagccaaatgacctctctgctcagggcagctcagaactaaaaggaaaacatttcacatccaagggccttgagttgagtgaaaattgtgtctgtagatatttcattactttgagtttaaagaactctgtttatgctcatatctttgagaaagaaaacaggagatgctgtgcagtggacggctatttcttcggccattttccttcctaactggaaagactttaaatgtccaccaggctccctttctctaactcaccatttacctgttcaaaatcactgtgtgcctctctcctgataagaacgttctgttcacttgtgaacaacagctgatccacttgaagctcatttggacttactgttgtttccttggctaggtttcctagaacttgacttgcgtcacacgatcattcctgcaaaatcaccagagaaatgcagattggacatgattccggacctcaaagccatgaacccccttaaagccaagacagcctccctctttgagcagaagtccatgaaaggatggtggccatgctacgcagagaaagatggcgcccgcgtaatggctgtatgaacatttcctggttctggttgaaaatcgtttatgccttttatcatttaggttttgccctttatccatagacttactccagataaaatgaggaagttttaaattggtgggagtttaagttatgggaacagtttgtctttgggatatgtttgcctttgtcttacaatataaggtgggagatgctgtgagcatgtgtttggagttggaggaaggtgaagaagttggaatggtcaaaaagtagaagcccaggtggtttcactatattttcctttcttcttcatcagggaagttaattaatgctaggcttctagtacaatttcgtatggaaaagggaacttcacatttgaatttttctcattaaaaaaaaaaggtagggctg

SEQ ID NO: 62117 - DNA, 1032 bp, Homo sapiens
ctagcaaaaaggaaaactactgcagttgattggtattaataccactactaatagtaggacttaatattttcaagtgactttgcaatctctgtggttctttgaggcagagtaacagatgtggacttcgcaatcagactgacctgggaatcctacttagttctgtcagttctgggctatgtgaccttgtgcaagttaatatattctctctgaacctcagtttcctcttccacaaaatggagatagttacgcagttgttgggaagaataaaataatgcatgtaaagtacctggttcatagaagatgataactgtgtgttaaaggtacctccattcccactctgcccctgctaaaccataatcttttctgtctgcgtgtcgaccatgtgaagggcgcacatatcattaatcttattttacagatgcgagatgaggctcagagagtttttccagccaggcctgcctcctaccatgaatctctatctatctgtggggtccaggcatcaatatttttaaaacgtccccagtcgattctaatgtgattctaatgtgcagtttcgagaaaaccatgcgctctctattgctttgacagtgtaaaatcgaatgttaccccctggtttcaaactagaagtcttcccagtagcaacaacttctttctgggcacactcattcattcattcattccttcagtaggtatttatctagtgtctactatgtgccaggcacaagcagaagaaaacttctcaaacgttaaaagttaagatgttactgaaatgaatgctcatagatatgcatgtggaaataagagctgacatcttccttgccggtatcattaatattatcatagtgaatttaagaataatttataaaaaggaagctgtaagattacttgatttgtgcttctttggtttgcttaagtaaaatatgggaaaggaaatgctaaaattttgagctaactcatattcatttaacctatcagcagtgctgaaagacactgatgagttatagttgtgaggactaaagtcatagccagcag

SEQ ID NO: 62118 - DNA, 1032 bp, Homo sapiens
tattcctctttgataccctgaataactagccttagaaacacaagtaaagctcccaaaatttcattttctacatattttattaccagcagcccatgtctatggaaaagaggaaatgttcgcagatttcaaaggaagtaatttattctcccaacctgcactgagtgccagcatccaacatgtcaagtgtcattgttgttcaatattctcttacttgcctaattcaattaaatcgtctctgtggatggctatgccttgatcatatgcctcgatcatagatgttgcgtgcagtacagcatagcgactacattctggtgctttccctactgtctgggcaaggtagttagctcgctgttcctcatctgtaaaatggtgataatgattattcttccttcccagggatattcaggtgatccagttatccaaagcatttaggacagtgcctggcacatagtattgttgctattccacgtggactgagtttgattccttgatacatgaaagataagacttgcgacatttaatatattcataaagtgagaacaaagtttcacctataatcccatgtggccttcaatcaaaactttgttaaagatataattagtatcatttaggttcactataaacagggaatgtttcatcaagttcttcattattatttttggatctcattaccattctctagggaaactaatctcagctaattatatatatgcaaatttatttgactatcataagcattatttttttttttttcaaatcagggaaacaaactcaagtaattctgaacggagagaaaactcctctaatcagagaataaagctcaacttaaagtaccttgcaaaatttggaataaaaatctaaatacgacatgtgaaaagatgaatcgtgcataaataccatgcctagtgctagacacagctgggtattatattacataccaagctatacatatacatacatgcacacaaatacgtatacctataggagctgtttgacttgtcttaaagtatgaaaagatttatgtttaaaatt

SEQ ID NO: 62119 - DNA, 1187 bp, Homo sapiens
cacactttaagaaatattaatctaggccgggtgcggtggcttatgcctataatcccaacactttgggaggtcgaggcaggtggatcacgaagtcaggagttcgagaccagcctggccaagatggtgaaaccctgtctctactaaaaatacaaaaattagctgggcgcggtggtgggtgcctgtaaccccagctactcgggaggctgaggcaggagaatcacttgaaccagggaggtggaggttgcagtgagtcgtgatcccaccactgcactctagcctgggtgacagagccagactctgtctcacaaaaaaaaagaaaaaaagaaatattaatctaatggatgcaaatattgttgaccctgacagcaaaactatggacacgctgattgcaaaagggttggcctgggctttctaggttgttttgtcacttccttcttgcttttattttgttctacatttccatttcttccttttcttactcttcctttcaccaaagaacttattcctccttctttctctcctctcaccccttagccatatgaggagtttcaagaaatgacagagtgaggaagatttctccccgggaatccacaaacccccatcacttctgcctccagcattagccacagactgtggctgggtttggggagacactggacgcctaatattctgtagagtgcttgatgaattgtagagccctgagccctagagattagttgcaggagagtcaggatcatagtaaaatacatccttttcaagagctccacttaatgtattttgatcacaatgcattaggaagccaatctagtggtttccttggcaactttcttgaagatcagtttgtttttgtctgaagacagagtctacagaacactcaaaaacagtttgaagaatataaattggtttgtacggttgatatagttttttcgtggcattcctgacctgtctggaagaacattcgagtcagatggatgggccaagtctgtgtcagtcaaagagctgagcaggacctcaccaagatggagcacaaatgtcagtctaggctttcacctccccttcctgctagccacttacctggtggtgggcactaatgaaccaatggccaggaatccttaccttttgggaactgtaatattatcattgtttgagctcctcttttgaaaatgccatgttgtttttcttttaca

SEQ ID NO: 62120 - DNA, 1029 bp, Homo sapiens
ctacccaggagggatttatgggccaggtccggaggagatacacatgtcacttctacccatgttaccctctggctgaacttggtcacatggcctcctctaactgcaagggaggctgagaaacaggcaggccatgagctcgtgccacagaagtaaatatataacgctcccacttacccgttctggtgtcctggcccctttactattggcagtccacaagttaggcttgagcctggttgggacagggctcctggtcagaagctctttctgtcaactcttccttcacaagtcaaagtttgcatgttggcactgcctgtccattttggcaaagtctgggatgaagtgctggaagcagctctaggcaatctggctgaactattcccaaatactcattcctgcttcaatgctgctttccattgcagaagccaacaaaatcctgcaccagcacctcggggcccctgaagagcggcttgctcttcacatcctcaggactcaggggctggtccctgagcacgtggaaacaaggactttgcacagcaccttccagcccaacatttcccaggtaaagggccttccctcccttgaagaccattatccctgccccaaatgcaatggcagtagttgacatttttgcgccttttatcttctttgaatactttgagatgcacagaaatagaaatgagactcaaattagcgtcatatcaaaagggaatttttttgtaagaattttcaggtaactctctaaatctagataggagattggccatgactcagaacaaaccagaaccagggtctctctgtgtctcatctgtttctctgagtctatttcatctgccctcttgctgtgatcaccttcctatgagtccagatattacagagagtccttgagtgcttgtgtgttgtaatgcagccccatctacttctaaatgcatagggatttgttgcccaaacttggctcctttgcccaccatgggaccactgagctccagcgaggtgggcagggtctgggaaagtgattgagctcggcccggt

SEQ ID NO: 62121 - DNA, 1034 bp, Homo sapiens
gacatgtattgacacaattgttttttgagcactttctgtataggcactggactaattgtctaaaaacagtaatgaacatataatcccctagaaaatgtctaaaaccatattatgtttggggaaacgtgatggattgttggtttattttctacattcaggagttgtcctctctattctgtaagtcccatccaagaataaactctaccatccaccctatggctgttaaacttgaacttggagtagaatgttcaccactgtatttctctaagtatcttagattaagaaagtatttgtcttgcagcctcccttctgtctgccccaccatgccgggacatcgttatcgaaatggaagacaccaaaccattactggcttctaaggtaggcttcagagctgatcagtggatgctgtcagttttatcttctatgcttagatgtctaagcatttggtgaattcagtcaaacaacagtttgttgcaattataatcatcagccaatccatttattgaggactgagtacagacaagagtctaaatcttgcactcatcaacagttatgatgacattgtgtagactagtagtcttcaaccctcactaataagtcacccagaatacttaaaataaaacccatgcccaggccccacctcccaagagggagagggacctagatatcagtatgtttttaaatctcctcaaatgattttaatatgctggcaggtctgagaaccacaggtgtggacagtctgagaaagatcatttgctagaaagcgaagtctgagaagcaaatttatagcattgcaacattcagatcagagataacatgcaacacgccagattcttccccctacataaagcagaattgtttgataaatttctaatgaccatatttatcagtgtatgggacacccaggtttttttattttcactgtggttttgaagtgaagaaattggttgaaataatcactcaaggccctattttagaactagctattccagccacttctacacgaaggaaagggggcaaaaagcctcagccca

SEQ ID NO: 62122 - DNA, 1004 bp, Homo sapiens
aggcaggtggatcacttgaagtcaggagttcgaggccaacccggtcaacatggtggaaccctgcctctactaaaaatacaaaaattagctaggcatggtggcacacacctgtaatcccagctacttgggaagctgagacatgaaaatcacttgaactcagggggtggaggttgcagtgagcctagttcgtgccactgtaccccagcctgggtgacagagtgagactctgtctcaaaaaagaaaaaaaaaaagtttacaggtggtcatcaatataaccctatgacagataatacgatcagtcttgtttgtagatgagacatagggaggtgagttaccttgtcagcattgacacagctattagatggcacagccaggatttgattcctatactcttaactgcattgcttttttaggggctcaggcaggagaaagaaaggggcaaaaccactttctttggatgacctacaagcttactaggataatgttcaaattaatcttaaagactttgccagtaattaagacagaatttttccttttgaatattatttttaaagtgctgagttaccttcccctctctttaaatcgttttcatagattctagcttggggcttaagaaatatgaaaaacttccagatggcttctatcacatcccccagtcttgttgtggagtgtggaggagaaagggtggaatcggtggtgatcaaaaaccttaagaagacacccaactttccaagttctgttctcttcatgaaagtggtacagtatcgattctctgtgatcacccatgcgcgttgaaatatgaaagtatgtgcctcacacacacacacacaaacacagagtttatttccaaaacctgacaaatagaaaaaccctgccttatattcagcttgtcagtgactttttccccttaaattctcccactgtagtgatgatttcttaaagcttcaaaataactccagtggcacagaaatatctgtgagcaatacttacttatttctccagta

SEQ ID NO: 62123 - DNA, 1260 bp, Homo sapiens
tcaacgtttaggaagattattttttccctcaaagttatgcagcaggggtgaagtgtgggtgttgaccccaggtgtatctgactgcagagcctcactcaaccatgagtgcagtacttttgcagagaaaaactatgggccccattaaccttggtggggacatactctaaagagtgacctctcagtacacatcagggtctcgcttcaggtgcctctgctgcagtgccagaaccttccatggggaactccctgctccctagaaaccctatctccaggcaggtggtcagagcccactgtcattatatccagaggaaaagaatatggttgcactgagtggttctggggagttagattttagccgtggccccgttgttattctctttttctgttttagatccatatgctcatatctgtttcctccatcggagcaaaaccactgagatcatccattcaaccctgaatcccacgtgggaccaaacaattatattcgatgaagttgaaatctatggggaaccccaaacagttctacagaatccacccaaagttatcatggaactttttgacaatgaccaagtggtaggtcgtttagaatttctaagataacttggggatgatggagatttgaagggatgattgtcggggaatttaaggatcactttgtttctctagggcaaagatgaatttttaggacgaagcattttctctcctgtggtgaaactgaactcagaaatggacatcacacccaaacttctctggcacccagtaatgaatggagacaaagcctgcggggatgttcttgtaactgcagagctgattctgaggggcaaggtacattgctgtgttcttcctcatgtattctgtcagctgcttaaaatgcatgttaattctaggcactgtttgcttgaactaaagtgaggcattgacatatccatgtttgtttcacaggatggctccaaccttcccattcttccccctcaaagggcgccaaatctatacatggtcccccaggggatcaggcctgtggtccagctcactgccattgaggtatgctgctccccacgtgttactcatcaaatcaaacggatgtgactgcaggacaggaatcttttgtatagaacatagaatcctgctgcatattttcttgctatctccaacttcctttacaacttgtccaaaaactggaggtattcatgggagtagaaggcttgttgaagcaacaaggacaggtcaattctaacattcctgagggcatctaaactcctc

SEQ ID NO: 62124 - DNA, 1038 bp, Homo sapiens
agattttaaatcaaacttctgccatgaaaatgtcagctgcatgaaagcaaagaccctatctcttcttcactgtgtcctcagcccctaacacgatccctgtcacacagtgggcactcatatttgtcgaatgaagagaatataacattgaaaactgataccactggtaaatcaatagttcttaagctaaaaagtaccacacgaatttgttattagttattacagaaataacatattctgatcacttaattatcagttatggcagctattagctcaggcaagacatttaaacctgggagggggcatttaatttttttcctacatatgtaaaatggagatactaatgttttacaaactatatcacaatagcaacatttttatgaaataatgaagtgaggaaacagaaagcaatttgagaaagaatccacttgcttcacccacccccaaatctgaatgaggtgcacctcctgagggtatgtccacgactgtgctgtcattgcctggttatctctctgcactcctgcagtccatcagctctgcaaggcagaggtcctgtctgtttttttcttttctgtattcctgactctagctcagtacttggcacagagtagattttgaatactgtgtatctgttgattgatcatataacctgttttatcaaaataaggaatatcatcatcatcatcgtcatcattaacatgtttacttctgttttaggccatggaggaattgcaagaccaagagggctgggaatatgcttctctaattggctggaaatttcactggaaacaacgtagttcagataccttccgccgcagacgctggaggagaaaaatggctccttcagaaacacatggtgcagctgccatctttaaacttgaaggtgcccttgtaagtactaggttgccagagcgcagatcatattggtgtagagaaaatatatgagtgttggatacagcactgccaactccatagaggtccctgtaaccctggtactataagatggcaaatattaacaggttgagggaaagccacacatcc

SEQ ID NO: 62125 - DNA, 1024 bp, Homo sapiens
tgtacctactataattcatttaatcccctctttctgggcatttaggtgcttttggttttgagtcgttggtttttataagcaatgtaacagtgaacatccttaaacatacatttttgtatgtttatgaacgtttatctgtagggaagatccttgcatttggttggtctaggtttaaatgcatataaaattttgataaaattttataaccttcaaaaaggttttataaattcatattttcaacaaaattacaagaagcccatttgcctaaatattcatcatcccgctttataatctttgccacatgaataagtggtatcctgttatttcaattttcactctcttaatttaaagtaaagctgagtattttttcatgtttatgggccgcctttatttcctttacttaggaactttcttttcataactctcttcatttttatgcaaacttaagtcaatattttagataaattttgctaattgtatataattaacattatgaacctccagtagcatttccccatactcaaaaacatgtgtctgccgggtgtggtgggtcacacctgtaatcccagcacttcgggaggctgaggtgggtggatcgctgaaggtcaggagtttgagatcagcctggccaacatgatgaaaccccatctgtactaaaaatacaaaaattagccaagtgtggtggcaggtgcctgtaatcccagctacttgggaggctgaggcaggagaatcgcttgaacctgggaggggaggttgcagtgactcgagattgcaccactgcactccagcctgggcgacagagcaaaactctgtctcaaaaaaaacaaaaacaggccaggtgtggttgctcacgcctgtaatcccagcactttgggaggccgaggtgggcagatcatgaggtcaggagtttgagaccagcctggctaacatggtgaaaccctgtctctactaaaaatacaaaaattagctgggcatggtggcgcacacctgtaaatcccagctactcaagaggttaaggcaggag

SEQ ID NO: 62126 - DNA, 1762 bp, Homo sapiens
agctagagagaaaaagccctcagaggggaagggtaaaagactggctgtggaggtggggacccttccgtcctttccagaaggttctattgccagcactgctgggtatggtgggagaagtatccactcttcatcctcaggctcagctgcacccagaacttcttcctcctacatcttcctcctttacttcctggctattctgagacttgccctggttgccagcatggcagcctccctattctgagaagaggagaaaagcagccaagttaacccagataaatgcagagcttccctgctgaagtacggtgaagggagacttagagccccatccaccccccaccccccacctcccagcctccacaaactccttctggagctagagcatggtttgaagacctctgaccttggtcacagctaagatctttttcagccctagcatcccaaggtactctttgagatctgtcctaaagccaatggctctctttcaaacaccagagacctgaatccagctgggagagttgccgactgattcatttcgaaggttagggccatgggaaggagaaactttttgcagttgtattagcctgactagagacacagaattctttttgctgttgctgcctagaggaataatcctggattattgcctttcagggggaaggagttgcctacagaggcaggatcttggttgaattagccacttttcttgagaagacaccaccagataaaaagcttgagcccatttcaaatgatgacctgctggttgttgaggtaaatgttaaagtgtgagtaatgcatggtatagaaaaggagacctccagggactgaaggggtagctgggggagtcggaaggcaacccaactcacaatgaggccctcatctggatgtttctacaacagccctatgaggatcgcttcatcctttgagatgttaataccctattgaaaactggcaagaacactgatacccacaaactgaatgacctgtttgctaactggcgttgggggtcatggggaagtggccataacagccacttcttgctggcaccaagagctgtaggtgccacctctactcatttccattttcagaggtggctggtgggcctcaggcttcccagcacaggagggcaggtgtgctgagggcccacactgcaatggctgtgaaccccgcttcctccttgaagacaggaaatcttcccagttgacttccccaaccatttctgagaatccaggtcgatgcctgtgtgttccacaaatctgaatcatttgccagcacagccagctcatggatgcccctctgcccgcggccctccttgctgggttgcaaatcaccgccagccccccagctgccccaggctgctgttgccctctgttccaagcacacaggacaggccctgccctgatttcaccactttacagcagaaaccaaacagcaacttttaaaaagctttcactttcagtttttgggataagaatacgaaaatacagtaaaaagggtgacaacgtggttgcgaaatgtggctattctcaaagctcatggggtcaggctggtgttctgggtccctgacagtcagccttcctgtctactcgcagcctgtctccttgtggcaggactgggttctccatgctctcccccaaactcccgtggtacccagaacacgttttcatctgagtccaggcccaactgccgtgagttctccagcgagccagggccttctccctctagtcgtctgatgtctgcctgttacatctgccccctttgcagg

SEQ ID NO: 62127 - DNA, 1046 bp, Homo sapiens
tgggatttttctggtgttgctaaatcacatacctggcactggatttgattaacgttttcaatgtctgttttataatgcccgtgttcttcttgtttaaccagtcatatttttactatatagatttctcatcttcgggaactggggctgcatcatatacaggtttatgcttcgtaattttgctctctgttatatcttcctagctaatattatcttattaagaatgtatcgactgtctttagaacttttttttgacattttgctgtctcaacatagttttgctaaagtaataatttttgtgtaagtgccatacggttgtcctgcacggctaagcttaaaagaaatatgctaaccaggctttgctccatgtcccatgctttcagctaaatgcacaccatcgtatttggctttattgcaaataattgattgtgagatataacattttctgttattgtttatgttcagtaagtagagaaatggaccactaaatcaattgttctgaaatgtatcaagtaactttcccccaatttcaacgtgaatctctaggttgaaaaatactgaacgttttttactttgcaccctgaagatcttcacctcccccaaaatgagggatcataacacattctttggtttgcacagaactcgtcattttttgcaagtttgctcaatactgtcacacacttgaccatcacaattctcctagggcagatgtttttgttcccctaatagatgaagactctgaggtttagagaggttcattatctgtcagataagcatgattcgccctgccataataatctcccagggttgtggtaagaagggaaagagatattgcatgtgggaaagctttgcaaactctgaagctgtgtgcaaatataaggtgatatcatgtaattatgtaattgacacaatgcccaattcttatttgctttaaacaatctatttcattataatcagactttatatgaatattaagtagtccttagatttgcagtggacttggcagatgtgcaagcactttattcctttatttgtttaaccaatcaatg

SEQ ID NO: 62128 - DNA, 1054 bp, Homo sapiens
gttcaactgctcataaacaaaagaaggggaacgtgctgaaaatgccccaagataagaaatcagggatttaattatcattaggctgtccagaatagacttcagaaatacagtcaagcatttcttgggaagaatcaccaaaacattctgagagcaattcattgttattgtttaaaaagaaaatggtaaaactacctcaatgaaggcaaggaaaagtccttgaaatgttctgatagaatttttagtagaccagccttctagcactgattggccataacaagaccattcttggaatgttctagttggatgtagcattcagcaggcacccttagctccctgacagtggaaacatgacaaatatcgttaccatcatcatgatcatcacaatcataattatgtaatgtgcctataattgattaattcattttatgacaatggtattgagtgtagccataggcacatctcttggcctctctgtacaattgcaatttcataacttcagaataaattaccttactagaccagtgtttccaaagggtgactggaggaccatctgtatcagaatcaattgggatacacttataaatgcaaattcttagtccccactctaggcttattgaattaaaaatgtgggcaggagatgagggtgagaagtctctagttgattactaagtacaataaagtttgaggcccactagacgtgattatttctgaagtctggggtattttccagctctaacttttttttaattgttgaaatgaagacatatcttcctagatggagctctgaaccttttattttttatttttttatttttattttttacacagggaccgtcttactaaaaatgatgtagttggaacaacatatctacacctctctaaaattgctgcctctggtggggaagtggaaggtaagtcactcaacagatctagaacaagactggatacagaacttttctccagtctgagaaaaaaatgaactggggtagccacctcacagtaggtttggtttcttagaagccaaatgtgatgaacctagtgaaccatttcaatg

SEQ ID NO: 62129 - DNA, 1050 bp, Homo sapiens
ttcaagtgattctcatgcctcagcctcccaagtggccgggattacaggcatgtgccaccacacctggctaattttgtttgtttgttttgagatggagtcttgctctgtcaccaggctggactgcagtggtgtgatcttggctcactgcaatctccgcctcccaggttcaagcagttctcctgcctcagcctcccgagtagctgggattacaggcgcgtgccaccacacccagctaatttttgtattttcaatagagaaggggtttcaccatgttgaccaggatggccttgctcttctgacctcatgatccaccagccttggcctctcaaagtcctgggattacaggcatgagccactgcgcctagcctgttgcaactattttgatgtataagagaacttttaaaattttgccaaatttctgggaattgaatttaatttctgctgtataactattaccttccagtggatgatgccttctcacagacagtaaaggaaatatttggaggcaatgcagataagaaaaatctcgtggatccttttgtagaagtttcctttgctggaaaaaaggtttgtacatgatctaaatgcagatgctgctagtaataaatatctaaaactactgtgctttccttggagtgaattcctgcttactctttgttaaaatagccccctgatgagccaggcactctgagggaacacagattatctgagtctgaacacgccagacttctccacaggtttattttggagtggaaagtatgcagaacacaaattagaaaattcaatcttttgagagattaaaatagggaaggctaccactgaatttctggaattgcttttcaggtccaaacgttatcttaaccttaggcaagctctctggccagccacacccatccctggtaaatgttgtaggacagagacccccccccagtgccctgttgccccttcctgtcatgtttctcaccttccatgccccagtaaactgttgaaaccagagaatgggtcagggaagccccatcccactcccctgaaaatatctgggagactctt

SEQ ID NO: 62130 - DNA, 1064 bp, Homo sapiens
gagaaaattaaatgagatagtatgtgtaaagcacctagtacagcacctggcacattgaagtgcccagtcaatggttatattaatagtagcattagctggaggagaaggaggaggaggaggagaactggacaggaaattgggccaggtgaatttctgtaggatgaccaatggtcccactttgcctgggactttagtggtaaaactgaggataacccaggcaaactgggtcatattggtcactctgcttctgtggtcccttccagccctaagactagctcattcattcaatagtgacttactgagggtcttccatgtgccacacatcagacaaggcactggggatacagagaggataagacggaaatgttgggtctcaaggaaatttaagtgtaatcaagacatgatatttaaatataatgatggcttctttaaagtgactagactgattttaaaatctacttagactactttcgattattgttttcccagattgatgttggatttgtttatgatgaacctggtaagtaatgttctccccatcaatatgaagtcttaaattcattccttctaactctgaagatgattctaagaatcaagacaatttgggggggatcaaagaattaaagttaaaggaattttttaaaaaatattttcttaatgagggagaggagaggatacttagtgggaataaataacagtagcttagaaaaaatgtctaattttttatcttaacattcaaaatagatgatttctatgttttgtgaggatattttgatcttatcaaaattaaattataaaactcgttggtacaacttagagagtcttgtttgagttacacgaggacagaatggtgggggtggggtgtagggagagtacaaaacagaagacgtgaaagtggacactcatctggggaatttggtgtgtcgtgaagaggcttccaagaaaatgcagcttatcttatggcagaggaatcacagacttatcagtacctttttagcatgtccatttccttttactccttctctattttaggccatgctgtcatgagaaagtggcttcttctc

SEQ ID NO: 62131 - DNA, 1049 bp, Homo sapiens
cttgtaattcatagggaaggattttgcctccctaatgtaggtagaaaacaatcaatagaaactgacccagaaatggcacacaatcagtagacatggacagtaaaacaagtattataattctttaaaaaaaattttttgtgagacagagtctcactctgttgcccatgctggagtgcagtggcacgatctcagcttactgcaacctccgcctccgggttcaagtgattctcctacctcagcctctggagtagctggaattacaggcacacgccaccatgcccagctaatttatgtattttttttaccagagacggggtttcaccattttggccaggctggtctcgaactcctggcctcatgtgacccgcccccctcggcctcccaaagtactgggattacaggcataagccaccgtgccccgctgagtgttggaattctattctatagattcaagaaggtggagaattgcttgagcatgctagtagggacatggaagataatttaaaaaaattaacttggactgctagagatgacaattacaatgtctgaaataaagtgaccataattatctgtctcagaatttgcatgtctagtattctttctgccctccaaatacatgtacttgtgcatgcaaaaccaccattatatatacttccacaccaatgcagaacaaagttagaaacagtttctgaatataaatctcaagcaaggcatctgttttgccgtattgtaggaaggagataacaaaaaggcctgacaatatacctagaaggaaatgtattccagttcttgtgtaagaggtgtgggcatgtggccagctgtacaatcatgagattagacagaactttggttttgcttcttgttggttgggtgactcttggcaaatttcttaatctttataatggggactgtgatacttcctcaataaatagtagatatagggcaaatttgatataattaagaaaaaattacttcaatttcctgatgaacaacaaaatagctaattcttttcttctaggtttactgtgtgtcagggacgatgttaaaac

SEQ ID NO: 62132 - DNA, 1377 bp, Homo sapiens
ctcatcatttacattaggtgtatctcctaatgctatccctcccccctccccccaccccacaacgggccccagtgtgtgatgttccccatcctgtgtccaagtgttctcattgttcaattcccacttatgagtgagaacaacaccctgcattttattcttgcagcagttgtggtagtcgttgagtccagctcttgagtatgaagcaggggtgtggtcacctggttgaagccacagaacctagaaagcaggaagccaggagttgtctacaggtcctctaagtcgacatctggtttgctttcctgccccctcagctgccttcaggtttagaatttaatcatttctgcataacttcaaaagattgtcattggtgaaaataatgacccaacatgtagtactggtgcatcttagtgtaatctctgctccttctaacagcctttttttttctcttttttcaaaacctttctgtgaacagattttggagtttgacttgaggggtataccactggacttttcatcttcccttgggattattgtgaaagattttgagacaattggacaaaataagtaagttgttttcacctgtttttctcattttaggtattactatctcactgttgtttattttgttgaagagacacatctttaataacgtattataatacttccaatataaatgtgctttaattccatgccccgctcccttctaagccaatagcagatgtggctaatccatcacagcactttttcccaatgactgcttttattccaaaaaagctgcaaacaccgagccacctagactagtttatcaaacttggcacttagagtgaagcctgttcacatgcctacaacttcttggtcaactgcacttcctacctctggcagtttatctgaactgtagtgatattggatacaacccaaatcacttcttctgattatttgtggcctatacatgtctcattcaagttttactttcagccccatttccatgttaatgtctccttcgccttttaatcccaacagacctaaacagaccttaatccttgccttactgcctctttcctttcacatggggaagggtcacggtggtgcccgtggtgacactgagggttgtcctctgagtaaaattgggagacttcccaaacaggttcccgtgggacagaatgatcttagtattaataaattcaccctagtcctggatctggactttggccttgtagacccagtcgtatgttaccaattcaaactaaccaagttcacaagagactaaaggtttttttcttttttttgactctgtcacccaggctggagtgcagtggcacaatcttggctcactgcaaccttcacctcccaggttcaagcaattctcctgcctcagcc

SEQ ID NO: 62133 - DNA, 1097 bp, Homo sapiens
gccctcagcttaggggtgctggtatttgtctggtatgggttttcctttctaatcacgggtgtgtttctcctttactgtaggatttggccctgccaagaaggtgtgggattgttatatcctctgcaacacccagcacatcactgatgttgaatatacattttaaatattgagcatgtagcaaagaactggcaggaaatttcagacaccttaatgtgacaaagtccttgatgcttagtcctgaaagagaccctgggaagtcatccaattgccctttacgtttaatatcctctcaggtgtttgtgaatgaggcttagcaaagaaccatgtcaagtattcatgaaccctgagtacaaccagttcctagcacctgttctctgggggcaaattggtgtataagacattttgcattcttgttcctggcaaggaaaatatgaagctgccagttttatgttgaaccttcatacatgaaacgtagtatatagaatgccatgatatggcagtggtcagctgactcactgtgtaatttctattgaacagctgttctgttgcactggggtgtgctttgagcaggtctgagcacagttctcaatcagaaaaagttatgggacatttgataccttaagccttatcaattaacttcttactgggcatgagggtacaaaggccctgagctctggggccagggatgcctaaatgagaattccagtggccatccctagttgctcatgagcaaatacaatctgcagcttcaagcccggtcatgatggctcacgcctgtaatcccagtactttgggaggctgaggtggacagatcacctgaggtcaggagttcaagaccagcctggccagcatggtgaatccctgtctctactaaaaatacaaaaaacttagccaggcatggtggtgggcacctgtagtcccagctactcaggaggctgaggcaggagaattgcttgaactcgggaggtgaaggttgcagtgagctgagatggcgccattacactccagcctgggcaacaagagtgaaacttcatctcaaaaaaaaaaaaaaatcagcttcagtgttcttaataatatctcctgccttgcagggctgt

SEQ ID NO: 62134 - DNA, 1005 bp, Homo sapiens
ccctgcagccgcgggattcaaactcccggaagcggcatccacacctgatggtgtgactcggccgacgcgagcgccgcgcttcgcttcagctgctagctggcccaagggaggcgaccgcggagggtggcgaggggcggccaggacccgcagccccggggccgggccggtccggaccgccagggagggcaggtcagtgggcagatcgcgtccgcgggattcaatctctgcccgctctgataacagtccttttccctggcgctcacttcgtgcctggcacccggctgggcgcctcaagaccgttgtctcttcgatcgcttctttggacttggcggtgggtatcatctccttacagataggcgcagagaggccaagtgacttgcccaaggtcttttgttaggacggctttttccgattggcaggcactttcgttgtgtgttcctcaaacatctttattttagaagtgagaaaacttgtgcctttttttgcagtttctcttttcctgtctgtctcctcaagtgagattttatgtgggaatttttaaagattggcgtcgccttgtagaagatgcggcttgtaattgaggccttgtaccatttactggatggaagcgcttgtttggtcacctgtccagcatgacttaggtcacttcagctaatcaaccaatcatttcttttcttttttctttttttttgagatggagtctcgctctgtcaccaaggctggagtgcaatggcacgatcttggctcactgcaacctctgcctcctgggttcaagcgattctccttcctcagcctcctgaatagctgggactacaggcgtgcgccaccacgcccggttaatttttgtatttttagtagagacagggtttcgccatgttgggcaggctggtctcgaactcctgacctcagatgatccacctgcctcggccttccagagtgctgggattacaggcgtgagccaccgcgcccggccccaatcaaccaatcatatctgagggcttgctg

SEQ ID NO: 62135 - DNA, 1532 bp, Homo sapiens
acgcctggctaagttttgtagttttagtagagatggagtttcaccatgttggccagactggtctcgaactcctgacctcatgatccacccatcttgacctcccaaagtgctggggctacaggcgtgagccaccgtacccagcccaagttgacatattttagaaggtgaatactcccatttatctaccactgagattaaaaaaaaaagttacaataccccagaagcctccatccatctttctccataccctgctggtttggatatatcatttctatttagagcagataggttattagacctgtttcaaacttgagatttaaatttttaaactcagaattatacagttgatttttatttttacagaccatttcagagatgtcttccagaagtaccaaagatttaattaaaagtaagtggggatcgaagcctagtaactccaaatccgaaactacattagaaaaattaaagggagaaattgcacacttaaagacatcagtggatgaaatcacaagtgggaaaggaaagctgactgataaagagagacacagacttttggaggtaaatggtcttctgatcctttaaattgtaagctctccaagaaagcgatgcatgaagatttcctgatgctaccttcttactcttgccgtgttccctgtcttgtccagttgattagttttggaaagctgacattgggtttagaatcttaaattcctactttgactttgccaagtcttagatgtactttagtcattactaacttctcaccttttaaatgtaattgagtatgtgttttgaggttaccaggtactaagtttgttctggaaataaagacattgcgattaatagttttgcacctttaacatggtctgtttcacctttagtatgctctgtttctcagttatttaaaacaaagtaataacctaattcatcattcttcctatagcttcttggtaatttagcttaactacatgaatattcttgataacttttgttatgctgtatttaagattgtgaaacattctggctaactattttcgctatttttaaattgatagcataacttagaagcattcgattttccatactttttttttttttttgagactgggtctcaactctgttgcccaggctggagtacagtggcttgatcataactcactgcagcctcaaactctgggcctcaggcaatcctcctgcctgggcctcccaaagtgctggaattccaggtgtgaaccgctatgcctggccattccatgcttttttggagtactaaattactcgttgatgtactttaaggatactgtgctgggcttatatctcttttttactgtgggagaggagaaaatatttacccaatagttatataatctggttttcctgttaatttactaaatgtaaaaaatcagatctgtccatttcagagtattaaatagtgttcagatttccttatttaaaacatattttatcatgcatattggctgctatccaagtaattctggttttcaggcttttgaaggaaaaattattagaca

SEQ ID NO: 62136 - DNA, 2247 bp, Homo sapiens
tcttcctaaattcaagttttaacttcatgctgttttgatcctgttagcctataattttaataattatttctattatctttttattttactttttcctttatgccagcagcagtttaaaaaacattacttatgtatatcttgtgaatctttgaagatgttaagcattcctttagagatcaccttctagattcaatactgaatcatttatcgaaagtaagcaggttaatgaatgcatccctctcctgctgaaatattctgtaacttttaagttccactgattcaaattcattaaggagcatgtatatcttgtgtgaccgacttttagctcttagtttttacaagatccagtgttatggaagaatgattaccaaatactcatgggaaagctagcccttctttagctttttctcaccacccttgatagaggtggtttctcctttctttgtgtctgtgctcattttttaatctgtcttaactacagcacttacaacgttgcattaatacattggcttacttctctgtgagctatctgaacataaaactttggcttcctaatcttttttggccttggtatttagcgtaatgctgacttgataataaatgcttcataaatgcttgttgaagtatatattgtttagctagatgtttgacctggctttgttctaagattcttcttagtttatgtctagaaaattcgagtccttgaggctgagaaggagaagaatgcttatcaactcacagagaaggacaaagaaatacagcgactgagagaccaactgaaggccagatatagtactaccacattgcttgaacagctggaagagacaacgagagaaggagaaaggagggagcaggtgttgaaagccttatctgaagagaaagacgtattgaaacaacagttgtctgctgcaacctcacgaattgctgaacttgaaagcaaaaccaatacactccgtttatcacaggtgctaatcatttctttaaacccagattttttttttctttctgatacagtttgtaattcttaggaggaatgagtttgttaagacatgcttcccaaatgatgagacaaatgattagtatagtatactatcaggtcacttcactttttttaatagcccagtcccttctctataagcaaaaatagttaatatggtaccctccactccttgtaccattgatttgcctggaggaatattcagaagacagcatctactgtgtatttacaattaccaagattttttttgagctcttatttctatagtttgtatcatgaaaacagtaggcttcatttttttggttatttttcatatttgaaacatacaattataatatcaagtatacttttcctaactgcacttgcattttctccccgttttgtttgagaggcactagcgtcatagaaagaacaaggatacagaaatagacatgtgagttcagatcttggttttgtacttgccagctctgtgactctgaacaaatttgttaacctttatagccttagagacaatactagacttctccagacccctgttctaaatcttagtttcttttttttttttttaaacatataagctaaacctgagtttccacatcagtaaaatcaggataggaatagtgagaattaaatgtaaatatgtatgtaaattgcctcgcatagtgcctagtatatagtaggtgttcggtaaatggttacttattgatcagacctttgattcttttggagatttggagattcgaataatactaacattaatatcatctataggctgggcatggtggctcacgcctataatcccaccactttgggaggccaaggcaggcagatcacctggggtcaggagtttgagaccagcctggccaacacagtgaaaccccatctctactaaaaatacaaaaattagccgagtgtgacggcacgcatctgtaatcccagctattcgggaggctgaggcactagaatcgcttgaacccgaaaggtggaggttgcagtgagccaagattgcgccactgtactccggcctgggtgacagagtgagcctctgtctcaaaaaaaaaaaaatcatctatagtagaaaatctgtagctttcaaatatatctcagtgctgttaaggatctttctctgtactttatttcccatttaggggagatagtgatcagacctatacatttatgtgtattttcatagatgggcgtttgagtgtttctgcagatgagttcaaaaagttgaagtttttctagagaat

SEQ ID NO: 62137 - DNA, 1086 bp, Homo sapiens
cactgccaccaaatacctcaataacatcccttttctatctaaatctaatttccctaatttgcccaatcattttattgtttcttgttttttcagtatttttctctttttgagatggagtcttgctctgttgcccaagctggaatggactggtgagatctcagctcactgcagcctccacctcccaggttcaagtgactcttctgcctcagcctcccaagtacctgggattacaggcacccaccaccacgcccggctaatttttatttttagtagagatggggtttcaccatgttggccaggctggtcttgaactcccgacctcaggtgatctgcctgcctcggcctcccagagtgctgggattacgggcgtgtgccactgtgcctggcctccattttattcttataatgtaatttaatttgtagtatcttctcttttggtttatccatgcaagatgctctctttggtttgaatacttctcttgaaactaaggtttgctttcgtaggttgaaaaggaaacgttctttgtacactcagtacttcctttctctagaatttggtatgaggttattttagttatacagtaaagctgtattattgcaaactgataaatggattggtgggttttattgggaatggaataaattgaggacacaggactgctacttacagtgtatttttttcaagttttagagatatgaagtataaagtttctgacttaagtattaggtcagtatgttggtattttggttccaaaaatattactggcatgtctatcctgatataagcatgttcttaagatttctgttttacttcatctatcaagtatcctttgaagtctttttgatcttcaaaagaagaatttaaatctcctggatgtctagccaggtgccaagtactcttatcagaatacgtaatttacctagaggtaactggaatgaaaaggaaaagttctatgtcttattacactgaagtttgttattctatgtatatccatacctatgcattagatgcacatatttagaaatatcttacacagctcctgcattccactttatttactccacctgcaccacaatggctttcca

SEQ ID NO: 62138 - DNA, 1079 bp, Homo sapiens
tttagtatttatttaagcattatgttagtataaactagacaaaccaaatagccaaaagacagttttaataggcgtttcttgctcttaaattcaaatatccgaattttaagcatagaacttagggaagataaataataattgttttaaaattattttgtctgcaaacattcaaattaacagaaaagttacaagaatgagtatgataacatataataacatataacgcccatatcccctttactaaaattcaaccgttgttaacatgttaccccattttgcactctgtttttcctctttcaaccctcacccacacacatatacatgtagtatttttttctgaaccatttgagaatgaattgtacatatccacagccgtttaaacccatatacttcaatgtgtgtttgttctcccatccaagtactaaacagactcaacgctgcttagcttccaagatcagccaagatcaggcgcgttcagggtggtatggccgtagacttcaatgtgtatttcttaagaacgaggatactcttgcccacaactatagcacagatagcaactttaataaatttaacatggatacaatacttctataatctaccattcctactgcagttttgtcaattgacccacattttttattcctccagtataggctaacattttaatctacgttggttggaatttttgtctacagaatatttagtggattcttgtcaaacctgggcgaagacctttatagcattccacaggactttttttttttttttttttgagacagagtctcactctgtcgccgaggctgtagtgcagtggcacggtctcagctcactgcaacctctgcctccctggttcaagcgattcttctgcctcagcctccagagtagctgggattacaggcacctgccattgcgcctggctaatttttttttatttttagtagagacggggtttcaccatgttggccaggctggtcttgaactcctgacctcgtgatctgcctgcctcagcctcccaaagtgctgggattacaggcgtgagccaccatgcccggactccacaggacatgttattttgccca

SEQ ID NO: 62139 - DNA, 1003 bp, Homo sapiens
ggaggcagagtttccagtgagctgaaatcatgccactgtattccagccggggccacagagcgagactccgtttcaaaaaaaaaaaaaattggccgggctcagtggctcatgcctgcaatcccagcactttgggaggccaaggcgggcagatcacctgaggtcaggagttgagaccaacatggtgaaaccccatctctactaaaaatacaaaattagctgggtgtggtggcgcatgcctgtaatcccagctactcgggaggctgaggcaagagaatcgcttgaacccgggaggtggaggttgcagtgagccaagatggcaccattgcactccagcctgggcaacaagagtgaaactccgtctcaaaaaaaaaaaaaaaaaaaaaaatttcatgaccatttaattttgacttaaattatttgtattaaaatactacttaaatgtggacaaatgtaaaatttagtataaaattaggtatctttagtatctaacacactataatttataggtatttggatatacatgtgcattgtgagtcatacagtgcttcctctcttatcaagtaaatttaaatctgatcctgggtttctcatgagtcctttcttttgaaagatgcataggttctgagtaagaacctcactggggatggcagtggagctgaataagagagtgactactgcagcctgttttaagataggccaagaatcctagcaatcttctcaactgtactaagttcactgattatttttcccaacttttatgattatttttcccaatttttattacgaaaaatgtcaaacatacacaaaagttaaaagaaaatacattgaacaatcatatatctaccacgaagtttcaataagacagactctttaaatcaaaaatcaaattactacagtgaaaacagccatccacagagctttacactattgacgatatataatacaaaatggatatacaatatctccacttgacaaatggactcttaagccatgtaaagaggac

SEQ ID NO: 62140 - DNA, 1017 bp, Homo sapiens
gagacagggtttcaccatgttggccaggctggtcttgaactcctgacctcaggtgatccaccaccctcggcctctcaaagtgctgggattacaggcgagagccaccgcacccagccagctgggcagggctcttgaagggggattctgagcagttcatctccatgtctgtcataaaacgtgttttagtttacagagaatgacatatacgcacacacaaagcaagttgtgtactgaaaaaagcaaacaaatgaacttaatcccacataaactacgatggtgtcatgttgttatgtattctgaaggcatgtaacatagaatggttgcccagaattagtctatgagccatagagtttttgttggaaaagactacatcacttggactctcttgcccattttaagattttgtttttttattttactgttgattttctttcatcttcccattaaggctctggagaaaaatcagcagtggctcgtgtatgatcagcagcgggaagtctatgtaaaaggacttttagcaaagatctttgagttggaaaagaaaacggaaacagctgctcattcactcccacagcagacaaaaaagcctgaatcagaaggtactgactggtataaaaatgttctctagggataggcctgacattttccaaaaggaatgattcatcaaatttagatttttatagatatgtgttagaaagtaaaataagagcaagtcttatagccctgaagtaagaaataccatttttgcaagttttatttcctaacgttttcagatcaaaagaaagtaccaacacaggctaatgggtgatctttggcagttctgaaatcacattcagttctctctacccatgaatgtccttcccctttttcaaagtccttctccagcttttacttcccccagagttggccttgtcacaattctcttttcactttgcttcccttcagcacttattcatatcaaccccaggagaaagaatgccttttttagatgatccttaaatcatttgaacttcaggt

SEQ ID NO: 62141 - DNA, 1805 bp, Homo sapiens
ccatcccaatccccgtttcttcctcccatcaggcaactgctcttaatatttctatttttaattttgatagttatctccacatataaataatgagcttgtgttcctatttgttgattgaacttcttgagactttccctcccaacagaatagatgttactgtttttagttcttctatttgtgagttttataacttcaaatagtatacctgaacttgttttttatttcatcaaatatcaaccatagtccctatctcttgacttttcatgttgtaaactaaggaaatagtgtgattcatttagatgtttgatgtttctcttttcaggaatattatttattttataaagtgagttgtgccgtaatgttgtttgtcataggttatcttcaagaagagaagcagaaatgttacaacgatctcttggcaagtgcaaaaaaagatcttgaggttgaacgacaaaccataactcagctgagttttgaactgagtgaatttcgaagaaaatatgaagaaacccaaaaagaagttcacaatttaaatcagctgttgtattcacaaagaagggcagatgtgcaacatctggaagatgataggcataaaacagagaagatacaaaaactcagggaagagaatgatattgctaggggaaaacttgaagaagagaagaagagatccgaagagctcttatctcaggtaaacttaaccagatccataattcagagtgttcaccgaacactttctaagtgtcagggactatttgaccactagagaactggctagggacaaaacaaattcctgcccctcatgggagttatattccagaacagaaacagaccataaacaataaataaggaaactaaagaaaatgcaacagggtgacatgacaaagggaaattggggaccagtggaggcctctctgaggagatggcatttggacaaagacctgatgatgaggaggacccagtgaggtgggtgacttttcctctcaatggaggaaattgtacacacaaaggctctgagtgaggaggaggtcagtatatgtgagaagccaaaagaagaagtgaagtaatgagaggaatcgaggctgattcctagactggcatcttaatggtgatgatatgtgctcaagtgaattcacatggcatcttccatgttcttgttatgctcatagccttatgctatggtatcataataatgttggagttactacgttaggattattggaattgaacagtactttgatggaactctttaatttagattttgctttgcagcctggcatcatggaaggaacattatttggaatccatgcctagtctctagtccaggatatatggccttaggcaaatcacctaacttctctgactactcactggttattcccttgtcaaattaataataacctctgcttgccatatagggctttggtgagcgtcagttgagagaaggtaaaagtgctttgtaaactaagcgaggtaaatgctagttattgctactattttaataataatttttaacagtcctacaaaagttgagggtgctggtgatgggacagtaacaagtccatctataacatttgccatcttagtcttttttttctttttttttttctgagacagggtcttgctctgtcgcccaggctggaatgcaatggcgtaatctcagctcactgtaacctccacctcctgtcttcaagtgattcttgtgcctcagcctcctgagtagctgggattacaggtgcccaccaccacggctggccaatttttatatttttagtagagatggggtttcaccatgttggccaggctgg

SEQ ID NO: 62142 - DNA, 1565 bp, Homo sapiens
gatagccatcagatggccagctggaatgattcacccctgactagcaggtgttgtcctggttagagatgtgagacttgtgatgtgagctttccgtgcatcccaggtcaagccggaaaaggttggatgtgacagcattggttctctttatgtcctacaggtccagtttctttacacatctctgctaaagcagcaagaagaacaaacaagggtagctctgttggaacaacaggtactcattcgggttgcttctaaattcaattctgcctgttagaaaatgcagtttttcctcatgtttatgctgttctatggagaactgtttgaaagttgtgaaaagtgtctttaaaagacttcaataaaagtctttcttcttcaataaaaaagatatttcaagagactctgctagccacttattcctgttgctgaccttaggctaaacagattcttgaggtgtgatggcagttttcttgacaggtagatgttggccttggcaaattttgctcttccccagtggctgtagctcctagcctaacaatgtctcctaagtagggctaccttataacttcaagcagaacttggagagacaccatttagtctcagaatgtattataaatggtgtaaagcagagatttttagtatattccaaaccagggaatagctatctctttcccttctccttcttcccccttaaaaaaggtggatagggaggagtaattctaatcaacaacttcttaagctgctcttcattcacctatacctcagcgttggctttgctccttggataaaccaaatcctcagccataagctgcctcgtttattaacatttcatggtgcttaggtgaattcttgctacgatggtacaataaatattttcttcatgtgctaataaaaaaatgtgagcatccagtcaagagaactagacagtctgtatcagctgtaatggtcttgttctgggccttttccagatgcaggcatgtactttagactttgaaaatgaaaaactcgaccgtcaacatgtgcagcatcaattgcatgtaattcttaaggagctccgaaaagcaagaaatcaaataacacagttggaatccttggtgagtctggaatgattaaactaaaatttgtcttcgtcttccatttatataccaaatcagttccgaacttaggaggatacagcttaacacacagctagctgtatctcaaatcagtaggtagagcctctgcctcatttgaagcaactgccctttgagcatcaattcagaggacatgaaagagggacatgatcacatctggaaacattcccccaactaccccagctgctgtgatgctggaggcactaaatagtgcctgagctggggtcaaaagggtagaatagagggtagtcacagaatcctgaactgaaattgtgtttatctattaaaaaagaaagaaaggctgggcacgatggcttatacctttaatcccagcgctttgggaggccaaggcaggcggatcatgaggtcaggagttggagaccagcctgaccaacatggtgaaaccctgtctctactaaaaatacaaaaaattagccg

SEQ ID NO: 62143 - DNA, 1293 bp, Homo sapiens
tcaaaaaaagaaaaaaaaaaagctgaacattggccctatttacaaattctattatttgaaacttatttttcagaaacagcttcatgagtttgccatcacagagccattagtcactttccaaggagagactgaaaacagagaaaaagttgccgcctcaccaaaaagtcccactgctgcactcaatgaaagcctggtggaatgtcccaagtgcaatatacagtatccagccactgagcatcgcgatctgcttgtccatgtggaatactgttcaaagtagcaaaataagtatttgttttgatattaaaagattcaatactgtattttctgttagcttgtgggcattttgaattatatatttcacattttgcataaaactgcctatctacctttgacactccagcatgctagtgaatcatgtatcttttaggctgctgtgcatttctcttggcagtgatacctccctgacatggttcatcatcaggctgcaatgacagaatgtggtgagcagcgtctactgagactactaacattttgcactgtcaaaatacttggtgaggaaaagatagctcaggttattgctaatgggttaatgcaccagcaagcaaaatattttatgttttgggggttttgaaaaatcaaagataattaaccaaggatcttaactgtgttcgcattttttatccaagcacttagaaaacctacaatcctaattttgatgtccattgttaagaggtggtgatagatactattttttttttcatattgtatagcggttattagaaaagttggggattttcttgatctttattgctgcttaccattgaaacttaacccagctgtgttccccaactctgttctgcgcacgaaacagtatctgtttgaggcataatcttaagtggccacacacaatgttttctcttatgttatctggcagtaactgtaacttgaattacattagcacattctgcttagctaaaattgttaaaataaactttaataaacccatgtagccctctcatttgattgacagtattttagttatttttggcattcttaaagctgggcaatgtaatgatcagatctttgtttgtctgaacaggtatttttatacatgctttttgtaaaccaaaaacttttaaatttcttcaggttttctaacatgcttaccactgggctactgtaaatgagaaaagaataaaattatttaatgttttaatatgtctagtgtattcgtgtatatatagatattctaagattcttgtttaaaaaaacaaatgtgttggacataatcaa

SEQ ID NO: 62144 - DNA, 1318 bp, Homo sapiens
cctgtatcatcaatcaataactgttcatcagtgaaatcaactgtatgtctattctttatacctcagttttggcatatgcattgtacagatccacattaaatgatttgatctatgtttcacttctgtctataaaatgggtataaagagacctacttcgttggattattatcagaatcaaatgagaaaacatacatgtaaagtatgtgcctgacgcaaagtaagtccttgataacctgtagctatcattgttatcagagaaaagaaaaatacagacatataaatcctgtgtttgttctctagaattgatgaaatcaaaagttaagtctataaaaatctgacctgtccatttgttaccatgattattggagacatttgccatttcttcagtggtgcaagttattagttaccatataatatccacaaaaaccaagatgatagacctactttcattattcaaaacatgtaggaaaaattgtatataattttaggcaccacactctaaagggaacattgaaaacttgaagcaggtcaagaagaaaaaaactgaggtatggagaaaacttgaaattatattgtaggaagaatgttggaggaactgcagatgtttacctgggagaagagtgaaaggatgggagggaagaggtgaggaagtagacatggaaattactgtatggatatttgcaaggctgctactatgtaggagacttattttttatgactctgggttggcagaactgcccaaaaacagatttttgccttaatttaaggaaaaacttgtcccttagaactgtctgacaaaaggaatggagaaatgggctgcctctggagtagcgagtgttccagcatggactggattggcacttattggaggtgttgcagtgaaagttcattcattggataagtgttggattaaatgacctccaggttcccctttcaactcagaaagtcagtgacttaaattctgatccctacttaccaataatcactgaatagatttgacagtgatgcattcttttgtgttgcctgttcttccaattgttatttccttagtaacactcctcccgcccctggcaggttgtaacagttatgatagcaatgatttgtagtgactgccaaccctcagggaaccaggatactatagattcatagggttataagggaccttaaaggtcatttagtccagtcttgtagacttgattctctagggatatctggccacttttttagtgggtattttttaagacagttagtttataatgttactctaaactgacttgattttttagtaaaattgactggtatcagaaaactggtgtaa

SEQ ID NO: 62145 - DNA, 1081 bp, Homo sapiens
aaaaaagtcatacctgaaaatgtttttttaaatccaaacattacaaagggtaaacagtgaagagtgattctccttcttatttgtgactgtcagttctccaatttccctccctgagtgaaccacttttaatagttaatatccagatattccatgcacatgtaagtaatagttctcttaaaacattaatatttatgtagtatgtattctttgacatcacttgaaagtagcaaaccatggttgagtttctaaatgtataatatttatattttcatgggtctagggagaagagacttgctaagaaatactatgataaattatttaaggaatactgcatagcagatctcagtaaatataaagaaaataaggtatgctttccacatatttatggaaagaggttcttattcaagtaaaatattaacttttattatactgtcatgccccacattattcttttaaagatgctaattctagactcagttgtcctgcgtttatgatgtgtcatttggaccatttaacctctgcagctgtggagtttacaaaaggcctatggaaatttatgaaggacaaggatgcttttttttgtttgtgagctgaggcatgaaaagtctaaaattaaacgcaagtgggtattggatcctgtttcatcctgactctagtctagagcctctagtgattgtaatgaatgacttaactctacagaataatgtcttatttcacagatgatgtttgaaactgatagattttaaaaattgattaccatttatagagatccagatgcacatcttctattacataaatgtctattctagtaaaattaacatttcaatcagtgctaattagtaatgacagatttcctttcccactttacatcttactttagttaatatttttatttttggttgggcgtgatggctcatgcctgtaatctcagcactttgggaggctgaggcaggaagattgcttgaggccaggagttcaagaccagcctgggcaatatagtgagactttgtctccacaaaaactaaaaaaaattagccaggtgcagtggtgcatgcctatagttctagctacttgggaggct

SEQ ID NO: 62146 - DNA, 1185 bp, Homo sapiens
aacaaaaagtaaaatgctcatatattttgttacaatgctttgaaaaaacatggcattttattctttgaatttaaaagactataaaaattgattttttatatttgcttttttgaaagtttaatgttgggatttaattataaattataaatataattataaaagttgcatcttctatttagaggctttatcattactaaaatagataaattatattttatgataatgaaagataaattctctacttttagaaactataatttttaaatttttcatattgtgattattagaatgagtggtggtaggaggctatatgcagttcagcaatagaataagaagctctatttctccccagatggaggtatatttttatcacaagagtagtatatgcttgaaaaatagtcaaaagaaagcctgtactttacaatcttcactttcaacaatttaatatatacccttctagattttctgaatgtgtaagcatgtatagtgtgtgaatatttttaaaaagctaaatagactcatattgtgcttttttttaccaccaatcagcaatatattatgacaccaaacagctcctaagagaataaaatccttaattttttgcatttcagtatcaaagacatacaaagttcgtaaatgactatattttatactatggtggcaaaaaagaagacttcaagcgtttggggtaagtatcaggaagtttacatagaagggaatgtgggttatgggaaactttaaagacccacagctactgtgccttctgattctgtcattcttccctgctttctattccggtgtgcctttttttttttttttttttttttttttttttaagatggagtctcactctgtcgcccaggctggagaacagtggcttgatctcggctcactgcaacctgtgccgctgtggttcaagcgattctcctacctcaggctcccgagtagctgggattacaggctcctgccaccatgcctggctaatttttgtatttttagtagagacggggtttcaccatcttggccaggctggtcttgaactcgtgaccttgtgatccacctgtcttggcctcccaaactgctgggattacaggcgtgagccactgcacctggccccagtttcttttttatattataaggtagagataccatccacagctcctgagtagctcttcatgaatccca

SEQ ID NO: 62147 - DNA, 1011 bp, Homo sapiens
tttgttttggtttggtttttttttttttggatgacagattctggagacacctggcatctccgtttttgagtttctccccgctcttgtcagttgattcgtaggcctgaagtgagtgagagctttttagttcaaccagtgagttaagataggtatgggtcggatggagcggccagcgaataaagaaatgggagagtgggagcaagaataggaagtcgtgtcctggggcgagggaaaagatgatgatgatgatgtaacatttactgggtttcactgtacaagacaccgttaaaaccctttagatgaggcaactcttttaatctccattcgtatgaggtcagccatcttactagcctctttttataaatgaggacactgaggcttggagaggttaaggaacaggcccaaagaaagacaaatggaaagtgcagagccaagcagtgaaatctagtaggctgatcctagaatatatctctaaacacactacagctgtcccccatcaagatgtaaagaacgtgaggacataggacaaagagtgagaggacaatatggcttgaacagatgtggtaagacagctggagttgacctaaaaaagggtgtaaaatccaggtgtgtaaggcaataacagatgtaagggagggtagagttggaactcgggctttcaaaccttcatctccaaccttaactagcatcttcctatctaggattttagtggggcagagaagagaggtatatacccacacacctatgtttgaaaatggaattacagactttaaaggttatttaaagatttaaacaacttaaagattatttcatgtagctatcttatttaatagatgaagtccagggagatgaaatgacttattcaaggtagccaggactagaaacatgtcgtttaccctagatccaatgcaatgaagtttagagagttctttcctctttttccagctgcacttgctgtcgttatattagttttaacaatttgatatatcatttaacctggactgttccttc

SEQ ID NO: 62148 - DNA, 1395 bp, Homo sapiens
cttcatgttccaaagggggattggcagcccatatggggttttcagggcactggacagccctgtctcacagaagagatctttctctgtgggatccatgcattcccacaattgttatgatcgtttcatagttcatattcagagccttctcatatatttcctacacaccgcacatgagtttattagaccttttcctgaggataggcggaagcagagaatattgggcaagaaggatggagagcagagtcttcaggcacagggtcctggagattagggacaaactttggcccctgacaattttgcataagttcagctctggcacaagtctaccatgttgaggttagccaatctgagttaaccgagaacacactgggagagaattactcgccttttgttatttctgaaacctgaactgcttttagaaataaaggctggaatgttccataggaactcggagcatggggcacgggcatggcacacactcggttgggctatttaaaaaccagtcccttggcttccctctgtgattctaaatacgtgaaatcacattaccctgcagcagccggtaactatttctataacattgtccagcatctgtgcttgccgtgactgggtccacccaacaaaaacaaagtggagatgtggtaattgattaggttaatcactccaggctttctgtgccacagctaatgtccatctagtgtctactgacactactcctggaattttaaggactgatctatgtaactagatctatgtaacttcctaggggaagggaggtgccttagcatatcaaaaggatgctttttaaaagagctatttattcatttaacaagtgaggaccagaaacacaatttatcactttctcagagacagcaaattcttatcctatggaaggatcccagcattagagactctgcccctttctgtgggaaagaatctatcttttttggatttgtttgatgtgctaactaacacttcccccagtcacaccactagccatcaatcaaacagataaaccccttaggaatatctagtcaattgctaatcatttgaagacatcagccagtagaagggcattagccaacatcattacataatgtcaaaacaactgatcaagtttgtgaatccaatgaaacagtcaaaccagtttaggaatttcatatacacaaaacaatagatgagtgacttttagctttttagcttgatataaaatttttaaaccctaccatttataaatgtgtaagcatttggcacaccctatgccaagtgttttatctacttaaaccttggaagtatgtgttctcacttccattttaaagataagaagactgaggcttagtgagatatactaatctgcacaagactacatgtttaggttctatgagtggcagggtg

SEQ ID NO: 62149 - DNA, 1027 bp, Homo sapiens
tcaaatacaggcaaagtataatttaccatatcaagaatcactaccagcttggagctgccatatcagggtgaaaagtgacagcgtgtcactcatctttgtgtccttcacaaagcccaacattgtacctgctacccagtagagcctcaaaacatgtctgctaaaatgggaggcttttgttttcattttgttgctgcttgcaactatacaataaataaatacttattttggctaagcagtacttaaatcaaaaaggaaattatctttgtgttattgatttttcttttcatattaataatgcttaactaacatttccctctggatgtccggtcaggctggataaaggagcatcttacccttcccaggacagactagtcggcctctgcagtctgactaaaaaccaaggagaccaaatgtgaagtcagcgtgggacacaagagattcgagcggtgggtctaaggaaaggcttagatgctttgcctttgaaatctggtatgctggaaatctctgctgaggaagtttgaattcacaacttcatgagcaaatatctcctcgagtttttttagttcggctcacttcccagacctccacactattagtccacgtgaattcagatagggtgcaccaaacatcagaaagagtgtgaacatgaccagcattatctgctgagagtaacacaggagtcttcagcacaaaatcgatggaaacataaactggattcaacaaatacatgggaaaacatgtctgggtttttctctgggaccacagtttattggtgatcctccatgaaagacacaaggcagatacaagcaccataactctagcaaatggcacacagtgccagacatcagtaaagtctagagaatttgagaatcaacagaggtcatagaatgagatcctgcagaacttgtttgggcacgtgtgtgtgtgtgtgtctgtgtgtgtgtgtgtgtctgtgtgtgtagagtcaatgatgtgagtgataaccttggacaaatagaaagggccaaacactatggatgccagctca

SEQ ID NO: 62150 - DNA, 1786 bp, Homo sapiens
aggatacttattaagtttagtgctcaataatatacttttattctttctgattaaaaaatgaaagtatttagaaatggaactttactttgtgtaatgcatccagtaagttttgctctgtactcatcttttaaaattgcgtatttgatttcaatgggaatttagaataatattcttaaaattgcctgtaattgttttttttaaaaaaaagctttcataatttcattattaatattgctctgggatcagaggatgtgacctgtaaaatgctaacattaagctctaattcctccagattctgctgtctgtagggacgggtcatgactaagtgacactttcacaccaaggtcataaagctattagggggttcctggttgaacggagaggtaggacacacagaatttacttcaaaaggaacggaaaagtaggcaacagggttaacatggagctcagagttcagagggaaccagggccagcaacagagaagtaaatgaagaagcagaggatctaagaatgaggatatagctacaaggggtcaagggtaaggctgcccaaataccgggtgagaggccagagacgggaatgcataagagcgaaaggactgggcaggctcatgtgttggtgctaagtctggtgggccactgaggtgctttcctgccctggggcctcgcctcttcagaggccagggaagcagcacactgaagagtgaatcaggaagcctaatataaatttgaccataccttctgtgtcctagagcataccacttttctctatgttgtaaagcgaggagactagactagatcatttgtgaggtcttttgtagctctaaagatgtgtgagtctatgcttatagcactgtagccttcattcatgaaagagtaggcatgtggaatctggggagcggggaggctggtctgcagatggctgaatggttgggggaagggtgactcctgctaagaaaacttcccattgtctcaaactagactgctcatttggtcccgtgccaggcaccctggctctaatgacatgtacttcttcagactctctccagtcacctataatatcttgattgccattagaattgtatctggcccatgagtggcctacatcccatgtttcagcctagagcagattttcctggctatggaggggagatgatctaggaggctcttccagatgattcccaactccacaaaaaccactctgattaagaagggaaaagtgagtagccagtgcctggttgtcacttggagaatgaattgattggattcagaatagagaatcaggtttctaagcttgtaactgccagttattattgtatgtttacacatcaagtaggtaaatctgtttcatcatctgttaaaataggattgaggatgcaaaaagacttcctggatgattttaagaattatgtgagataatgtgtatgagcatgtctccaatgcttctgccaaggaatagctaagtaaagagcacagacatcaaatgtcagagctggaagagctcttacttagatctaggaaaagaacacgtgtttaactgctaaggaaactcaggtcccgtgaggatgtcacctgccccaagaagactttgatggacatctaggatattaggtaggacacggacagtgtgtacaaacatgagtgtgcacactcccaagtgaacatgggtttatttgcatatgtatatgtatatgtaaatgaaagagcacaggatgcacaggttatagctgttggaagatatggagggacagctggaggggcttgccaaattgcttagagctggcttt

SEQ ID NO: 62151 - DNA, 1139 bp, Homo sapiens
ctggactcaagtggtccaaccgcctcggcctcccaaagtgctgagattacaggcatgagccaccgtacccagccttgaatacactttggtgaattctgtttataaataatatatgctcattgtggaaattctggaaaacacaaaagcttaaagaagaaaatgaagtgcaccataatcatactacccaaagacactgatatgcataagcataatgcatatatgatatatacacatatgtatttataaaattgatgtaatattatatcattgtgtatccttcttttcatttgcttattatatcatgaacaatttctcatgacaatcaatttttcaaaaatatagtttccatagatgagtaagttttgtattatggatatatcatgatgtaactttttaaattatcgattccaatgtttactattataaacatgattataaccatccttatatataaatatttttcctatctctacttatttccttatgatagacttaggatagatttctaaaagtaccattattagattatagaaggtttttaaatctctagttctttactgctgacttgtaccaaattacatgtccaactctgagtaaggaaatgcctatctgaccatatcctcaccaacatttaaaattatcatttttatttctctatgaaatcatgtcctttgaccccttttgttgctttctaagcactttttatttattaaggatattacttcatcttttcctatttcttttgatgctaaaagttttttcctactgattaccaatttgccttttcattaatgatttttaacatatagaagtttaaatttgtatttaacaaaatacatcaactcctattatgtattatttctttgcgtttaatcttttttttttttttttgaaacaaagtttcactcttgttgcccaggctggagtgccatggcacgatctcggctcaccaccacctccgcctcccgggttcaagagattctcctgcctcagccttctgagtagccgggattacaggcatgtgccactgtgccggctaatttttgtatttttagtagacacggggtttcaccatgttggtcaggctggtctcgaactcccgacctcacgtgatccaccctcctcggcctcccaagtgc

SEQ ID NO: 62152 - DNA, 1042 bp, Homo sapiens
ttcacaccacacataaataatttttaaacgcccaaacatttaaaaatgttttttagaggatactttcaagaaagccaagaaatccactaaaaggcaagttggcatggatccttgtacttctaagataattcttgatttgggcatattagagtaggtccaaaaggctaaacccatcttgggattcccatgagagactgagccaatttcaatatttttttgttttgtctttcactagtgtagggtatagactgacacaaaaatggggtaaaggacccccaatgagctacatcccacgtcacccatggagtgtgttctaacttccaagacactcccagaactgacctagtctcccaagagaactctgacccacactaatgagtggcaacctttcaggctactgtaaaccagagaggataactatggtctgtccaggactctcttggaagaatcctgatttgggcattctcctggaattaaaccatatcattcaggaattgaggtaatagacatggaggaggggctggggaaatactgcaaggaacaaagaaagtttttcattaggctactgatttgaagttaaatactgggcttggaagaaagtacttgactcagattttctttttgtttgttattggagaaaagttgttttgaatatatattctacagacaagtacctgaataattttttaaaaaagcttttgttttcatatatcctttcatttgttcctgtcttccaccttatgacatttaaatacctttctaatgttctggaaggcaaataatgaagctgaattgcttttgagaagtttaggcatatattacttgctttgcttacagcaaaatatacaaattccttgcaaagatctttcactcggaggcttaaaagtcaaagtttgaaagctcttttgtttgaaaaagggtcaaaaataattaagttcattcccttcctggggcttaagccaaattcctggggattaagcttagagttgttgttcagtctaatgagaaaaaaggcaaacttttctcccttcccccacttcct

SEQ ID NO: 62153 - DNA, 1026 bp, Homo sapiens
ggcacgcacctgtagtcccagctgcttgggaggctgaggcagaagaattgcttgaacccgggagttggaggttgcagtgagctgagattgtgccactgcactccagcctgggtgacagagcgagactctgtctcaaaaaaaaaaaaaaaaagaaaaaaaaagaaaaaagaaaagaaaagaaagaattaaattccatggccaaattaagggtgaaaaatattggaaaaatttcctcactgcaggacttctcagatccacagatgtctgtattatgaacctacaagaccaagatatggttcatgaatttattggaccacaaaatccttttcattacaaggcatacattaacattttgtagaagacacgtttgtgtaacaaatttgagacttattgatctaaaataaccttcttattttatagttaagaaaaaggggttgaggggtgtcagtgagtatgagcagcttgcccaaatagactgtggcagaacctggactagaactcatgattcaccatccaatacttttatttgaagaaaaataatcaaatatttactgtttatgtattatactagaccctatgctaagtttcttgaatatgtgttcacatgatcttattaacaaccttgtgagttaagtattaatattattcccgttttacaagtggggaaattatggcttagagaacaatcccaggtcacttaacaaatggtagagttggaattcaaatgctaaagcattcccctataccactcatctttccttgttgcccttggctgaagcagtttaaattaccactcaaaatatcattaggcttttcatacctgtaatgttgtcataattccggaaggtcttttccacatggtcccattcaaggaaaatgcattttccagtaaaaggctgagcgatgactacatactcatcattcaaataagaaaaagtgtctatggacaatgattgataaggcaggtcttgagactttgcaaattctgcaaaaataggaaataataagtaactgtgagctaatacc

SEQ ID NO: 62154 - DNA, 1604 bp, Homo sapiens
caagcactgtaaggttacaatctctatcagctgtcagatgtttagaaagaccctaaatagggtattgagatcctaattcttgattttactttctcctagaaattgtctgagtgatgattttagctgggcttatcagtcaggaaaggatgggtcttgctgtccttaatttcaaatcagtcttcttgtagtaggcaaatttctctacctttcttttaatttgtcaccatttcacctcaaattatccctaaaggccatgacctttggaaatacctttgaatgttcaaaatcagctgatccagccacagataaacctggtcataatcaatgggtaatcaatatcatattacccataattttatcttcactcattcttcacatcgtaaatccttgatccaaatacaatactattatataaaactatttcttcaacataccaacaacaagaatgaaacagctcctgtaaataattacctctgggatatgaaagaaaatgtaaacattttatttggcagttgtttctgtacacatgaataaataaatggaaaagtacatattaatatttctttttggagtaacagataccattaaacgcttatttacacatcttcactgcaaagaacagttacacaattaaattttgtcttataaaaggtaacttcccacatcactggactggacagttaaggatggagatactggtagtgcttggttctagcagtctcaatgtttgaaaggcattcatttgcaagtgtgataagaagagtcatcatgcattgagttcatccgggtcatgtactgtagaaaatttctgatggcagccacagaatttggtgtctcatgcgcttaagtcaactatgacatgtttgtaaatctgtgtatttcccttaaaactggaagcaaaaagaaaattacgcttattaatggacacatgtgtgaatgatcttggtgcctgaacatttaattcctgaaatttcacaaatttggctttctctgcatcccagttatacacttgagtaaaggagtaatcacttccaagaattgcatattggtaattatttatttgaagaggctggaacaccatggatcctcgcgatggcatcctctgaatatcctggaacgaggagcctccccatttcatgactttggaatcaccaatgaatcttgtcaagcaaatgtacacgtcccctttcactgagaagtgcttcactgcgtacacatcctccatgttaggaatgtcagtttggttagtgaataattgtgttgctttgttccactgataaattacaggacgctgggaactactagacagaattaaatgaggcgttctgagtgtctgaggtgttctgactatttctagatattccacatcagtgtccctgtaccacgcgtgtaaggattgatgggagtagaatccgtttccgttccatttgtaaatggtagtaaaaccagcttttgaactgtcagcaacaacaaagtaccagttgttttcaatcttgaatgtttcaatgtcattgggttttcggattttgagaatttcaatatcctggatttttatgaatttatttgcaaaactgtctcgcttatagatgtgagagccaccaaac

SEQ ID NO: 62155 - DNA, 1077 bp, Homo sapiens
tcatcatttttatgacctagcctcagaaatcaactatattattcccaccacattcttacaagcaagtcataaactaattcacgtttaagagtaggtgaactaggtactgcctcttgatgggatgggggagaggctgtcacagagcacatgcgatggcagatattgttgtggttatatttgggaaataaaatctgccttgcatgtactgtctcaatccttccattatctttggaagtaggtattattgtccctctttacagggaaagaaactgaggctcagaggggctaagcaactggcctatggacaaggctagtacatggcagagttggagttcaccctagtctgtacagagcaggtgttctccagtagcatatgatgctgcttacaggaaaagggaactgaaaaaaataagacattcaaaggccagttcgggagtgaggtattcttctctcccataatcctgatgtcagagttaatatcttccccatatgggaatctggttcctgtgcataactccccagggagttgcttcccagaaactatgtaagtatgtgtgtacctttgatgcctcaagtcttccagatatgcactgtgtgccagcagctgctgtctgccctccccgaccacacttatatggcaaaatagtccagcaaacaatgagcaggagcaagctctgaccccctccgtgaaggcagcacacagaaccagttcgtgccaggaatatcttctctgccgtgatccccctttaaaattacatcttccctttaagtgcaaacaagaacctagacttccagaaagtcatcttgatactcccaggatacttataatctggaatctttagaaggtacttggcactcactgcttgctctgtaggatttttgtgttctaacaccccagttagtcttctaaggcctcagagggcaaggttcatgccctattctgcctcagtcccccacccctgctatacaataccccattcttagtaggtaggcaataattaggtcaaaaggcctcagaaagtttattatattataacaggaggacacgtgcttctttaaaagcattttttgagagcc

SEQ ID NO: 62156 - DNA, 1110 bp, Homo sapiens
cttcccaggtgatgacctcaagaggactcctgaattaatgtctgtacagtaacttctcagagtctggttaccaggtaactcaacgaggaacactgtacctccccatcttcctctcactatccctccctcctcacttcctcttcctttttgctctcccttgttccctcttttcctccctctttttctcaccctttttctctcttctttcctctctctattctctctcctgctctccctcaaactgcgtagtttctcacctctgctcctttctgagctctcatgtcattctcttctcattttctgaccagtttcctcagctcttccggcacatggaccatgatggctgcccccagatggtgccttcagctccccagtcaccatcactgtggtatatgctgttggtatctcaccccgatgcctttactgggctgatgtcctcatcttgcagctgctgtgggtgtcagttaataacagctcatatgtgtacccttctctggaggactatcctttaccaactggaagcttctctcctggagatgcccaaaaggttttgccccacatgccttagccaatgactgtcagatgggtgggggcatgcaaaagtccatcctccttgcctcaaggcaggacacactctgtggtacaattcacactctggacagccccctaggatcaggtgcaggctgccttttcctgtctttgcatagcatcttcccctgttccatgttgctcctctcactcccttcaggtgtagcctcggagcactccctcaatcaatccctctgcctctaaggagcctgatttaggctcatctccttacagatcctgtgcctgtggcaaattggctcagcctttgctgtcctaattccaaatatccaggagacagaactctcttaaagttctttctctttgaactcccattcaaagaccagtgctccctacgtgcagcttggctcaggctgagctcagcccagcatctaggacaaacacctggagttcatttcaggtgaacactgggaacacattacaggtgcaaccttctgtggctgcagaggagacagagttaaatagaatagggcagatgaagggtacatggagaggggacaactc

SEQ ID NO: 62157 - DNA, 1211 bp, Homo sapiens
tgggaattactgttaaaagctccagctagggaggatgctccctctggggcatctctgagtagtactgaccacagatgtggattcctctctggggataaaaatttcaaagggcataggctttctgaaagtgctagtgtcaagcttcttgcctttttactccccatggcttaattcagtcagttcccatccttcagttttgtgaaccaggtcttaggtagatctgcagtgtgtgtgtttaataaggatttactcaggaaataaattgtgtctctttcaccttcaagcctacccaggttaccagtggggagctggcagactgtcaaatcctattcttttggggtaatccatggccagaagcttttgtggaactcactacaggggatgtggctgcttgtcagagatgcaaacaggagcactgaagcttctgggcttaagtgagttgattttcaccaagtttttggaccctcttcaaaaagtaggactattctaggagcttaggggagggatggatggaagaatcacagatttctaagacacagtcctgaccctcagagatgtgtaacctggtgggacagatggatatattgacagctaaccataatgcaaggtcaagtgaaacatgagccttgctcatggtacaaagcaaggggccaagaaacccagaggaaggagaaatcacacctaactagttggttgagaaggactaagatttcaaaagctagaaaagcagggaaagggcattctgggtggttggagccactgaagcacggaagcatgtcagtgcttagatgaatagagattggcaaattgtgtgggtaactggagtgtgggcaaggtagaggatgcaggagtgggcgaaaaaacaggccagatcttgaactccaccttcaggactttctagggccattttaggtcttcttgaaatgtgttgtccctggaggccctgatgctgttgatagaaatcatattaaaatgccttatatcccacattatgattgatatgtaatgataagagccgagttgagtgagttgagctgtagttgtttcagttacatatagatgtggtcctgggaccaatgccagtccagggagagtttggaatcagtttgggataagtacagaacttgagacattaccacatcaaccaagtgtgtgatcgtttttctagtaattcctttttaatttccaaaaagattggttcacaatatatt

SEQ ID NO: 62158 - DNA, 1763 bp, Homo sapiens
tcccagagacaggtggccactaaattagaattggcagcttgacttcacttaggaaaacatcattctgaaacaaaggacaccggtttaaatattttaaaacaatatttgatggaacatactttaaaactgcttatagaaaaggtaacagtaaatcgttataaataatagaccaagatgggaggttatattttgccaacttttgaaaaataagagctggaagggatctttgaaaccttttagtgaagggattctagacacgtctgagggtgtggccatcctttagtaactctggctctctaagcagaggttctcaaaagagaccacacctcctactgatagcatttgttgttttgcctgtctggtattctttccttccttttaatagcactccaattttactttagggaatcactcttatctcactctcactctatgtggttctcatccgtgggttccaggggtgggaacatggcccaacctgggccaataagcattctacccttagccacaacaattgcatcaggatgggcactgggccaatgagcaccagccctgagcttttgttagaactactagagaagaggagttcccagcctttctgttgggcaaggctacaccagcaagactaatgttggagctgttggtaggcatttttccaccatgaaaggagggactgacttaggaaaaagtcaacatagactaaaatagggccaagagtcagggaatgacagatttatgaaagtatcatctgagcatctggtccagatatttctgaagctagatgttcttttatgtttcaactagtttagttaggcttcagtaacttacaaccaaaaaaaaaaaaaaaattcctggctgccatgactcctcagggatcagaatctgggctgtgcatttagaaaaatcctgataattctgatacactcattgagagtggacaggatttgaaaacaggaaatgggagtatgcatttactcagtggagcacttctagttgagaataatttaagctagttgaggaaatttggccaaaatcacatggctagaatacaataaacctcttgggagcttgattctgtcttcttttggggaaaaaaaaaaaaaaaaaaaaaaaaaaatatatatatatatatatatatatatatatacatatatgtatatatatacttttaaaaagtaaaggcacacatcacttaatataaatttgctgacagggacgatgtggtaaaattgcttcattttatcattcagggatatctgacttttattgatgcaaaagccacacagaaatttgaagagctatttttcacacagtgttccctccactgatgtaaaaacaatgaccacattttaacaacagcaagttttattggaacataggtaattttctagaggccaaagtccctcaatgttcctcaataagaatgcatgcatatcacacactgtgactcctgtcatcttctatgttggagcacaccaatgctgctggggtggtcagctcacttcactgccgtcttctacctgtaacttcttggtgggccccactgcctcacctgggtttctgttccacctgttcttctagaggtccacagacatcctcagctctcacagagaaagatgtgatggggtgtaagcattttccacctatcctgatcagtgattacagctcctatacaataatgtaccgcttctacaactcataccagcttagcagaatggagtggccaaaatcccagatgcaggctcccaggtcagacttgctag

SEQ ID NO: 62159 - DNA, 1133 bp, Homo sapiens
tgttttaggagatgtggaaaagagtaagttcttcaagatttgggtgaaaataagtgcatatatgactattttgtgatagtagtgggaaagaggtctttatatttggtcttttaaaatagtatctgtgcttattcacactccattcagagtactagtccctctttactaaaccttgatgaattctgtgctaaaaatacttctttcccatttggtgcactgaaatgtcatatccattaaacaccaacataccaaatgctgcttgcagatactcaacccagcaaacccaagtcaacaggaaattggatcttcctcagcttgttcgtactgcacatctcaacagattattctgaaggattatctaaatgctaattattatcttagaactatcttagaattatgaaataaagaactcatctactataaagaaggtggtattgggtcaaggtctccaaactttcaagctgtttttttcctcctttataacaggtagttacagaaatttcagaactgaaagggacctttgggatgaccttgtccagttccaatatcttctagaaaattgaggcaccaagaaacttaagtgtcttgccatgggtaatgcttaaaactagtatgttctagagcttttggacaactttttctaaccacaggcttggagctactagcatgatactggttagtccaatgtggttatttatatcagaggctcccaaatcccagttagtgggcaggtcgtgggctatcaacatcagaatcactcaaggaacatttaaaaataagaattcctgggtttcattctttgaaaattcaggtttgatgggtttgaggtggaacttcaggaatctgcatatttagttaactttctaggtgattttggagtggggcatccagattggggaaccattatgaacagaagtcagcgttttatgttctgttctctgctgagattggcctgtgataattttagccactgactagatacttgcaggaaagctaaattaggaaaagtcttggaccactaaggagcctctaagattttaatctgcaaggccaacctcaaggtgattaaagtatagagagaggggagctagtgctgcccttgacagatacagattgatttgagatggaagcac

SEQ ID NO: 62160 - DNA, 5220 bp, Homo sapiens
taattctgtttctggaactcttcctagaggaagtaatccaaaaaatgggggaaaaaagcttcatacacaaagatgttcatggctgtattactttctatggtaaagatctgaatatattataaatatttcccaacaataaataaatattaatatttccatttaatataatattatgcagctactaaaataatactttacaaagaatatatgatataaaaatgcttattataatacaagggagaaaatttgtagccattttttgttgttttatacaagcatgcattaaaaaatagcatagaaagactaataaaaagaaaccacatcagtgctaaaaacggttgtctcttagtttttctttattttcaaaattgtgtgttatgtatatgaatcgcttttataataggaagatacctaaataaatatattaacaaaaagctgaatgatagaaggacattttaagacaggcatctttcatgattatagagaatggattggcatactacaaaacgattgcttctaaaacacacaaacagcagaggaagcttttgtgttagaagattattggttgtgattagatgggttttcagcatcagggcacaagaagcaccagtttggtgacatcgagcaaggaggcagggctacaagggactggcagatggcaagaacctacactctgcaggcaaatggccaggcgccaggatcagatgagggaaagggcaagctaggagactgcgccaggggagccagtggtaggggccggacaggagccaacacttattgaggggttgctgagtttgtgccaggcactgttttggatcctgaaatacaggtggagaagactgacacagttcttgccttcatgaaacttacagtccatggcaggggtttcaagctgtttttttttttttggaaagggctagacagtaagcatcttaggttttgtgaagctatacaatctgtgttacaattactcagttctgccactgtagcttagtaaaagcagccacagacaacagtaaatggatgggtgtggctaggtaccaatgaaactttgtttataaaaataagtggtggctagacttggatggtggcatagtttgccacctcctgatctaagtggaagacagacagtaaacaagtaaacaagttaatatgataattatggtttgtgatcattgtcaggaaggaaatcaaaagggtgatctagtagtgaattagtaatacattacattttaccttttaccgagatgtgacatccatacaataaggtgcacaaattccaggatatagaatattcttaacaccttagaactgggtcctgaagcattagaatgacctctccatccaaagaactgggcatggggaagcattccaggcagaagggaaaacaagtacaagagtctgaggcagaaaaaggtttcgcatcttccatgaacagaaagggttttcatggggctagatagcagtgagcagggaatagggtgggatgctgtgggtagaggaaaaccccacagactttagaggccattgtggacattctgtatcttattctaaatgttataggagagcaatggagggttttaagcagaatggcatgatctgattgaagtttcaagatgataagtgaactgctgtcttctttctggacttttctgtagtagtgttcagttaggacggggaactggggctaggggctgggggctgggagcatccagcctcagctggagctgagatgggctgtgtgaggaaaatccattaaagaacaccattaccatacaccacatactgaaccataaacatcgatttattttgtaaaacacctctttgaaatattactgtaactagatttattggcacctgtttccgagcacttaattaggagatactttaagaactgtgcatcaaagacaagaacctgaagaaaatgcaagcagggggttaagaggtgaggtgagctggcaggtacagatctagcagcagcaagtcatgctgccgaggtggaggctcacgggaggcaggaggagggggtcagaatatatctttagtgtccaggaagagaccccggtggtttttggaaccagagagttgaggtttgctttcattggtgtggcttggttctgatttaatgttttgaagacatattgtagggaatagttacaaagtgtccctaggatggtgaaaagaggcgggtggtgagggggcaagaaggaatggagttttgtaaatggagaattagaggaaatgataatttggggccaagagccttcctccttctctccctacctgcctctcttcttttctccttccttccctttcatttatttacttacttatttatttatttactatctaccttggttgaatgtcatctcctttcttttttaaaaatgcagaggcgagagaccaagaggaagaaattgaatcagtatgtactgccttactaaggttgtcatgaagcaagcgcaaactaaaatattgttcatgtttgtctgacattcaaatttaacagagcaccctgtatttttatgtgctaaatctggccatccgtctatgcctgtggcttggattttgccatttcagcgtcagcgagtgaaacctcctcctaattactccctgctaattggaaccagctgccaccaggaggcagccgggcgctgcttccacccaagatgaggacagtgtctgagattctagggagctctgagtctaccttcctctcgaactctcctgacacccatttccacttctagccacaactttccactgctctctcctaatcttgctttagtaaaaatagctaaactttaaaaaaaattatactccatttaaaggtaaaaagaacccataacatcacatgcatcttgcctccctaaataattgcagttagaaattaattcatcttcctttaaaaacctgaatttagcctcaactagtcacagcttctgtcactcgcccctttgacctgggggtccccttcgctcccagcttttcccgtgtccctgtccttgctccctctctccactgtgcccttccttcttcagccgtcactatggttacagggggacctgtttctgtggtgccctcttccatagcctgcttccgaggtaatttccccagtgaattccacctcctctcagttatctctgcccttatcctacttcagtgaggtgggtgggggggggaatcagagagagaaagaaagcgcatgcatccagcagctcagatatcaaaattctttctgttaccaggagactttctccaatcaatgttgcctctttttttgttttccttctttatgaggaaaagctgttcccgactctgcctcttactctggcataaacctaaatccacttataaaagttaactaaacacctcttggccttgtgactgtaacactgagcaacagtttgcttctttgcatacctccaattctggagtcaaaagggtccctttaggacagaaaaatgaactgaagaaagaacaccagctctgtcacatgggggagacagcgacacagaaaatgttaaccaagcagtccaggccacagagagatgtgtccaaagcccagggccccgtaatgagaggctacaggcaaagactttcccagagaggtggagaggaagcgtctccaacagtgtccaagcagcaaaggtgattccagaaagcttatggtgaaataacatggaagcaaagatcacaaacagcagtgttttgataaatatttggatgttggtttgtttggtttctgctaatttgagattctgtgagttagataattttctttgcttctcatgagatataggataacctactcaaattatgcaaatgctcattcaaaggaggaagcagaattatgttagtctcttctataattctattgaaatgatgattcatagggtccattctcaaagaagacttgcatcaaattaacgcagtccagcaacatttttttttaaatgtcataaaagggctgtaactcacaggaactcttcttaaaatccccatgtcctcacccttccactccctattcacagctccttctggtctctttcagaatacaaattctgacaccctcctacggcctaacctgtgagttactttgtgttattctcctcttctcccaattctgcttcatgggagtccccaaaagagggctatgctgggaacgctgtgggagaagaagaaattgactagaaaaagccggaaccttctttaagttgtagggcaactggaaagctgggaacacattgacagcagcacttttgcctggttaaacttatatttttgttctcaaaatgtaagtttcctgtaagtccagacctgttgggatagtcatctcacctagtggcgaccttgagtggtatttggtacttgctaagctgctgcacatgaagctgtgctgtgttcaagggcagtaaaattcaactacactcagtctgcctgcccttaaccaaggaggaaagcaaggtagtctgtgtgggtatgaagccagctctctcattgcgtgtacaatgcctgccatgctcaccatcacctgagccagatcattggccttcctgctaggaggatcgagggcagaggtctatgggaagatgaaagcaaagtgtttgttaccacaccccctttgttatggaggtgatgggcattgttgatataggtgatgcatgggcaaatctactgacatgctaaaaggatgggtagttgttcatgctgaattgaattaattgtttatatcttggctgagtcattaggaatctatgttacagtctctgactttgcatgatccaaagctgaattccgtgactgttattctgattttcctcttggaatgaccaggctttgggggactaatccaatcttccaaggtgggccagtggatcgatttcagggaagaacagaagcttcacgagggagacatagatatgagtactctcttcttgctaaggaacgtctatttagaataccaaagcaagatgctatttaaatactttcttcagtttcattctttttctctgtcctttactgccttccttatcatctgactgaggcaggaccttggcaaaccttattcagcaaaacaaattatcagaaccttgggaacccctggactctgttcttggaatctccataacagtcttgctggccactgtctaggaagaaaatttctttccccaaaactcattgctcacattagttataccttttctgggatccaccctt

SEQ ID NO: 62161 - DNA, 1030 bp, Homo sapiens
gaggagccggcggccgccgaggcagctggggcgccagaccgcggtaggtgctggctctgcctttcctcgccgtgttgctcccgcaccgagccgggtgagtgcgcggtgtggatcgggctctggtctcgctcgggggtcccgagcgggcgccggcgggttggggtccccgcaacccgggcacagtgcccgccgcgcctccgtccccaccctgcccggggctcgggaaacccctcgagctgtcagctggggggctgcaaagcggaattcccggcgccccagccggcgctaagacggaagaaactttccgattgttagcagtccttttgggattccgaggctgctcctgtaattagtgtcggggcagggctgtggagtcagactgcagtttggcgtaccctcccctaggtcgtaggtggggggtcagcgagagaggccatcctgcagtggggcgacgttgcgaggaagctgaccctgaaaagtgatcccggtggttaagggttctctccgaaaaggaagctgaaaagcatcgagtctagaaaaaatgttcgtcctagagttttagaatcttggaaaggcagagataagtgggaccgctagtttttaacctttagggatacaaggactttttagcaaacgatgcagaacaaggcatatcttgttaagaagctcacagccccgtccccaaagtcagggacccctcgtgaagaacactttatgttcagtccccctccttcgacacatgagcaaagtgaggcccaggaaggtgagggcttttgggttttcgtttgctttgtctcctccaagatgtggaacgtgggggtgagatggggcgcatgtccagggagcaccagggttaggatcccagcttgccatataccggcctagggccctttccactggccacaagtgctgcttcaagcacattcctcttagaagtcgaccatctaccaggagcagcttcctgcaagaagaagggaataggcagatctctttttaggacagttacacggcctgcaccaccttgtcctct

SEQ ID NO: 62162 - DNA, 2350 bp, Homo sapiens
gaaatttcagaggccagaccctaaggctgaccacagccaaggcatgtattttgtggtgcttcacttggaagtcttctaaagcttccttctcgtgggctgcgtgtgtgcagtttatttctgcagtatacaagcacatggatacagaacagaatgaggattctggcatcttaagggaaggactactgctagttccaaagcagtatcttcagctgtgcacctagaacaggaagaggtagagaagggtgcctttgaccacaaggccaggctgtagaatgccccagaaagcctgtgcatcagcatactttggtcccagtttgcaaagtcatctcactaacctgaggatgtgtaaatgtgttacctggtgtttacatttatcagagaagggcattttaaaaaacattacacaatactgttttatagctatcacattataaagtcctagattggaatgataatacgagttttcctacaagttgctcatatccactcacccttcagttccactgtgctcttaatcaatgagggccacttgtgtttccttcttaccctcaaccctgtttttgtgttaatttcaaaaaagaatatatcccgcagtgtgtgacctttgttttagggcattctctgcccaccctgctgcttttgctctctgaatgacagaggagtaagactgaaagcaggttctactcctgtgtaggaaactaagacatagtaagtggctaaacaagtttaaagctcacacagattgtcattaatgactgaatacttgatgccctggagaaagcactggtttcctcgttcagatcgagccaagagtagggattagatggcagttctgtacaaagcacttgggatccaaagggctagataacccacaccctccccttgaggagtttgtgctctgaatgggaagataagtcgtgaaagcatgaaaagttaaatatagatttgattaacagttcaaaataacaaaatggagaaccttcccagattatgctgttgccgatagtgttagactcttgagtctttccctgaagttctctcatctttcattcactgaatatttatccagtgtcttccatgtgccaggcatgtacaagacagcaagatcccagccctggaagagctcacagacttgtgggaggaagtcaaataatcaacagataactgtataacccaattataacccattttccagaaaagaacactttcttcataaagccaatttcgccagtgaggtgtggcgtaagatatcacttggaaggattttttacttgccatcttgacaagtgtttcttaaagatttctctcaccatcttggcaagcgttctacttcttgacttgtaagtgaggatgattcttcagtgagccataggaaatccatttgatagggcgaaacggcattttaaaaatgcaggtttaaattgttatcctcatctatggttcttcataattgatggggaaaatggtacaggcccagagaaatgatatgcttaggaggtaataaagcctgttgacctttgacactgttccatttttctcagtttctaagtgaaaatgataacacatacacttggaagcaaggactaaccagaatttaatctttttcagaagccaagaagaaagcaccctgtcctggacttggcttgttttacacattattgtctgccttccttttctcagtgggctctttatttgttaaaaaagtgcaagacgtccatgctgtagagattagtgcgtttcgatgtgtgttccaaatgctagttgttatcccttgcttaatatacagaaagtaagtattttttaactgcaaagtagaagatattaataaatgtgtgtatatcttttcacctgcctataattactctatctgctttatccatctcatatacttaccagttcctatgccccttggctctgcttaatgaaaagtcataagcatctacccacagaagattctaccatgagcataaaccacatacccaacaaagtggggagaaagaaattttgtttttcaccacctccccttttgaaaacagagctttctttgtataattcctcttgtcttgtatcaccctcccttctttcctttggcataactactgtttggaagttaaaaaaatgaatgaaaagaagtaatagtgtatcctagtatcagaagtttttttagaatgggctgctttcttaccagggcaaatagaagattatagtaataatatttaggtattcctcaaaaggtgatggggtaaccctgagcaaggttactttcgtatttagtttcctcttttgtaaactagagggaatgatactgtgtgacttctgccctacaaggtgattccaagggtcaaataag

SEQ ID NO: 62163 - DNA, 1939 bp, Homo sapiens
ctaatgaagtctagccctggcacacgtcagcaagttgcacctagccaggaacctacacagagtgggtacttagtaaatatttattgaaaaagaatttgaatagcagtaatcatacttttccaaacactacatgttctttttcagtgtgttttgactctttcctcatgagaacaatgaaaacttgtctcatattcaatgactaaaataaattttagcagtttcaagttttatagaaaaattcatgagattgagaatgagcattagctgggtctaagtttccttacacagggcagctgaatcttgacattgtatttatcataaaagtgatatgtttatagaaaatttggagaaaataaatataaagaaagaaaattacctatgagtttatctattaagatataaacatgattaacatttagtttattttcctttttgtcctttttgcaagcatatatatacatatacgtgggataaatatctatattaattgaattataattttactatgcatgtaattcacttgcactggttttgcttttactgtgaacactttactgtcattaactatacttagaaaatactatttttaaaaagtatataatattcatttgtggatattataattaatttactattccctcattttttgatatttagtacttttaaaataatgtttaattacaaattgtaatttaaaaacaaatattaatttcatttaatatgcatttcttcatttgaatttacagaactgggtttataggcccaaaaggtcaacgaattttcctcattctcagaggagtccttggttctaccgccatgatgcttatatactatgcttaccagacaatgtccctcgctgatgccacagttatcacgtttagcagtccagtgtttacgtccatatttgcttggatatgtctcaaggaaaaatatagcccttgggatgctcttttcaccgtgttcacaatcactggagtgatccttatcgtgagaccaccatttttgtttggttccgacacttcggggatggaagaaagctattcaggccaccttaagggaacattcgcagcaattggaagtgccgtatttgctgcatcgactctagttatcctaagaaaaatgggaaaatctgtggactactttctgagcatttggtattatgtagtacttggcctcgttgaaagtgtcatcatcctctctgtattaggagagtggagtctgccttactgtgggttggacaggctatttctcatattcattgggctctttggtttggggggtcagatatttatcacaaaagcacttcaaatagaaaaagcagggccagtagcaataatgaagacaatggatgtggtctttgcttttatctttcagattattttctttaataatgtgccaacgtggtggacagtgggtggtgctctctgcgtagtagccagtaatgttggagcggccattcgtaaatggtaccaaagttccaaatgaagcatcattgctgaaatacatatttttttcaagtacaccatcacctaattcacatacagcatacgcacacatctggaaaatctgcattttcttcattggttgtatttaataaattgcctaaagtaccatttttgaatatagtatgtctttagttaagaatagctagtctgtttggtgtaacaattttttggtagctttggttttggttttggttttttttgttgttgttgttggggtcaagttggtgagaggagagctcattgtttgaagaaaaaccaaaacattttatggctagtaatatttatgtaatttttaaaatgtatttttggtactgatgggatatgggtggggaggctattttagatattcttttagcagtgtagagcctaagaaacttggttctactaccatgatctttataaactatgccttccagacaattgataatgctgct

SEQ ID NO: 62164 - DNA, 1045 bp, Homo sapiens
tggagggtggccggtggtttggtcctagtatagatcaactgttacaggcgagggccatttggtggactaccaggattgtaagccctcctggcgtgtttttggagggtctgcatcaatctgactcagtcggaagtctttctagggaaattgaattcctcttttcttgtgggagttcgactggaactgcaaggctggtctgggggcaagaatggacatttcatttctcctcctcaagtagtggcaagcctcagtgatctcttcttagattttggtccaaacctgcctttgaagaaattattgagtaaccccaaggtttctcctttgagtaggaggagatgttctggacatttgaccttttgtgtgtagtttagcgtggcctctgcaggaccccctgtctctttgcagccagggggcatgtatacctcttgcggcacagtctctgaggcccctaatgatctttccccacctgactccctgaatccagttatcatggcttaaggtatagagcctggacactctattcgtaaatacaagattctctagaatcaaatttccctggggtttacctagtacaaccttggatgagcaactgacctttgcgtaaaatagcaatagtaattgtacagggttgctttgaggccaaagtgagatggttcacctaaagcactttgcatagagacagacacatcctgagtgctcaaagttaactactaatattactgtttcttcccccagggctcctcaagtcttcccagtctgcagtgttaggttttggggaggtggagatggtaggctagatcatgatctaccaaagatgtccaagtctgaatgcctggaacctgtgaatatgttactttacgtgacaaaagggacttttacagatgtgattaaattaaagctcttgagatgatcctggatgatctgggtgggctcagtctaatctcgagtgttcttagaagaaggagacaggagtgatgtgagcaaggggtcatgagccaagcctctagaagctggaaaaggagagaaaatgagttctttcctagag

SEQ ID NO: 62165 - DNA, 1048 bp, Homo sapiens
tgtgagaatcactagcctcagcctcatgggaagacaaagtgaggaagactattagccagggtggatgggttaactcacagtatggggagacagctgcctggatttgaatcttcacttcacctgtggttcactgtatgacttaatctgtcaaaacctcagttttcttatctctaaattggaaattgtcatcttggtacatacctcaccgcagttcctgtgaagactgaataaaattatacacacgaggtgctcagcacaggtcatggagtcagaggtcttgatatagtataggggctgctgtgtgcaaggtagttatgttttcttgaggagttatgggtaaaatgaatcaaattttactacctcaaagctgctttatcttagctgtcatccattgcaggaaagcaaccaaggttattagtcaggatagaaaaaaaaatgccagtagcaactgagagggtagaatgcttttcttgaaaaatcttttcagagttagattcagatagaaaagttcctgagatgaatggttaagtgactagtagtatgcattgcatctattgtttagctgtgggaaataataaagaaaacgagggattggtgcctgaaccagatccttaccactgccccactgggaacagggcagtcagggttgtttaaagactattctggatgttttgtgccccagtcgtttgagagtgaggcttatagacagtggtcagaaaagcttcctgactagaacgtggctcaggagaaaggaaggtaatgggagcctgggaatgataaacaggactcagaaatgggaatgaataggccaggttcagggaatagggggctagcgcaccctaactgaaatgagtgtcaaactaatgggttggagaggctagtgttgatcagaccagcctcaaacccagctctatttggccgaatgaaatataaactatcacctaaccctagtaaatttccctttgataaatatcaattaggccaattagagtagttttatggaccatttttacttggtacctaccacatagtgggtgttaaaaattat

SEQ ID NO: 62166 - DNA, 1743 bp, Homo sapiens
ctgcgaaaaaccttaacattaactgcaacaacatattgagaaaccatcagcatggccttcctcagagacaattttatgaaatgtacaactctgttgctgaggaagacttgtgtttagaaactggaattccttctccactggaaagaaaggtgttccctggaattcaactggaactagacagaccttccatgggcattagtcctttaggaaatcagtcagtgatcatagagacaggcagagcacaccctgacagcagaagggcagtatttcattttcattatgaagttgacagaagaatgtcagacactttctgtaccctatcagaaaacttaattttagacgattgtggaaattgtgtaccactacctgggggtgaggagaagcaaaagaaaaactatgtggcatatacctgtaaactgatggaattggccaaaaattgtgataataagaatgagcagctgcagtgtgatcattgtgacaccttgaatgataaatacttttgctttgaaggctcttgtgagaaggttgacatggtatattcaggtgatagcttttgtaggaaagactttactgacagtcaagctgccaagacctttttgagccattttgaggacttccctgataattgtgatgatgtagaagaagacgcttttaaaagcaaaaaggagcgatccactttgttagtcaggagattctgtaaaaatgacagagaagttaagaaatctgtgtatactggaacaagagcaattgtgagaactctgccttctggccacattgggctgactgcatggagttacatagatcagaagagaaatggtcccttactgccttgtgggagagtaatggaacccccgtcaacagtggagataaggcaagatgggagccaacgtctgtcagaagcccagtggtatcctgtaagcatttgagtttctttttaccatttctttaaacttgctttttttttcaaaaaaaagtccaaatttccattgtcataattgatgagaaattttaagatctgtcaaattatgattcttaggttaagcatttgtggttattgaaaacagatactccaattgatagctatcaagattgagttgatactgcaacaacataaaagtgtgtcagaaaataatgttattgggagtggaggaattagggagatttcctggtagtggaaaaatggctccatttgttgcttatctgtttgtgttcttttgagataaatgcctgggtcctgttctatggtgtagttcattattgtttttaggtctccagacctaacagaacttaattctgttttttttcattttccaactaatggccccacttccttccctcttaaacttttttatgccctggattcctttggcaaagtgatgaaacctatggattcagaatgatgtttttaaatgaatcagatgaaatagaaatcatcataaaggacaagttatgcggatatacatttatcatgatttttttaaattaacctgacaatttaggtgcttctttattaatacatttaataataatatctagttatgtgataactatcataatttcaaaatagaattagccctcatctgtatccacagattcaaccaactgcatatagaaaatatttttgtaagaaacaaaaaataacaatataacaataaaaaataacacagattttacaatctaatacactgtaacactatttacatagtataaggtattctaagtaatctagagaagatttaaagt

SEQ ID NO: 62167 - DNA, 1024 bp, Homo sapiens
ccttcccacacatttaaagaatgtgctgtttgtacaattaattccttggccctcacattaaacatttttttttcttggataccttggtcagaatgacccatttaatttatatttgcacagctgtgtagagaagattggctttgaatggaaaacattaatgaagattaatgcttgctgacatactaactactggtatcctccttctcctcctcataagaaattaaaaccctatcccttatccagttacagtcatactccctctctcctgctctgaaataagacaggatattttgatgggtggctaaagtctccaagctaaagattggttaggggtgtttttcctttaaaaaaaaattctcaacctgcctgaattttgaggagtttagatacatatagttatcttgaatgtgaagtacaagaagtttctgcttctgccttgctggaattgctcatgtaacctgagatccacgtgcactcagagaatgtgaaggtgccagggcagaaattccactggctcctgtattatcactttacttatttcccttctttgttccacaagatttactgtacaagaatatgtatgacaaaatagaaaaaaaactcagatacactaaagagtaaaaaacaaagaataaaaatgtaaagattgaataaaaaaattttacatcagtctagaaaagctataatttaaaaaggaaggtcaaaagcagcttctgtattgctgcttcttattctgctttcttccttttaaaagttgcctttcttcttcatactttactctcaagaacagaaaattaaacctaacaggcaatttttttttagtgtttcacaaaaatgcctttgttggtatacatgtccttgattctatattttgtctctttcaaattgaagagacctgaaccttaggggagagataatgtctgttgtgtgcaaagggaccaaccgctaataaattcatcttctgagttgtaatttttatggatgataaaatatccattgagccccactgttcaatgttgtaagg

SEQ ID NO: 62168 - DNA, 1018 bp, Homo sapiens
tttcatgacatgaaaattatatagaattgaaattgtattgctcattaataagggttagggagcacagccatactcattcttttatgtattgtctgttggtgcttttaccctctaatggcagagttaaatagccacaacagacactgtatgacctgcagaaactaaaatatttgttatcttgtcctttacatgaaacctttgcctatccttggcttagaacatccctcgctacctggctaactcccattcagctttcaggcctgagcttagtttcactttctcttggtggtcttctctgccagcccccaactcccaccctggaccctaggccagagtttctgacagtcagtgctcaatatgtatttctcgaatgactctttgaattataaatgaagaagggcggtttccacccacttctgctgtctccttctttccttccccagaactactgcaggcttgttagctgtcctccgcctgaccctcagagcttggaaccagttcttttgtgcaatacctgtaggacggaatcaggattttccattgaaatttgaaaggatctttttcagtcctgcaaacccagcaatccatgcttgtcatctccccagacttggcctgaaaggtcatgtttgcatctccttgtccctggctccccatttcaactggctgttagaacccttgagaaagtttctggatcctttttgcttacaagggaacacctgagacagctgtgtgcttcagtgggccaagaaggaaacacgcctcccgatctcaagaccccagagctctgtctctgctcttcagaacccccagtgcttcctagacagaattttccacatggactggagggaatctagcttctgtcagtgggggttcggggatggacatggtggtggagggatagggacagcatgctgtcgttgtaagttggggagatcatttcattcctggggtttggaaggtgtttgtctagttccttcaaaccatttgacaccaatacttttggtaagagacctgaaac

SEQ ID NO: 62169 - DNA, 1983 bp, Homo sapiens
agtctaaaattgtgccagtctgtggcttcctgatttaaatcctgaccctgagtttcaggttgagtattctacctccctcagcaatgcctccttgaggtttgatttggaatgaatcttgtgactcactccctgacgctgtgtagtagaagggcagaggatttggctaagcctggaaatgtctgtagaagtaagatggtaagtactggctggatgctttctgtgtcttacactgggcttcccagatgtcttgtcttttatcttttctttcctttcattctcatggcgactgtctatgaggttaaacacccccatttcattgggtcctgtgtgaccaatgtcacaccatgttagcacttgaacccaggtctggctacctctaaagtccatactcataactgctcctaagttcctctggaagattctgatgcaacttacccctataacttggcagaaattctgttctcttattaaatgtgcaaatgttgagctggatgagtccctgagctcttttttttcttcaaatgtgaactgggtgtgacttttggatgaaatgggagatgcagggaacaataccaattcttaatgcgaggggtgtgttgtctattgaaatggctaagatttattttttatgactcagcctgctaggaggaggaaaccaagccccaaggtttgaatgttttacagaattgctataatttagaagtacagttaagaagttttataagtaagtaagcaagagcaaagtccaaagcaaactgcacacatcttgagtcagaatctatagcttattcacaatcatgctgagatacccaaaaatactggcaacgtatgttagtatttttccattttaatttagttttctgtgatctctcagggttctgaccaaccgacctaagtatgaaagacatgactcagtagcatttctttccataatcacaccattagaatgaagttttcacctacttcacaaggttgtgaggcggtaggaaaaagatctaagcgtgttgtatattaaagtgcttggcaaacactatttaaacctccctgcaagtataacttttctcctcttactccatgctctaaaggattcagagtgaggcacctggaggaaaaacagacacaaaactacagaggaggcaacaaaacaaaaccagaggcaccctgttttcctttcataaatgctgcaagcgcagtcgaacccgctatggaaacccgacgctttggtttgcctttcagggtgctggcatgaatgaataataacttcattttcaacttgagattagataacttttatcaccaacacctacttcattttatccctatgttttaatagaataaggaatagagaatcaatttgttggtagaccatgctgagtagcttagcttcagaaagatttagcaccaaattataaatggtgacactttaatagtgagtgtgatgtgcattgggagccagcctgtgggagtttggcagttggaaagccccatagcttcattttttccagatttttgtacccttccatcagatagtaactccttagccttgagaaactctcttccaggacaaggggaaagtttatttgagttctaaattgtttaatagcaaatgcattatttgtctctttaatgagaccaagaaaatggcttcagaccctggttgaaccagccagttctccttttgatggccacaaaccaaatatgggcagtgtaatgatggtatgactctggcctgactaatatttttgtgaggagaatgccattattatggtgaccatattttccaaacaaaaaattgggaactttttattcagaggaaagaggggcagaatatttgaaattgagactgacccaggaaatccagaatgaatggtcttggtagctattgatcacagcataaaggaaaaagaatgtgaatgaaccagtgcaaatctaattggttgctagaaaagtcaggagcctcaaaatgaatgacttgctagtggt

SEQ ID NO: 62170 - DNA, 1034 bp, Homo sapiens
cttccccctaaataccaactcacaaagagataataaacaaatctttgagaaaaggtaagtgtgagtccctcctccctacttctccttcttagagtgagggacatgaggcaggagaggctggggaagacagtagaggtgtcctcgcagtagataaatctgttactctgtattgcctgactgtaaaatttgctgtggaacatttttattggtaatttcttttgcagatgtttctggagaaagttgaaattatgctggtaaaaacatatctagactccacattgcaaatttaaacatattgtattttatttccttaagcaaaaagggaactctttttccccctccttcttttctttctttctttttctttttttcttttttaagctagaaaaaaggaatgaggaaagtccaaagtgtcttttcctatttggactgaaaaattaattatggctttgggaataaaggtagtgagcatcatatctcatttctagttaaccggtagttccctttacatataaagagcaattacttttgaagactcaaaaaatatatagtcttaaggtgtgcttcatattatttccccatggtttcatttttatttcattatcctctgactccatgacaaaatgtttatttggtgcttgcaaattgaaaaaatctggagtggaataagccacttgccatttctgattaattgccttggatatgcttttaaatcctcccactgaacctgaagcgtactgtcccaaataacgctttttgaagagaaaacttttggaatgcccttcatttctttgagttttcataagagtggaatgtgttatacaggcagcctagtgagcagttaagagctgggctctggaaggagtcccggctccaccgttaactagcagtggagccttcagcaatttacttaatctccctaagcctcagtttttctcacctctataatgagaatcatgaaaataacacctaatctagagagtcatgaggattcggtatctgaaaaagcaacatggcacatagaaattgttcaa

SEQ ID NO: 62171 - DNA, 1043 bp, Homo sapiens
ttcatcaggtgatagacatttggattgtttccaccttttggatgtatgaatagtgcttctgtgaacattcatatgcaaatttttgtgtggatatatgttttcaattcttctggttatatatatctaggaatagaaatgctgggtcatttggtaattccatgtttaatattttgagaaattacccaacaatttttaaaaaatggctgcactttttcgttttcataggctgttttttcatctaccataatatcatgattatttatatatgtcttaaattttcttcaaaaaaatttattttccttaaaacgctcataacagattatgaaagtatttttaatagctgacctacactccactggttacataagcaaattaattgttttcctaattttggacattttacattattattataaacaatgatacaatgacatttgtatgcatgtctatttctttagtgtaagtatgtagaggtagagttatggggccaaagggtatagacatatttaatatccttgatactttgatgccgcacttttctctcagaagaattaccaacctatacttccacgaaactgtgtcctttgctaatttttctaaagagaacttaacaaaaacttatatgtattagttctattgctgcataacaaatgacctcaagtgtagtggctttaaacaatagaaatttatcatctcagtttctgtagaacagaaatctggcatggtgtggctgtaatctttgctcagggctaaaatcaaggtgtcagctggggttgcaattctcacttggggctgggatcttcttccaagctcacttgttgttggcagggttcatttccttctcctactttctattcattaagttattttctttttctgtgaattaggaaaagacacacttctattctattcacctttagtagttgaatacctatgctctgcaggcttgacatttgagaaccagtgaactagattaattttaagaaccttctaggtataatattttcagtttgttagctatgtggccatctttttacaataga

SEQ ID NO: 62172 - DNA, 1053 bp, Homo sapiens
gaagattgttcccagatttgtatgcttgccactgaatgacatagtcaactgttgtctttctgagttcaccctccagaccatgatgttctatagcagatcttggcaacacatcaggttccgggaaagtacatgaatcatgatgggactctttaatctgtacctctgaacttcataaaaaacatgtgattctattagcagatccctagctaagttccatcttccctgctgttctcacatcctttcatctcctctctttacccactggcactcaccttccattgccttctcaactcttcgctggtctccatgtccaagcctcccttcctgttgtctttgatccaatccccaatcctttcccacctggactcctctcccacatgctcccttcctaatgcctcttcttcccattcttcagaacacctcctatgctatgcgcaagctctgtgtacttctgcctcactcaccactctccctcctactcttttcctttatggtggttttgtttttaactgaagacatcacatactctgctgtattcccatgtggaagtcccaccttcttctgtgggaaaggggggaattttactttctcgtcgctctgttctgagagtggatgattgaactgccactttctccctgactctcatgggatgttcatgtcatcttccaaggcccttgctatcgcattgccacatctcgtttccaccatcctagatggaatattgacaacagagcctggcacatagtaggcattctaatatgtgccacgtgaacataataaatgagcgagtgaataattgattcttcctaaaaggttttagcaactgccacactgctttttgcctatcctaagcacattttcttgtccttatttattgattcactgaatagacatctgtagagatgctaggtgtggcttgccactgggagtacagtggcaaacacgatgtggttcttctcttggagcatgccatttagtgaggggaagatatattacatacataaattaattacagttgtgagaagtgtttgaagaaaaaagtgcaggatttta

SEQ ID NO: 62173 - DNA, 1064 bp, Homo sapiens
aactgtgtgcaggacagttaactactcctgttatttcttggcttgctaggtttttattgttactttcagctgtctttcagccttttacccatcgtccttcacctttgatgagttctctctggtactttggtctttgagaaagacctaagtacactccccttagtccctcatttaaatgcccattctcacagcacccctgaaccttgagatgtctttagattctgcatgaacacctcacaggtccaaactcctctctgcctcaggccctttgtatgtgctagtccctctgtctgggacacactctcctagctaccagcctctttttacctggttgttaacttcagtttatgttctcagggaagccttcctagaccaccacaccccttctcctagctaagatcagctattagttgtgattctttcatgagtcagtctctaccatgagattggacatgctattagcccagggaccaagtaaaatgtttcatttcagtgcaatgactatttgtgcagtgaatgaacaaatgaggcctgtacttctctggattccgagtcagcttctctgcttttagactttattttccagacctacattcttactgaaatatgtgtgtttcctcacatcattcacctgtccttttcactggcccccttcaccagcctttacactgtttccattgtaggcccagcctgcactctcaaaaacagagttatccaggcacttctgtattctgttgtttcttaatatcaacaggttgttttagagatagtttgtttgcttgtgtttatttattatggatatttcaagaatactgggaaagcacaaggagcttatgacaaatagccatgtaccactgcccagacttgcaggtggaaacatttgcagtatttgcttcaaagaaataaaatgttacagaaacagttgaagctcctactctctcctctcccctcagagctaaccactgtgtggacaattgccacatgaattgttggaacacctcaaatgaaagtaaataggaaacttgacattttggctagattatgggaggaaaatgttatctcaa

SEQ ID NO: 62174 - DNA, 1077 bp, Homo sapiens
ggtatccctttccaccttgcctgcttgtgcaggcatgaaattttattgaagtgatgccagagaagcacttccagtgtgtctgaagaaaactaatagactttgtttaatttagacctgccaagagtagattaaagaaccttataagtatgaaacagttcttattccagataatataagcattcactcaggtaatataatcacatctcagtggaacttcagctatagggagtagatcttcatagtaaattaacattctgaggaattaacaagtaactgcaatgccttccttcccagcctctctccatgaaaaagctgaggcaccttacaaagatcgacctaaaacaaggtgaaataagaagatgagaaaattaggacaaagagaaataatatggtaaaacagaaaataattattgccttagtgtcattggctagagtttggccaccacataatcctaagcttcctagcaactgaagcaaagaaaacctatccagctctacaattcacagtgggcacgagatgaaaatagaatggttgctagggggatactcagcttttcctgctcccgggactggagagaagcttgtgctttggtccccagggaggggccctgtgcaatcacagggacagcgcttacagcatcttctcagtggtgggagtgcacctcatgtgactacattcccctctactttacctcaagctccttgaggggtgtgttcttcatcatatatcagagcccagcacagtgcctgagacatagtaggtgctcataatgtatttttgaatgaatgaatgttatttgtaatttctgtcaatgaaagccaatgggtggatacaagatcaatacacaaaaattaataattttttccatacattagcaatgaaccatctggaaataaaatttctaaaagttccacttataatatcatccaagcaataaaataattaggagtaaatttatcaaaaaagatgcaagacttatccactgaaaactacaggacattgtagaaaaaccaatggcaaacatttgaacaaattcattaaaagcaattctatgtgaagcaaaaatacagagattt

SEQ ID NO: 62175 - DNA, 1053 bp, Homo sapiens
gcagtccatattttggaatgtgtttgggggtagagctgtgcttggaggagtcatcccgagttcctgcagacaggactgttaggaggccagctgggctgcagggtgttccacatgtccattgaggcaccctgcctacacctgatgagtttgtagaaacattccccagcggttgcctgacttccagggctggcactaaagggggaactagtcagcccatctgaccatgagtcctaaatagttcccatggaatattcagtgctctgcacttacttctcttagcactgaatgccagaacggccactagcaggggcaggatgggaaactgtagtagcctgtcacgagcaggctgatcatccagggcctggcctggaagacagactgggtaagtatagtcttcatttggccattgtgctcaactggcaatgtgcccacagtcaatatgcagatgtctagatgtggccaaataataatacaattttaaaaaacaaataatcgagaatttgcatgttcaaaatatctctcagtcaacaaatatttgttgagccatcccctgtgcccagtacaatgccagatcctgggggcatggcagcaagcaagctcgttggggacctgctgattgggagctcacagtgagcaggcaggcatgtgattattctgcaggcagtgacttctggtgtggttaagtgctgtgctggggaagctttgtcttttggaatctctttgggtagctctttaatctggagatggtatcattgctcaaaacatttttggagctgccctttaggaattgcctttagaactgatttgggtcacacagtaaaatctatctcacttttattttacggccacacccagcttgtgaccaaaaatggtattgcccagcttgacgacccattttattttctagtcttggctctgatttgcttgtaagccaaaattacatccaccctttaaagatggatatttatgaccactgagcatattagcagtaatttggataattttgaagcaatttctcacttgcctaagctcccattgtcctttatatctctg

SEQ ID NO: 62176 - DNA, 1041 bp, Homo sapiens
actttgaaggcacttagacccttgggaggctctgctattctgcagcatggcaggtgcccacatacctggatggctgccttctattattattcccttgatactgggttctttgcacatgtatacactttgggttctatttgctacccttttttttaaacttgactaaaacagtgagtaattgggaagttctgaatttctatttggaaaacaaattgatgagatcagaaaaatccaagtaatcctaaatttacagaagccagattactaaaacgcaaggacatttttttgtaatgtagaaaagttatgtttcacagaggtttttgcaatgccctgactctggatcgcagccctccctcgattctgggtattacatcatttcatttcagctaatgtaaacactcatcaccctgcacgttgcaggatttttcactgtgatttgagattgggcttcattcagtgggtcgtggtgattaatggtttcagaaggaagtgcagcaggaagagactttgcaggaatggaagaggtgaggcagctccacgtgagattctgcaaagggattaagatttggcaccaggcttggtttctgtgcagcctcttaggcagagagccccaggagagggaagcaggctgtcagctgtggctttgcacgctctcagctgtcttgaaggttggttggctcttcccgctctctgaggtacccaattttaccttgttaaaggatggatgtggatgctggaggcttaaagaagaccaggtaagggttcttgttgtctaagaaatcccccagtgttcttaatgcatggaatcctggggactgtttctttactagcaccattgtgcagtgttagccaaaatacaattcctctgagacattttacaaagaagatcagagaagtttctttccttgttaagaaagtttctaaaatgttttaacctaaaatgtttaactatagagatacaaattatttttcttgctgtgcaattcagctttgagattttttttgcatgttaatctacaagatctcgataggtatcctgag

SEQ ID NO: 62177 - DNA, 1031 bp, Homo sapiens
atttgaaattacagacttcaaggctagtaggcaccaggccaggacattctcatttcgggtctaccaacaaactatctcctttttaaagagaaatgtcattttgatttcagccatccttgcaggaggtttttcagtgtaaattcctcttagccttcctaagtaaaaatgaagaacagctgatccttgtcttgtccaatgtatgattttccctggaacttttatgagctgagtaggatgagcaagagaggaagtgttctttaagagagtcaatgtgcggccactctcagctgcgtggtgttgcctatagcaactaagatttattttataaacacatatatggtccttactgtacagcaggcactgctcaaaacagtgtacaaatagtaacgtcctcttcacaaccctatgaaggggaaagtgaggcagaaaggagctaattaactggcccaaaatcacatcgctagagtggcaggtgggggatcagggctcaggtagcttgccttcggtgtgcattactcgtggttagtagtgttgccaatttcttctgacatagagttgattatcttcatgctgtttttctcacacagagattaagcctgaagttcatgtatcccatgaccctggggagaaaaagaaacctaactacaataagcaatgggaaatgagtcagagcctgtttattttgatgattgattttgtgagagtgatttgttgaatgaatgaaccaaatgaatgatggccttttgcggcttctgtttgccactttgatattccaggatttatttcttttgatcttctaagccatctaattgaaatacccacaaattcagatattacgatttatatttggccttcagtcccccatctgcatctggcacggtggactcaagtacagttcacctcttgtgcatttgacctctcactctaaaaataagggccagatgaatgttcatattccttatagaacagatgatggttttactagacgagtgtggtttatactttagaacagcagctgcacatatggaatg

SEQ ID NO: 62178 - DNA, 1012 bp, Homo sapiens
actcacaatttagatctcatttatccttttatttgctatatctatagaacttggcttttcttgttttctgtgtcttgtgtctgaatataataatgatgtttaacattctgtgtgtgacctctgactgattttggaaatgggaaaaggatccatggcattggtaggaaaaggttgccaagtctgccttaagaatttttaggaatggcagggcatggtggctcatgcctgtaatcccaacactttgggaggctgaggcaggcagatcacctgagattaggagttcaagaccagcttggccaacatggtgaaaccccatctctactaaaaatacaaaaactagctgggcgtggtggcaggtgcctgtagtcccagctactcaggaggctgaggcaggagaattgcttgaacctgggaggcagaagttgcaataagctaaaatcgcaccactgcactccagtctgggcgaaagagtgagactctgtctcaaaaaaaaaaattttttttaagaatatttgcagggtaaaacataaaaaagctgatgatgaaacctgttggatgaactgatgaaaccccaaatttacccagccagtaatggccatgcccttcaccttctaaaagaagtgcatttgcttctccctggcctcatgttgaagaattggaaaggagcaatttggagagagtgcaataaaagaaaagacaaagagtttctgctattatccctgcatctctgacttcccacagtctgtttttcagctgttccctgtccactcccaggacctctgcctcctgtcttatagtgtatcatggtctctactggataacagataagcaaggttgagtcatctgatatggtcatccctggatgtggactttctcctccaatcatgagcacaacatatagagctcccatcctctctccttcactctcatcaagtgaatggctcagcaaggttgggactcttgtggtgagaccagaagatcttgagaagagtgtgaggaatgagcttcccag

SEQ ID NO: 62179 - DNA, 1057 bp, Homo sapiens
actcaccagactgtcagctaatgtgttatctttaaattggcgttttatgcaagagttggaagtttctttaactttttgctttgaagctctttggtgatttctgagaaccctctagaaactcctgctgaataatacaattagctggttgccttctgctccaagcttatttctgtagttctgacttactatcttggaaacatttttcaatttcagcatcctctcccatttggttttcaaagtctttacgtgcctcagttaaacatattcctttaacatgcagtggaagaaaatgcattagaaaaccagatgggtttctcaccaccaaaaatgataagtatgtgaggtaaagcatatgttagttagctcagttgaaccattctacaatgtatacatattacaaaacatcatgttgtacattacaaatatatataatttgtatttgtcaacttaaaaaaattaagttaaaaaaaaagatgggtcttcaaagtcaaagagtgtttacagaatctgtaggatcagcatattggttagtgggtcttgaactctgatggccatgtactctgccagaggatcaggagtacatgcagctgctgtgatgtggttgtgagcttttttttcttctttagtatgtgtcctgtggcatagatttggccaacagcttttagctattggggaatatataatacactcttagtcttcagtttataaatgggttatattctacaagttcatttcccaggagcgatatagaacttagaacactttcctggataagcagtattaaatgttgtgatttggttcacagactctagtcctcaaaaacctctgtaacccataacacagttgtgatctgcacatttcccacgaaataaagaggaaaacactattgttggaatactgagcattagcctcaaagaaaaagcaatagaagtgagttagaagacatttcttgttgaggggcaataattttattaaagatgagtaaagagttaaacttttcagagatttcgaaaaggagttttagccatttctgagattttagatgttggcagctgta

SEQ ID NO: 62180 - DNA, 1048 bp, Homo sapiens
tagggatgcccccatgggcaccaccccttccagccctcattgtaccccaaattaaaatatttacatttgaaatggtcatggatattgaacttgaaaataaatgactattctgaaataaagactgagatggtgttagttgaaatgctctttaattgtttcgaggagttgggaaaaggagtaatggctactaacccagctctctctacttcctgggaactgtatttcaagacgttggacttagaaggaagcttgtggtgtagactacaaaggggaattaaaaacctgttccctccaggcccaggtggactgttaatgctccccctaccccatgccatactcactgatgactatgagttgtagcagtgttttacttatactgcaggaacacaaattccttcttcatgggccaaatccaagccacgtgtgtttttctttgaccgttgcagtactttaaaaattgggaatcttgcattaaaatgttctggcttctctggcaaccctgggccactattctcccttggcccgtgggctgacagtgatccatactaacccccacaagatgagacacaccagctctttaccacacacctggccccacctccaggtggtgtcctgttcagctctagcctcatttcctttacctgcttggtcctgcaggcatctccattttggaccctggagttgtattctgagattcacacaagctttggggcacttcagttcaaggatttaggaggctgaactgggagttgggacaaaaaggagaagggctgtaaatacagacaggtcatctgtgaacaaccttctggttgggttcttcctgggagatacaggaagcgttccaagcagggaaagcaagtgagatagtgccagggtgagaatgtgtgcagcaactgtgagacaatgaagaaatgatgcagtggacatagtgagaggtaaggtccatttggtagctgtggttacagtttggagaatgaggtgaaaatttgaacctaaagcattagagagccattgcagacccttaagcaggttgaattttgaatagtgg

SEQ ID NO: 62181 - DNA, 1042 bp, Homo sapiens
tgatggctgtttttctttccaggcaaagagacagacatcacattgcaatccttcctctcactgtaccccaacttgcccttaagcctaattgatctcaactccattctattgcattacccagtccaccaatcctagtccctttgggcacccagaatgccaatctccaaccccttcctctcccctaccaacccctcattcccaaaggtgcttttaaaaccacatgtctcaattttgagttttgacagcatgatccctgaccacattcgtataaccaaccccctgacccccttccattattaggactccctcagcagaaacacctaggtcaccagagaaggcaggaaacgtggggcaattcattgaggggcagtgaatcacctcggttctctctctgcatcccctgaagatcctcagccccagaatatcaatccaaagcctctgagaccacattagaagccagttctgaagaagacaggtgtgactggagtctgggaatacttaggacaaagccattgcgtgggggtctagggactcactgggagatcaagagccactggctgacatccctgtggccctgggatagggaggagcgtcaggaaagagcagggagtctccatgcagtactggggttgggcggactgcactcttgggcttaaaaggcactttctcttagtaatgtaacccacacccagagttttctattctacattttatgttttagatttaatttcttttgttttgtgtattcaatcacaaaattttaattggtatgtttgttggttgttagttggctgaacacagagtagttgcctattttggtcatttagtaaactctacctaaatgctaacaggatattcctattctgagtcatatatatctctgattgtctgaggatctgtcatcctgtgttacataaacactttctggcaaggtgcggtggctcatgcctgtaatcccagtgctttaggagggtgagacaggaggatcgcttgaggccaggagttcaagaccagactgggcaaaatagcaagaccttgtcag

SEQ ID NO: 62182 - DNA, 1048 bp, Homo sapiens
tcatgcctgtaatttcagtgctttgggagactgaggcaaaaggattgcttcaggctagcagtttaagaccagcctgggaaaaacagcaagaccttgtctctacaaatttaaaaactaactgggcattgtggcacacgcctgtagtaccagctactggggaggctgagacaggaagatcacttgagcccagtaataagaggctgcaatgagctaggattgttccactgtactccagcctggctgccagagtgacaccctaactcaaaaaacaacaacaacaacgaaagataatgaatccttagctcaggatagtgcctggcacatagtaggtgttcaacaagtgctaattgctatctccattgtgactattatcatcatcatcgtcatcatcttgtgaagaaatatctagtttggtacatgttggttctaggatgagagtaaagtatgatctttaaatggatgcctactaggcagtgcaaggcgggagcatggagctcgtgtgctagattggtgatgcagatacagttttggaataattgttatagaagggatgagcgagccatgagaatctgtcttctaagacataaagtgggagagagatcacaggcttcaaggatcaagctttggtaacaccccctgacatggcagatcataaaaggatccagtgagaaggatcatgtgggcatcacaagagaatcaggcaagtgtgggtgatgagaaattaaggggccccagcctcatagggtgactaaaagaaaaaagaaaaaccaatggggaaaaattttaaagatgattatcatattaccctgagccagggaagctgagaagtacattaacagagcattcagaatggcacaatggcaaacattgtggaatggcataacattactctcctctccctaaagtgggcacacttgaattgacatttgcaggagaatttcactagagcagagaggaccccccctgccccaaacagaaaaaccatgttgtacaacagtagttaaagaaacttgggctggacgggcacaggcgctcatgtctgtgatcc

SEQ ID NO: 62183 - DNA, 1144 bp, Homo sapiens
gacacttcaaaaattgtaatttccaaattcaaagaaacaccacaattcaatgcaggtgcctcacaaaatcaaatgccatatctagaaatcattgactatatgcctattaatattagtaaaattggctaacctttcaactgtgggcttaagtatgtaaaggcactttcatattatgtcctttagtcccacagttctgtaagggaggtgttgctcgtaggcctgctttcaactgaagggcatagaagagagattaaataattgactcagtatcacacaattggtgatactagagctgagacttaaagccagcacctctgacttcacacctggcctaccctacgcatctagtacagaatatttgtccagtcaacagaccaaaaaaatgatcttttttttggctttggtttcgtttggtgtttttttgtttgttgtttgtttgttattggtataagatgtcacgttttaatatttgaatggtgtttttttttttttacttttcagtttctatcatctatgccgtaagcacttcccaagtaaatatttcttgaaagagatttcttgagccagatgtacaacatgtctttactcctctgaggttaaaactcaccctttctctacaaaaaaagcaaggctggtatttggcccccattccttctgaggatctttgtgacccctaaattatcagacccctaggctcccaaacaggtctgtcacttttacaggaactgtcaacacacccccgaaattttttaactgaccaccctgaagaaaacaagcaggctttaacttgagcttgctcaccaaaatcactcaagtccttccagctgcatggccccagtctccaaaataaatccccttcctctgctggtctgaggctcacttcagcctccccacgtcctaggctttgaactcctgtgacttttaaccttggctttgtgcctgttgagctgttaatcagggtctccagcccataatcagcagctggtgagcagctgctccctcctttcctaaaacagatcctagccagaattttccctgaagggctcttcctgccagcttcctctcttctaggaagcagaggaagttttcttcctttggcttctccctctctggccattcctaatgaagacaaatagcaatggca

SEQ ID NO: 62184 - DNA, 1013 bp, Homo sapiens
gcccctctcccttccaggatgtccaaggccctaatttgcaaagtaagtctaaatgaattttcctacagtggtagttctgcaatttaacctctgtaaatgggatgggaagtttttgttccccagttgatgtattaaagcatgtcactggaactcagcagtgatgtgaccaggacaacgggggacatgatgaaattcctgacagagaatcttgtgagttagaaaacagtcacttgggtggccagatcattattcttctgtggccgtctgtgctcttccacctcttggaattttctgggagacattaatatatttacttccccattgcttgatgcttcctattgtgttcaccatgtggctctttcacaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgagggtagagtgttatttgtttattaagcattaaacccatcttccaggaccgctgtatggtgaacatcaccataaaacacttaaggttgtttgggttgaggacaaagtcaggtataaaatagaagatacaagggcttaccacatacctccatggtgccatgctagtgccaggaacaccagggaaaagacaaggtccgcagaaggacatagacatgtaaacaaacacagtgcgagctaaaaagagacatcgttgagtcacccacaaagtgctgtgggggcagagagaaggaaaatagagagctgaggggcaggcacagagggctccacagagcaactgacacgcaggtcttgaagaacgtgtaggattttaccaagcaaagaacataggagaaagtatccccagcagaggagacagcatagaggcataaaagacagcttgttcaaggaagcacatgctgttctggatgg

SEQ ID NO: 62185 - DNA, 1036 bp, Homo sapiens
actagaaacatgttttctttttcacatagaacatgttttatttcctctgatacaatataggttaagagatgtgaaaagagagtactggaaaatagcttcaatcttaaataacttgcactcatccttttgctcatattgctaattggagcaagtctggtgggacagaatcacaacagtggcctgcccttgtgcccatgaaggccttgtctttgttgcagtgcttggagcagtagtagctggcacgggcggatcaaaggcggcatgaagggatttcagagcttcatggtttcagatagcaacatgagttttgttgaatttgttgagctgttcaaatcattcaggtacagtcttatgtttccttcttattctttctcaggcccccccatttctataaagatactcaatgagaggtgttttccattcctcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctaggtttgttgaacattttaggatttccctttgggatcaatctgtctaaaacttaaggtcagaggtccagtcacacaaactctgagcctgtcccacatagtgtgctattactgctgtgtagggaaagacttaagagaattttttttttttttttgagatgcagtctcactctgtagcccaggctggagtgcagtggtgcaatctcagctcactgctacctccacctcccgggttcaattgattctcctgcctcagcctcctgagtagctgggactactggcatgtgccaccatgcctggctaattttttgtatttttaatagagacaagggtttcaccatgttagccagaatggtctcgatctcctgacctcgtgatctgccacctcagcctcccaaagtgctgagtttacaggcatgagccacctcacctggccaacacttagagaattattttaaggtgtcatctggt

SEQ ID NO: 62186 - DNA, 1050 bp, Homo sapiens
tttcatagaaatcagccttcttttctcattctcttcttttttctattaaataaatatgcttagtataataaactcacatataataaatgttttcttttggactaaaaactacttcttaccactacgttactaaattagttcaaatatttggtttagatgtttcctgatgaaaacagaacagctttaaaaaatgatgtggtggtttctttccccctcttagtttccttaacctaaataacacttttttttttaatcccttgcagaagttcgagcctagcatcagtatgtgtcatcagggactaatgtcatttgaagggtttgccaggtaacttttaaaatatcttttgcccatcttttaagagtagatgcatttttcccatgcagtcttaagaaaatttgtttcacctaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtacagggaatgccacttggaatgtggtttttattaaacctaattatttatgtaacccccaaagtcaaaaaaacctgaccccagactcctttgaagagcttatagagtaagctattacatgtcaaatgtgaggaaccatgatgtgtgggaaaactggctatactacagcagtcgttttctttacttcttttgttttgttttcccccatctatacttaacctttattctgggccaaaatgaaagtgtttgtttgagactcatagcttttagatcctagttagtctgacctactcccactaaaattagattttcccatgggaaaattatctaatcgtctctctaactgctaaataatatattgtagtgggaaagcatagtagaaaatgcaacttcctatgtacttattcccaaaatattgtttgttttgcttttcagtttgttaaataatcaatctatccctatggtaaccaaaaaa

SEQ ID NO: 62187 - DNA, 1050 bp, Homo sapiens
agctgtttatagacctccccccaggaatgcaattcttttcctagggtcttaatattatattccttgctaggaaaagaatttagcaatatctctcctacttgcacgtctgtttataggctctctgcaacaagaaaaatatggctctttttgcctgaccctgcaggcggtcacaccttatggttgtcttcccttgttccctaaaatcgctgttattctgttcattttcaaggtgcactgatttcatattgtccaaacacacatgttttacaatcaatttgtacaatagtggtcctgaggtgacgtacattttcagcttacaaagataacaggattaagagattgaagtaaagacaggcataagaaattaaaaagtatgaattttgggaacgataaacgtccgtgaaatcttcacaatttatgttcctctgccacggctccagctggtccctccgttcgggatccctgacttcccacaacaataatgcacccagatttagaagcagatattccattatacttcccccttcctttaatggtagaggcatttgtggaaatgaggctctcagtgggaaagaggggcactgacaaaatgtccccaaatattaatgccaacaaaactaattaacttttcatattgtcctggcctaagctttgattttttttttcaattaaaaaataactcaaggccaggcccagtggctcacacctgtaatcctagcactttgggaggctgaggcgggtggatcgcttgagctcaggagttcgagaccagcctgggcaacaatggagttgatataagcattgtgtctgctttccctccacccacctccttgacagacacacattctgctttggagatccatgctcaaaatctttgtgagaattgtgtctgtggttctttacactatgtggacgcaaattctacctatgtctttgtccctgctccctaccccctccaaagttttatccttttgacttgacttcatctgaaactaaccttattctacaaacaacagcctctaactgattctctgttttcttatttaatac

SEQ ID NO: 62188 - DNA, 1052 bp, Homo sapiens
ggaggcaattctggcctcactggtgccttcagctcactctttttacattggagccaggtctatgtggtttgcattcatttcctctttcagcaaatatgtattcagttcctgctctgcaccaggcactgtgccaggcatgaagcatccagggagttgttagaccaggagtgagaaagagaagccataaacatcattatcaccatatttcccatcttcagagtaaccatatgagtgagttcctatcattacacacattttgtagataaggaaactgaggaccaaagaaggaggtgttatgtcaaggctaatatcagcaggaattgaacctagacactatgacactaaaacccaagtaatagccattccttcatctctccaaattaaataattagccactgatcatttctggccacagcaccttcttttcatgcagtttttcaaaatctttctgatgcacaatcagctaagtgtgtgtgtgattttgtggtcattctgtgataagcatgcagttcttgttgcatttgcctatagagatttttaaaactttgctttaattgcctacaatgctattattaacagaacaaaaactgccagtagggtttctgtactaggttccaagggagtagtaggacttcaaaataaatattaatggggatggaaaatgttgagttgccttgcttgtagtttttggcttatttattttcattttatgggaacaggactgtcaactctaaatgcatctggctctagcagaggaaaagaaaggaaaagcaggaagtccatttttggcaacaatccgggcagaatgagcccaggggagacagcatcatttaacaaaacatctggaaaaagtaaagtcactttcttacaatatctttgcttgattctgcatgctggatgatttagatattttactgtctaagcacttcccttgaattttttaattctttttcctgaacattaatattgtctgagtatagtataaatttttgtaattgctaacttacacttttaacgtactaaaaacagcatttcaggctgggcacagtggc

SEQ ID NO: 62189 - DNA, 1050 bp, Homo sapiens
ttctcaaggaaatggaagtgcatttggttttggatgtgccctttctctggaagtgccaggactggtatagacacactggctccactgaatagcaaaagggagcaacaggtgaaggggacacagggagctgccactccatgggccatcctgcagtccagaagtacaaactaaagctgcctgtcctccactgacccttaaaggctttgcctctcttccaaatcaagttgggattgagagtacgtctttaagccgtcccactcaaatggctgtgctgtgtggttcatcctcaagtttctctgcataatcttccaaaccgggaaaaggtgctatcatataacctctctccattcaatgtgctgattaaacatctccccatgttggacaaaatacaagcaacatgcagtatcagtgtgttcatctgtaaaaatggtcttcatttctgcaaactgggggtacagcctgatttaatattaatactttgcacacagtagatgctcagtaaatgcttgttactctgagttgaggcagattatctctgtcagccccactgcaatatgaacatgtggttcttgatttttggtcaagatcttttccaagtgtttacttctctgaattgcaaattcaaacagatagataaggccaggtgcagtggctcatacctgtaatcccagcactttgggaggccgaggtgggtggatcacttccggccagcagttcgagaccagcctgtccagcatggtgaaaccccatctctactaaaaatattaaaacaaaatagtggggcttggcggtgtatgcctgtagtcccagctactcggaaggctgagcgggaagcagaggttgcagtgtatcaagattgtgccactgcatttcagcctgggtgacagagcgagacactgtctcaaaaaatacatagctaggggccgggcacgatggcttatgcctgtattcccagcactttgggaggccaaggtagatggatcacctgaggtcaggagttcaagaccagcctggccaacatggtaaaaccccatctgtactgaaatacaa

SEQ ID NO: 62190 - DNA, 1047 bp, Homo sapiens
gcctgtagtcccagctactcaggaggctaaggcaaaagaatctcttgaacccaggaggcaaaggttgcagtgagccgagatcgcgccactgcacttcagcctgggcgacaaagtgagatactatctcaaaaaaaaaaagaaaaagaaaattatatatatagatagatagatcgaatagatcgataagagtcaacagtggaagcaccatttttcaattgttgaaaagaatttccaggctggaaagtgcttgattttccatgaagcatcccaactaaatagcagagaaaccctcccagggccagcctcccaagaggtttcatggatcatctgctctgtgacttcctggatttcaggggattctaacgctccaagtgggtgtccatggacttatggccatcccttcccaagctttctgctggttccatcaactccaagaaggtctgaagtgatctggaaccaggagtttcccagatcaacactcaataaaaccaactcttgagtttagaaactgacgtgaggctggtatgcaaacccctggttattgctggcaacagaccctctaagttctttgcatctgaggcagaacaataccgcctcacacccagacttacaatgtgtaaacatgcaaccctagtcaaaagaaaaacttctttttttaaagaatttattaagcttttttgaatgacagacttccaatcctcaaatataaggataaacattatgtgaatggtgtctacataatgcagagtattttaatgggtagaagaccatcaaggcaatggtatgtttatctatcattatgtgcattgtttcagaggtgtagcagggttacactgatttgtgcacactttttcacttgattggaatgatgatttttaaactatagccccagatgaagttctgggaccatgtccaggggacagcaagagggctagatttgaggtccgacctttatttcaaaccgtgcggctctacgtggatctcttttacatgtttggtcaccaagttagatttcagttaagaaactgagcattaggggaaagagct

SEQ ID NO: 62191 - DNA, 1027 bp, Homo sapiens
caatatggagatagtatgatagtactttccttgaaggttaagtatatgtaagatgtttaatacaatgcctagcaaatggtaaacattacttaagggttacttgctgttcttactgtatgataacttagttaatattagccatcttattcaactgactttgaattccaaagggcccagacttacatttctttaacttatctttgtctcccctaaaagtacagcacagtatctgggacataattggccctcactaaacatttaatgaattaacaaatgcatcaatgaaagacattcttatattaaatgaaaagagagatcagttgacttctaaaattctttcaacatccaagactctgtgatagagatagcccagtgggacagagacgctcctgaagagcaagattctattcctcactggctgactttcatgtctgtgagcgctggtacatgcagaaaatctggttcagacctttattgttactattatagctgtatatatcctggaatctacttaacctgtcttaagtataagcttcctcgtctgaaattcaggataataacacctaattcatagactgttgcaaagctaaatgaggtaacgtgggaaattacattacaagctacaactatacaactgcaaaatgagttggatgaaatgatctggaagatccccttcatctctagtctgggccatttttccaccttaaagtttcatatagaatgaatgcaaatgttggagattctgtgtctttattcagttgatcataacttacctttcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggtaaagtttaaagttattttgctctgtt

SEQ ID NO: 62192 - DNA, 1934 bp, Homo sapiens
gtggtggtatctttacattttttgtgtttgtgatttagatctgctactgaactttttgaggcatatagcatggcagaaatgacattcaatcctcctgttgaatcttcaaaccccaaaataaaggtatgggatatttttcatttttttaaaggaagaaatagaaaccaatgtatctcaataactctaactccagtttgcttaattattttataggtagttttttttttaatgtttaggatttcatcataggatggatttctgaggttgaaattctatagagatgatcatgaaactgttcgttcaatataggatatgtccaagaccttaccaagcatctgtcattgtgttgcatgtgttggtgtcagctgttgccattttcaacttggttcacaggttggctttagcttatagcataagtaacttctaactcatactttaaatattttcctagggtaaatttttacaaggggattcatttttgaatgaagatttaaatcagctaatcaaaagatactccagtgaagttgctactgaatcgcctctggatttcacgaaatatttgaaaacatcactacactagtagaggaatgaagtcagtggactttcttgtatatttgtgtgtgcagatgtacataaagatgagttgttaacttaggatcttttctttttatacaaggaaagcttcctaagaatgtctaggaagaagaggaagaatgaccctttgcatggcacagggttctgcccctattctgaatatgtcattccatcaaggagatcaaaagcctttttttctccccagtatttggaaattactttcttgatgatgctgccttttaaaagcttcacgtacattatagttttttaaaaaaatctttggactggatcttactgaagtgcagttgctatattaaaattagggcatagagcacagaaaaatcaagaccatgagaagacattttaccatttagctactttttataactaaatactctttaaatatttttatttcaatactgtggatggaaatgagaagcattctaaatttgagttaatatatttttatgaagatatttgagaaaagaaaaaaatagcttgtattcaggttcattggcttttgctggatgatccacctaaagaagttacctaatttggccttttaaaaaaggtgttagtgtttattatagctactttcaaggaaagtttgaatatgattctagtctctaaagttcttcacgttttctgacattccctggagggtgactggggaagaattgctccagggtagaagaaccaggcccaagactttaccattctgatctagagacaaaggatactcaatgaggagcttttttcccctcttggaacaggtaaaatgctttttcttattaatataattataaaacagtattttatgtaacagctattcccatattctaggagtggcctaagaaatgcgtgtttcagtgactagattataaatattctctattgtgaatagttgaataaaacagctgtttttttctgcttcctattcttgtgatatgataattttttgaaaaaagcacagcagtccaactaaagagatctcttactgtttgaaagtcatagcagccagttattttactctggagcttagagttcttttttcacatgaagtaaacgaaagtagaaaattcctttaccattccagcagagtgagaggatatgagcttaacagtgtatgtcagtcttttagcatattatatatgatttttaaaagtggttctgaggtcacattttttaaggcttgattatttaatgagaaaggtatgattcagcatatgaatatttgcttttagtccaccttttaggtataaaacaaagtccaggaatgtgataaatatttgtgtggataaccaaagggtctaatccccatcagagcacaagtgaccaat

SEQ ID NO: 62193 - DNA, 1070 bp, Homo sapiens
tggaagatttactgaaacctttccctttattgaaatctttccctaacactcttcagaggatttgttatcaggtacatttctgttgagtcttatccaaggagactttagtaagccctgtttcaagatggtttcacctatgcagtgatcctacagtatggacagcattagagtgagacttgtagaaaatagaagtggcaggtaacctgttgtaaattaacttttttcactctgaaagaggaattgctttttgatttttctatttatattgtaaaagcaagactaaactacttcactggtaacttgatttgtgttttaatcctattagcaaagataatattctttctgtgggtatgtgcttctaatgaattacatatactgtacataggtgatgaaaaaaaatttggtgtaattttatttaagaaaatctttgctgtggctagtgttttttgtaaaggactgacctgtgcagaatgtgattgtcccgttttcccttcagaggcattatcatcccatagtgcagagatttgcagcccacctgatcgctggagcaccttctgaaggctctggagcactcaaaccagagttgagtcgaaggtaatatttagcattgccttattctaaaactacagaattgagctgatagccacttactatgagaagactgtttcataaagtaacatactacaaaatgtaaagtgccagttgggtatctggattggtcttgcttcatattcctgaattgttctgaaagaaaacatgctatgattttgttgatcacttaaaacattttttttcttcttctgtcattcaacttgaaaaacatttttttaatcgtgaaaagtttcgcacatacaggatagtagaatggcatagtgaatgtccatatgccccccatcactcaggttcaacaatgaataatctatggctataggtgcttcatgtgaagataaaacacaagtcaaccaaattaagcttccttgctttctcgctcgctcggtcttttttttttttttgaatggccctgttagggcaggatgaggagaaaaaaaaaatgaggagagggaagaaaa

SEQ ID NO: 62194 - DNA, 1139 bp, Homo sapiens
ggcaattaccattcttaatattccatccccctcaccccccccttttttttttaaaggacctaagctatcaagaaagtcttcactgtgtccagactgcttttcatattctttctggacaaggtatgatattttcttaatcaagttttgtttgccttacctttgaatgctataacatacctaattggtgtttgttgtcatttcaaaggtgatgttctgaatattgatccattgaaattctacacacatctctacaaaacactgttcaaattacatgcaggtatgtatgtttagataatgtttcttttatatgtatttatgttttaagaatatgttatgacccatcattgtagacaaatgagaaataggaacaggtacataaaatggtgactttccagtgccatgcatctgtatttaatcttatgtaagacttggagaaagagcttctggaattgactggagatgcagtaagtatagcccgctgtatctccttagcagtatagcactacctcattgattagagaaatggtttgggacaggtacaaaagtttatcttgggtttatctgaagttcagtccagttgcgtaatgaaaaagtaatgagaacagctctgaagaatatgtctgctgttttaggtgctaccaatgaaggtgttgagattgtactccagtgccttgatgtcatgctaactaagcgcagaaagcaagtttctcagcagcgagctcttgccttcatcaaacgcctttgtacccttgctcttcatgttcttccaaattcaagtattggcattttagcaactaccagaatattaatgcatgtaagtagtgatacaaatgaacagagctaagttcttataatgcaatgattttttttgtttgaggcatgtcttttccccccttttatattatttcaattacagaagtaattcacacttgtaacaaaatcaggtgacaaaagaggtatataaaattgaaaaaaagcattttatacctattgacacttctcagtgtcattaggtgggtatccatttaccatttggtgggtatttttccagcagccttttaaagttcatatataaacacatacacatagaaacaactcaactttgtattttaatggaaagaggattatgctatatattc

SEQ ID NO: 62195 - DNA, 1050 bp, Homo sapiens
gtgttttatgacatttacgtattctgcctctgcttttttcactctgtggtatatgctcttagatttttgtttttcaatctattttcagtggaagaaagcagaagagaaactagagcgagagcttcgagaggcagaagcttcagagagtactgagaaaaaacttaaactggtaggcagtttcatattctgttatgcttttaaaatgcgttaagttgtttaaactagaaatttattgtttcagcttgtagctgtgtaattttggtttctttcatgaggcttagatgtgtgacttttgtgatgtgcgggaaactgtgatgtgatcagtgctagttttatgcagtcacagggtgtatatcttcattctgttttgttaaaaatttcaaagattgcattgtggggagggatgggtagggaaaaaagttaacctgttgaagtgatacttatgctcactcaggagaaagcataccaggttatcctaaagtcattttgtctgtctcctctgccagcacacagagactctgaatattgtgtttgtaacctacttcagaatattgaagaaggcccagaggtcacctctcctgccagcagttctagaaggtcttgccaagtaagggctgtgtaggttgaaatcttttagattccttctaaataggaaagaccaaagaattttcgagagttccctaatgatggcccattatcctcagttctcattccttttctgattgtcaccagcctttacttgaagctattcataacagtgggcttttttgattttctcatctcaaaccttttatttttaaaatctcctttaccaactccttctttctgcctactaaattctaggtgttcctaaggttaaatctctcagttcttgactctttctgcactgtgtagtcaattgcccatcgtcatagtttgagtggatcatgcagatgactcttaagtctattttaacccggctgtacatcatttctctagttctgtgtaatgtgtttctgctaagatagatcttttggtgtattcactcaacactaatggccttgtcaggat

SEQ ID NO: 62196 - DNA, 1051 bp, Homo sapiens
tttagagatcattgaagatcctattcaagagctgaccatagaagaacatttgattgagagaaagaagaaattacaggagaagaagatgcatattgcagccttggcatctgccatattatcagatccagaaaataatgtaggtagtattaatttctttaggctctttgtattaggtatggtgtaaatgcctaattgttaagattcccttgttacctataagcatacactaaaaggaaaagcattaactaaacatagtagctgggttagagtaagagagtagacagaatcttagcttaatgctatgtctgaacttaatttcttttgtaatcctagaaaagttacttaaactctctgaatcttattctcctcatcttcatatatgaaaatactggacatcttataactctaaaaatgtttaaatttataaaattgtattagggaggaggaacctgtttgcaaatttgcttgacatacccgtggagtttttaaaaagcgcgctacaggggaagtgtatggaattagttcaggaatatttgtaagttgaaaatattttaagtgaactagagccaaagttaaagtaaagtgttattgtgccatgtgtatagtcgttgagttagtgatggttataacacatgaactagagaaatctgaggtttaatcttggccctgataagtactatctgtgagactttgggtaagttatttatccaagactctttcatctctaaaaaaggacagtgtctttttcaaaactttgtggtgaggattatatgatgaaatatacgtgaagtcatataaaatgatactattattattgttatgctggtgtccccagcatactattataacaagtatttgtttatgaaatgatagaatagcttatttacatttatagaagcaaatttcatgtgggaatgctttggagtagtacttgtccttttctaatgaagtgaggggaagatctagagcagaattagggaagagagatttggaatatttcttatgtgtattctctcaatcattacaaaaccataggcataagagattgatc

SEQ ID NO: 62197 - DNA, 1069 bp, Homo sapiens
caaggttcaggtgattttcttttcactaaattttgttgtttctaaaattagagcatattaactgttcttgattagctttcttttttaatgtatcttcttttgtatgtgaaataaaacagaaaagttcagatatcaaagatgtgaagttacatggtttataacaaagcgcatacctataaaactactattcagacaaggaaaaaaaactactgctagcttccagaatcctcccttgtgctcacctcaatcactaattgtgctcttcccataaaagtaactgctatcctgagttttatcgtaatcacctcctagcatttctttacagtttttaccacttaagtatatatcacagttttaatacatatgttttccatatagttactgatagtaacaaagatgaagaggatcaagaagaagagagggaacttgaggaaggtaatatgtctttacagttactaaattgttaattgagaatttttttgcataatagtaaatgtgagttaattttagatgaaatctggaaggtacattttggagtactgctcatttcaaggtcactttgaacatttttccacatttgaaagcttcatcttgtggaattattaatagattctttatttttttgattatggaaaaatttacacaatcatatttgtaatatctaggcatacaagaagtgtgtcttgttaattattactgttctgaattccttttaattgtaagagaaagactacttacaaataactgttaactttttagctttaaattacaaaagcgattctgtagtatgaagtcattttggtttgtttctagcacaattatacttgcatatgtttcatataattgaatgtcagtttctattacctaggaccatttaatcaaagttgaactgaaataatgcattttattgtttgaaattatattagtttggaatttgtgacagaacaatctagttaaattttactttcgcttagcagacctcattaatagcaaaaatgaattacaggtcaactgtttaactgttttcagtcacccatcataaaaccattacagattatgctagtgttga

SEQ ID NO: 62198 - DNA, 1042 bp, Homo sapiens
ggtgagcactagggtttggaatgtggccattagagaggctggctgaaatggaatacgaagtgaaagtaattggagatgagaaggagctgaggggctaagtcattggtttccaaacgtcctgaaaggcatttcagagtatgtggagacatttagtttttggttgttacaataacctgggaatgctattggcatttagattgcaggagtcagagatgctagcatttttccagactcagaacatcccagtacgacaaagaattgtttgcctagcatatcagtagttcttccatttagaagcactgggctcagctgtgagccatggcccactccctgtaatcccagcattttgggaggctggagtgggaggattgcttcagaaagcgtaagcttttcctgtttaaacccaaaatgcagagagttctacatctctgatacttgtttctaatttttctttgtgtgtgtgtgtgtgtggtacaggtaaaaggattgagagggaagaagaggaagaagaagaagcccttcctttagatatgatggatgaagatgacttacagttaatgaaggatttaggacaaagagtatcttttctaacaagagatctttcttctaggtaatacttcatttgggttataatcattcatatccatttagtgttaaaaacttggttctgaatttcacttaggtggttcaaggtgttcacctttgagcacaatgtttacaaagaataaagtattatttagcttatttcctaaataaaggaggttcatgtataagataagctgatttcatttaatgtacatctttcttttgagtctgaatagtcaagtagagtgaatgggggaagaatgctgttctcactttgaggtagtggcagaacagttctgagttcctacggctatgatttcacttaatcctcattaccctgctggtaggtcttattcccatttccagagaggaaactgatggttccctgcagtcacaagtatctggaatttaaagttggaccttttaaactccaaagtctatgctatactctaaagat

SEQ ID NO: 62199 - DNA, 2008 bp, Homo sapiens
agctcatccttggttacccactgtgtgcgcgcaccacttcagagtatcacgaagagacaggcacggagttttgcatgcgtgggatttcatactttgaaggaatttttcaagaccgtctttcgaactcgtttttcacaaatgagaagcagggtcctaccctcagcgagtttataatgtgagtcacggtacccatgaagggtaaagagatagaaaagcaagtgatttgtcctggttctcccagaaaataagaggtagtcctggggttcaggactaactttgggatttctgaatgagtcaccagcaagagaagtggaatccaaagatccgaattcagttttgccctccttagtttatgggtcttttggcagcttcatcagtaatgtgaggataacagcagtcagtactcaactaggctgttagaggtgatttgttggagcactttgtaagtaataaaatcgtagataaatgtaagttttattaaagacagccagcattttgctttgaatgtgttaaactacaggtgtgttaaactagccttgaatagccacttaccactactagatcagtggttcttaacctgtttggggatcgtagaaccctttgaattgctgtgaattgggattgaataactgatgctgtagcgctcttctgtaggattaaagccatcgtttggttttagcttttatatgcaagtctgtggctgtgggacattgaaattgtggaattggtctaatgaaatttgtaatcagttctctttaacctgatttaaaaaataagtttctgggtatgcagtattctttctgttattttctagagaagaaataaaaaacagatcccaagctttcgcaagttaataaaaactagtaaagtcaaacttgaaaacaagctaaaaaataagcagtttaaacaacaaagcactctcaagaagtaccgaaaagaacagaggaaactaaggcaagctgtgaaagatgctgtgtctaagaaacccattccattggagaacccaaaggaaaagcgaccaggtaattgtgaaaacatcatgtgctctggtttccattgatttattctgaagtgttcttcatggaaataactttgctttctagtaatcgcttttcttgttctcagatcttcctagagtgggtaaggatagtagtcctataggactgctataaagcatatatgctttatcacagtcagtatgagaaaacatttcaatacagtattcattcaagcttctgcttttagtttgtctggaaggcagatctgaagatgcactacttgggaaaacaaactgaaagtactccgttacataaatattgggcagtgtgccagtgctgccactttgccattcaccagcagttaggtaaggtaagaacattgcttgtctctggttcattcttcacagtattgccaaggtacacttctaaacttctgactttcttttcatgtggaaacttggggtgaaattgagttgtaattgtcatggttattttgtaaaactatctaaaaattattaagtactcaaaacttgtaaggaatatgactattttgagtcaggctagttctacaactttgctggtacttttagggtattcttatttgactatatcagattattagacaactattcagtcttctcaggtccattttttaaaaattattattattattttaaatagacagggtcttgttctgtcacccaggctggagtgcagtgtgcaaaaatagcccactacagccttgacctcctgggctcaggcagtcctcctgcttcagcctccaaaagtgctggaattgcaagggtgagccacagcacccagctaaagttttttttttttctaattttgtgggtacatagtaggtgtatatatttatgggatacatgaggtactttgatacaggcatacaatgcataataatcacatcagagtaaatgtggtatccatcacctcaagcatttatctttgtgttacgaacaatccagttatacttttttagttattttaaa

SEQ ID NO: 62200 - DNA, 1121 bp, Homo sapiens
gctgcagtgagctatggtcacaccactgccttcctgcctggatggcagagtgagactgtctccaaaaaaaaagagaaaattgctcacagttgattcagattgtcaactaggttttagtgaattgcttaatcctaggtggcatcttcaaattacaggatggtatggtgcttaaaaatgctggttctaaagttaggctgcttgggtttgaattagcttactagctctttaattctggacttctctggatcttaggcaactcatccataaaatggggataataataatgcctaattcatgggattgccatgagggttaaataatattttacattctttgttttaactatgtggcatatagtgaagattcaaatgttattattcagacagtagcaagactactataacaccttcctcagcttcaccactgaaatccactgatttgaagaaaggaagatactggatgaatttttgtgtcctgtctggggaaacgttacacaatttgtgcagaagaagatttttaaacataatttatacatgggattggatggatgttaaaatagattctgatgtagtgatatgacatttcccgaagtcttgaagctttgactaaaaagcaaatctgagaaggaaccgaaaggaatgctgagaaagattaaaatatttgtatcttttattgtcttaaggaacttttatagacaggcaaagccaattttttagtttaagtccatgaaatgtttaacttggcttactcatgcatttcatacttagtatgttgtggtaggaaggttttgggaaagagtggaaacatttggagattttgagacgatacatctgttatccatctctaaatgtatgcagaaaggcaaagtgtgtcctttttgagacagcttttttctccctaggaactctgttagctacactatgagttatcttcagatagttatggctgatagttgcttggaccctactacagtgattcttaaatttagtgtttaaaattacttggaagggggagggttgttaagaatgcagattccttgagacccaagtagatcctgggtggggtccaccaggaatccaactttttaaaaagacccccaggtgattctgatgcaggcgatt

SEQ ID NO: 62201 - DNA, 1013 bp, Homo sapiens
aagtatgcagctcaaaagcaagactttttataattacttttttcttttatcattaaatgtattctattttgttctctcctgctgcaaaagaagaaaaagatctcagctgggcatggtgtctcacatctgtaatcccagcactttgggaggccgaggcaggtggatcacttaaggccaggagtttgagactagcctggccaacatggcgaaaccctgtctccaataaaaatacaaaaattagccgggtgtggtggtgcatgcctgtaattccagctacttaggaggctgaggcaggagaattgcttgtacctgggaggcggaggttgcagtgagtcaagattgtgccattgcactccagcctgggtgacaaagtgagaccctgtctcacaaaaaaaaaaaaaaaaaaaaaaaaggaaagaaaagaaagaagacctctatcagtaaggcattgcctgtaatttatttaccataagaaataagacataaggtgacttgctaacatgagtacacttggactgtattctggaaggataagaaaataaatttgtatatttgaattgtttaaaatgaaggcattttggcaatgtgtaggatggaaaagattagggattagttgtgaagctcttacatcttgattgttgtatggaggacatgaacaatatgaatgtgattaaaaagaaaagcaactatgcaagagagacctgtttcaaacacttagtagtgtgaccttggcaaagactctgtggggtcatcagtctgtcttggaagtggtaggttggtgtattgaatcctaggagaatttgatgaaagctggccaagagaaatgtttggaacttctttttttttttttttttttttttaagacagggtctcactgtgtttcccaggctggagtgcagtggcacaatcacagcttgctgcatcctcaacctcctgggctcaagtgagcctcccacctcaacctctcgagtaactgggactatagacgcatgccaccatgcctggctaatttt

SEQ ID NO: 62202 - DNA, 1060 bp, Homo sapiens
ctgggactacagatgcatgccaccatgcctggctgatttttttttgtagagacggggtttcgctatgttgcccagactggtcttgaactcctagatgcaagtgatcctcccgccttggactctcaaagtgctggcattacagacgtgagtcatcatgctcagcaggttgattgactcttaataaagaactctgacctggatagtcttttttttttttaatttaatttttaattttctttttctctgaacactctccaatgttacggatattttctaaggtccctagaagctctaaaatattatttattacttgaaaaattgtagcctttcagccttgtaatttctcttgttttgacagagtgggtgatgttgaatttccctttttgatagctctgatctcagaaaatatctggttagttaagtaatgtttattgaataaaaattctctactttttttttaatttttaggatttgtaataacaaagacaagatccaaaaacagcttgaaaaagaaaattcttggaattaaaaaagcctaagttatctggcaaaaaaccctactttttttgcatatagtcagctgaaagttttttccaagtgaaaaatgattgaggcttgtaaagaatgttagtaatctttgtgccagatctttaatccagaatactcaagggtaaccaaagtactgagtttagagacagtagttatacttctttgaattaattatgtagtcagctgtggcattccatggtcactagataatgttttctttatggctttttattctttggggaaattaaagtccaggaagtttttatgttttcagccatccaacttcccctctgttatgatttctaatttttaaaactgattttactctttcaattgattctatcccctccacttttttttttgagacaggttcttgctctgtcactcaggctagagtgcagtggtacgatcttgtgttactgcagccttgacctcctgggctcaagtgatcctcccgcttcagcctgccaagtagctggggcttcaggtgcgtgccaccacgcctgcctaa

SEQ ID NO: 62203 - DNA, 1047 bp, Homo sapiens
caatgacgcggagtgcaatgaggcggtctcggctcactgcaacctccgcctctagggttcaagcgattctcctgcctcagcttcccgagtagctggaattacaggtgcccaccaccacgcttggctaatttttgtatttttagtagagacagggtttcaccatgttggtcgggctagtcttgagctgctgacctcgtgatccgcccgcctcaacctcccaaagtgctgggattacaggtgtgagccatcgcacctgtcctgggttttgtttttttttttctagatttttcagtgagagatactttcttccttggttatatattgactcttttgtagtaagctttcttgtacatagctggcctaggaaagacaggttatgtatatatattatagcaataggggattagtagatataattttattataaataacaaattattactgtaaataatatttatccaaatattgtattacttaatcctttaactgttatatagattcttttaaatgtttttgttttcagaattttggctcttattgttaagtacatgtacagtcaattctagtatactttgtagctgatttagacaaatgtttgcatcttatttatggctatcattttccttccaatttgtttatctttttattatttctgttgatgattcttctaatacctctatataagccagatagtctgtattttactttaagttctgggacacaggtgcagaatgtgcaggtttgttacacaggtatacgtgtgccatggtggtttgctgcccctatcaacctgttatctaggttttaatccctgcatgcattaggtattaagctacatattcttaattgagccttattattctaagtaatagtggtataagtagtagaaatagttttatttaaaagtatttttgtttttgccttgggaacaaacttattataaaattactgttaaatagctctctggttacaaaaaacacaattcatgtaacttttctgtgtttcagaaacctttttccaaaaaggacaaaggaactcaaatcagtt

SEQ ID NO: 62204 - DNA, 1079 bp, Homo sapiens
ctcactctgttgcccaggctagaatgcagtggcacaatcatggctcactgcaaccttgacctcctgggttcaaacgatcctcccaccttagcctccctggtagctgagactacaggtgcatgccaccatgcctggctaatttttttatatttttagtagagacagggtctcactgtgtttcccaggctggtcttgaactcctgggcttaagttatcctcctgcctaggcctcccaaagtgttgggattacaggcatgtgccaccatgcctggcccgaaaagtttaaaaaattgttacactcttgcatgttttgttttcacctttatttacctcatctgttatcaccttgaaaaggtagtgaataactacacttctagttgcgtgtgtgttctttattgatggttgataaattattatgcatttctgtgtataaatggatttcataaaaaataatttgtgtggtctaaagattggagaggtactagtaatatttctgggcctatgcttctgggagaagggagaagtatgatcctcaagagagaagcctaaattattaaagaaaattaaaagaataaagataagttttcacaaattaaacggtagaatttgaggggacgttttttcattttatcagaaacagagacttggaaagggttatgtttgaaaatactctgaatatctatatttgattacaggaatactgttttgcttatcaacattatattaaaagttgtattcatcctgtctttatctcagacttgtatattatagcaggcttcagactaaacaaacaagattgtgctggtaactttgcaaaaatgaagtttactacggtactcttatatgccagaaagtgatgaaatgctttgccccgagactgcaattgagcttgaaatataggatgggttttttgtctcctaattcatagatctggaataaaatttataatctataaagacatcataatcagctaaaccctgtctatcccaagcataatggtttcctcagctcttagatcaagttgtgtaagagactctatcttgggcagacatggtcttgagatagtagaggtggggagt

SEQ ID NO: 62205 - DNA, 1062 bp, Homo sapiens
tgatctttttgacctaatctttgttggagtggttccagaatagcttttagtttaggagtaatttgtcctcactactgaggcattattcttctaagcactctacctagtactcttatctatcaggaggcctttccactctggctggtcttgtgtgaactttaagaatgtcctattttttttttctctggtggttctttctctggctgtagttaatcacacacatgcacagatcagtactcagccaaaaccttgagaggactctctgcagctcccttcttttctggttttctggtttgtaacttttagctgtcttggactctccaactctaaactttctcctcaccttaggattgatggaccactgagacctggaaatgtcaggtacttgtagggttaccttgcttatttcttttctcttaaagatcactttcttgtgctgcccagtgtctgttgtctggaaactatagtttaatatattttgtccattttctaatgatttaaggggaaagggtaaacctggtttcttttattccattatggcctgaagcagaggtcttaacttttattcctccctcctacaacctaccagatcaactgactaatttgagaagaggaggtagaatttataatttgaaaatttgtcacatacctttttccacactagcctgttgaaaagaaaagactgactcctaaaactggacactattatgattatatttggataagtgataatataccagtgtatttctttttgcattttttatatctaaatcactgactctgtgaagccattgatttgataaaccaaaatacggtgtagtagttaccccttattggcggttttgcttaaggcaatttcagttacctgtactcagctgtggtttgaaaacattaagtggaaaattccagaaataacttttaatttttaaattgcgtgccattctgagtagcatgatgaaatctcactgtcctgctccatcctgctagggacatgagttcagtttatctgcactatatacactacccatctggtagttcagttagtaaccttcttggttgtca

SEQ ID NO: 62206 - DNA, 1047 bp, Homo sapiens
tgtgacctccgctgcctgggttcaagtgattctcctacctcagcctccagagtggcggggattataggtgcccgccaccaggcccagctaatttttgtatttttaatggagacggggttttgccatgttggccaggctggtctcgaactcttgacctcaagtgatccacctgccttggccacccaaagtgctggaattacaggcgtgagccaccatgcccagccccagctcattttttagaagttattttgtagagatgatgtatctctatgttgcccaggctggtctcaaactcctggcctcaagcaattctcccacctgggcctcccaagagcgttgagattataggcatgaaccactgtgcctggctccagttaagtttttattaattttaaaatttttactatatgattactatgtaagataactattggtactggatgatcttaaaagcatggtatgatagggataatattgaactgaggaatcagaaggccacagctttaaccttgtttgatactaccttggtgtgatactctgaacaggcctgatgttagttttctcatgcgtaacatgtgagaggcaggtcagcttaatcagggctttgaagcttctctttcatcattttttttttgttgttggtaaagcagtggaacattctcccaagaaatcttatatagaatatgaatacataaaacaaataaaagaaagtagagattgtcggccagatgcggtagctcacgcctataaccccagcactttgggaggctaaggcaggcagatcgtgaggtcaggtgtttgagaccagcctggccagcatggtgaatctctgtctctactaaaaatacaaaaaattagctgggcatggtggtgtgaccctgtaatgccagctactggagaggctgaggcaggagaattgcttgatcccgggaggtagaggttgcagtgagcagagatcgcaccactgcactgcagcctgggcaacagagcgagactctgtttcaaaaaaagaagaaagaaagtagagattgtttacttggccttctg

SEQ ID NO: 62207 - DNA, 2059 bp, Homo sapiens
ttcataagaaatttgacttcatagatttagtgtaaatagaaatatgtgataaagtaatctacttaaattatttttctgaccttttattccacttacttttatagtagaacaggagatgttattttaaaattatgttaataactgggcatggtggcacacatgtgtagtccaagctgttcaggaagttgagatatgaggatttatttaagtccaggagttcaaggccacctgagcaacgtggcgagacccatctctaaaaaaagagaaaacaaagaatagaaaattatgttaatcaagttcatttactttcactttttccctccctttctttccctgtccctccctcccttatttccttccttcctcttatgataatattctttttgagaaagtctattttgtagagtttaggtaaatggagaaaaggattttgatctagcttatttgtattgaaataatttttactcgtttaaaacagaaattaaggaagcacataaaagaaaaagaatcatgaaagaacgatttaagcaggaagaaaatattgcaagtgcaatggtaatttggatcaatgaaatactgcccaattgggaagtaatgtaagtaagcagacttttcctaaattcccatttgtctccgaagatctcatgtttctttttttttttttaatttattattattatactttaagttttagggtacatgtgcacaatgtgcaggttagttacatatgtatacatgtgccatgctggtgcgctgagatctcatgtttctgattctgtatttttattatttccagcatatattttatgctttggctaaattatactattaattaatgcctgaaaatttccatatttgcatctgtgcctttgcttttgtaaatccctcagtgtctaccacctacttcccttactgaccatcctctgtgtctgctaaatcttttttttttttttttttttttgagacggagtctcgctctgtcacccaggctggagtgcagtggcgtggtctccgctcactgcaagctccgcctcccgggttcacaccattctctggcctcagcctcccgagtagctgggactacaggcgcctgccaccgcgcctggctaattttttttttttttgtatttttagtggagatggggtttcaccgtggtgtctgctaaatcttacctatcctttgggacccaactgaaatgctaattgatttatgaaacttttaatgtctttggttactgtgttttctttttttttttttttttctgagacggagtctcgctctgttgcccaggctagagtgcagtggcacaatctcggctcactgcaagctccgcctcccgggttcatgccattctcccacctcagcctcccgagtagctgggactacaggcactcgccaccatgccctgctaattttttgtatttttagtagagacggggtttcaccattcacaggatggtctcgatctcctgaccttgtgatctgcctgcctcggcctccccaagtgctgagattacaggcgtgagccaccgtgcccggcctagttactgtattttcttaatgctaacataccatcaattgtaagacgcactattgatgtaatagcagttatttggaaagagaatattaaatatataaatgtattagaagatgcacttattgttaaaatgatttttaaagtgtttatctcataatcaaggaaatatgtatgatctttcccttatgtaaatgtcccatcatcatactttgagactaatatacttatcttgcctttgcatttatttattcatttttaagttattttgccagcatctttttaatgataaataataattgtatatatttatatggtacagggtgatttgtttttttgtttttgtttttgttttgttttgagacagagtctccctctgtcacccaggctggagtgcagtggcgcgatctcagctcactgcaacctctacctcctggattcagacgattcttatgccttagtctccctagtagcagggactacaggcatctgccaccatacccggctaattgttttgtatattt

SEQ ID NO: 62208 - DNA, 1033 bp, Homo sapiens
atatattatttaatcatcagtaaccctatgagtaggtgttgtttttctctggtttacaggtaaagaaagctgagttccagggtagctaaataactttcttgaagtccctcagatagtaaatggcagagccagaatttgaatctaggtctgattgactccaaaaatcatttttttctgctgttccacaatgatacttcttagcagaagcatctctttctgcctcatatgtacattctgtatggatgattactctgcagtaattttatttactttctttctgagtatataatgaatagttttggtagaatcaagtacttagatttgccacttttttgatgcttgctacatcagagagacctgacctgtaataggtaaagagtaaaaattaaaatttgcaaatatatttctttcctattattcatacatttttgttctccccccaacccccagaactttatgaaatcttcctctcaagagcaaaagaacggtggaaaagtttcagtgaaacaagttcagagaatgatacagaaggtgtgatttctttttttaaataagaattttaggatgaaaattcagatactgagcatgtatcagaagctgtagtaatcgctttacatatatcatcttatttaatcttaaccctttcagtaaacaaggctagaaaaaagacttgatttacagaaaagttcatgtaagtatcatcctaagacctcttagctatgtcagctatttgtggagaactaaaagtatgtaaaaggtaaagaagtttatactggcagacagcagctatttcatcatttttgactcatttttatgaagcattgaaattatgagaattaaaattataagtattcacttctgaaatattttttcaataataaatggtgaggctgggcggatggctcacacctgtaatcctggcactttggggggccaaggcaggtggatcacctgaggtcaggagtttgaaaccagcctggacaacatggcgaaaccccatctctactaaaaaaacaaaaattagccgggcgtg

SEQ ID NO: 62209 - DNA, 1094 bp, Homo sapiens
gtgccatttttctatgtatctgtttttatgccagtactattctgtttgggttactatggctttgtagtgtattttgagatctggtagtctaatgcctccagcttttttttttcttcttttctcaagattacttttgttgtttgaagtcttttgaggttttatataaattttaggatggtttttttatttctgtgaagagtgtcattggtattttgatagggattttatggaatctatagattatattgggtagtattgtcatttgaacaatattaattcttccaatctatgaacatgggatgtctttccatttgtttgtatcctcttcagtttctttcatcagtgttttccttgtagaggtctttcacctccttggttaaatttactcctaagtttactccttattatttttgtacctattattaatgtatccagttttctgatagaagaatgatgccttatttaggcactaatgtcttttatcatgttttctgttgaaaatcttttgttttaacttggagagtttgcctttgaagcaatacccagtagattatagaatggtgggtgaattttgccaaagagatggagcagttgatcttaagacaggttgttgttaagaatacacatgggtgcagaggctcatacctgtaatcccagcactttgggaggccgaggcgggtggatcgtctgaggtcaggagttcaagaccagcctggacaatatggtgaaaccttgtctctactaaaaatacaaaaattagccaggtgtggtggcaggcacctgtaatcccagctactcgggaggctgaggcatgagaatctcttgaacccgggaggcagaggttgcagtgagccgagatcctgccacttcactctaacctgggaaatagagcaagactgtgtctccaaaaaaaaaaaaaaagaattcacatgataatttgaggagggggaagagtacagatgacatatttaaactttaattcttaacaattcacaaccagtgggtttcacgtaaatggtattaagctttaatgtagaaaaataaataatggcattggtcaaatgtgtcttctcaggtcttctttggttcaggat

SEQ ID NO: 62210 - DNA, 1019 bp, Homo sapiens
aatttttgtatttttagtagagacggggtttcaccgtgttggccaggatgggaaagccatatgttatttgccttcttatccctaattaaacactgttctttttttatagagatgcttactgagtaaatgagtcaatgaatgaaaaatttcagtgaccatttttccctctaattttaggatcttcacactatatagcaaatcactaccacttgatctggcctgtcgagtctgggatgtattttgcagagatggggaagaatttttatttaggactggattaggaatcctccgattatatgaagatattctcctgcagatggactttattcatatagcacagtttctaactaaattgccagaagatatcacatcggaaaagctgttcagttgtattgcagccattcagatgcagaatagcaccaaaaaatggactcaggtagagtgacattttcttatctttaatagatgtgttaaagcagttgacttattgtaaaaaagttaggtatttcttaaaagttagtacttaaaaatatgtcttttaaaaataatttttgacttctaagaagcaagagtttaaatcaaattgcccactttgcagctatccaaacatagggcttattttattttattttattttattttattttattttattttattttatgttattttatgttatgttattttatgttattttatgttattttatgttatgttattttatgttattttattttattttattttatgttattttattttatgttattttattttatgttattttattttatgttattttattttatgttattttattttatgttattttattttatatgttatgttatgttatgttatgttatgttatgttatgttatgttattttattgtcacccaggctggagtgcagtggtgtgatctcggctcactgcaagctccacctcctgggttcacaccattctcctgcctcagcctcccaagtagctgggactacaggtgcccgccaccacgcccgg

SEQ ID NO: 62211 - DNA, 1231 bp, Homo sapiens
gtggggaatgtaaggtatcgcgagatgacaggattttcccgcgaaggagaagcgcgcttttttccctggcgggggatttggctagaaggctgggccggcagcggttgtgaggagttagctcgcggcattgcaggctctgagaggaggggacccggttcccgggtgagtgtccaggcatgccagcggaacggcccgcgggcagcggcggtgagtgaggaaaaccttttgggcgcgggtggcagcctgcggggctgaggtgggcaagcatggaggctgcggcggagtttcggggagggagccgaccccgggcagggactgaggaggaaaggagggttgggaaactgcaacggtgagtggaggacaccccggaatcgcacgtattagcatgccggtgaagatttcacataggcaactgcattttcccgagcatcccgagttgtaaactgtggtccaggcgacttgtagacattgtgaagacttacggtgtcttctgagaggtgatgctggcgtcccctcggtcttcagcttttgctccagtgcatctcgggtgggagaaaggctgtttcttgttggagttgagtagttggtaatttttttaaaactgcaatttgaaagctttctcccccgtcaggctcggaggctccagcaatggttgaacaactggacactgctgtgattaccccggccatgctagaagaggaagaacagcttgaagctgctggactagagagagagcggaagatgctggaaaaggtaatttaggcatcaggttcgtcgtcgtgaaagcctgtggtaacctcggctttaacccggaggtgtggtttgtgttctttgctttcctatttagtgggctttttaataactgaaagaaaacagctttattacttgtcttttttgtatgtttacagatattgcctttgagaatcctttcgcaagtgctttgaatggtgtgtttctatgagatgtagtcttggtagtcccatcacttttaaatgagcatttcagattgcttgtttagccatgaaaagtctttcaaagtccatagtgagttttttcgtttgtcatccttatttcctttaaaaattaccttaaatgtatgtctcatggcaaacaggaatcgctaaaacctgcagaagtaatgtactagactgagggcaggagaagttagcatcaatcaaaggctgggctggaatccaagtctaatgatttccttatactgtagtgctgtttt

SEQ ID NO: 62212 - DNA, 1628 bp, Homo sapiens
gtggcatgatctcggctcactgcagcctctgcctcccccgggttcaagcgattctcctgcctcagcctcccaagtagctgggattacaggcatgcaccaccacgcctggctaattttgtatttttagtagagatggggtttctccatgttggtccggctggtctcgaacccccgacctcaggtgatccgcctgctttggcctcccaaagtgctgggattacaggtgtgagtcaccgcacccggccttcaattgttttttaaatggaccttccaactcagtagtgccagaaaccatgtgttcaatatttgaaattataatattttgatatacgaattgcatctatcagattgcctgttaaacccaaaaactattttttttttaacagttatttgttccagtttttggtttgaaagtgtttggtttaaaaaatgttattttagccatttttattaaactttatgccaaaaaaattaaggtatgtcagaaagtgttcataattatggaaattttctctttggataggctcgcatgtcttgggatagagagtcgacagaaattcggtaccgtagacttcaacatttgcttgaaaaaagcaatatatactccaaatttttattgacgaaaatggaacagcaacaattagaggtatgtatatgtaactgactacaagtgaaagcttaaaaaaatttaaaaatagctttattgaagtgtatattatatacagtaaaatggacagattttaagtgtacggtttgctgagttttgactagtaaatatatagatctgtgtaaccaccagcacaatcaagatacagtgcacttccatgaactccaaaaaattgtcttgtgctgacagtaatccccatggctggtgtccagcaactactgatttgctttctgtcactatagaccagtattgttttttcctagaaaattgtataaatgaaatcatggtattgtgctagtgagtaaatagttggtcttcatcaccatttcctggtatacaactcttgaaatccttggaatcttcaaagtaatagtgtttttttttttgtttttttttttttaatgctaatgatcaatggctagctgcccttaggtagcttcaggatgggagcctaagaaagacaaaacctggattagagggttgggatttagcctcaccctcaactttgaggaaaagagactgaaagttaacttgttcaccagtggtcacgattgaatcaatcacgtctatgttatgaggtcttcattaaaaacccaaaagggctgggtgtggctcacatctgtaatcccagcactttggggagcctaggtgggtggattgcttgagcccagaagtttgagaccaggctgggtaatatggcaaaaccctatctctaatagaaaaattagctaggtaaggtggcatgtgcctctagtcccagctacttgggaggctgaggcaggaggttggcttgagccaaggagattgaggctgcagtgaactgtgatggcaccactgcattctagcctgggtgacagagcaagaccctgtctcaaaaataaaacaggctgggcgcagtggctcacgcctgtaatcccagcactttgggaggccaaggcagacagatcacttgagcccagga

SEQ ID NO: 62213 - DNA, 1530 bp, Homo sapiens
tattgtatttattgtttgtctttccactagactgttatgaagatttaaaaacttgtgcaaattgagagaatacagtaagtcccggtgtccccatcacccacatttaaaaattatcaatttaaattttgctgtatttgtcaaatctcctttttcctttgtttgaaacccttttattacttttttatggtaaagtaaaacaaatggaaaaacaaatattcaacttaatgagttacacagcatctacccctttcatcacctcttggaaatggtttgaatttttggtgtctttaaaaaatttgtaagagtatgtctagaatagcttttagtctaggaataagttgatcccttttctgagcactctacttgatgccctttatattaagaggactttctactttggctgagagaatgtgaggtataccttattatgcctgaccccttggaacatgagaggttccacctgcttctttctggtgactcttctcctggccttggttaccatgcacttaccagtactcagcctgagagagagataacagctgcctttgtgcagctttgtcctctctggtacttgaccctgggaatgctactgctcttaagttttggattctgtctcctcaacacaaagagactgttgggctctgtttggatttttctccattatttgtactttaaaattgtatcaggcagtaagctgggcagtcagaagattaaccttgtttccgttttgtcagtgtttacagtccgttactgcatgttgtctgaaaaccattgtttaataaattttatctggattttagttgtttaaggcaggaggctaaatctgtcccattagtccataaaggcttgaagtacaagttcctccctggtttttaattatgatagaccttagtttctcattgtaaacataagttatttgagaattgatatgcgttttttttttaaatgttgcactttccacttgtgacataagaaaaaattgtcttacaggaacagaagaagaaagaaaaattggagagaaaaaaggagtctttaaaagttaaaaaggtaatatagccagccggaatattttttatgtcatttaaatattgaagaaatacttttgtattcttctgacttttttgatcatctgtttaattttaagtttctttagtgataaacctaactttgttacaagcaatgcagaaacatgtaaaatctgttcctcactatttaagaaatggagaaagagccaaagtatggtccactttagtttcttattctatggattattttggacgttggcaaaatttgactttcttaattggaaagaatctgcaaatttaaacttcaaggcattttgtaagtggccaccttctttgaaacctgtaatgaagttttgctagtgaaaagagaaataatttattgaatacatactgtgggtcaggtgtgctatcatgtcttctcttactctattttttttttcttttttgagacggggactcgctctgtcacccaggctggagtgcagtggcgcaatctcggctcact

SEQ ID NO: 62214 - DNA, 2006 bp, Homo sapiens
attttattttattttattttattttttgagatggagtcttctgtcacccaggctggagtgcagtggctgtgttcatggctcactgcagccttgacttcctgggtttaagtgatcctcagcctcccgagtagctgggatacaggcagttgcgtgcaaccacacccagctaattttttgtatttttagtagacacagggtttcgccatgttgtccagggttgtcttggatacctggactcaggtgatcctcctgcctcagcttcccaaagtgctgtgattgtaggattagccactgtggcagcctgttatttttttttttagtagcttttcatttgtagagggatggcgatgtctccagttttttaatccaggtgtgatcttagtcttctatacttaatgattataggactcagtagattttgttagttgcattttctgataaatggtggcatacagcagcattttgtataacacatcttattaaactttttttctctacaggatgaaaactcctcctctactaatctctgtgtggaagatcttcagaaaaataaagattcgaatagtataattaaagatagattgtctgaaacggttaggcagaatactaaattcttttttgacccagtccggaagtgtaatggtcagccagtaccttttcaacaaccaaagcacttcactggaggagtgatgcgatggtaccaagtagaaggcatggaatggcttagggtaatgaattggaatttttaatacaagatactggttttatttctatagtagcctaatgatttgaggtaccacaacttgagtcatttctatcatgtttcactattatacatttgtatgtggatacttgctttctgatttctttaccctgaatttttagaagtagaaattaccttgttaatggcttccagcacttttatggctttgataaaggactttccagtgttgttataatttatggtgtgaatatatcagctttaacataattctcatctttgggtgtgattttttaaagagaagaaataaaatattgtaatcctgtagttgtttatatccaagtttaaatacagtatctattattttgtccagatgctttgggaaaatggaattaatggcattttagcagatgaaatgggattgggtaagacagttcagtgcattgctactattgcattgatgattcagagaggagtaccaggaccttttcttgtctgtggccctttgtctacacttcctaactggatggctgaattcaaaagatttacaccagatgtaagacatgcttccttatgttaaaattataattttacatgttttcttatgctttgttgtagtaggaattaaattgtagaactcttataattatattggtttctgtataaatattttgtctgatttgacttactcaatctgcacaataccctaatttaaatttatatagtataggttttggaaatccctgacatctttcctaaaatattcctgaatgattttcagtgcattggtaatttgattcgactgagacagacttaggtagagattttattaaaaattctgcttgttcttcacttgatctttgccaaaaggctaagaagagagttttctgttttttctgtacttgttaccttctgcaatttttttttttttttttttttttgaaatggagtctctgttacccaggctggagggcagtgatgcagtcttggttcactgcaatctctgcctcccatgatgaagcaattcttgtgcctgagccaccggagtagctgggattacaagcatgtgccaccatgcccagctaattttatgtttttagtagagacgatgtcttgccatgttggccaggctggtcttgaactcctggcctgaagagatctgcccactttggcctctcaaagtactgggattatagacgtgagccactgtacctcccgggcccagcccttctgcacatttttgccttatgagaaatatatatattctagacgtagtatcaccatc

SEQ ID NO: 62215 - DNA, 1924 bp, Homo sapiens
ctttttttttgtcttcagacaggatgttgctctgttgctcaggctggagtgcagtggcgtcattctggctcactgtggccttcacctcccaggctcatgtgagcctgctatctcacacgcctgagtagctcatgtgaacctcccatctcactccactgggtgagtagctggcactacgggtgcgtaccaccacaccagctaatttttgtattttttgtagagatgggatttctccatgttgctcaggttgatctcgaactactggactttagagatcggcttgccttggcttcccaaagtgttgagattataggtgtgagccattgtgctgggcctgactttgtttttttgtttgtttttttttcattttctcccataatagttcaatgatttgttagaattgcttggcttattttgctatagaaaaatagaaataaaattttttaaaattatattttttccctcagaatgatttatattttctaaatagtcaatatttacattttgttcttaagtctgataaaaatcaatataaaatttttcagatccctacaatgttatatcatggaacccaggaggaacgtcaaaaattggtaagaaatatttacaaacggaaagggactttgcagattcatcctgtggtaatcacgtcatttgaaatagccatgagagaccgaaatgcgttacaggtacaaatgatcttcattggtttctttgtaatacataaaacatgcttttcttcatttatatcactttctcaccatctgggagcatttgtctaatttttttttgttgtcgaaataatagattatattgtgcatatacctgtagaagctggaaacttttattaacagaatgattgggatgaaggccatcatttgtaacaatataattaaagcttatggcagtttaacctatggcttagaatcatccagaaatagacctaatctcggaatgtattacagatatatttgtgacaggtactttgaatatatggaatttacttatcgtattttaatcaaataagagtatttgaagacaagttatttttagagtatcttattggactatttggtagcattttcgtttctattttcttgatgttctagctacttatttaaataatttccagttagcataacagaattgaaagattgaccttttttctttcatgccttctgttttcatttattggtgttttgaacttcttcctcactgctctacctcattcatttataattcttgactgctttttttttcctttctctggccatgtgagaaccctcttagtgcagtccccttaggtttatcttgcttgcttggaaataggaaagtatttaatggtttcaacataaaatcaaaacacataagtcataaatagaataattatgacttgcataattatgaccagtattgtcaggttttatgtgtctgctggtaaaactttggaatatgatttgcagaaatctcagttcaggagtttagcaaagtttatgaatgtgtacagcattaaaaagtatttaaaccaggccgggcatgaaggcttatgccagtaattccagcacttgggagtctgaggtgggcagatcccttgaggccaggagttccagaccagcctggccaacatgacgaaaccctgtctccactaaaaatacaaaaattaggccggacgcggtggctcacgcctgtaatcccagcactttgggaggccgaggcgggtggatcatgaggtcaggatatcgagaccatcctggctaacaaggtgaaaccccgtctctactaaaaattacaaaaaaattagccgggcgcggtggcgggcgcctgtagtcccagctactcgggaggctgaggcaggagaatggcgtgaacccgggaagcggagcttgcagtgagccgagattgcgccactgcagtccgcagtccg

SEQ ID NO: 62216 - DNA, 1591 bp, Homo sapiens
gttaaaacaatttccttgataactttatgaaagtgagtgggtgactttctgtgaaaatataaattgcttaaataagggaaaattctagtgctatttgatgtttcagcacatatggaactaataaaagctcaatttttagtagtctagtgtaacattaatatcaaaacttgggaaaatattagaaaagaaagctacaactgcgttgactaaggtgtgaatagggaaatcttaaattcaaaataggtggagttcaaactttattgcatattttagtaggtctcttccaggaacagaaatatctatcagttttaggaatccttgtaagtggatcaaatgaaaacatgatcatttcagtagttactgaaattacatttgataaaattcaacatccatccctcataatagaggttttatttttagaattcttgttagaaaaattgtgagatcattgtttaaaaatctttttcctcaattcgttttctagcattgctattggaaatacttaatagtagatgaaggacacaggattaagaatatgaagtgccgtctaatcagggagttaaaacgattcaatgctgataacaaacttcttttgactggtactcccttgcaaaacaatttatcagaactttggtcattgctaaactttttgttgccagatgtatttgatgacttgaaaaggtgggtaagccagttatttaatgatttaacctcaaaaatctgtgctgttagttaaaattactttcttttcagtgactgaattaaaatgccaaatatttggcaagttctttgtggtgtatattgtatgttctactcctgccacaaattatgtgagagcagattaagaaaagattatttaaaacttacttgcattgattaaaggaagactgctgaatgcaactttaagataatatttttataataaggttcttttatgtgttacctttgtaaaacattttaagatggatttttcttactatatcctcattaaacaaccagggacaatagagttgttaaattatttcctatctcacataaaagaaaacctaggtgtaaagttgttacaagataagactagttagttagcaccagagccaaagttaaaaccaaggtctcccaatgtaaacacagtgttttaattctggaaactgtttgaatcttagcttatataataaaatcagacataaaagtagttttcagaaagtaattagtagcttcagaatggaggaggaggtaatgttgacataatttaaaactgattacaacggaaatataacttgggcaaaaaataatttatacttgttttggcatcagtgaaggaagtaagctaattgggtgtggaaaaataattttaaattttgggaatttatttcaaatctggttaccgaatggtggctcaaggcaggctaccttattgtgactctgggcgcttttattgaaagacaagaattccaggtcctgtgcagacatactgagttacagtgtcaaggtaggagttgagaatctgagttttttgaacatgcttctggtgatccaagtttgggaacttctagtctactgcataaatgttactagcattttccagaattgg

SEQ ID NO: 62217 - DNA, 1027 bp, Homo sapiens
tcattgtaatatatatattttcaacattgggaaggaataagcatgtatattattgtcaagttatgtatatgttgaattttaaaatatttattgtagtgggccatacttagactgatggagaaaaatcatatggctttggttttcagagatagttctcacttttgtaatgtaaaattataaatatataccttaatcttatttttgatttttatactactgtacaattgttaatctatttataaatcagaaaagtgttccctttaagctcacagttcttgatggttcaaaaatgcaaccaatttatctttgttgttggaatgtgttctcttccattataaattttaaaaattgcacctaaggatttgatgcaacaataccacgtttcattatcagattattactgtaaatgataaatcatgtatcatgttgacataattgaatttatgtgatggttaacttaaacatttttctcttccagctttgagtcttggtttgacatcactagtctttctgaaactgctgaagatattattgctaaagaaagagaacagaatgtattgcatatgctgcaccaggttttccatgttttcttattctgcttaaccataggctcgatagagtataaaaggaactctggagatcacctgtctaaccctttgtagtagagatttgaaaaatgaagatcctcctacatttaaatgactcctttgtcctttcttctcccagaggtcacatggttttatgacagaactcaagtgcttacctaagttttgtccttttcagatagtatactcattttacccctaatggttactgataagtttgtcaagcacaaaacagaagtatgtggtttttatggaatgcttgccaataatacttttataatttacatccttgcatggctgctgtctaatctatttttattgcttcctgtaattcctaccccatcctacctatctttaatttagagaaacattatctttcaagggtaatctagtcatatgggcctgaaaagcttctcagttgt

SEQ ID NO: 62218 - DNA, 1994 bp, Homo sapiens
tatattttaaaatgtaaaagttaaattattattgactgtagtcaccctgttgtgctaccaaatattaggtcttattatttctactttttgtactcattatttcaaatatttttaatttttattcatttttattatttccccttttgtatggtgctgataacatctcattctaaaagttgtgggctataactgaaacttcaaccctaagaaatacaaatgctacctttatatttttacttttaaaattatttgagatagattcttacagtttttaaaagaaaataaattctgaaatgctgcggacaactgtgagtttatcatttggtctggtctgggaaaatctcaagatattttcaccttttgagatttggcattatttatataggaagtcaaaagataaggtaaaggagtatatggggacagtattccttgaaaaacaagaatgtttaatactcatatttttctgttcatgttttaattttagattttaacacctttcttattgagaagactgaagtctgatgttgctcttgaagttcctcctaaacgagaagtagtcgtttatgctccactttcaaagaagcaggagatcttttatacagccattgtgaaccgtacaattgcaaacatgtttggatccagtgaggtatagtggttttgaaatgtactgtaaatgaaacttgacatataaaatttctcttttttccctttttttttgagagaaggtgtcgctctgtcacccaggctgtggtgcagtggcacaatcactgctcactgcagcctttacctgcctggctaaattttttgtatttttttgtagagactggcatttcgccatgtttcccaggttggtctcagactcctgggcttaagcagtccacccaccttggcctcccaaagtgctgggattccaggttttagcaattgtgcctggcctaaattccagttttaaggtccccttgttcatttttaggacttgggtgaatttctaactggggtataaggcataaggcttagtggcaaaagttgtttcctagtatctggagtcctgctaaaatgttaagtgataatctttgtattaattgctttacagtcatctggaatacttactaaaaatttaggccaggcacggtggctcatgcctgttatcccagcactttgagaggccgaggcgggtggatcacctgaggtcgggaatttgagaccagtctgaccaacatggagaaaaccctgtctctactaaaaacacaaaattagctaggcgtggtggcgcatgcctgtaatcctagctactcaggaaggctgaggcaggagaatcacttgaacccgggagacggaggttgtggtgagccaagattgtgcctttgcactccagcctgggcagcaagagcgaaactccgtctcaaaaaaaataaataaaaaaaaaatgtatatttccgtacagattaactctaatcatgctttctggagatgaacttggaaatgcatttttaacaagcacacaggtaggtatttgagaatccctgtactaaggacttggcaactagactaatctccagatatacagattgagcatccaaaatctgagttgctccaaaatttgaaactttgagtgctgatatgaaactgaaaggaaatgcttattggagcatttgtattttcccgttagggatgttctacctgtacagtttccttacagaaggttattgataaccaaaaagattaataatcaatttgatgatgattattcatcacccaccatattataggagatagaggtgggatgttattatcatgtaactgaaggagacccttaagttttgtttaactttccaggttttttattgtacactataaacctacgtattttcttttcaaaatatttattgtgatgcatttttaaacaataggaccaccagactcttctccccccgacttttttttttttttttttttttttgagacagagtctcgctgtgttgcccaggctggag

SEQ ID NO: 62219 - DNA, 1293 bp, Homo sapiens
ctccgaaagtgctgggtttacaggcgtgagccaccgtacccggcctcttctccctttttaataattaattataattaaaggaagggtctagccgtttacaaatttacattatttgtctgttaatgagcaatttcataatgagcagtttcatgcagtgttacaccagtctgaagaaatatcctctgtactgcaaatttccggagccatatttcaactttaaggtattaaatccttttgtgtaagttcaaagtagttttatacacccttcatttttacctattgagatatgaaggcccttcctcttactttcagatattgttgtccatgttaaaattaaactaatttcccacaacatttgtatttgtctatagattgtcattttgtacataaaatatgccttattttgtttacatttagaacctaaggacatagctttataaactgaatttcttttaattcgttcccttttagaaagaaacaattgagttaagtcctactggtcgaccaaaacgacgaactagaaaatcaataaattacagcaaaatagatgatttccctaatgaattggaaaaactgatcagtcaaatacagccagaggtggaccgagaaaggtttgaattcaaaagtgaatttaagtattctttaaactgtgaccattttttgcatttcccatatatgcattatttgttttggtagagctgttgtggaagtgaatatccctgtagaatctgaagttaatctgaagctgcagaatataatgatgctacttcgtaaatgttgtaatcatccatatttgattgaatatcctatagaccctgttacacaagaatttaaggtgaatactgtttaattctaatttactgttttgatttccattacttttatattggtggaaagtgttactttttttgattataattattaaaaataagtatggtgctatttgtcatgaagattgtaatccttcagtaagctgagacagtcttctttccgaaatttcagagaaccttatcagggttagaaaaatggtcactttctatgagcaactagttttttaaatttttttattttttatagagacagggtcttgctatgtttctcaggctggtctcaaacttcctggtttctcaggcaatcctgcctcagcttcccagagtgctaggattacaggcaagagccaccacgcttggcctctatgcaacttatatttttatttacatattttatgtgaacaactaagaattctaaatttagtaattgatttgtactctgcatgtttacttgttatatttt

SEQ ID NO: 62220 - DNA, 1070 bp, Homo sapiens
aaatgaaagtagctctctcatgagggaatttcaccagaaggtgaaaaagtctttgtccacaatatttagattacttatcagctcctgtattttctcttaatttctggtaagaattctagcagtagtttacatatacatttagttggaaataactcacttataaagaataagcctgagtatgtacccattaagtttgacataattgttttctttcacaatgactttgagagaggagtgttgaggttagatcaaagttatatttgtactttgtttttgtgaaattgctggttttacattctagagtatgtctttgagtaataactatcttctgattttacaaagattgaataacaggtcagtttttaagttttttaagtgacttggctttgaaaattgaactttccaaatggcttttgttttaacaaagcaaataacagttttctctctattttttcttcctttgcccctccttaagatcgatgaagaattggtaacaaattctgggaagttcttgattttggatcgaatgctgccagaactaaaaaaaagaggtcacaaggtggtacttttgattggaattttggattgttcaattatttttttatcaatcattagaaatattaagatatgtttaatttcaggtgctgcttttttcacaaatgacaagcatgttggacattttgatggattactgccatctcagagatttcaacttcagcaggcttgatgggtccatgtcttactcagagagagaaaaaaacgtaagactacttatgtcatacataccaaactattcttttataattcctatcttgatttctgaagtaatattccaaatagacccacaaattgataaaaagatagaaatgaccagaaaccctgtggttttatcaaaaacaaacattttgatttagtactaagaagtcttaatttttgattcacaaatatatatatcttctggcacaatcttattaataatatcctacttaaccatcactgtaagaatattgggatagcaggaaattttttgcctttttgccctgtcctcaactttctattatgaaaatatc

SEQ ID NO: 62221 - DNA, 1016 bp, Homo sapiens
gttattatgaataagttggtcctgtacaagtctttgtggacataatgcattttttggtccttgatcttagggagggtgcgtgtttaactactggaaactaccagccttttccaaagtggacatatcattttccagtcctaccagcgaagcctgagagcttcatttgcttttattttttatcaacacttttttttgccgtccttcttaatgcaagccattgtgattggtttgtaatatgttgtattgtagttttaaaaggaattttaatgtttttaatttctcattttttttagatcatttcaaaggtggtcagtctggattaaatctgtctaagaatttcttagatcctaaggaattaatggaattattaaaatctagagattatgaaaggtgagtttttaattttagaaagatttaatttgtagctttgaattattcacatagacttgaatattttgttttctatagggaaataaaaggatcaagagagaaggtcattagtgataaagatctagagttgttgttagatcgaagtgatcttattggtaagtattatgcttttttttaatggaagcttcgaaacatacacttaattagcataatgtaatgaaccccttgtgcaattcattcagccacatgtatccaatcttgttttattgtcatttttcttcttagagtattaaaatcaaatctcagacatgacattttgcccataaatgtcattatctttaacttcttccataattcagatattttctgtaaactggtaaataacacttgtaaatgaatatattcaagttcctgtcttagttaagaataccagtgctttgttctcatatttttcgtcataccaggaggcacatcgtatctggatttcttatttccagtgagctaagattaatcaagataatgttataaagtgtcttgtcagccttcatcctttacttaacacgatgatttattttattttattttatttttttggagacagagtcttgccctgtcgcccaggctgg

SEQ ID NO: 62222 - DNA, 1690 bp, Homo sapiens
aaatcagtaatacaaatgaaaatcagatttcatttcacagctgtcatgttgataaaaatttaggagactacatattgtcattgattcaaaatgtttctcaaggtaagctttttgtggtgtgttttcagctattaaacgaatcgtgattgggcctctttttaaaacgtttctgacaacatgattcaaattgatattatttattgctctttgacttgtttatcttaccttaaattcagcaaaagcgattttgactagcaaactgatgctttagattgtatgctcccaagagtctgattctagttgttgtattaagaatagtgtacctttttgctttcactgctattaaatcttggtgattaaggaagagagtgccctgtattactgtgagttttataattttggacagatgactcacttctcataacatcatattggatgtttcttttacgatttcttcttcttatacttctaaaatgtacctgttttaatgtttttcccttagatcaaatgaatgcttcaggaccaattaaagagaagatggggatattcaagatattagaaaattctgaagattccagtcctgaatgtttgttttaaagtggagctcaagaatagcttttaaaagttcttatttacatctagtgatttccctgtattgggtttgaaatactgattgtccacttcaccttttttattatatcagttgacatgtaactagtaccatgcgtacttaaatagatggtaattttctgagccttaccaagaacaaagaagtatccatattaagtttagattttcagttaatttttgagactgagtagtattcttggatacaggctgatgtgtacttaaccacttccagatttatacagtcttcctgtggaagtttagtaaatgtctttttccctcctttcttctagtaatgcagttcatgggctttaggtacttcagttatgaagtaggcttttcatggggagagattgggattatgctctctgttgtttaagaaactgtttgattttagagtctatttctatgagatagtttaccaaataaatgttccttataagatgatctcattaaattatttcttcaggaatagcttaggtgcaataatagcaaaagacttggctgtcggtaggatttggttattttgttttcttggtttcattcactagtactataggagtgtgtcatatagagatttcaagtggacattgtgttagcacaagagaagtttctgaatgaaactttagggtcttgagaaacgactagaaattggaaatggtagtgtatcatgcaaaacaagacagaccctgaaaatttatagtagtgggttaactagaaccaaatataagagaataggccttaggaatatgtaagtaatgcacaatctgtaatagaacagcataaaggccaaaagaggcacaatttagaccctgtgtgaaaggatatcagacaatgaggaagagaaatcctgaatgtaccctggagaggggacatactccataagccatacatttctgtgttagtgtttatttcatggaaaaatattgctgttgccatgtatattcaaatgcagatcagatgatctgttaaggataatggaaccgtcacttaagaaaaacttaattttttttccctgtgtcctattggcacaggtcttttcttttaaatttttattttaatc

SEQ ID NO: 62223 - DNA, 1040 bp, Homo sapiens
aatatttgaagctgtatttgacagaataatcataacaacattatgatgataatatcagtctgaatcacggacaatatatagaccaaatactgagttttgctactatttgaacctccttttctatgtttagttctcaaaagtctatggccctgtgttcactgtgtattttggcctgaagcccattgtggtgttgcatggatatgaagcagtgaaggaggccctgattgatcatggagaggagttttctggaagaggaagttttccagtggctgaaaaagttaacaaaggacttggtaaatgtgcatgtatcgtgtgtatgtgtacatgtgtatgtactgggcagtggctatagggatggggaggatggaaaacaggcttgaagagctcctgggacagaacttgacctgtccacgtggctgccgagtgtcagctctcttgtccttgtttggattctccctcgtagcttctgttttctgttctgctaggaatccttttcagcaatggaaagagatggaaggagatccggcgtttctgcctcatgactctgcggaattttgggatggggaagaggagcatcgaggaccgtgttcaagaggaagcccgctgccttgtggaggagttgagaaaaaccaatggtgggtgacttttttttttcctgaaaaatgttttctaaaatttattttaatttatttttagattgatacataacttttatgcatatttatggggtacatgtaatattttgttacatgcacagaatgtgtaatgatcaagttaggtgtttaggatatgcatcactttgagcatttatcatttctatattttgagaacagacctgtgttctagctatcttgaaatacgcaatactttgacattaacacactgctatgttctctaatgacatccctggaaacctcctaggggcagccagatctttcatgatagtggttgtcagtcctcatatggagggtggaggtttgaagcagagagccaagggaggttttgtgcacctatgcttgttgtgtttgtacacaatgact

SEQ ID NO: 62224 - DNA, 1044 bp, Homo sapiens
ggggttaaggattagggtgattcttataatcccatagccacctaattttaggagtactgctgtggagactattggcccagcaatcgggacctctacatgggcttttgggagttctaggtggattccatagagaggtgcttttactataaatgctatgatgcatgctaatcataaaagactgttggaccaggaaattgttagttcttgaagctgggtatttgtcttaaggtagacacaagagtgctgataaatttctcaagcatgagtgtttgaataagtgaagtttcaaatttgggtcttctgtatattagctgtgggacactgaaaatgaatttgtcattctcttagctcagtttgtttgtttaaaatagagcaaatagacctgctgaatatgttggtgtgagggttaattgtaatctgtgtagcaattgtctgaccattgccttgaacatcataggccatctgagtggcaagtataataatcatcatcatgtttatatataaaattcagaaatatttgagcctgtgtgactgaataaaagcatacaaatacaatgaaaatatgaatctaagtcaggcttagtaaatggacaaaacagtgacttcatttgctgttaactgtatctccttttctagctctcaaaaatctatggccctgtgttcactctgtattttggcctggaacgcatggtggtgctgcatggatatgaagtggtgaaggaagccctgattgatcttggagaggagttttctggaagaggccatttcccactggctgaaagagctaacagaggatttggtaggtgtgcaagtgcctgtttcagcatctgtcttggggatggggaggatggaaaacagactagcagagcttctcgggcagagcttggcccatccacatggctgcccagtgtcagcttcctctttcttgcctgggatctccctcctagtttcgtttctcttcctgttaggaatcgttttcagcaatggaaagagatggaaggagatccggcgtttctccctcatgacgctgcggaattttgggat

SEQ ID NO: 62225 - DNA, 1018 bp, Homo sapiens
ggctttacatttaagtctttaatccatcttgagctgatttttatatatggtgtaaagaagggatccagtttcaattttctgcatatggctagccaggtctcccagcaccatttattaaatagggaatcctttcttcattgcttgtttttgtcaggtttgtcaaagatcagatggttgtgggtgtgtggtctcgtttctgggttctctgttctctgttcttctaccagtaccatgtcgttttgattactgtagccttgtaatatagtttgaatttgggtggcatgatgcttccagctttattgtttttgcttaggattgtcttggctttttgggcttttctttggccaggtgttaatctcctattttatagaaaaataaactggggaccagagaggctaagttacttgcccaggatcacagagcagagtcactccagttcccatggccttgcttgaacatatatttataagtggttctgaagagctgagtgatacttatgcaattctgcccttcctggccaatgacagtgttttcctcatttcaggggatcccaacaagccctcaggattcagaagtgttaaagctcctgtcactaaagtggctgcgtcgattggaaatgctcagaagttgcctatgtgtgacaaatgtggcactgggattgtgtgagtatctgcttcccacagcctttgcagaccctgcaggttgggtaaaccatgaaaatgtggaaagtgctggatgttgcacattttgcttgtgagggagacaaatccctcctggaaaaatgcaacagagaggccagaaaggtcctgtgtcccagagccaggttgtgaaggttttccttcactgcggagcccttaggttatgaacatgtaaaatgagaaaaatcagggctgccctgttgaagtaggaggggtttttggaaaaatgtctctggaccctgggaaggagaagcaagtcccttatgattggaggccagttgggaggccctggtttcccctgtgatgggttcctggggaga

SEQ ID NO: 62226 - DNA, 1108 bp, Homo sapiens
tcaaaatcagaaaattcagagcccagatttcattgtttatatgatactgcctgatacttcctaaaggcttggtagatagaggggcctgagccttgaattccagctctgcctcttactagctgtgtgaccttgggaaaaccatgtaacatctctgaaactcagtctcctgagatctaaggtggaaataatactaacttctttaccaccaggttgttgagacaatgcaatgggatgtgcacagagcactcagcacagtgcctggcccctggtaggtgctcactaaatgctaattattgctaactttagtttccatgaggaactccatccccatcacttctgagaactgggggctacagaagtgtggaagcacatagacaaatgtaatggagaagactttgctgtggcttatggtacacttctttcttgcccattaaattcagccagcccacacagctaatcagcttactgatggggtggtggtgttctcttcaaggaatgattggagagctcctgtaaccaacatactaggccctagataatagctcttccaaattgtgttgtaaggtgttgcccccaaacattcatgagggagatttctaagcagctgccctggaaataaagggatgcatcattttctattcaaatattatcacaaggatgatgttaaccctggcttcttcagagctgaatcagaagtacacctctatcatgaaggctgcttgcccctctagctaaacctgcctgccacccacagaaaactggctctgctgtgcgggcattcctctctcttctcctggtgcccacaattacccctctggtttcttattgcaggaccaatatgtgtgcctttgaagaccaaaacttaggaagcacacaggccaggcttcccttctgaaaatgattacatagggtttcccagaatggcgtttttgggtgaacattggggtaatcaggctgggacatctcatttcttgggatatgagataggaaagatttttctgggtccgcctacctcctttcccccacctacataaaaaacaagtattcctctacattatttccagctagcacttaacttccaccatttggggaaaatatttcttaaaat

SEQ ID NO: 62227 - DNA, 1089 bp, Homo sapiens
cacgctcggcccaaaagagaagtcttaaacataaaaatattttcaggttgttttcttttattttaaattaggtactcaataaagcttttagttttcatgattttttttttttaagaaagcataaaagacttgaatatttaacaaaaaaggagagaaaaaaggaagtgcaacagatgacaggaactcttttggaggcagctgttctgggcctgggtgttttaagaaagagactagagttcaggaagatttttctggaaaacacagacactaagacacattttgagttcagctggctgcacagagcatgcatcacctagaagccatgggttgtccagacacccatatagaaaggaccttgctgattgggctatcagaaaagctgtgatgctggcaggagggaaagaaaaagtagaaaagctgtagttttagaaaacaggaatgttaatttccaaagtggctttgcgggtttgtaaaggagctctgagatgttgtagctgtagtaattattcacctgactcttaacaagtctagggtgggggtggagggaactttctcaaattacagaaagaggggaatgagaacacaaggaactcaaaagtccttttctgcagctctgctgggtaccgcccctgtaacaggtatccccgaccttctatctgattagccttgtctttctcccagaagaaacaatagatccttaatttcctttacccttgctctgcaggagactgagaccatctctgcctagtcagcagctgcttcccctgtgacaccacaccctcttaccttgcttgtctaacttgctcacttatggagaatttatctccaccttttatcatctcctgcttttgcactgaccaaagtgactgcatatttctcttcacctagtgctttaatctctttggtatgtgccctgaaagcgtgttttagctctgacttgaatcttacagcccaaagcatcaagggctgtcctgcccgagggtgccttagagggcaggctttgctgggcctcaaggaagaatcagaaggtagagatgattcagggggtgtgaactcgcacaggtgcccattgtgggaaacttccccagt

SEQ ID NO: 62228 - DNA, 1070 bp, Homo sapiens
agccagcatcaggactttgtgacactccaggtcctatgtagaaggccactgcagatgagtctcctggattttttttttttggctttgacagttgagtttggagcctctgcttgtggcattgtgctaaagcaaaaaggaatggaatttgcaatgagagagcctttcaagttcaggctcagcctttagctgtgtgaacttgaaccactcacaatttttctgaatctcaatttcctcatctgtaaagtttatctaatatgttggtggtgaggtaatcatattattatctcaaataggagattgtatatgaaagggctttggaaaggcaaatcccattatttgtttaaatcaattttttcccctaaaaaagatagctcataaaagaatgtgaacttaatctgtatgtgtaatttctttcaagtcctatctgatgttgcttgtgactttctgagatttcctttggcttcttaccagtttggctttaaaaaaaaaacaaagaaattatactgaaagataggatgaccagacctcaattactcaggcttggggcgcctaagactggttctagcttgtccaggacctgttgggatatacttagcagaaatgtctctcccacaaaacagttggaaccaaatgctggacattctggacttctcagcagttcaccgtaaaaaagtgaaaggaaacttctttttcatcttctcaacctctccagttccaatctcatttgagttttgtgagtggtcatgcttcaggatagcagtgtagagggaaatgattatttcatttttgaaataaaaatatttttgatgtttttgaaataattcattttaaaggataaaatgaagcaggctgattacatatttaacaacactaggtgttttagagccaatcatttattatacagatatttattgagcacctactatgttccagttattgggtgttgaggatactgtaactgcccagtggattcttgcccattgcccagatagagctgatttatcaagacaggggatttgcaatacagaaagtttaatacacgtagagctggctaaatggaagactagagt

SEQ ID NO: 62229 - DNA, 1102 bp, Homo sapiens
tatagacacgaccattcgtatcaagtaagacaataagaacatagataggacctagtttagataaagatattgaaaatgcatacagaggctgggcttggtggcttatgtctgtaatcccagcactttgggaggccaaggtgggtgaatcacctgaggtcaggagtttgaggccagcctggccaacatggtgaaaccctgtctctactaaaaattcaaaaattagccaggcgtagtggcaggcacctgtagttccagctactcaagaggctgaggcaggagaattgctctaacttgggaggcggaggttgcagtgagttgaaatcacgccactgcactccagcctgggcaacaagagcgaaactccatctagaaaaaaaaaatgcatacagatagattaaatatggttgatgcagcaaatagtttgcacccatttctttaaaaaaataataaaaaatacttatgcttctgaagctgagcatacccataccatataacccaacagttctcctagttaaatagtcaatagaaactgggtccacatgagtgctaaaggacaagtttgagaattttccaagcaacactattcataatagccccaaatttgaaacgattcacatgtctaacagcaatagaatagataagtagtgggtgtaattatatggtataaaacatcacagcaacaagagtgaagaaattacaactatgcacagtgacatgaaggagacacacacacacacacacacacacacacacacacagagaaaaaggccatacctaagagtgaagagtaaatactgtgtgattccagttacataaaattagacagaattaatctacagtgttagcagtcaggatcatggcagacctttgccggaaggtcagtgacggaaggcgggcacagggaggtttagcagttcaggtaatgtcctcttctttatcccatgctgtttccttgggtgtgctctgtatgtgagaattcaatcagctgtatcgttaccatttgtgctgtatacatgtcatccttcagtaaaggttacatagaagcccgcgtaattgtttaaaagatcggacaatataaacctacagaaagcataaggtaaaa

SEQ ID NO: 62230 - DNA, 1068 bp, Homo sapiens
caccacatgtggctaatttttgtatttttagtagagatggggtttcgccatgttggccaggcttgtctcaaactcctggcctcaagtgacctgcccaccttagcctcccaaagtgctgggattacaggcatgagccaagagcccacttttttattgttagagtgtcctagtctctcatggcattagttgtaccttcaatcataagttgatttagaaaacactgtgatttcaggaatgtttcagatgtatttgtcttctgttaatcacagcagcatccatttacatttgaaagatttgtgtgagaaatatttatttgatctgcttgcagtaataaccatagttaaaacatatataggacttttaatatgccaggcaccattctaagaccataatatattcagtgatcttcacacgtattttgtgaggtaggattaagatccccattttacagatgagggaactgaggcttggagaccttaagtacactgcctgcatcatatagcagtgagtggtagagctggagtttggctggggagtccggcttccaagcctgtagtcttaatctctatgtcatagtaatatattaataacagctaacattttttgagtgcctgctctgtgctaagcatgcacttacattatcttcttctgtattccccacaacccatgacagagggacacagaacacaaagtcagacaattgcagagctgggaagtgaagccaggcagactcacttccaggccagctttaaccactatattctgcctcctaataagccataactgtcaatatttcattgctaacagtgttaacccagcacacagctctgaaaagtgctaagggtggtgcaggcttcaacatgagggataagacactcctgggctccacaccctggagcctctcattctcctgaggttggttggggtggctctccagttgccttgtggcctcagctcagagcacctcagaaagcagcacctcccttccctgtccctcctgaaaaactgaaagtcatggccccacctgggagaatttacagtccagttatgaggttccatgcccacttg

SEQ ID NO: 62231 - DNA, 1628 bp, Homo sapiens
tttaccttcatatattcactcatttattatttatattatttatttatggcgtgtgcacgtgtttaatgagcacgtatcatattccagaaactgtgcaaacgcctcagaaatgagagggcacagctccattctcaaggtgttcatggtctagtgatggaaactaatctttataatgcccttggcaggtgctttaattgaaaagtggaagtgactcagaagaggtaacattttcatgctgacagtaatttatttgtttctcttcagctccttattaatacatggaaaaattgtgagcctgttcacctcatgggaatgggaaagtcattgtcataaagggaccctggtgtggccatctgagatctggtgctggtccagtgtcttcttgcttgagctgtacctggggtgaatcttccactgtctgaggctacttaaaaaaaaaaacctctgcagtggggatagcaccagcccttggctgtgagttaaggtatgtgagagtgctccgtaaatagtgatagtgaggaaatgtgagcactgacaaagagctgtacacactttctgattggtaggtatgctacattatttatcatcctgggcaatttgctggtatagttttgtatatgatagactttgagtctccacaccaaagcaaaccataaaattaggctgggagaggagtgccttttatttaaataaccatgtttgctttctcttgcatgaattattgtggtattggctccagtcttttgctaaactgctaaagcttcttaatataatgctaatcttatgtacttgcaatttttttattttttaacttattttttattgtggaataaaaaatcataaaatacaaatgcacagcaaatgattataaagcaagcatctgtataatcactacccaagtcaagaaatagaatattgcagcacccaaaagttccctaaatgtaacgctatcctgacctatggtaatcccttccttgcttttcttcatagttttaccacctaaattaggtatcccaaataccatagcttaattttgcctgtttctgaacagactcatacagaacacgtgtgtgtgtgtgtgaacagcttctttagctccttaatgttttcatctagtatcgttatcaacttaaaatttcaacccaggtttccaactttaagtggacataggctagcttcttttacccacattctcgtttagtgctcttgccttgtgttccctgatgatccagccacacatttgccactgttctctgatatttttttctgtcagttcctgcttcaaatcaacacttgcccatttccttgaggtatttttttaattaaaaaaattttccatgttaatttctccttccctctagttactttcaagggaagccttcagagaaatacccaggccaacattgcaactcagtttatgttgactgtttttctctcccagcaactgataaaagacaggaaagggtgaggccaagatcaagggatgcccttagttggaggagttgctcatttgtctctggagtcctggggaaccctttgctaagagctgagcggttctgtggcaaatgcttatgctttttctcaagtatcccaagggatgcttaataatggttactgtggccagaggg

SEQ ID NO: 62232 - DNA, 1063 bp, Homo sapiens
taaacgtcccggttgcctcagcatcaaatgagatcgttcgaaagcaccttttaaacatcattaccgattacaaaaagcaaatgggaagtcggagccgacctcagagggctgacttggcacagcacttcaaatttctcgttttacaaagcacgaggcgcgagtttgtctcgctgtcaggacctgcttccctctcacctagcacccgccccgggcccgagagccgcggtgcggccgtgcgtacaggagggagggaggcggtgtggggtcccgggcagagctgctgagagccccggccccgcatctgactcgcgctctctcggcgggactccgggccagggcccccaggccggcgcgcagggcggggagcggctgcgggcgggaggacgggcggggcggcgggcggctacgcggcctgggcggagccgcccccgccctggccctcgcggttgccctgcccccgccagccccaggctccccgggcccgcgccgcgccgctctttctccgacagccgccgggggtgccctgcaagctgttccgcgcgtcctgcccgtctgtccccgcgggtcgtcgcccgccacagccgcgccatgaccacccagcagatagacctccagggcccggggccgtggggcttccgcctcgtgggcggcaaggacttcgagcagcctctcgccatttcccgggtaagagcagctgggacgtgcgtggaagcggggcgctatgggaggtgatatgcggagactggggccccgcgggcgcggtcggggacggagtcggaaccgcagccgggcgcgtccaggtgcgctgttagttgagcgctctccgcgcgcccgggccccgccgctccccgccgccccttcgcggaggctgcgctcccgggctggtcggcccgccgcgggcgcgctccgtgtccgccagaaaaaaagaaggcagttttcgttctttggccccggaagcgcggcggggcgggtgttagttctttgtcaaccagcgaggggacgagggtccccgcagatcccgcgcgctgggagatggcacttctcccttcttcccagatcgcag

SEQ ID NO: 62233 - DNA, 2405 bp, Homo sapiens
atacaaggtcggctcccagtcacccggcaaagacctaacgtccagagtcattgtagaagaagcatgacgtggctcatttagttccgcctcttcttttactcctgtcagagtgcaaggtgactggtttgagtggttgcagtttagaaggtttttggagaacttgaggaggcttcccaaaaggacaggggtattgaaatgatgcctgcaacggaagttagtcctgcagggcttgctaacggttgaggacatttccaggggaggtgaacaggagagggtggtctggtggagcggaaagagcagctgagccactttacctcttactggctgtgtgatgttgaggaatgcatgaaacccctctgagcatcagcttcctgggttttttaagaaaacaatgataaaccctgtcctgcctgactccagggtttctgagggagtcactgaagatgaggtcagtgagcacacttgataaggcagaagatggtctgaggataaaagacaaggtcagttgggacaatagatgaagccaggagaaaagcctaccactgacttgatgtgtgacctcaggggaggctcccactttttctatgtctctctgtgaaacaagtgggtcatgcacaaaagatttctaagcgcccatctagaaggccctggagttgtggcctattgctttatttttttatttttgagacagggtcttgctttgtcacccaggctggagtgcagcggtgcaatcatgctcactgtggcctgaatctcccgggctcagttgatcccaagtagctgggactgcaggtgtatgctgccacatccagctaatttttgtatttttttgtagagatggggttttgctttgttgcccaggctggtctccaactccccggctcaagcagtcctcctgccttggcctcccaaagtgctgggattacaggcatgagccaccatgcctggccagcctgctgctattattgcatgttacctggaggattttttcaaggatggctcttcagggtatttatttagaaaaacttcctagagcttggaattgagtcctgtctgggggacatggttccaaacactctccaagtgaaggctggcctctacaatggaagccccactcaaaaggcaggtttgcttggccatgtttgcacctgtgtttctatgttagcatgtggtacctgggttggtaagtgaagagtgacagtttcgtcacacacagtcctatttctggaagcaagctctgtcctacaagctatctgaattcatctcatacctcactggagtgtgtcatttgcagatttttccaggggaatggtcttggttggtacttcatatattaccaaggaagttttcaaaaatgttattccctttttcagtttttataagtttctgaaatacagcagacttgatggttctatgggcctgctctgctagagggggcttccagtcaacaaaataaccaaaactggctttgggttcagccaccttccctagatgcttactagctgagcgtgaggggaccaatatgtgtgaagggacctggctaagatggcctttctgagtctctctcctgccaatctggggaccctgtgttgttcatcctcacctcactgcagccatgtttccaatttcccatttcatttcctggatgcttgcttctaactctacatttgcattttcttctgtgcacccaccctgttgttgtggagacttggtggccataggccgccggtatctggtgtcatccaagcgtgatggtgtggtacgtggatttgctcatgcttttattttgaatcctttccaatgtgacatctgctaaaatgtctcccttataatttgcttggtgatcacagctttctcatcattcattgagagcaggaccagatctcacagaatctgaaaagagctatgtggtaagatgcctgttgaataagactgcagcttttctaaagagaatttttactgatccttacttctggaatctagactagagtgatgcctggttaacccacagaaatattatttataagaattctgtggctattgtagtagagcgagatgttaggccactgcattacccccagcccctggaaaaaagcagaggaatttagagacgatatttctactctgcctatatgtgggattaaattaatgtattagtgcatgattggggatacatacttgcatttctaccctaaagtattccatttgtgacagttactcactaatttcaggcttttatgctgctgcctttttttttttaatattcttactaaattccaaattcttctgtatcttacctgtttttccatgcttacgcctggatccctcctgcactccactactggaatatctatttttttaacctggatcttcaactctgttttctccctggacttatgtgcttc

SEQ ID NO: 62234 - DNA, 1061 bp, Homo sapiens
tcacattcccaattcacacacggcaggtcttcgttttctcatttgtaaaatgaggtcaatgttgaccaccttcttgagttgctatgagaattaaatgaaatataatagagatgaaagcagctagcgcagcctgtaacgggaccataaatacctgttgtgtgatgtcgaggtaccagggaaatgaaacaaaagtagtttactttatccaccttaccctgttccacctaagagagaaaaatggtgggtggggaggatgggaagagaagaaaatagagaatgatgggaaaatcattttactttgggttacacaaatcgagaatttagaaaatctggaatttgtgctccccaaattagtttattctaccttcagtataaaggcataagctattcttggaaagcctttggtttcttcacacttgaatatgtatctgccattaccccccaactgtcttatgaaaggaagagaagactgtatgatagtctatgaagagaaggctgagcattggttgagtatttactgagcatttaagtttagtgttgtaatcagattcaaattacaacaaagttaatgtgttgtctagtgagtgacttgcaaggagataaaatctagatggtaagcaattgaactagttgtttgtaattagttttatatttaagctgtgatctttttctcagtaaactcaataagataactcagtggagtcagagactgttttgagggtgctctggtggtttcctggagctcaaacccaggagactgactcattcgggcctttctactcctctggaagagtttgcccatgatgttccagtaggtgcaaatctatcactattttggggcagtcgcttgggatacttccagaagtgagcactccatccatatctggaggctgcagtcgaaagccttcctcctcccagtcttcagtaagcaatgagtagagtgctgcctcccttaagccaagtcagcccctacccagtcctacttcttaacccatgggacaggcacattgcaatcatagagcattaaagccaaaaagacatttatgtaaattatgtccaat

SEQ ID NO: 62235 - DNA, 1039 bp, Homo sapiens
tcagtgttgagtcatcatcccggcccaattccaggatcctgtgtgtataggaagtgcgcacggtgccggatctccgagtaaggttaggggtatacgcttcctgcttcctaaggcaggataggaggggagtagctggcaacactgaagattatgttgattggaaagccaggcttgttgaaacttggtgttcctttcttggtgggcctccagaccccaagtgtaccacttcctgtcccctcccttcctcctgccctcctggcacaagccccttctccatgggtgtgcacaggctgtggcctggggctcgctcccccttgagagctggcatttgtgtgaaaagggctgctgcccacacctccccttcagccccctcactttcccctcctgtggctggagcaggagctgacaactctggaaacggggtccttcagaaggggctcctgtgtcttgggccccctttgggtgacagacatgctaaaaatgggaaggacttgtatgacaactgttctctggcagccccatcaggatgacgtgaccacaggctgtgttgcttatttggaaaaatgcattccagaccagtttgtgtatcaagaaaattgtcagccattattctccttgctgaactaaagagctgaaacaaaagttcacttttattgtaggtattggggaggtaggttgagaatctgaccaataatgggagggaattttacctgagaaccttaaatgaaaagatattctgaaatgttatgatcatttattctttgaagcatttaggatattccaggtacttagctgcaagagatagagaggggtgaacatcatcagggcttccatttagatgtaacttctaggaagctgttggggccaagggaaagtttccctcttatccttgaagtttccctaaaaattactgacaagaagcaaaaatttttttctttctttttttttttttgagacagggtctcactctgtcacccaggctggagtgcagtggcacaatctcattgcaacctctgcccccaggttcaagactccttca

SEQ ID NO: 62236 - DNA, 1047 bp, Homo sapiens
ttttccaggaagtgaggctgagcagacagagcggcatagaggtggcgagcaggcggggaggaaagctgctcggagaggtgggagccaggtaggactgcagcatgccgcgtgtgcacttggcgtctcacttggcagggtgggctgcacgtctcgcccctggtccatctacggaggccaagtgaatgctggtgagaccatttgcttgcctcaggagcaaagagatggccccagagggaatgggaggacatgaattcaggtgccaggactggatacagttggagggaaaggacaggctatatctggccacttgaggtcatttggaagttatctctactttgaatgcctcctggcctgctgcaagggcctctgagaaggcagaccttcctcacatcccatgtatgccttagagatgaccctcagtttgctttgactaacacagctgagaacaccaggctttggtgtggtgtggtttgcttttatgtaagatgcactttgtttccataacccatggtgctctgctagtgctcggctctgtcaggtctttgtcctgtctcgtgtttgtgtgggagcgcggggcctttgtttgctatgaaacaaaggtgttttggttctggagaggagaatgcaggtctcctggggccctgactgacatggggtatcctcgaatagccatgccaggttttggggtgagtgtaccatcttctctctgggtcagctacaaagacccagagagcatttggacaaaggtagccttagggtgttttgagacctgaaaatttttttggagaaatgaacttagcaactaaacaaatcacaattctgattttggctatgctgttgactactgcgaaagtcaaagactttcggcaacttctcagaagcaaccaggtttgaatgccagctccacctcttacagtctagtgacttgggagttgcttcccctgtctgagactcagtttcctcatctgtaaaatggagatgatagcacctacctcaaagagtggttgattacaagggcttatgatcctgggaacatggtcagcactt

SEQ ID NO: 62237 - DNA, 2234 bp, Homo sapiens
caacatggtgaaaccccatctctaccaaaaattcaaaaattagccaggcgtggtggcgggcgcctgtagtcccagctactcgggaggttgaggcaggagaatcgcttaaacctgggaggcagaggttgcagtgagccgagatcatgccactgcactccagcctggacgacagagcgagactccatctcaaaaaaaaaaaaactgcaggaaagcagactgtacactggactttgtctttatgcatacaaatggccttttccagtgcttggttgcagatatatctcaagggaaaaggaatagtcaagtaattgctctgggaataaggtgactagggaaagagaaacagagaaacaagagcctttatcagttggcccctcttgggtgaagctgttggtgtgggtaccaccactgtgtcataaatcccatggtccaaatgcggtcctcagtcatcttggccaaagttgacctgcagaagacaaaggctgaaagagagacttacaccttctcatcagccatatagaccagatccaaagtattatttgcattcactggaaccaggtgattggaacaagtaacttacagcatctcagtctctgtgggctgaaaggatataggtttataggcgtaataagatgttggctttcccaaacattaattatgaacaaacttgtttagaaatataaactattcctaactgatccccactttcccaaagccaagaaaatgtcagaaccttgagttcagggtgacacggtgggggtgacatccctgtgaaagagcctggacaaaccaccatgtatgttgtaaggaggttggcagaggaacaagagtaggacctgggggcccaggttgaccctgagatggtgcctcttgtctggtcctctaattgtttcctcctctgccacctgctcatcactgaccccagtagagggttcttggcagaaagcattaaacgggctgacccagggcttcctggacagtgatagccgcatcctgttgtcttataggacagagtgtgtgactggagtgggacattcttctttgtaaggatgcagggaactcaactacatttttcacttgactagccaagagtgattgtaaaacaaaactagtacactactcatactcctctctggaagactctgctgagctcccagagaaaataaaaccccagggaagggccatggcagtgtggggccacctttccccgtatggttccgggtcagggatctggatgcacaggggctgggttggctgggatggggagcttccaatgtgtccctttgaaaatctgattctgcaaagcagggcggcctcatccgtcactactctgacgggaacctctccccatctccacacctctcactgcttcctccaccccctgcctgcacacatcaggatcacgctcgcacatgctcaaacgcacactcacccatcctggtttctccccagatgtaacctgaggatttcctttttggacaccagagtgtccttgctcatcctctccatttcattcctctttatataccccttgtgattattttccttctttttcctttatgctgacacttgtaccttttgcttctttcttttgttttcctctcttttcttctttttaagttttccagtcacagcaagctcatcacgccagccccctcatctctgccccactcccgccgagccctgtcccccgagatgcacgctgtcacctctgagtggatctcactgactgtgggggtcccaggcaggcgttctctggccctgaccccacccttgcctcctctgccagaggcttctatctataacactgaccacctcgccttgtcaccaagggccagtccctccctgtctctcagcctcccccatttgagttggtcagatcgtcccaccccacgatcagtagcttctccactggccctaccttccccacacaaaacctactccctagcacctacttcccaggcctcccttcacatgaatggagacggtggtgtccacacgccatcttcaggcatccaccaagatagcttcttgcagctgccgctggggagctctgatagtgtcatctcccagcttagtgatgcctttagcagccagagcaagaggcagccatggcgcgaagagagtggacaatatgagaggaaagcagagaggggggcaggcgaaagaggccctggtggacccaagatctctaagaagagctgcttgaagccttcagacgtggtcaggtgcct

SEQ ID NO: 62238 - DNA, 1536 bp, Homo sapiens
gtaaaatggatgggtggacaaatggtgaaattgatggaatgatagaaggatatcaatatatcacaaataatttgagggcaatttaaagcaacgaaggcatgccctgctagggcgtagaagaggatagtgaaggtatccaggagacgttttgtttaacaaacatcagttaaggcagctgagtgcattgctctgtgttgcataaattttctgagcataagacaacattcacaaaaaatgcatttagaaaaccacaacaaattaataaggcctctgagcactttcaagggctagtcaatttgaatgttaacatccatcctgcaaaagagtggaaaaatgccaaatgtgatgtaatttcctgaatagtggggttcttacttccaaatatggaggcccctctctggaatttgtaccctttgaccccacttaaaagtctccttttgctacaaaactgaagtgtcttaatcttacacatattgaaacatctgctaaaatgccgttgaccttctgtcaacagggagcttcctctgcagaagggagatattgtttacatttataagcaaattgatcagaactggtatgaaggagaacaccacggccgggtgggaatcttcccacgcacctacatcgaggtaccgcagcctcttttctttctaaggaaaagcctgacagtgcccaaagcaccatttatttaccaaatgcttatgttttgtttcctccttttcctcttgtttccctgctttcttctcttcccttgttctcttttacctctttccctttctcagcttcttcctcctgctgagaaggcacagcccaaaaagttgacaccagtgcaggttttggaatatggagaagctattgctaagtttaactttaatggtgatacacaagtagaaatgtccttcagaaaggtaagctgcacttctcatgccttgctttggggctctcttggatggcgcagctatgtggggaagcgtggtgttgctatcacaccccagtctgggggtgctgtctgtacccttaagagaagtatgccaatcaataattgcattaagggctgggcacggtggctcatgcctgtaatcccagcactttgggaggccgaggtgggtagatcacttgaggtcaggcgtttgagactagcctggccaacatggtgaaaccccgtctctactaaaaatacaaaaattagctgggcatggtagtgggttcctgtaatcccagctattcaggaggctgaggcaggagaatcatttgaacctgggagacagaggttgcagtgagctgagatcgctccactgcactccagcctgggcaataggtctccaaaaaaaaaaaaaagaattgcattaaggcctgtaatcccagcactttgggaaaccaaggcaggaggctcgcttaaggccaggggttcaagaccagcctgagcaacgtagcaaggccccatctctactgaagaaaaaaaaaaaaagaattgcattaagggcaattggagaattttctgaggtaaggtatttttaaaataaaccctaggctaat

SEQ ID NO: 62239 - DNA, 1161 bp, Homo sapiens
ccacctgctctgatgacgtggaccgctgttcaaatatctccactgacagcagagaaggcagtggcggcagtgttcatggagatttccccaaacatcgcctcaacaagtgcaagggcacctgcccggcctcatacacccgcttcaccaccatccggaagcatgagcagcagcagacctctagacagcctgagtggcgcctggatgccagaggggacaagagcaccctcctcaggaacatctacctaatgagcccccttcctttccggctgaaaaagcccctccaccaccaccccagacaaccttcccctggtgactcctcaggcctcctggtgggccagaagccagacctccccagtcagccccatcaggaccagcccccttctggggggaagcccgtggttcccacacgcctgtcttcccgacacaccatggccaggcttagccgcagctcagagccctctcaggagagacccacggccctggaggactacccaagggccattaataatggaaactccgtgccatactcagaccacagcctggacaggaacaacaacccacaaagtgaactggcaccatcccgtggaggtggcattttgtgtgtttgcctagtctcacctgcccgtccctccactttgcttgcattatcccgtcctcctctgtgcccttggtgctcattttctggtctgtcctttgttttctgtttgttttgcttggcaattaatcatggctcgtagtggctgcacttctttaaaaacaaagcccccatgtcatttagactaaccaccaaactgtgtttcgaaagaaaaattggccgtttagctcaactgagaaatgtgttcatttgaactcttgaaccccttgctgtttgcaccaatccccaacataccccatggttttttgagaggcagcctctctcaatggccctatatgtgtgtgagtgtgtgccttgtccctataaggtcctgcacgcctctttgtagggacactttacaaagaaagttctctcattttgctcaccttttgccttttgagtagttttctttgcattaaactagttcacaaataaatccaaaaaatggggtggggggtggaatttttttttccttcagaattcgaccattgatcattaatcaagaatgacttcaaaattttgatatt

SEQ ID NO: 62240 - DNA, 1017 bp, Homo sapiens
cccctaaactgcacaagacggaaagggcttcatgggacagctggcagagtgaattccctagctctactggatccaaggcactaagctctgtattctaataggaatgtagatatagtcccttaatagttttgggacaaaacacacacacacacacacacacacacacacacacacacacacacataaggttagtaaatgaaaaggccaagtggcaaatgctaccacaggcagtcaggataaaggagcacaggtatcgaataacatcattttaacaatttatcaggcatttactacgtgccaggtcctgtgcttggtattttatctaccttacctcatttaatcctctgaacattccaagatgaggcattatttttaatccccattttatagatgaggaaataggcacatcaaagcagtgtaatgccatagttcctcagcaggttcagggcagagccatatccagattaggaacggtgaagctctaggccaagggactagggttggcagtaaactctcatctgccccatactgattcaaaattttgtaataagttagcagaagatatactaaggtttaatgttttcaagctattaaaaaacaatttagacctggcgtggtggctcacgtctgtaatcccaacactttgggaggccaaggttgggggatcacttgaggccagagttcaagaccagtctgggcaacatggcaaaacttcctctttacaaaaaatactttaaaaattagctgggcttggtggtgcacgtctgtagtcccagctactcagcaggctgaggtggaggattgcttccccgggaagcggaggttgcagtgagccaagatcgcaccactgtactccagtctgagtgacagagcgagactctgtctcaagaaaaacaaaaagcaaacacccccccccacacacacacaatttaagcaactatttatgatattgggttagcaggattggagggtactaatgtaagctgactaaaagagcaaattgttttcagacactgt

SEQ ID NO: 62241 - DNA, 1074 bp, Homo sapiens
tcctgtctttactaaaaatgcaaaaaatagctgggcatggtcctagctacttgggaggctgaggcaggagaatcacttgaacctgggaggcggaaggtgcagtgagctgagatcgcaccactgcaccccagctcgggtgacagagtgagactccatctaaaaaaaaaaaaaaaatagacggggggagggaggtgccgagaaggggctaatttacctgattctcacatagatgggcatctgttttcctctgtcagttcttaggactctggatgatgcatgcataccccactcctttgtggggtgccaccagcctcttcccctgccaaaccatcctgaatcctatagcagattgcctttctcagcactttgctgtgaagctgttatcccagctgaaaatgttcagtgctaccctcacctcctgttctatatgtgataaatagcaaacattttagcttatatagataggccctcgtggagccttcctgtacccaggctcacgttagtacctctgtggtccttacttctgttgctgtatacctgacatatactcttgtatttttataattgctagtgtattataaactcctcaagggcaaggccccagtcttcacagtgcctggggcacccagtgaatttaggaaaggagcttgttctggtaggagcttttcttattttgtcaccatcgcatctgtgtcttgttctttgaaatatgacaatgaggggaagacacacctattacctatgctagtagggttggataaatccacaatgagcagagttgctgagtgtataaggtttttttttgacagatattgtggtctctgggacatatcctacctacattgctggagaatgtgctttacaggaagagtttcatttgaaagtcagcagggatttgggtattttggtggaaaaatggaaaaatttaatctatttagggtagtgatcaaaagctctagctagatccatcatgttaatttttcttctataaatatgtgtgtttcatgattaatatacccaggagcataagaagaaattaagaagacatattaagacagcagctagagaaggact

SEQ ID NO: 62242 - DNA, 1040 bp, Homo sapiens
gagcgagactccgtctcaggaaaaaaaaaaaaaaaagatacaaaaggaatatggagctgaggaggccaggaaggtccacaaaccatgacaggaaaagtggaaactgctgatggacccatgccacacttaagcagaaccaagacagatctccagccccagtgacttgggcacaaaagtcatgagagcagcagagactcaaaccagggaaggggtgaagagaccggggatttggtctggggtaagagagtcaggagccaaggagctgcaggttgcttgagggtgttaggaattggggatccagagacagcagagcatgaggaagccagcagggccaggggttaggctcaagctctccctcagcacttgaaggagccaccagaggcactgcacacatgggtgaggcagacaggtgatgggtggggcaggtggggtggggttaggggctgagtttccaattagggtgaaggaaccagattagccactgtggaattgaaggtcccaggtgagaagagatcacaactagccctggagtgagaatggtgactgtggctgtggtgagagcccttgctgggtgtgccagcatgcagtgaggagggcagatgcaagccaggtcactgaggatgttgcagtgggatagtttaattaactggtgtaaagagcaaagaattgggggatgggattaagacaaagacaaccttaaggttttggccaggcagatggaagaatgaggatgtgagcacgtcacagaggacagctgggaagaagatcagggcagaggcaaggtgagggagttggctttaggtaattgacctttgaggtgttggttgggtgtcatataggtaatatccggtaggcagttggaactctaaaactagagttcttggaagaggcatgggcttaagatggggattggagtcacctgaggagaggcgatggttgaagccctggggatagaagaagatacccaactagggagtagatgaaagactgaagaggggattgtgttgagagaaaggatgtgaaaccaagaactacccatg

SEQ ID NO: 62243 - DNA, 1244 bp, Homo sapiens
cttctccttcaggatttaaaccgtaagtccctaaagacatttggaggaagtcttatctggatgcaggaggacagaccttgtgtttcagtatgattttccctccgatttcaacctagcttggtttcagttaaaagaaggttccctgccatatttccatagtcctctacctgtagcaaaagtgaaagtaatgctaaagattcttttaaagatcttagaaaaagggatggtaaaggtcactaagaaagttagcagccatttttctacaagctgcaaaggggatgttaactgtgttgtaagtaaagtacaagaagagctgctttgtgaagcactagcattaaagacctgcacaccacacatggcaaccccctccctcaggtgttatagcccagaagtagtgaagtttgttgtgcagtgttttcaatctcagtagaaagtgtatgcattttatatttcaggttattgtagaaaatcaccccaactctctttttgcgattatcaatgttttttgaaacatatatacatacttaattagtcatgaacctcaaacacttttccctgatgtaaacatttctccaatttatgaaggggaaaacatgatttgctttgcacacattcattttccaactagttatttccagaaacacgtgttattccatgaaataaggtgccagaactttatacttatttggttaaatattatatcccatgaaatcaaattatcagtctattgatacctcatagtgttatataaagtgagaaatctaacttatttttgtcatataacccagaagtttttttcccctttgttctgttatctgtcttgtctagcttttctttcactttattttttcccaattctttaacatttatttgttaaaacacgaagtatattctgtctgtattcatccgccatggatacttgtttaaaatgttttttcactgtgtcctctgtctttacttatatcatttttcactttcactttactgtgtacgggacatggtttcctacctactcatgtgccattaaagatgcagtattaaccaattggcttttataaagtgtcaatatttgtgtttatttcgaaaaccttaaggcagctttgcaaataagtactaaagttgtactagcccataaaaatcagctctactcaactggcatagatggctaaatgtttggtgtgctcaccaggtcatttgctcataactaatagttctttgtaaagggctttcttttcttccacatt

SEQ ID NO: 62244 - DNA, 1275 bp, Homo sapiens
ttagcaaggggtgtggcaggatttgaaccacagtcaactggctccaggacctgtgttctctctcactgctctagtgtgaatgggaagtacaggcatgtctgtggaatgaaaagcccatagagcgaagcaaggtgaaagatttttccagagccagctttgctgctgccgcctctgttcctgttgctttgtccactccccttcctggtgcctggttttgagcacaggacatctcaagccttgtgagaagcgaacaccaaactttaactggttgttttgagaagcaaaccaacacaactaaattgttcaccctgactccgatgttatgctttggatataacagttctttgattacactacagccatccaaagtcagaccgtgtcggaagctaatgccagttgtcatgaaaatagctctaatagaattttctttctgcagaaatgactgggaacccccagataagaaagtagacacaagaaaatatcgtgcagagcccaagagcatttacgaatatcagcctggcaagtcttccgttctgaccaacgaaaagatggtaatgtgcatattaaagttattttgtctcaccgtgcccatgttctttaatcagaatgcattgtgcagttggattacattctttccccttgagatagacttaactttgttttgaagataatgacaaaaatgaagtacttttacccttttcatttttgcaggtgttcataaaataagtcccgcgagtctgcttttaaaaaaccctcttattgtggctctgttgctttttttgtgcatggttttaactaatattaatttttctactaacataaagattgattttgctgctgtctttttttgaatgtctaagtgttcatttatcaggcttgtcattaagtggactgaagtccagttttttttaagtgactctgaacaggcataaattttgtacaagttactagaatgtcattaaaagctacataactaataggatgttgtgacttggaaaaaaggcccaggctgttagaatatatcctttaggtcttccttttttgacaagtgcaatattgaggacaaatttcatattcgacctggtttatgattccctatacaagtttacatctctaagcaattatgagtggggaaaatggtttgtatgcatatagcagaccaccctggaaaagcggcctcttctgtgaaacaggaagaattcttacacattgattagtttcatacctgccaatcatgcatccttttattaacccttcattgggaaaagctgtttt

SEQ ID NO: 62245 - DNA, 1019 bp, Homo sapiens
tgcctcgctcaaaaagtgagatgagctacattgatggtgagaaggtagtcaagaggtcggccacactacccctcccagcccgctcttcctcactgaagtcaagctcagaaaggtaagtgcccgcttgtctctcattcattcagcctgggccttgttgttcattgagacctaggagcctccattcttaggaatgtggaatttgagtctgtcccttgtcacctattagcagtgacttatttcttagcctcaatgtcctcctctgtaaaatggggataaaaatagcatgattcctagtaaggatagtgcaaggttaaaatgagataatacctgtaaacattcctggtagcacttagctcctagtatgggagccaagttaagagtatgggcttaattaatattgactatcattatcataactttttgcattttcacaagagaaatcttaactgcaagatttgtcacatgttgtcatattctttttgcatactgtgttcacatattcatagcaatgactataacttaaaaagaagccacactttttaatgtccatttactcatgcaacatgtattattgagacataagccttggacttgttctagtgacagcattaataaatctcttaaaatgcctgcagcaaacaaaacagttttctttttcttgagttttttttttttttttttgagacggagttttgctctgtcatccaggctggagtacagtggtgtgatctcggctcactgcaccctctgcctcccaggttcaagcagttctcatgcctcaggctcccgagtagctaggactgcaggtgcacacaccactcacggttaatttttgtatttttttagtagagacagggtttcgccgtgttggctaggctggtcccaaacacctgacttgagttcttatctctaaaaatgccctctgaagcaatctcctcatgctatttggacaggagttccatgcatcttctagccccaacttacaccacttctcaacacacaaaaggctctggccaaac

SEQ ID NO: 62246 - DNA, 1017 bp, Homo sapiens
agcttcagaaatgcagtcccccactttcttccctgctgctttaaggaacagcagtgtggtggccaacatctcagcagcccagagtggtaatcctattaataataatagtcttataatgacataaccaccacctcagtgactatgtggctgtcattaattgagcccttgccacatacaagtttctgtgctgaatatatcactattgttatctcattttcattctcccagcagccccatgaagtaactcttcattttatcaatgaggagtatgaggttcagagagattaagtaatatatgcaagattacacagtaagtagcagaaccaggattcaaacctaggtgtttggggctccattaacacaggcttttactcaacgctgctatactgccctgcagattcctttccccttcctgactctgtgttcttgcttgtccccttcttgtccagaggctctctggtatctgactgcaggcattcagcttcccctgagtcagtcctgcctcagtctgctaagccagtacctcccagatggtgcctggaaatatatagttagggacccagcacggtggctcatgcctgtaatttcagcactttgggaggccgaggtgggcagatcacctgaggtcaagagttcgagaccagcctggccaacatagtgaaaccctgtctttactaaaaatacaaaaaaaaaattagccagtgggcgtgatggcaggcgcctgtaatcccagctacttgggaggctgaggcaagagaatcacttgaatctgggatgcagaggttgcagtgagccgagatcgcaccactgcactccaccatgggcaacagagtgagtctctgtctcaaaaaaaaaaaaaaaaaaaaaaagaatatatagttaggaaaactcctcaagtgattgacagacaggattgagaaccactgggatggggaaataccactcttcccagcccccaaaaagagatgaagaaaattggccagatgcagttttgggaatatggatataggatgagaa

SEQ ID NO: 62247 - DNA, 1036 bp, Homo sapiens
tttatttcactcatttgcatgatgtgctatgttaaaataactaaatcctttctaattcattaatctatttttaagtgtgatgcctgtgtgctttaataacactaaaataggtaatcagtcattcgaaagagtcaattgggatttgtcacttcctctacttcctggtggatagtttcaaaatccactgcttttctctgctacagaggacaatccttacactcccacctaccagtttcctgcatctactcctagtcctaaatctgaaggtaattaaaggaaaattgtgtgcctctccgtactggtgctgctactttcttttttaccttggggtttttcctggtggctaagggctgtttcccagtcatttgcttccctctaaccttgtgttttgtggtggtgtctcactccttgctgactgtatcaccggagtctatccagatggtattttagtcctattcccctagggtttacatgattaacggggtagccagtgttagcttagttacaatgttttgaacatgtggggctctggtcaaagctgcctttacccaactacccaaggctttgtacctgaggtggtcacctgatgctggtggttgagcagtgactcagggaagctgagtcattatagcgggtgggcaggaggtagatctgtaaccgtcaacaggaaaattacccagttctcatgcctgcaactaactcttttcatgggccctcagggtatctctctttggtagggaattcctaaagaggtatccaggtataagattcagtcatagtgggagatgacatttcttgaaaataagggttttagctaagctggaaaacatttaatgaaagagctggataggaatttgtacctgctggggaagacagtcacatttgtgtctaagaaatattatttctggggaaaaagtctaaatgtcaaggaagtttctaaaatgtgagttaggggcaacatcttgagaattatcctaatagcagggattatctgatctttggatgagtaatccagatgagggtgaatagatacggt

SEQ ID NO: 62248 - DNA, 1370 bp, Homo sapiens
gtctgcacctgttcctttcttaaagacgagaacctgtccatagtcaatcaataagcaggttttaactgagcaattactaattgccacagcacatcttgatgcccttcatccttacctcatgggcctcattctcactgacaggattttaggctcccttggcctaaactttttttttttttttttttttgagacagagtcttgctttattgctgaggctggagtgtagtggcatgatcatggcttactgtagcttcgaactcccaggctcaggagatcctcccaacttagcctcccaagagctgaagcaacaggcatgtgcctggctaattttttaattttttgtagcgatggggtctcgctatgttgcccaggctggtcttgaactcctaggttcaagcaatcctcctgcctcagcctcctgatatgttgagaggcatgagccacggcacccagccagcttaaacctttttgtccctaatcctttgacctcttgaattaccatctagtacattccttcctctgtgctgaactccccactcactcccccaacttcctgcttacaccttcaaccctctgtgcaatctggcacccacccccactgccctcctgaagttgctccctcagagtgttcctgtgacttctctcttgcctaatctaatgccgcctcctcctctgcttcaatttctggggtttttttttttttttcttttgagacatttaaccacccacttcttggagttctgtcttccctggttcagtggcaccttgtgtacttttctggttcatctcctgtccctcggattactttgcatcactttggggattcttttgccttgcagctataactgtggtgcccttccatgcatgactttagcgctttactctggccttgcttctgtccaccactgagctctgccatctccctggcgtcagccatcacttttgggctgatgcctccaaagttgcactcctgttagggtgtctcacctgggccccttcatagttcctctagggatctctagggcattcctacttgagtatcttgctgtcttctcaaagttaccatagtccatatggaagcagccatttctccctcccattcctaacccaattctaacttctccatttggcttaggccaggcttccagacttgaaaccttggtaccatctttgaaagaggcaagacaggatgtggttcagagaggactgctagagtcaggtggacattaggccacatcacagcttggctatgagctggttgtgtggccgcaggcagggtactttaacttctctgtgtattgatcctttaactattaaaaaaaaaaggtgataatagtttcttcctcatagatctttgggaggataaaatg

SEQ ID NO: 62249 - DNA, 1054 bp, Homo sapiens
ctgtcatggttgtgattataattacatttccctcaaaaggtaccaagactggggtcatataaggccttgctcacttgaagctggagggttggatggattcccttctatgatggaatcatcttgagataagatgtaaacagctagaaaattgtggcagtcccctgaatcctggtgtagatctggaagcggggcaggctgggagacaccacactggcataatgggagccacgctaatacccctgcagtcagctggctgcatgcacattgtaccatctaagtccagaggacagtgaggactcagggttgagatcctaacgagttatgccagggcttcttggtcttactatgtgctgtataaatcttacttacactgtgtgttcttttatcacagaacagcaaaaacgactcagtagcctttcaggtaggtgagaaatatttatttatgtgttaatccctgttcctgttgaaaccgtcttccggtcaccgcccgatattcaatcagcaatatcttccaagatcctctgatgtcttggggagactctttgttgctggactaccaagatgatgaaaataggcatagttcctgcctccctggagcttgcagggtggtggacagaccagaccagtgagccacactagtaaacatgtcccatggaactgtgataagggccttgatggataagaacaggatgttctgggttaaaaagaaccaggagtccagctttagatgcagtgttcatggcaggcctctctgaagaggtcatctttctgctgcttctgtctcccttctggatgtgaggagtcaggggttgggagatatgggcaagttctctcctttttgggtggcaagcccaaatgccagtagatgcccctggggtggtgggtccaggtgagaaccttccgaccagcagtgcccagaagacagtgtgagaaaactgcttcttgaatttgagcaggcatcagaaattcctggagagcttgtcgaaactcagattcctaggccatccccctagagatttggatttaatggtgggtatgagtaagaatttgcatt

SEQ ID NO: 62250 - DNA, 1179 bp, Homo sapiens
taattattgcaaagtctcctgagggaataactttactccacttctggaattctagttttgtcatcctaaaaaatgcctccctccctgccccccccccccttttttttttttttttttttttgcctagactgtcccagggcatagtgtggcaataatcctgtctctccaagccagcttacccctactagaaacagaggggcactgagcctctggcctggtactgatggttgtgaacaacacagccctttccccttctttcctgagttttcacaccacatgggtatgaagacaaatcgcttaccatctgtctgggagggaggctttgaatcagaaaactctcaggatgaaaagaggtgcgtgggtccccttgcttagggcttctcagtctatgtgcgtcggatcctgagagtcttgttaacttgcaggttcagcctcaagaggtttggggtggaggagacgagattctacattttcagcaagcttgctaggcataccagtgccactggcccaccgaccacattgagaactagagctcagaggttcccagacttacggacacatgaagcagtctagggatcaccctagggtttttcattctaatgctttaaaataacaccactagaaagtggccactgttacctgtgttgcatgtcatcctatgaaagaaaggctatttcacacctcaaaactggagacaacatagtctttttttttttttttttttttttttttgagacaaggtctcactctgttgttgaggctagagtgcagtggtgcagtcatggctcacttcatcctcaacctcccaggctcaggtgattctcccacctcagcctctcgatgccagtagttgggaccacaggcgtgtgccaccacacctggataattttaaaatattttttgtagagacggggttttaccatgttgcctaggctagtcctgatcccctgggctcaagggatctgcctgcctcggcctcccaaagtgctgggattataggcatgagccaccgtgcctggccaacgtggtctttttcatttatttatttatttattttttgaggcagggtctttctatgtcacccaggctggagttcagtggcacgatcttggctcactgcaacctctgcctcccaggttcaagtaattctcatgcctcagcctctggagtagctgggat

SEQ ID NO: 62251 - DNA, 1536 bp, Homo sapiens
tatcttttacaaagtatgttttcttatctgtcactatccaagaattttctttctactggggttcccttttaagggaacttggtaaattgctcataaagaggttttatcctttatattcaatgtaaaatcagccattcaaatttcaggaacctttaggtcatgcattacctcttaggtgtgttttctgaatggaaacatgacttcttgtctatatagtgattgccagagctgtaagtatgcactggcttagaggagggaattggtagtttatagaactgtataaactataaacataccaggattttccagaagcctcatattttcactgacccaccttctgaaaagataaatagaatttcatttatagccaactgggcagaatgcagactgcctgtgtggttcctacaatgtttacaacaaaaagtagttccctgcatgtaaagtcactgtgcctatcccctttcttcttcaggactaaaagaagccccagggcaggagacctttggatctgagtgcactgttgatgctctggggaagcgtcctctctacagggtcaaagccctgggaaggctcatgcctgatgtaatgcaccatatatggcgagagccaaaataagttagaaactcactgaagctgatttctatctttggacaagaagaaatcacatatgggacatttgagctgaaagtaaaagtaaatctgagctcaaatcaaaatgatcttttgcttacctccctactgccattatcagcatacccgccagtccctttggtgcgtgctagcccacgtgttttgtttctagaatcgtttagtctgtaaacatgttcactgaaaccaagtgagttcacctgaaagcttttgctgttgctgaatactagagaggggctattcattttgttttttttttggctggtgcatattcactggcactgccatgggtgccctgtggaaaggataggcattgaattagtcaaggatatccaaatgagctgcttgtccaatgagcttatatgtgtgccttgaaaactgagtttaaggaataggttatttactatttctgggttgatgttctaatctggactcaaaaaactttttttttttttttgacagtcttgctctgtcacctaggctggagtgcagaggtgccatcacagcttactgcagccttgacctcctgggctcaagcaatcttcccttctcagcctccttagtagctggggctacaggtgtgtgccaccacacctggctatttcttttttaaattttttgtagagacagagtctcgctgtattgcccaggctggtctcagactcaagtggtccttctgccttggtcttccaaagtgctgggattacaggcttaaaccacagtgcccaacctataaaacttttaaatatttttcacctattcaccctttctaacattctttcttcttgccacctgtatgccacaaatataagaatgaaataggccaggtgcagtggctcatgcctgtaatcccagcactttgggaggctgaggtgggtggatcgcctg

SEQ ID NO: 62252 - DNA, 1050 bp, Homo sapiens
tggatctatccctaaggatcttacgttcttaaagctatttatcacatggcagagatcaacaatgctcatttttttccatggttttttcccccttatgctttgaattctgattttgcaaagcacatgctttatgccaaatactttcatttagtcctcttgattcaaaagaggtagatattatctccatttcacagacgtggccaggtcatttgccacaggatatgcagttagcaagatagagactcagggctgaaactaggcaatctgatgtcacagtgatggtcccttcatgatacctggagatttagaagaacagttcacatttcagctttccgtgacatagctgtttgctagtgtcacttgaatagaaccaacccaactgagaaccagaaagtgggcaaaataatgtgtccccaattgcatgtacgaagtttacatccttcactagatagcccttcactcagaacctgttgacgttagtatatgcataaatctaataaatttgatagacttatttgacaaaggtggactagaaatagcaacttagtaaagaagatggaacggtaaaagtgatagctgtgagggaagaagtggaccattgtcatggcatgtcaccaggtgtttaagggcctgccaggtgtgaggggagctctgagccagggagccgtctggatgcgacagggagtgtggtgcactcagaggtattttcatgtacctgatctttgattctcaaagattctccaattcttcaattggagagaatcaaagaatcatactccctgtgaggagtatggggtaaggcttatattttataggtgagaaaagtaaaatttagcatggctagtgaacttgctcctggtcatacaagccggtacattgcagtaatgtgagcaaaacacatgtcctgtatgtacctttcccaactacagttgtccctcagtatctgccagtgattggttccaggaccttcacggataccaaaatctgaggatgctcaagtcccttatataaaatggcattgtatttgtacataacctatgcagatctcct

SEQ ID NO: 62253 - DNA, 1055 bp, Homo sapiens
tgaggaagaagtgtatgaagtgctgtgtatcatgcctggtggcatggaatagactgttagatgttagctgctatttgattatgattagattattttggcctctccagggacgactttgcacagcccaagtattctggtagttggcaaatgctgactttgagatcaggcacagttagtttagggtgagacagcacctctccactctgtagggcagtgactttcacactttagctgcatcagaatcacttggagtaaaaaggtaggttgctgggccccagcctggagttttagaatgtagggttcccacttgcaggtctgaggtagggtctgaaggttcacatttctgacaggttcatgctgatgctgctagtgcaaggactgcatctgagagctgctgctgtaggggatgggagcttgctttcttgaaggaaagggagggagaaatggaatggaggggaggaccattcccttgggaccagagaggctaggcagtagggtatgcagacccctctggtgcagcgggagtggtgtgttgtgataagacagatatgatatgtaggatggaaatggccagacctagcatcctggaaactgattttcttccttcccagctacccataacaggtgccagggcacatgctggtggatgaggccaggctagggtttgagcacaaacccctttctggtgatgttggtccccgtgagggcttctttgtccttaggctgagggcaggcccgagcagcccacagccctaaaagtcaacagagtagcttcttggtcctgcatccctgagcccagccctgactcctgacccgctggaaaggtgggggtgaggagagaaggcaaagttattttattctaaggctaacctcatccagcctctccaagcctaactgggacgacccacttccaagctagagagcatttggagaagagagaatcctaagggatgatgcaaagagaaaggctttaatgtgcagtcccctggcccagtcaaataaccttacaaaccaactgtcccgtcctctggcagcaaatggaggtggtggagagg

SEQ ID NO: 62254 - DNA, 1199 bp, Homo sapiens
ttgttgctgtgagttttctttgttatgtttggaaagtgagactgtcactcgtgagctttctcgccaggcagcatatccttctgtctcagcattttgggagtcttgacttgctgatccaaggagatttgcttttccttttcccactggaaaactgcaaaggggtagttgttctccatgggaccacccgcccccaccccccccaccgcccccacttccgtagttgccagcctggtcttcaatgagaagtatggtctggaagcttgaaacatctttcataaactctttcttgaactgtgccttactaactggtcagaagtctgctcatcaacctaaacttcatttaataaaaggaataaacctgctttcattttgaaatgttttcagctgatagtataactcatccatttactcagaactcaccattgccgccatgttcccctaacttcatgatgcacagtaaacctctgaaaacttgcccctctccaccacccacagattaatttcattgaccacaggtgttcaaagacttcgcatggctgtaaccaggttcatctcattccccggctgtaacaatttgctaaccaactgtcctttaatccttcaggagtcttggattcagtcttcaattttggaccttttcttttcagacatggatcttacaaaaatctgcactgggaagggagcggtgactctccgggcctcgtcttcctacagggaaaccccaagcagtagccctgcgagccctcaggaaacccggcaacacgaaagcaaaccaggtgcgcggaagctagggaaagctgttcaaagccacgtgggaagggcgggaggaggctctggtgtttttgctcaggagggtgtgagttcatcagatacctcttggggggggggggtgtgtgtgtgtgtgtgtgtgtctcttacggtcccctgggacagtcaaatcatttggatgggtagtggtcaaagcctcaaactgacagtcacatgctgcagatgaaggcacagcaataaccacactttatgttagctttgactgagcaggtcatcctgtgaccacagccagtgctctgcagactgctctcatgcagactgaaatagcttagggcatggggggtaagtaagcggtgcgatgggctagaggttgggcttctcagagctcatccctgcttcctagaggttcactgtgacctgtccaggctggg

SEQ ID NO: 62255 - DNA, 1032 bp, Homo sapiens
gagctccagtctcagcctctccgcttgagaactgaatgagcctgagcagttcactgagcctcttgcttcttcctctgaaaatggttacaaaagtctcccccaagcccatctcccaggtggagcagacaggaggatgctgtgagagcacatttgtgtcttaatccatgcagcagcgtcattggcaacctagtcattgatggccaggcgccgtgtgactgccccatgccttatgaggtgagctgacagcgggatggactggaaggtgcactgtctctggccgacatgcctcccttctgttgccttgacaggctcaccagcacgatgctgactttgcagtggcggtcttgttcccagacagccctacccgctgtgtttctgtagatctgtggccacagtcgactctggcaccttcacacagagctcccatccctctttatgtgctgcccttgaaagagaggacgaggggaggcctcacaacaggctcggtgtgaggagagttagggaacgtgcctaccatgagattacagaatctgggcaggcagggagcccagagaccctgcagatagataagtttgagcacccaggatgttcgagcggtagccttcaccacgtcccaggcaggcattcctgctctgccttagctcagctgggcattggggtcctgggctgtgcacttgggtgctgcccagagactacatatgcacttggacacttggcacctcctgaccaggaaagggtgggtttgagcaaggccatctgccgtttaacagatgggggctttgatttgcttggggccagagggctacaattatcggagcaggcacaagaccccggaagttatgctatgggggaagtagctctgatggctgaagggaccagacaactcacgatcttgttccttcgttcttccactcatctggagcccatgggccacagccctcctcctcggaacccactccccagccttctcccaagaggccctgtggaccctgagtgctctccccttcttctgtttgccaggccatctgtgtg

SEQ ID NO: 62256 - DNA, 1869 bp, Homo sapiens
aagatctggatatatattagggcattgtcagtataatttcagctttctttgagaccctactaaattaaggggttatccatttgaacatcagggattggttcccacctccaggtggtagagcacagtgcataggaacttgggccagaaagtcaggctgtctgggttccagtatcagctcctccactgcagcaagcacacagcttcacctgtctgtgtctcggtttcctcatctgtgtaactaacctgacattagtggttacctcctagggttgtgagggtcaaatgcgttaatatattcaaagcatttagaacatttccttgtgcatagtaagctatatataagcattcagtatgatcagtaagttctcaaatcagtttgtgttgtgattttacctctttctcctaaaatgtgttttttcccctttcctttaccctctctttaaaccacgtgcactcgtgtagcttgaggtttttaatagaatgtttgaaagggatgtcggataacatcagcaccaaatatgggcaacaaaactgaaaccagtgaggttgagtgatgtgcccaaggtcacaataatatgtgggtgaccacaaaccagaagcctggccaggtgactcctggttcagctctgttttatcaagggttacagtgtttgcatttttaatactaaccattgggatttatcgcgaacctgccattcatcaattgcattgtgtggtgtttgtttttctacagagcagttcagagccccagttgcagacgacttgtcctgccaccaccatgagttctggtaagtcattttaaactcatctttctcttatctaccaaactgggcagtttacccagatttcccacgcaccctgaaggccccactctggcattttattttttattttttgccacctgggtgaatgccaaagctttgtcataagttgtcatcatcactctcatcaccttcatggttaatgattttttgagtgcctactactattgccaaagaactgtgctatacactttacatgcacattagccctctctttattgagatgtaactggcatactataaaccacagatatttttagtatacaatttgataaaatttgacatatgtgttacaccttcatggcatttcttaatctgggtgactgcagcaaaagtaaactgattggccataattgcccaaggatgtgaactaatctaatgcttccttcatctaggctagtagagtagtttgctccctcttttgctttgcctttggtagtaaaagtcaagacctaaagaaataatcagttttgagtatttttagttttgagctgaggtagaaaacgtgggttagggaagacagagatgggaacagatccctgctcatcatgcagctaagagctgtcagctttccaacccagaattggagcagagaagtttccatctggagattcagccccacctaggctactgagcatgccctggaccctcctgagacctgcaggtggggcaggctgtggggtgggaagatgatcatgtggatatctcattccggagtctcccaatcctgccgtatttcgtgagtgttgtcagtgacctctgtggattaaaaatcacccttttccatttatttgcatacaatgccgttttaggcaagttctgagtaggacagtatgtagttcagacctaggaaggctctgggctggaatagctgaggcccacaccctgacctcagtgtttactggctgcatagccttgggcctgtggtggacccttctcctctgcaaaatggacataataaaaacaccagttcattgggatttagtgaggattaagtgaggcaatgcttttatttatttatttttgagacagagtctcgatctgtcac

SEQ ID NO: 62257 - DNA, 1154 bp, Homo sapiens
aaccagcattttgttcaagtggggagctggctcccttttaaggagccatggtggagttaaggaggctcttgattatcttgaaggtaagactctgaagttaggttccgaaggttaaacagaggcgagagcaaaggccgtgactgagcacctactgcatgtccagtgctgaggatgatgcagttttcctttccagatatttacaatctattgttggggatgggggagctatggaggcaaaacaccatagtgcataggagaagctggagcatgctggctaggagatttaaaggctgtttgttttccaagaacctttgcaggaccttgaattcatttttacagacatgctcaatttcttcctagtcatatatccctaaactacccatataaggaccttctttcctttcccagtaaccaacccatatttagttgattgtttttcagctggaagcatgagtataactttggctttttagtaattaatcactttgtgtcatcaaaacttatcttagaattatagggtcatggaattggcggggtaggggggacaatatggaatgattaattatctggatgctttcttaacaactctggccacttcacatcttgttcttctcgtggaatgtctgtgttgatgccatggtactttgaccaagtacggcaggtccaagcagctcaaagcgtggaatggcggtttgactccccgctggcacacccaagctgtgacactgcataggttcctgcaactcactaggggaatttactgcccacttgcagttgtgtcattttgccactagatggtacactgttggtccttttggcttttacccaaaggtgcctggctcatttggaggggacttgtaagaggcattccaaagacgtgccatcatgtactcaaccaaatcaggctctttacagcttagtttttaaataaatattaagtgttagaggtttttatgtaaaataaactctcaagttctcatctgattgtaatggcccatattatctctaaataaacagcagggactagactatgattttcaaagctttcagtgttccggtcaagctcaatttgtgtagtttcatggatgcgtcctcactgcccaggctctgagcacttaaggttgtagagacacaaccactgccgagccacttgg

SEQ ID NO: 62258 - DNA, 2149 bp, Homo sapiens
tctaattttaagctgtgactggctttctgggctcccaggcataaccatacagggctgtgttagtgactcagatcaggattcagctgtgctgaccacccagaacttattcccactcctactccccaagagaccagctcttcaggactcccacccagggcagggctgggtgggtccaccaatgcctctgccagggttgagttctccaggaccatctgggcctctccctgagctgaggtacaagaccgaggctgcccagcccctaggtcagagacgaaaggaaggaacaggctaggggtgggctggcagagagttcaggctccctgagctgggagtatttggggaagggaaaagaggaggaggtcggaaagtttgtgatgactctgaagactctcaggtttgtcccggggggactcaggccgccaaactgttcacttttctgcagctcggtgttgggagtgtgctctcttttggagtcacccatcctattttgggatgactgagtcaaaggagtagctctatcttggtgcctggaagtgcctcacatttcctcattttagacttgccattcttttcttaaggtgcttttcttaaggtgcttaagaaaagcaccttaattccattattaaagattcaggatcattaagactcaggctggattgaaatttatctctttactgtctatggaaaaagatttaaggagaaaaatcactgtgagggatgtcgatttaggaaagctttctaaagaacccactttaggaatgtgcatttgcatacaaacaatgaaagtgctaattaaaatgattctcacatcatcattttagcagtgcagggactgctgcttggcaacacttatgaagtggaaatgagtgtactttgaaaataataaaatattgttccatccattgaatccactaagacattaggtccttttatttgcaaggcactgtgctagaaccactgtgtgtgtttgtattggtcaagagtataaaacctagtccttgctctctagggtgaccaactgaggggtttccctgggataaaagactatcaggaaagcccgggaagaaccaggttgaattgggccaaacctacctcgggagttgaaaggctggtaggactgaacaatgttcctcaaatatttcacctgttgagataggccacacctgttcacattgttttagaaacagcattttgccctgtaggacgtttttgccctggaaattgagtagtctaattcccttttaaagcaagagcccaacatttaaaatatttctgtcatcattgtcgttattggcatcagctatcactgggcacctgctgtttgaggctgggactttgccctggagagtgggggtggggctgatctggcctggagatgatgtgaaaaccttttagctcctgggcgaataactgccaccttatctttttttaaaaaaagaatagtgttttagaacacggagcctggagcgcagtagatgcagagtcaatatttgtggattgaagtttattaactttgtggttgagagttcagggtctgcagtcacatagacttaagtttcaaatcctggctctgccatttgcctgctcgatgatcttggcttgtgacttacctctctgagcctcattttcttcatttgtgaaattgagataaacataaatttagttattatataatattaatgttcatatgataattatgacaggctgcatattgtggtatatagtaccacaaactcgagtcaggctgctaaagttcaaatcccccttcctagtatcataacttccagcaagttattgaacctctctgggccttaattttcttatctacaaaacaaggataataatagtacctttacagagggttgttagatgtgagaattgtcaagcacctcatcccagccataagaaaacattatatacatgtttgctaaaccttaaagactgtgaaactattattaattatttcattttggttcttatagaaatcctgtgaggttagatacagggcaagtattactccccactgcctcattccctatttgttgttattgcttgtttcgtatttgagggggaaaaatggagttctgaaaggttaaagtggttggctgaagggaacctggctagtaaatgttataactgaaactagaac

SEQ ID NO: 62259 - DNA, 1043 bp, Homo sapiens
tatcctaagtggcagccttccttgcaccctaacctcaagctctcctctcctccagatgtgcataattttcctgtgtggtgccagggaactgtggttataaatgagagagaaggggctctgtgggggtcccagaactgtgttgggatcctgtctgtgaagttacgctcatctgagctactggtctaattctatttttaaaaagggaaattaattgataccttttgacagtgagcctgtgtcagtttttggagtgacaccaaaatagagtcatcactttcttttcataggtattcatctatttaatattccaggctagaattcttcaggatgttgatcccaagcttcttagtgtatacttctagacccttcttagtgttaattatttagttcctcaatttcatcacctttccttttctcagaggtttctgaaggattactgatagtgattcatcagtgacagttcagattcttttagctgtctatggatgtggttcacctgagcctgaaaacccaaaaaggagtagctctcacttaaaggggctgcgactctcctagctccacacctgtcttctgcctcagtcacctcttaccagagtctccctttccagtaagatcattctcatagttggtggaggtggaaacaacacgaggaagagtggcttctcttataatatgacgagggcttcttcaagcaggtctgttatcatacgctttgttttcttcttggtctgatcatagatttttaaaaaagaacctccaaaacaaaaaacctaatggttatttcaatttcttatgttttaactcttcccagaccttagaacaagcttgtccaacccaaggcctgcaggctgtatgtggcccaggacagctttgaatgtggcccagcacaaatctgtaaactttcttaaaacaatatgggatgtgtgtgtgtgtgtgtgtgtgtgtgtgtgtgtgttgttttgttttagctcatcagctatcactagcattagtgtattttatgtgtggcccaaaacaattcttcttcttccaatatggcccag

SEQ ID NO: 62260 - DNA, 1031 bp, Homo sapiens
aactaaaatttaaatgatagggaaaaaaatgttgggacagtagggtgaaacaaatatttttttctttaaataaatttgtgtgttttatggctgggcctggtggctgatgcctgtaatcccagcactttgggaggccgaggtgggcggatcacctgagatgaggagttcaagaccagcctggccaacatagtgaaatcccgtctctactaaaaatacaaaaaaattagccaggcatggtggcgggcacccataatcccagctattcaggaggctgaggcaggagaattgcttgaacctgggaggcaaagtttgcagtgagccgagatggcgccattgcattgcactccagcctgggcagcaagagcaaaactacatctaaaaaaaaaaaagaaagaatggaatttgtgtgtttttaactaagaggaaggaaagaaagcaacaatgtaatttttaaaaagtattctttacaaatatcaagtcattatattagttttgaaacatataatgtcctttgtataatgtgatttactcacaaaaataccatgttgggaacatttatacaaatttactaattacatttgctcttaaatattttcattttatttttcaaatagaagtgaactactgaactcaaaggagttgaatgtttcttaggtttttttccttttaatagacaaaaatataaaactggacaacagaagtcaccagtgttttaatgaaacaaagaattagtttttgggtctggtaccttctaaagcatctgtagattttagaaaaggaatttcacaccaccaccaccaccaagaaagcccaaccaacctaaaacttgaataactgaacttaatccgagtcattcctattttatgagccatcatgatccacagtttctgtttcttctcatgtcgtcgtttcctttctgaaatcattcttgtagactgctgaagactaaatgctagcccagatggagactgaatttcaacctttttcatttttggcttcttggttttggggtgagagttcatcagactgtt

SEQ ID NO: 62261 - DNA, 1102 bp, Homo sapiens
aaacattaaattgtgttggggtcgtcactaaaacaaggagatcagcatcatctccggtgattactgctcgtcatgggaagaaatcattctgattgttccactgactaatttagacaaggcaccatttgatgcctacttcacagcagtgccctcatcctgctgtctccttatcaacatagagatgactcactccatgtttttctcactcagagagaatttctctagtctactgattatggcagtgattaaataaaaaatgattcctgcagaggtgtgcttgaaaaaaatgattgtattatttgtgcttgttgaactttggataattcagcattcactattataatcagtaagatattggtttttaggctttttgggtaaagggtcaggaacccctttaaggtacatatgcacgtacacaatttccatgtataacacttctacatttttaggagatgacattcccctgcccagttaccatgcttagtcacacatcccatgctaaatgtgcttctggatagctctgtgtggcaggtaggtgcctgctgtaaaagatggcttttctgattagatctaggtgaaagactggggaagatagctatgttcaaggcagcctaacttcaataaaatttacaacttccagaattgtcccaacatggactcaaaagttggaaatagtctcttatatgagttgctaatccttttaatttaaaaaggaagcagaagcacctttacactttttgtttcctttctatttgagacagggtctcgcactgttgtcccggctggagtgcagtggtgcgattatggctcattgcagcctcgacctcccaggctcaaacagtcttcccaatcagccccgttagtaactgggactgcaggtgtgcgccaccatgcccagctaatttttgtatttttttgtacagacaggatttcaccatgttggctaggctggtcttgaactcctaggctcaagctgtgcacccacctctgcctcccaaagtgctgggattacaggtgtgagccaccacgcccagcccctttttgttttctaacagctaatttcattttccagcagatttcatgtttctggacattgtattta

SEQ ID NO: 62262 - DNA, 1076 bp, Homo sapiens
tcttagaagagcacctcacacctgatgggtgttcactaagtattgtgagcaatacttatgaaggaagcaaacaaataactaaatagacaatataatttcaggtggtaatgagtggtatgaaaacagtaaaacaaggtgaagggctggcggggctctttttgaaagaatggtctaaaaaggcttctatgtatgtgagagagaaaaagaaggagattggttttgtgcagagacctgagtggagtaaaggaaccaggggaggagaagtgttcaggcagagggaatagcaagtgaaaagaaaggcctttgacgtaggataagcttggcttagtagaggagcagtttggctggacttgggctggggggtgttcatagggagggagagtgatgtgaaataagagcagtaggtgagagccagaccctgtaggccatggtaaggagtttgatttttactctgagagtgattggattccatagtccatgtgatcttctttgtgctttaacatttttcctctggatcctgagtgcagaatagatgctaggggcaagagtagaatctgtataacctatcggaggtccttccagtggtccaggcaggagattagggtgtggcttggattagagtagtgatgattgaatgatacgaagaagcggtcaggctcaggatacattttgaaggtagagccttctaggttgcatgtggcatgtgagtaaaaacaagagtcaggattagtccaatgtttttggctaggtgaatgacgttgccgttcactgagataaggagcaaagagggaccctaagggttctgttgggccgtcttaggtttgagatgctcattcaatattctcataaagatgtagagttggctggggctggaaatggtatctctcatagtcattggcatgtagatgatatttaaagccatgagactgaatgagatcatctagggagagaaaggaagagatgcgtaggatttttgacagaggaaagagggaagacgaaggcaaagggtatattttccatataaagtccccactaagaagtaaataaagacatgctaatgaatatggtttccattt

SEQ ID NO: 62263 - DNA, 1012 bp, Homo sapiens
taaagatgcagattccctggctatcccctcaaaggttttaatttctcaggtctggagagatcgcagaaattctgatgcaggggtctgagaaacatacttagggagataatccaagagaattggacctgcttttcagtctgctgacaagtggataccactttactccagctacccagtgcccacgagcccctgcttggacatctgtcctctttagagtctgtgcctgaaagcctatgccccatatttgagagatgaagctgtagtgtgggaggggagtggggcttgcttaatggttgccttcttggttagccagcttcagagtttccattatggcctgtaaagaggtctttttacctgcagtgtcttccatcgatattctgcctcatatacactctacttctgcctcaaggcccagtatgaatctgaagtcgaagtgacttttgtagcccatacttggttcctgctcacaacttctctatgaatgatgatgggtcttctggtttttcttttgccttgtatggctgtctgattagcttccattgggctgattttatctctgaaattatattgtaagcatcatgaaggttgtggggtctgcatggtgttgggcatacagttatcgatgattatggataacttggttcaccgtgatgtttctggggtggagtgaccactgtttgatacctggtttgacagatatcaaaaccatggcaataagggtctagaattggcttgatctccacagtatctcttagatgcaaagatgttttaggtatagggctttgagtatcagtgccatcaaatagtacttccagggggaaccccagacaagtctgggtcctaagtgaaaccagaggttttagccagaaataaaccagcatcaggaagggagctggtcaaacactgttccactgcatcagtgggtggcagaggttgctggcaggacagagttagctggcatcagtcatggcagaagatgactcataaggctagttgaatgtgtgtgtatgag

SEQ ID NO: 62264 - DNA, 1043 bp, Homo sapiens
agagaaaaatcgattggttttggcatgcctttgtcattgtggacgcacattgccttttcccaacattcacatttttttcgaaatgttcccaaaccatttgttctataattttgccgggaaccattattggtctgtagtcgtccaggcttatttatttgtagatatcaggatcacccactttcctgctttaaaattgagacattggcccatgtctcctactcttagaccccgaactttgtgtgattttgaagttgatcaatagcagttctaagaaacttttataatcagttaaatatgcacgaaagaaattatatgttgtcaaaagaaaagttggagccacatcaaaaagtggaaatcagccatggtcttgctgctccagtgttatccctgctaacattttggtgttgcttttgccaaatacatgagaaataatcaaagctcacaatcatatcgctctggaaggggtatggcttatagggggagcctgatgtgtaagctacttaaccttttagaggggcacaattcatgtgtgtttaagggatggtgaaggcatagaggagaagggtttgtttcacctgaacaagtggatgtctgggaaaggcacaatagaacaggtgacccttgataatcaagtagaagtagttgaaataaaacagaattgcatatgggctacggttacaaccatgtgctaaatgtattttttaaaaactgcagggaactgtcctaaaataatactgtggttggaatgttgatgaatgtggttttattttctctgggtttccaaatgggagtctattgcctcttataattatttttcttaatgcaacacatgcatgtccctgtcctcaggaactcagggctgcagagcttggctgcagtctgctgcagggtcagggagcttagagccgtgttccatgcaccgttgtctttttcattagtggtagctgaggatgaagtagagaatctaataattctctgatagcctagccctgggagtagtctagtcttgggcgtggaacctgaaagttttagacaaatcttgg

SEQ ID NO: 62265 - DNA, 1060 bp, Homo sapiens
atcctccacttgtggcctgaccacagcagggtacagtgtgagtattaccattttttctgtgaaccagatgctgtcctacttttaatgcctttgaagattgtattactctgggcactgtgggctctgatgaaccttgtggtcaggatggcacccttctctgtttcccatgaatggttgccagggcaggtctcgtggacttcaggaagtttagacctgcccccagcccgtacttttgcacaatcggctttgtttttcgcccagaatgctgggctgttaaggtcatttgaatcttgattctggcatctatagcattagctcttcttcccagttttgtgccatctgaaggtttgataagcctgcccttcatgtctgtctctagtcaagtcattgttaaaaagacagtggacagtgtgtgcctaagaattgaaccctgcgtcattccaccagtaacccttctctagcttgtcatcaagtcattagtgatgccaatgtatacatttactcaccagatgtttattatgtgcccattatgtgccaggcactatgccagtgccgaaggtataaaggagtaagacaactgtcctgcctggaaagagatcatcagcttgaaaagagatcatgattggcacactttttctctaaaggcctagatggtaaatattgtcagctttgcgggccatacattctctgttgtaactattcaactctgccattgtggcaccaaagtagccatagacaagatggagacaagtggcgtggctgttcctataaaactgcaaaaacaggtgacgggctgggttaggcctgtgggtgtgtttgctgacacctggtctagtagaaagacaagtaactcaatcaagtttaataagtgctctgagagcatatgcacagagcacaatggcggcccaaaggagggagtgatgtacggtcagtggggtagtaaccacctggctacatagacagtggtgcaagcagcttcactctgtttcactgtcttatctacaagtggatcataggaggtttttctagatgctttgctgaaatctaggtgcatgatatc

SEQ ID NO: 62266 - DNA, 1056 bp, Homo sapiens
caaatgatctgcccaccttggcatcccagagtgctgggattacaggcatgagcccctgtgtccggctaattgttaaaattctttcatatgagctgaaatcatcctgtaatacagttttctcatttagaacccatgtcacactagtttttacaccccatgattcatttcgtcattcaaacgtatgtattgagcaccgactgttttaggttcaggaggaatacgagtaaacaagatagataaggtttttgccctcttggaatttagagcctggtgttagtacagtggaaagaagattgaactatatgtcagaaaacctaagtataagccaaagaattttacagaaagaaagaaaagaagaagtgaagattatataacacttataaacttggctaagacacttgagtatcagttttcacttcatttaacagaggacattatcccattggaccttccagaacagtgaaggctcgctggaataatgtaccttgaaaaatgttaattgctatgtattaccaagaggagtagtagtagctcttgcttctgtagagtagttcttaaagcatggttcttggaccaccagcatcagtatcacctggaaacttgtgcaaattctccagccccaccccagacctgctgattcagaaactcacagggtgggggccccaaaatcttttttacaagtaatccaggtgaattcgatgcctttcctagttggagaactactgctgtgggttagagcaataattctcagccttgcctgcacattggatgcgcctgagagaggggggcgctttcaaaactatatctgttccccccaactcccctcaaaagttagatcaggatctgtggtggggcctgtgcagaggctgcccaggtgatctgcaggtgcgccaggtctgagaatgctgctgtggccacagggcccagcccggagggacaggggattaagataaggtgcggcagccttggagttacctgggttggtttgagtctgagctctgccccttcctggctctgtggcctttggcaagaggactctggcctgagtttccttat

SEQ ID NO: 62267 - DNA, 1120 bp, Homo sapiens
actattactagtgcccccttttcctcttaagtgtccctgcttggatgataaattacatggtcttgcaatcctcaaggccatatggcacccctgaaggtttcacagtgggccatggtcaagctggtcttaggaaggtcagtgtccacagtgcctgctggagtctaggggcaggagatgagatgtctcctggtctaggcacttcaggccttagctggaggagctgtagtgacttctgaaaggaggagatggttacaaaagagattaaaaatccaagtgacacccacacatggtctctaaaaaggctccaaagtggctcttccagcatagacccattctaaagttcagggatcccggacaggcatttttctaacttgaggttatgactgattaaaaaaaacccccaaaaaaccaaaaaaaacattgtgcctacttcctgagcaattagaagttaagagaagcttctgcccagcctctaaaatggcctggtggaactcactggtattcactttcctaaaccccggcattgttccttggaattcaaaataggttatgaatgtgcttgatgtcaggaaagataaatctgtgaggaggactgtagtcaatacatttcctttttaagtagaaacaatataaagagcttaattcagccctgaatcaatctcactttgttgccatgattgtgtaaaacctgaactgctttacgtctgtcttacaatgtttatattcccctgatgttccccgtctcagccggccgtgcagagtcccagcctttttaggccatgcacggctctctcttcttgaggctgttttcttgtgtgctgccaaagggctgtgcgacgagcagtgattttatttcatatctaggggttctcttcagggtggctattcagtggtgcccgcaaatgagcttccttgtctaagcaagttggaaggctaaattcttttgccttttcctttccattaaaagattattaaatgtaaaaatagtttgatacatacacatggtttggaaattaaggcactataaaaatgtatacattgaaaaatttcattcttacccctgctgggtcccctatactccctccctcaccccacctccattagctggaatgaactagtt

SEQ ID NO: 62268 - DNA, 1046 bp, Homo sapiens
ctctcttattagcccatgttacagataaggcagtaggattagaggggtgaaccactttgcccaaggtctcagtggtagggtgggatttcattttattcagatttctgactccaatggcaacaaatagccatgccactatattctgctggctctctgggaatataggaacaacagataatgatttgtctacatgactttattcccaagttaaacacttacctaaaacgcggctgcggctgccacccctgctgcagctttgcagtactgtgcaagaccttagaggccagtgatgggaggccgttagagctcctctgagtctgaaaccctcatttatagatgaggaaactgaggcccacaaaggagaagagaatgtgccaaggttaggggcagaatgggaatgagaactagaggagtctggagactttggcgcttgtggctgtttaaaggccccctaggctccctgtgtaaaagtatgtttttagacaacaatgggaacctttgtctggagggttggtctgaccagggttgaatatgaaagggtctgtgtgtatgtgtgtttctttcctttgctttaacctcagatacctttgaactagcaggaaggattctttcagaccaaaggttaagactaaaggcatttaacaggtggaaagagcataggaaggagggggaagatcagaagccacagaaatagaagactaaactccaggcttggataaaaggaattttccaagcctgtaaataatcactaacgtttattgaacacccactgtgccaggcagtctttacatgtcattttatgtaactgccatcgcttccccatgaggtaggtgctgtttaattgttcccattttgcagatgaaggaactgaggctccaagagtctaagtgacctatttaaagtcatggaattagtacaatgtagagccaggactccaactcaccagatcctaaactctccctttaactcccaaggcattttattggactaggtgctcccaggtgcctgagcatatgaggatatatgaaatagcaaacttagggagg

SEQ ID NO: 62269 - DNA, 1055 bp, Homo sapiens
agacagctgctccgggaggagggtctgcagccgccagcctgcattacagtttatgttcttggttttgtctttaattattaaaggcacgggctatttaaatactcacctgaagcatcattgtgagtaattttcccttcctggggtcaaaggagctccagcagggaaggggtttggtggcctatggttctgggttctccaggtgcttccctcaaggaatgcaaggatgtcatgaggacgttgtaagatgcccttgacagtagggtgcagacctccctgggctgtcttgcagattggcatttattttgagtgagtccttaatttgaggagtatagggtgttcccttttatcataggcaaggaagaaacagtgctgttagaagatgtaaaatatttaacactctctttaaaaaattaactgtccaggaacctttgattgctggtgcctatggcaacatgcatggttttcaggagtgtcttctcggagtccctgggctcctcagaaggggtgatatgggggtccatgggttaggggtgatgtgagggtccagtcttgggagggctggctgggaggccaagagcccacctgttctgcttggcttagaggctgggcagtagcagggctgagccactgcctcagagggtggtagtcgggggtggtctgttttgacaagtggagaggagtgaaggggagaaggagagctcgccatccttcttgggcttgctgagtttatgcatttgttttgttttactggcctctgttagtccctggtgcctaccgttctccgtccagcctcaggacttttgcgcatgtggtttccttagcctggaatgtaaagggagccttccttcctgacctggttcgtgcctcttacccctcagatctcacctggagcgtcatgttctggggaaattatctctggccctgcttcctaggtgacactctcctgtttgagggctcttatggttcggtggtctttgttacacttttttggaaaatcattgtttgcccaccctaccagcctgtagggttatgacaacagtggccagggctctttc

SEQ ID NO: 62270 - DNA, 1018 bp, Homo sapiens
ttttatgagatagtgtttcgaatactcccttttcagaggagatacttggagatgaatgatttactgaattgtagctcatttgggggagcttctggcttgtgacctaagctaagcctcagaatgtttcaatgagcaattaaagagctgtgaacagtggttgaccagagcactaaccattcaaaggcaaggataaaaggtgataatagttcaaggtctggagctacagccaacagctggccatgaacaatgtaactgactttggctaactcttcaagccctagaaagtgtctctgtgggtcctttggtggctccccctttttgtgtgcggttaggcatgtggacccgtccctgaatcttgctgtctcccattcttcttttgctacatctccctccactatccatttctttttcttacctctttctccttgccctcctccctcattctttctttattatcaacaatatatctttgtagtttcttttaatctattgccattaaaatttcatgttctctgttcttcatttcaaatcagtcgagggccaggcaaggtagctcatgcctgttatccgagcactttgggaggctgaagcaggtggatcacctgacgtcaggagttcaagaccagcctggtcaacatggtgaaaccccgtctctactaaaaatacaaaaatttagccgggtgtggtggcaggcacctgtagtcccagctactcgggaagctgaggcaggagaatggcatgaacctgggaggcggagcttgcagtgagccaagatcgcgccactgcaccccagcctgggcgacatagcaagactccgtctcaaaaaaaaaaaaaaaaaaaaaagacaaaaattagctgggtgtggtgatgggtgcctgtaatcccagctactcaggaggctgaggcagaaagaattgcttgagcctgggaggtggaggttgcagtgagccgagattgtaccactgcactccagcctgggggacagagtgagactccatccaaataaataaataaataa

SEQ ID NO: 62271 - DNA, 1034 bp, Homo sapiens
ccgcctgaatgaacggggactagtatgcgccggggacacggcgcctgcccgtgccgcccgtgccccttcttctccccgagtggctgacagcatcttgctaggcagctcatcaccgacatggacagcaagcaactcctttctccgaattccccgggcatcccctgctaccacctcgctgctttccgatgtggcttccttgatacgtggtagcgccattcaagatagaggggaaagaggcttgaagtcattatgtttccttcatgggggaatgtgctgtcgaattctgcatccccatgcatccgctgtcgtaagatggctttgaaattcaccagtgcatgctttctccaggcagacaagaatttattacgctattacattgctacgtaaaagcagaagggatcccactgagcatggctcgttttgttcagtcctcggtttttcccagcatgttctgggcgagcctttggatttttgttttaaacactgagcgttgggatgcccctgttgtcacagggccgacctgctgaaattgctggaattggtttcatcgtcaataggagggaggttcatctagagacatcatggaacctatctggcgtgtcaggcctctgactccatctctcccctcaacacccccccccccgcccagccccccgcgcccttttttcctcttaagtggaggcgggggatggattggctgtcttcactctccttgtgttttgagctcctctgcttagattcaattctgtggttttggttggaaaggtatcttggtggtgatcgaagagaggagggttggattaaaagtggggtggacacagaggggtcagcagcatcaatgacagaagacagatgatggacatatctacagccttcagacaccgatgaggcagatggctgtctacagagtgaggggcgtgtgtttgggctgtgagggggaggggtggaggaggaggatgcctccagcagttttctgccccgccctctggatgctgccttaaatagccccttgccaaccaagctctgatgtctct

SEQ ID NO: 62272 - DNA, 1140 bp, Homo sapiens
ttctttgagacggagtcttgctctgtgccccaggctggagtgcagtggcacaatcttggctcactgcaacctctgccttccaggttcaagcagttctcctcctgcttgaacctcccaagtagctgagattacaggcacctgccaccatgccctgctaatttttttagtaaagacggggtttcaccatgttggccaggttggtttttgaactcctgacctcaagttatccacccgtctcagcctcccaaagtactgggattacaggcgtgagccaccatgcccggcccaccttgcacatccttaacgttcaaggcttcctgcttcaatccctgttccaactgtcttgagggcccattgctggcaagtggccagtcagatcatgctggagggaggaaagtaggactagttcagttgttgaggctacaggagccactttgggctgtggttttacaggctcacctttctgttctatcctagaacttgcttatttcagttgtttttatgttgttgcccctggacttcctctgttccaggtaaaaattcatgcaggccccaaatttgcctcctatctgaccttcagcccctccgaagtgaagtcactccgaactgagtatggggacctggaattatgcattgaagtagtggacaacgttcaggatgccattgaccacatccacaagtatggcagctcccacacggatgtcatcgtcacagaggacggtcagtgtccagatgcttcccgcatacagtgtctgcctttgctgctttctgatcctgctcctcttagccccccttgggctgcagaaaaacatcatttgagtaggcttatggtaatgtttagtagtggttgcatttggtactttgatgagtgctttcacatcactttattatattgtcacagctggaggaggaggggcagggatgattagctctgcttcgaagatgactaaccctgtcagaggcactatcatttaatgcgtgcagcaaatcttacaaggtagttaaaataaacccattttacagctgaggaaaccaaggcagaaccaactctgcacattcattcattcattcatttattccacaaatatgtatgcagggacactcctgggtgtcagatactggagcctcaatggtggagga

SEQ ID NO: 62273 - DNA, 1087 bp, Homo sapiens
tcaatccatggagtcaaggaggccgtgcaactggtaggtccctgggaatgcaccaagtcaggcccagaggggccagatcaggtgtttgggaatttaaagcaaaacttaggccacacagagccaagacactactacaagcagacttgacactccagcaggcctgtgagccttcagactttaggccattctgcagagccagatgggtcctcagtggcttaggaaggcccctcccttacagctgcgtcttggcactatttatttacaagaatgtcaattagaccttcattctttgggtcacaaggcagcaggagtaccagaactagagtgtgaggcctaggttcctgtcattggcagagtgatctagggtaagtcagatgagaaactttacaaaagtttgtcataaactgtcatgcggtgtgttgagtatgagatcatgctgttatcactattattattaaggtcatcactttaactgaccatttctcattctcctcaactgtcaaatgaagtttgataataatagctactacttgttgagtacctactatgtgcaaggctcattttatccgttaactcatttgatcgtcacagcagtcccataaggaaaatatcattaattattagactcattttctacattgggaaaaaacagattcagaggtaaagtaattccccaagagtcacatggtgtgtgatagagtttagatttggacctaggctgactccagatccttttttttctttggctcatttgctccaacattccaggattctgttggctactgggaggatgtctacaaacctgctcattacacactcagtgaccagaatctggtttttttcttatgcccacatagtggttggaaagagcgcagattttagggattcaaatcccagccccaccacttcctagcttacacaggtgccctccctccttttcttcctattgatgtgtaacatacgtacagtaaagtatacagatcctgtgaaccactctgcgactgttcacacacacacatgtataaccaccagccgtatcaagatacagaacagtccaacatcctggagggcccccttgtgcccttcc

SEQ ID NO: 62274 - DNA, 1091 bp, Homo sapiens
gttgttattgccaatggaacccacccaaaggtgtctgggcacgtcatcacagacattgtggaggggaagaaagttggtaccttcttttcagaagtaaagcctgcaggtaaatagttcttcataaggtcccaaggcctgtgatgggaactagtgacacctggcttagttagagatcacaaaattgatatgctaatattatgaaatatggcattgttttgaacgctatttgcaaaatcggattttgctttgcttttgtgaaattctatctaacctgcctatctagacctattctctgcaaaatcactcggttaaaatatataagcattgattttctcaagaaacatttgctaggcctatgttagatgccaagtgctaaataagcactagagatgcaaagatgcatatgatacagtatgtgctctcgagtgttcacaaaggacagaattgcctcataatctgcattcagaagtgtaaacacattaaaaaatatcgccaaagtggaattcagaagaattctagaaaacaaagtatattgtctgccccagaaatacaggcaagttcttatgtttatacctgagtgaatctggcacattcttttgctattttattggtcatggtgatcccctgtgtgaaacaagcataccaagacatcatgtgttccttctgtgggcgtgatgagcttgtgcatgtgctggtagttctctctctagtagtagaactagagagagaactaaggtgaccatgacctgatatttgcacatattcttgcaggccctactgttgagcagcagggagaaatggcgcgatctggaggaaggatgttggccaccttggaacctgagcaggtaataaccttaggtgataatattgttatagttttcagagtgagtcatgctgtgtagttacaggagtcaaacctgctgactccatctttattcctagtgagccacagagttatctgagttacaagtctgattcaaatttgctctgccttttttctttttcttaattttattttccgttttatcttttatagacagaggtccaagataacttttcatcactatgatgttttgatcaagagcatcata

SEQ ID NO: 62275 - DNA, 1541 bp, Homo sapiens
ttgaacaagactctagcaaatcgttttgatgcagcttcaagcaccaaaatcgggtcattggtagactggcattcttattgtgattatcctaattcattttctactgagtgttgattttttagaacagtatctgaattttaactatgctcttggtggggtaaggggaaaagaggagtaggcacattatcagaatgctaggaacccctcactgtctttggagaaggtttggctagaattgtccaatctttcctgtactaatatatgaaactgaaacagcttccaaatctaaatctgtgatctcatagcactgtatcttctgggaagatcctaaccctaaatcctggagagttgtggagtagtaggttgagactgacagattgtgaaaggttattttttcttttcctgtaataatttgcactgcttatagttgccactgctttgctctacaatgggcattgatttcctcacttccctgattcacttactcctgcagagaggtagtatgtagcaagattgtcttaaagatttggaataatagaggggagaggtatattatagcacaggaaaagcagtaacttgagaccagaaaaatcactgcccaaaatgtccttcagccagtccccagcctccccatctgtgtccactttaggtcttgatttaactctagtttctcagccctttcttacccccactttttcttgtccaagctcctacttactctttttcaaagtgaaattgtgagggtttttcatcttggattgtatgcatgtaacatttcaggtaactattttatgtcactccacttagttataaaagggacatacactttatggtaataaatccagactgaatgccaagagtcacgcactctcctgctgactgagcctaacctctacagtgactcactcataaaactgggagtgtaaattagtgactgtttcaaagggtactgtgagagttaatgagtacctctgttgcatttcatcctgcttggaaacagtcacattaaacagtatatggctgctatgctgtttctgcaatagccacccttctttttcagttctgtccttaaagcacagcatcataagtagcaatggcagaattaaggacaccttgccaggaatatgggcagggctaataaatgttgtgctgaggatatggccatgatctgatgttgggaaacatttatttattaagccaggttatagaaataatgtaaggtgagtcttcctggagatgtttgtcagtgtcgaatcccttgttctctttttctggttaaagcaggtggtagtgcagtggaattcatttggatgagtaaagtacagagtgattggcaggtgccctggggaggcctgtcttggagacacttccatcaaagcagtattactgactcttgtctattttttaggcctttttgacagccccccaggttcagatgatgcaaagcttattgatatattttatcccggagatcagcagtctgtgacatttggaaccaagtctagagtgggaatgggtggcatggaagccaaggtaagaat

SEQ ID NO: 62276 - DNA, 1156 bp, Homo sapiens
tcatgcattttccatctatttaatccttttagattttggtgaccaatttggatttccatgatgagcagaagcgccggaacctcaatggaacacttcatgaactccttagaatgaacattgtccccattgtcaacacaaatgatgctgttgtccccccagctgagcccaacagtgacctgcagggggtaaatgtgggtaaagtatttctaagggtttagcatgctggagacactaacaccatgctatgctgcatgcactaacaccagaagtttggcataaacaagatggaaaagttgtgagagaaacttgtcatggagcagtgactgcataagctcttctgaactcgtggttgcattcaacagggtgaggtgctatagtcactgaagatggtgcgatgagcatggcttgtatatttcagtggctagaagactgcatgtttggaaaaaggattgccagtagacagtgtgttctgcagacagaaggggcctgcaagagccgtcatctacatatttgggttcattggttttgcctgatcctagcttggttttgcctgagcttggctgtgttcttccatgaatttctttttggactgcttagctcactcacttatgactttttaatctgcattctaggttattagtgttaaagataatgatagcctggctgcccgactggctgtggaaatgaaaactgatctcttgattgttctttcagatgtagaaggtacaaagtaatgcttttttcctttatctgccctttgttttaaatgctacatatgtgagcacatgagtttccctctttctttgagtccctctgatgtttttttgctatagatcattagccatatgttctgacaaagggcttttatgactcaaaacagggtgggtgagtctaagagatgtcatttgaatcctgaaatgttacttccaggtgctttcagttgttttccttaaataacagctttatggagatgtaattcacataccatacaattcacttatttgaagtttacaattctgtcctggcgtggtggctcacacctataatcccaacactttgggaggccaaagcgggaggatcacttgagcccaggaattcaagatcaacctgggtaatatagtgagtccctgtttctacaaaaaatagaaaagtcagc

SEQ ID NO: 62277 - DNA, 1011 bp, Homo sapiens
ttagaaacataacagtctttaccctttgcgagccagaactgggactccccacacattaaggtgactgttcagggcagtaaatatccaaataagtgggcccaaatgacagtgagcgatgggtccagaggtgggaaactcagatgagagtatggttgttcctggggcttcctaggagagctggaactcagcctgggccttgacaactgatgggatttgcacaaacagaggggaaaagttccatgctactaagtacacagtgtgaggtgcccctgcagttgtgcaatccagtggttctggggaagggacaggctctaggagtgtattccaggtagaggacaggcaggaatgagtatggcatgctgtgggccagggaggagacaagctggaaagcagaggtggtggtctcattaggaagaatgaaaaataaagtggatcattccattaggcagagctctgaagccaactaggtgagttggagttcagtctcaaaagcaggctgaagattttgaacggaggagaaacttgatgaaaacggtaggaaaaacctggtaaaggtttgcgtaggttaccagctttctttctagggctgcgtgtggacctaatggaagagctgtctccatcagggcctgactaatagacatcttatcatgtcagatggactcaggagccaacttaaactggcttccactggccataaatgggatgatgtaaacatcaagaaagggaatcacagctgggcacagtggcttacacctgtaatcccaacaccttgggaggccaaggtgggcagatcacctgaggtcaggagttcaagactagcctggccaacatggtgaaacctcatctctactaaagatacaaaaattagccaggaatggtggcacctgcctgtaatcctagctacttggtaggctgaagcagtagaattgcttgaacctgggaggtggaggttgcagtgagacaagatcgcaccactgcacttcagcctgggcgagagtgagactcagtctc

SEQ ID NO: 62278 - DNA, 1069 bp, Homo sapiens
gcaacctctgcttcccaggttcaagcgattctcctgcctcagcctcccagttagctgggattacaggtgtgcatcaccatacccagctaattttgtatttttagtagaaatagggtttcgccatgttggccaggctggtctcgaactcctgacctcaggtgatctgcccgcctcggcctccctcccaaagtgttgggattacaggcgttagccactgtgcccggccccatgctatttttgttcattactctttttttgtaattaagttttagattttgagctaattataaattcacttgcaattttaagaaatagtacaaaaaggtcccttataccctttacccaatttcacccagtatctgaaccaaggtattgacgttgatacgatcaagatacagaacatttcaatcaccacaggattttttatttctctttaacagccactgtcctcttccctattactaacccctggccaacattaatctggtctacatttttataattttgtccttataaaaatgttatataaatggaattatccagtatgtaaccttttggaattctgttttcttcagcataattctctggagattcattcaagttgctgtgtgtatcagttagttcctttttattactgagaagtatgtaatgctatgagtgtatcacagttagtgtaaccattcacccattaaaggacatctgggttgttctcattttttggctgttatgaataaggctggtatgaacattgatgtacaggattttgtgtgaacatagttttcatttctgtgggataaatgcctaagagtgtagttgctgggtcagattgtagctacatgtttagttttttacatagtttgaatgtatgtccctaccaaatctcatattgaattgtaatccccagtgttggaggtggggcctgtgggaggtgtttgagtcatgggggtgaatccctcatgccttggtgctgtccttgagatagtgagtgacttctcacaagatctggttaagtgtgtggcaccaccccctcactctctcttcttgttccctctctcgccattggagatgc

SEQ ID NO: 62279 - DNA, 1070 bp, Homo sapiens
acaaagcacatgctggctctaatgaaaggtagcagccagtcttcagaacatagaactttttcttagtttatacttcataaaagaaaacaacacaggtaattttatagttctttatgaatagtgctcttaggaaataagtggattttgagaaaattaagcatttgaatatatttttcttatttgcagctcaccaggacatgattatagcttctcaagcttatctaaaataaaagataacatatatatcaacatttttgatgaaatgatgactgaaaaacatgaggtaaagtagaataattacaatagccaatgctgaaataattctaaggtcaaactgaatgaagtctactaacatgtttgtaaatatgcttttagatgcaatgtctacatccaacattttcttgaaaggatttgaggcaatttgcaataaaatcagacatataacaagtcagttcaaaaataacagagatcataaaccacatacaggaggaggaggaataaatattatcaagaacttgggagaagtaggtttctgcaattgaacattacaattaaatgtgagcttcctgtagccaatacagaaatataaacagaaataggttacatatatcttattatctgatcaaagaaaatataccactcctgcaaaagagatcaaattattcctaaggctaaaattcagttctacttaatctaatttctaaaattactgtcatcctcatagatgtgtaaaagttcctagcacaatgcccagcaccctagcaagctccaaaataaacgttagtttcctcactattgaacttgctactaaaaatataaagatgcatacccatagtatctactcttttaaggtatgtagattaaatgctttaatagaaacgttttccaaattctatggcaatgctactgaaggagcaattaattctacctggagggcctggggatccatgtcagagaagttgaacaagaccttgaagagtaaggttcaggaacgagccttctgtaaaaaccactgcaaatcataatggctatgttttccaactcagttttccaggagatacaacacacat

SEQ ID NO: 62280 - DNA, 1037 bp, Homo sapiens
cggcctgccttctccttctgtgtgtcgcgccagttgttctgaatctcggctctctagaaggtctagtcaggttctttactcactatcttccgggccagaaaaggcgagtttgctcatttgctcaaggttaattaacttcttggctccttctctgggatgtatcaaaagaacctgcaacctgaatgagtagggagatggtagttgggccagggaaggtggaaaggggcgttctggcttccaggtgggtcatgaatttgatcttgtattttaaaagatatatacactgaatttttgttgggcagaacagccctctttgttcgagagttgccgttgcatgcagccagtttaagtcgcttttgtacataaattcctcagcctttccgctaacttgccgtgagacgtggacaagtgaaatttctgtttcttgatttcctcatctgtaaaatgaggaataatgagtgtgccttatgattctggcgattgtgaaacttaagttagtaccgtacatgtgcttagaaactgctcttggtatatagtaagcactaagtgataacttcttatcacttacccctcaggatttgggctgttcaaaagccctaaagtggagggagttggctgccccttcctgctgatatcaaaggcagaaagtagacttaatagatattggaaaaaaatacttttccaacacaaagcaaagtctgtgtattgttgctattaagtaacggttttactctgcatgtggcaaggcagattaatgagacatttctgcctcttcgataaccaaaagagagaccagatccaaaatgatctctagcttaactcagtttcaccttggataaagaaagccatttgttaaatgtagaaaattgagaaagaagcaaaacagctgactttcaataaaaaggattctgactcttggggttgagatcctggaatgataatgaacttttatcttgagtttctgaccaggtcaagtagattggaaaacctaattctgacttaaattgttacccttttctaggcctgagatttctaaa

SEQ ID NO: 62281 - DNA, 1023 bp, Homo sapiens
ttcttatattagaatactttctactgactaaataatgagttggcttaatgaactaaaagttaatgtgcaactactataaatgtgaaaacttttgcttatgcattagaccaactgtgtagtaggctccaagatacaatctgatacaaccatatttgttacttagtacagaatatactggtggatcttttggcccctctttctctttacatcttcctatacctcatttcattgctcgttggtactctcactgaagatagggcacgtaaaggaattgaaattgtgtttttttttcttttaataatgtggaagattgtatttgatatggaagttgaatcagtaatatagtttctatattcatgttattacaatgaaatttatagtatgtagatgtattgataaccttcacttttaactctcacttgagggataaagattgtatttgatattgaagttaaatcagtaatgtagtttctgtattatccatgtcattataatagaatcttaaaggagtatgtagatatactgataaccttcacctctaactctcccttgaggttttggggtcaaatatggctgggatgaaataaggaacattccccctatatccatgccaccagagttctttagcacttctgtgcctggctgcttataaatctaaaaccaaatgtagtcctatgtagtatcatttctggtactaatctcttctcagattttattttctgacctttattcttcctttgatctgatgacctcaactacttattttgtccccagaatgtccctttgtaagttatttcagatccattgtagaaccaggctgaatgtaaataaaacacagctgcagcatgacttcccactgcctatatattaaggtggaaactgcttaatgtagtgtttagaatctttcatctggacccagccacctttccagtctcatccccatgtacgttgagcaaaattcttagaataccatttacttcctgaatatctacatttccccttaatctactgttctctaaaatt

SEQ ID NO: 62282 - DNA, 1048 bp, Homo sapiens
gagaatggcgtgaacccgggaggtggagcttgcagtgagccgagatcacgccactgcactccagcctgggcgacagagcaagactccatctcaaaaaaaaaaaaaactatcttctactctaaaatcaaataatttattttaccagctaccacccacctgcaaaaaaaatttcctgaaaatattcagctgatgagattgagttatttttttcactggcacatgactatttccattctatactagaacacagatcaaaatgtttatgtatttcaagcatttttttttaggggattggggaaaggttggggatggtggcactgggaaagaaaacacagggttctggcacaattgtatctgtgtaaggtaagtacgtctttggatctaaatcctggcaataagacagcaaatcccattttactgactagaccaataatgatcacttgcctgacattttctctcccctcccatccccttttcttataaggtaaatttgaagaaaaagaagacagtgtgcctaagctggagcagctcaacagcctgggttgtatgactaatatgaatctagtattaacaaaacaaaatttgctacatatggaactattattattagaaacctttcagtggaacctctgccttccaacagccgcccatttcattgagtattatctctctgaagcagtacacgaaacagatcttcatgacggctggccaatgatttgcttggaaaagactaaactctacatggccaaatatgcagattacttcctggaagtatctttgcaaggtgggttgttgtgaataccagtaagtgacttgtgcacttgtgactcgtgtattctgttccttaagttcatttttggtgtctccacagattatgcctttctaaattatgcaccttctttagtagctgctgcatgtgtggcttcttcgaggattatacttcgtctttctccaacgtggcctacaagactacatcgtcttactgcctactcttgggatttcttagtgcagtgtattgaacgactgttgatgtaagcctttttattct

SEQ ID NO: 62283 - DNA, 1056 bp, Homo sapiens
gcatatctcagtgcaatccatgatttatactcagaatcgacattcttaaaaagttatttcaagggatggcataactgtaagaggtcagtgctagaataaagtcctgtaggtttattttggaagggactgtggccagggtagttctcaggttgtgctagagcagcactttgttatgtggaagacaggttttttaagcaacctttgaatccagctctagtcagtctaagcaggcaaaggtaactgatgactaaatttcagtagctactttcattggattgaccctacaactgccctgggacatttcactgtaccagtattaactgcaaacagcaataattgtcattacagcaagggcagtttgggggtaaagcattttggaggaataaccttaaaaagttaaaaagtcattgtaataactgataaactgtatacattgtgctcctttctgtgggagaagaaagatttggtggagggaagctttctggtttaaaaattagtaaggtgtgtctttttgttttttttaagatagcacttgaatagaagggaaaactgcatggcagatacgtgactgccacaatatgcatcgaagacaaacttactataaagatgttgtgggtatgcagcaggagtctcagtaatcaagccaatggcctttgtcaggaagggaaggggctcaacacagtgatggactgatccagatggctcccggggatgaatgtgggtgggtagcttctgtcagtatcaatgcttagagaaatatcctttccttaaaaagaaaataacttttatatttagagtacatagggcatgatgtggatttattagtctggtagataaaatgaaaaaccactcaggtaagaacactcactcatggcagtttttaagcatgaaaattgttttctgaaagtatcatcacttttcctttttaaagaaggctgctaattggattttggtagttcttacctcaagaaaacttgaattatttgggggaaagtaggctcaaaagagaatatatctttcacattcacattcagaacccagcaacctggagtccaa

SEQ ID NO: 62284 - DNA, 1130 bp, Homo sapiens
attaattgcaaatagcaagtatggtgctaaagtctacaccaatggaattagatgagtgctatgcacttaattttaaaataaaactagttttcagtaaaatggcttcggtatttttgttttaaatacaaacttgtatatttgcagctctagtgaaccatctcatcatgtaattcagacttggaatcatgattttatttactaaaagccatcaagatgtagaatatagccattagtggcataaaacatccgttcattgcgtattccatactgagcattaaagcccacaaaagtatattggacaccactgttgcctttttgagcttaaaatcagttgttagtatgttagcaactacagattctaatttattcaacaatcatgcaagcatcagaaaatctgaagtttgatgtcaaaagtagggacacagaaaatggttaaagctatgagaaggaatatagggtctacagtgagtgagaatggtctatttacctgagtataaatatcatttgctacttaattcaactcaaaccttagcagatggaatttgttttgaaaagtaaaatttaacaggtttgtacaagcgggttaggaatttacactgcctttttaaaaaacatttttgaaattagtctcaaaactatcgtattgtcacttgttctggcacagtgccagggtttagcagccctcaagagttaatataccatgttctttagggctgactttaagaaaaagaaaaagcattccaaaccaggccaggtagctttgccttgaggtgatctgagccccatgtggcaagtttataaccaacaactgcctctcaggcacgtggtaaaagcctccctagcctcaagcagcttacatctagtttgataaatacgactagcacacttgcagcaattaggctagtagaggcccgcacggtggctcatgcctgtaatcccagcattttgggtggctgaggccagtggatcacttgaggccaggagtttgaagccagcctgggcaacatggtgaaaccctgtctctactaaaagtacaaaaactagctgggtgtggtggcacgtacctgtagtcccagctacttgggagactgaggcacaggaatcacttgaactcaggaggtggagactgc

SEQ ID NO: 62285 - DNA, 2339 bp, Homo sapiens
cgccggggccgcgcgctagatggagaggtcagcggcgaacccagctccatggcctagtctcgtcagaccgagcgcggaccctgccggcctccgttctcttccgcttgtctcaggtaaagcgcagatccctccgccgcagcgtgcgctcccggtagcgctgcgatcagcttttcggcaatacccggatggaagtgtaatggccgccatcagggactcgcaggcaatgggtactacgacaggtattccccgtcagcgggactgcccagaccttttaggatgtcagaacttctagagggccacccagcaggcaaacggcgagtttgtggaccgtcagggtcccccaaacaggtccagggatccgcctcttgtgagaggaagcgcgagttaaatagtcccggccattcagcgcttccgcttaacttgccgcaaagtttttctggagaagtcggggtttttttgccgagcgcttttgccgactgctagagcttacccttactttcttaacctggggttgttttacttccgggctttttgaactctacactctcctacattctaggagctgggtgggagtaggagacggtgtgcctccgcgctccccgcggggcagccgaaccccggaggaaggggcggatcgggcgcggtgtttggggcgaagctgggcgcgcggcgctcgaagcactcactcggcgggtttcgtggttggtggagacagcaagggcgccccgcagaccgcacccctcgagctataggttcgcaggcccgactcgacggcgtccctattgctggcccagcgtatggtcattgggggccatttcttgcagagatgccctgctccctgacgcgctcgctcttctccagagttggccaaaggtgctcttccccgcagaccctaaccacacccagtggcagttggatttctttgtaactggctttctcacatgtagggttcattttgactctattcgttacatggtgtcctctttgtcaagtagacagtctcttcctaggtggctgtggtaattgaaaagtacatagagcgaaatgtatataaggaaaaatgttttaactcttaagtggaccgatcaaacagatgtagctttaaagttcagaatacaacagttaagactcagttttctttttaggtttaaatttgagagcaagtagtgtatgtgagctgttttagtgcaaacattgttgagtatgttgtcaaacgtctaaaaaaccctagaaaaataaaataagtcaatgttcaaggaattcataagaatgttggaatttgtacagttgtcgcagtgataaaacatgaagacaccaaactgtcaggataggaattctattaacttgaaagtgtgcatgttagatctagttactggtaattgttgaattgctttttctgcagcaaggggtctgatttgagtgtactctaaggttgatatcctcaggtttaatttaaaacatttaaattgattcagtgaaatttcctaacattttttgagtttaactgcaaatttatagaaatgcattcactatctttcagcaaaattgtcttttctgaaatttataaagagacattgcgttctgttaacactttgagggtgttgggatttcctggggaaggtaagcatagtaaacgatgttgatttttgccatagaaactgtaaattagatcatccctagatacagaaaattgccaacaaaaggggagaataaaatgtaggtatgttacacaaccaaatgtttcctgtttgttgcgtgaaaataagtataattaccaaataaaacgttttatatctggttttatggaaggacaaaagacagtaaccacaatgaacacccactgtgtgcattgataatgtatgaacttttaaatgcttcaattttttgccatggtcacacttcggattctgttctagtctctctggtaatagtatgctgtaatcccagaagtttctatattttgaaatattacagagggactatactttagcctagatctataatttgacttcaggatatgctttaaatgccctttaagtgtatttttgttgtttacttttctgtttatagttgtttagaattgttctcattgaggcattgtgacattgcatactttagagcacttaatactactttttttttttttctttaaatgataggagacttgaatcttgcccacattccttcaggtatgctactgaaggttttgtggcaaagtgctattagcagaacaaaaaggttttaacaccgtcttgaaatttttatttattatctggtcccaggtgtgtaggctgtgagtatttcagttctatatggggtattggcttctcatggtgagc

SEQ ID NO: 62286 - DNA, 2598 bp, Homo sapiens
tagtgagaccccatctctatttaaaaaaaaatgtttttaaagataaggaacagacttaaagtgatgattgattgctcatagaacgttcattttgggctccagaactaggaatgatgtagaatttattgttgtgtcattgtctcattaaatgctgtagtttcctatgtccttgcctaccttctttcctcagagcctcgcatctgaccctcagagagtagcagttggattattccattataccaaggttggcaagcttttgctgtaaatggccagatagtaaatattttaggctttgtgggccatatggtttctggtgcaactattgtaacacaaaagaagccataggcaatatgtaaatgagtgagtgtggctgtattccagtgaaacttaatttacaaaaacaggcagcaggccagatttggcctgcaggccgtcatttcattccacaaactctctcagtcacatctgcgcacctgctagcatctttatttatcctcccctctagttactatagatggatcatgtttgctcctttctaagttcacctcttcagctcgttcactagattccgtccgttctaacctgaaggacttcactgctgcatttctttcctatcctttatcatcaatttttttatttttactagatcattttaataagcgtgcagtcatactgtaattcctcccacctttaaaaaacaaaaaataaattgaaacaaaacaaaacaactcctttatcttaaaactccttgaaagagttgtctgcactgcatcactacttcctctcttcccattttgccttacatccaagcttgtcagcctttctcctctaaaactccactgaaactgttctaatccatggtaccagtgatcttcacattaagtctagttagtcatcttcttacttgacagagttgttcaatcccttatccagtaaacattttcttcattttgctttgaggataccacattcttgatttaccttaactcttattggtcatttcttttctgtctcacttgctggttctttttaatctctttctgttggatgtgttatagaatcttgaggctcaggccttggactgctctttttgtttattccccctggtgatttcatcctgctccaagtacttgaaagtacatatgtacatatacacacaccgataactccccaaatttcatcatccacctagccctctgtattctatatccagccacacagtccacatttcctcttggatgtcaaatagacatctcagatattacatgcctaaaatggaacttttgataaactttcctattactttaacaatcttttatatctcggtgaatagcaactcagttctttccaatgctgtcagaacttctagagttatccttgacatgtctctttctttcagagaaagcatatcaggatatcttgtaggtgctagcttcaaaatatattcaatctgaccatgcctcattgtctcagccaaaccaccatcaactcttacttggataattgtactgtgtagtctttgtctttactcttaatccctcctgaatactctgttcttagcatagcagcccaagtgatagaagtaattcgactcatggtaattctctgcccacaatgctccagtagcttcctctctgattcagaataaaaccaaagcctttacagtttctatcagggcctgtttctgtccccttgttacttctctgacctcatcttctagctttccctctaatgctttctgttgtggtcatactgattttcttgctgttccccaaatgtgttaggcacattgcacactcagggtcatgtcactaacttttgttttcttggattgttggcttcctcagctctttaagatactgactccaataagaccttttcaagtcgagggctccctgacttaatatgtaaaattacaacactctgattctgcctttctgtctttgctttatttttctctgtagcaattgttgcctttgaatatactttataatttacttactttgtttattacctaaataatcagtaaaatgttacctccgtgaggggagggatttttgtctgtttggtttactgccatattcccaatgcttagaacgtagatgtggtgctagctacaagtctggcagcatcccacatgctggtgatgtagtaaaggacattacagatgtagttctcacccttacgcaacttatattccggtggtagagacagatagaaaataaatgggcaaataaataaaatattgccagagatattaagtgttacaaaaaaagaaatagaaaaggataaagtggcgaattttttttttttttttttttttgaggaagggatggtttatagggaagggcccttctgaggtggtggcatttgagctgagacctaaaagatgagaaggatgtagccttttgaagaatggaagaaagcacatttcaagtagggaacagcaggtgcaaaggcctgagataggatggataggaagaatatttgaggagctgagaatctgtggcagcttgttggagtatatgtacaatggggagagtggtgtgagatgaagttgaagaaaaagacccaagaccagataccgctgtttcttgc

SEQ ID NO: 62287 - DNA, 1334 bp, Homo sapiens
tggtctcggctcactgcaagctctgcctcccaggttcacaccattctcctgcctcagcctcccgagtagctgggactacaggcgcccaccaccacacccggctaattttttgtatttttagtaaagacggggtttcaccatgttagccaggatggtcttgatctcctgacctggtgatctgcccgcctcggcctcccagagtgctgggattacaggcgtgagccaccgtgcctggcctgattttttttttcttttacctcaatctgttacagctgataattttaaagcataataaaaataaattgccagaataatgaaattttaaaaatgaagacatacaaaacataagtacatgtttttattattagattcaacagataagtctaactctgaaaagtttataaatgtttattttcggttttggtacttaccttgtcatggactggtgatagatggcttatgggccatcagcagaccatagtttaaggagcattgctgtcgcctaggagccaacttagaagcagaaaaaaaggggatatgaggtgagggtttgtgtctcatgtatatggtcgtttaatcctcttggttttggcatagtgcctactctctcccctgtgcctggtctcccctaaaacaaagattcgttttacccactgtagagagtaagcctctagacttctgtagtggggaaacaacagtaaccaatagcatgatagagtggggaagagaatcttagcatccaactataagtcaaccaactttctccaaatttctttctgttttagcttcccccttcctccttcctcccacaagctggcagttcttaggcctcgtaaagattcagaatgtaaaatgtgttagttcctagctttcccagctgtctgcaaggtcatttatctgtttttcagtatccaaaattttgttgctattgctccctcttctgttttccattgtgaattctgctgtaagggattctaaatatttgatgtcacaggtgttctttttctccatccagtcttttctgcttttttaactatattaataacaatgtttatattcaatgtatatattttcctcaaagagtacatatgtagtatattttctgaatctttgcatatctaaaattgtgcttttccctcacatatgggagcttttctggatgtgaaattaatcttgggttacctcagaactctatataaatgttactccattgtcttctcgtgtttagagttgtgaataaaatgtctgattaatattggtgtctgggccgggcgtggtggctcacggctgtaatctgagcactttgggaggctgagacgggcagatcacgaggt

SEQ ID NO: 62288 - DNA, 1582 bp, Homo sapiens
atttttagtagagacggggtttcaccatgttggtcaggctggtctcaaactcctgacctcaggtgatccgcccccctcggcctcccaaagtgctgggattacaggtgtgagccagcactcccagccttactgcagtaactttcattatggtcactgctggatgggagaacaggggagaggtttctctgagggttcagattattttctctttttagagctgctgcatccagtgatgtttctgcctacttatcttttttgttggcattgttgggtgggatgaattcctaaagaatacaccaagattttctcagtgtttttgttaggagaaggggaagttgagagttaacctcatttatttttcttacagtgtagagataattcagttatgtagcgaaaggacagggctcttaaacagaggaagatagccatgggtgtaggaagattcgtctttgttcagaaataatgtcctctttgcatctctcctaacagttggtgctagcaatcccctactctgtctggcctctggatctagcttgaagttctggattcatttccttcttccttgtacctcagcctgagccttctgtcacccaaagggctccagctggtttttcactcaggcctcactttatcttccaaggtatgtttaggggaagttgtaggcagaattatgtctctcacttccttacttgggcataatgggcagatcctcattaaatattgattggatgaatgttcctagtgaactccctttttaaaaatggtgtttggcagtgggtcggcatttgtttttactcccctctcaccagactgtttgctgtcagacaccttgccatatgtatatggaatgtttttctagttcctagccattttgtaggagtttttaaattatattttttggttgtttcaatgggcagttaggagaaggaggaagtcagatgttttcagttgccatgttcatataggaaactacagattattttaatacttttacaaaattgtattatttcaagacttattgagatgttggtcaagtcttatgctgtaataatacatatatagaaggcagtagtttaaatagcacatttaaaaccagtaatctgggctggacgttgtggcacacacctataatctcaacactttgggaggccaaggcgagtggatcgcttgagctcagaagttcaacaccagcctgggcgacatggcaaaacctcatctatgcagaaaaatacaaaaattagcggactgtgatggtgtatacctgtagtccctgttacttgggaggctgacgtgggaggattacttgagcccaggaggttgaggctgcagtgagctgagatcacgccactgcactccagcctgggcgacagcgagaccctgtctcaaaataaataagtaaaaccagcaatctttgttggtgggtagagattggactgtagtaaaaagagcattagctcataggttggaggattacaattgtaataaaatttttctttttttatgttgagacgttcacaacatgccaacattttttgtccatacgtggcaaccttagtataaattgctgtcagatatcatgttt

SEQ ID NO: 62289 - DNA, 1992 bp, Homo sapiens
tgattaacattcctactttgtgccaaaatgaacttacagatacgaatttactattatttttgtgatgagaatttcaattctttgtttaattttaggtgagttattgtgggaaaaatcctgtatattgaagatgtctctacacagtatcgtttcctgtttaaattacagataacttcaagagttttcagaaaaaaagaaattgggacttttttggttaaatcatgccatctgaacagaaacagttattttgtgatgaaaaacaaactactttaaaaaaagattatgatgtgaaaaatgagatagttgataggtcggcacctaaaccaaaaatttcaggaagtattcattatgcactaaaaaatgtgaaaattgatttgccaaaaataaatattccaaatgaagtcctattgaaacatgaagttgacaaatacagaaaattatttcagagtaaacagcagactgcaagaaaatctatcagtataaagactgtaagctgtgtagaggagtgtacattgcttcataagtctgagagagctgaagaagagggtgtaaaaatgtctgcaaaaatactcaatttcagctgtttaaaatgccgagacaacactcgatatagcccaaatgatttgcagaaacactttcaaatgtggcaccatggcgaattaccttcatatccttgtgaaatgtgcaacttttcagcaaatgactttcaggtatttaaacaacacagacgaacccatagaagcactttagtaaaatgtgacatttgtaacaatgagagtgtatatactttactgaacttgacaaagcatttcacatccacacattgtgttaatggtaattttcaatgtgaaaagtgtaagttctccacccaggatgttggcacatttgttcagcacattcatagacataatgaaattcattataagtgtggtaaatgtcatcatgtatgttttaccaaaggagagcttcagaagcaccttcatattcattctggtacttttcccttcacttgtcaatattgtagctatggtgccaccaggagagaacaccttgtaagacatgttataactttgcacaaagaacatttatatgcaaaagaaaaactggaaaaagacaaatatgaaaaaagaatggcaaagacttctgcaggacttaagctaatactgaaaagatataaaataggtgcatcaaggaagacgttctggaaacgtaagaaaattaacagtggaagtgacagaagtatagaaaagaacactcaagtgcttaagaaaatgaacaaaacacagactaaatctgaagaccagagccatgttgttcaagagcatttaagtgaagaaaaggatgaaagactacactgtgagaataatgataaagcccctgaatcagagtcagagaagccaactcctctgtccactgggcaaggtaatagagctgaagagggaccaaacgctagttcaggtttcatgaagactgctgtactaggacctacactgaaaaatgtaatgatgaaaaataataaactagcagtttcccctaactataatgctacgtttatgggcttcaagatgatggatggaaaacagcatattgtattaaaattggtgcctatcaaacaaaatgtatgttcaccaggctcacagtcaggtgctgcaaaggacggtactgctaatttgcagccccagactttggacactaatggatttttaacaggagtaacaactgagttaaatgacacagtttatatgaaagcagctactccattttcatgttcatcttctatactttcagggaaagcaagttcagaaaaagaaatgactttgatatctcaaaggaataatatgcttcaaacaatggattatgagaaaagtgtatcttctttgtcagcaacatcagaattggttacagcatcagtgaatttgaccacaaaatttgaaacaagagataatgttgacttctggggaaatcatctcactcagagtcaccccgaggtat

SEQ ID NO: 62290 - DNA, 5021 bp, Homo sapiens
ttaaaagtccagataaagtcaactgtgttgccaaaccaaatgcatacaacagtggagatatgcataattattgcattaattatggcaactgtgagttacctgttgaatcctccaaccaaggatcattaccttttcataattactcaaaagtgaataattctaataaacgtcgtaggttttcaggaacagcagtgtatgaaaaccctcaaagagaatcttcatccagcaaaacagttgtccaacaaccaattagtgaatcatttttatcactagtgaggcaggagagctcaaaaccagatagcctattagcatctattagccttttaaatgataaagatggaactttaaaagcaaaatctgaaattgaagaacagtatgttttagaaaaaggacaaaacattgatggacaaaacctgtacagtaatgaaaatcaaaatttagagtgtgcgactgaaaaatctaaatgggaagacttttctaatgtcgattcacctatgatgcctagaatcacatctgttttctctctccagagccaacaggcatcagaatttctgccacctgaagtaaaccaattgcttcaggatgtattgaaaataaaacctgatgtaaaacaagactctagtaacactccaaataaaggcttgccacttcattgtgaccagtcatttcaaaaacacgagagagaaggcaaaattgttgaatcttcgaaagatttcaaagtgcaaggcatcttcccagttccacctggcagtgtgggtattaatgtgcctacaaatgatttgaatttgaaatttggaaaagaaaaacaagtgtcatcaataccacaagatgtgagagattcagagaagatgcctagaatttcaggttttggcacattacttaagactcagtcagatgcgataataacacagcagcttgtaaaagacaaactacgagccaccacacaaaatttaggttctttttatatgcagagtccacttttaaattcagaacaaaaaaaaactataattgttcagacttcaaaaggattcttaataccattgaacattactaacaagcctgggctaccagttattcctggaaatgcacttccattggttaattcacaaggtatccctgcttctctttttgtaaacaagaaacctgggatggttttaacacttaataatgggaaacttgaaggtgtttccgctgtcaaaaccgagggtgccccagctcgtggaactgtgactaaggagccttgcaaaacacctattttgaaggtagaaccaaacaataattgtcttacacctggactttgttccagcattggcagttgtttgagcatgaaaagtagctcagaaaatactttgccattaaaaggcccttacattttgaaaccaacgagttctgtgaaagctgttcttattcctaacatgctatctgagcaacagagcactaagttgaatatctccgattcagtaaaacagcagaatgagatttttccaaaaccacctctttataccttcttgcctgatggcaaacaagctgtttttttaaagtgtgtgatgccaaataaaactgagctgcttaagcccaaattagtccaaaatagtacttatcaaaatatacagccaaagaaacctgaaggaacaccacaaagaatattgctgaaaatttttaaccctgttttaaatgtgactgctgctaataatctgtcagtaagcaactctgcatcctcattgcaaaaagacaacgtaccatctaatcagattataggaggagagcagaaagagccagaatctagagatgccttacccttcttactagatgacttaatgccagcaaatgaaattgtgataacttctactgcaacatgcccagaatcttctgaggaaccaatatgtgtcagtgactgttcagagtccagggtattaaggtgtaaaacaaattgtagaattgagaggaacttcaatagaaaaaagacttccaaaaaaattttttcaaaaacaaaaactcatggaagtaaagactctgaaactgcctttgtatctagaaacagaaactgtaaacgaaagtgtagggatagttaccaagaacctccaagaagaaaagcaacattgcatagaaagtgtaaagaaaaggcaaaacctgaagatgtccgtgaaacatttggatttagcagacctaggctttcaaaagattccatcagaactttgcggcttttcccttttagttctaaacagcttgtgaaatgtctaggagaaaccaaccagttgtagttttgaatcatcctgacgcagatgcaccagaagtagtaagtgtaatgaaaactattgctaaatttaatggacatgtacttaaggtttcattgtcaaaaagaactataaatgctttactgaaaccagtttgttataaccctcctaaaacaacttatgatgatttttccaagaggcacaaaacatttaaacctgttagttctgtgaaagaaagatttgtgctaaaattaacactcaaaaagacaagcaaaaacaattaccagattgtgaagactacctctgaaaatattttgaaggctaaatttaactgttggttttgtggtagagtatttgacaatcaggatacttgggctggtcatgggcagagacatttaatggaagctactcgggattggaacatgttagaatagtttaccataattaccaaggaaaagaaaagtaaaattaccttagaagaaaacaacgggttcagttaccataatgcagacattttctacttcagtatagtacctgaaatcgaacattttaaaagttgattgtatttctgtggaagagtaaaagttgtatgtatgatatttgaaaatgctatccctgcactcaaaagttttgaaagaaactaatcacagcacagaagtaccttgatttaattttttaaacgtgttctcgggaagttagggctaaagaaaattttgataaaacaattttcccactttagttctttagtgactcttagtagagggtaatggctgacacccccattccctctcttcttccaccagccttatgcatctaagtgtagctcctctggagatggagagctctttcatcgtagaactgaaggagtttctcacatttgtgaagatactttgagagaacctgggtaaagaagtcactctatatctgctaaatatagttattttgaaggatattaggctccttgaaagtacatttaactcactacagttacacctcatacaatgcttgaagagtttttggcaagtaaattttttttccagttgaactctgtcacttgttagagattgggaacactctcccaaggtgattttctttttctaagtgactgtgtcaaatgttgcagtagatgggcagcttcaagagaagaatttaaactctttgtctcattgaaagtttggttaaagaacttgaacatatttctaaatttgattatattctctgatgatccctttgcacagaactatgcttatctcatgtttgtcctccataaacaaatggccatttttttcttcttggttcccatccctttaaaaagagtggaacataggagcacttccaagggagtggcttttcttgaaaattaaaattgtttaccaaaacagtattttgaagcaagatcatatttttgtctgtattcactttattatttgaacatgtccaaattaggacaaagcatttctgttagctgcttctcagtgtgactgacaacccaaaacatatatacagattgttggcatttgcaaaaggaagcatcaatagtggacccagaggcagtgcataaaaccttaggatagattcctaagggacatgcccaacagagttttaaaatggatgttttcatgatgacaacagaatcatagatttagatttttcaccttgtaagtttggatcaaattttgctggttctttggataatggagttcttgtgttaacaaattacgtgctatatgattttttgttacattgttacaagtgttaatgacattttcattaatggatgaaaacttcagggcttcttttctgtatataacaaattaagtctgtacatatttttgtaccttttatgtaaattttgcacagaaatttttggcataagtttattttctttcagtttagttcagtgcatgcactaataaaactggttgtttaatttaaaaggaatatataagactttacccatgttattttcttggtttttatttcagatgtagattttgtttttgaggtaaattcgttcttcagggattgaacactattgttagcaagtgcctaaaaaagatgtgaaacagtttacatatgtcaactgtaacagtaggtcccaaatgggcccattcccctaatagttttatttttaaagaaagccatacatagaatgcttcaagctatcttgctatgcacattatacttgtactgttttgtgcagtttgtctactttcttagtgaagtattttttgtataaaatgttacaattgtgtttcttaaattgagcctaagaatggagttaattggaaatatacagtatatattaataatgtacatggtgtttaaagaatggtaagcattgttaatttctgtaatgaacattttcaattaaatttatcttgtttgtgtttacacaataatttttttactgtgctaaaatctgatggaaattttgttctctaggaaatacagattttaaagtgtatgtgttttttcaatgctagttaactctacaagatagataaaagtgtgggattttttttcttcccaaaatcatagatgatatattgtttaagaaaggtaacatataccataattttactatggttatgctggcaaggtgagccatagagaggcttatagtcttcagtaccctaacagcaataaaattaaaatgctctgtttgttacatatagatctgttatgagacatcacctgctgtaaatagcaaggagagagaaggaactttcctgctaatattcgcagcactataacattacatttcagaatagccatatcaggaaa

SEQ ID NO: 62291 - DNA, 1039 bp, Homo sapiens
gctgtcagtgtgtttttcttcgtacttaatacagcaaagtccaaggtctgccaccttgaaggttacagcctttgttaaactagatttttttgtgcagaatgtcagctggggtgtaataacttttactaacttgagaatgagagaagatgggaggagtggagctcaaatttaacacaaatgccaaagtataattcatctatgttttcttcctctagtactttggaagtgttgctgaaatcatcaggaatcatcaacatagtcctttggttcttattgacagtcagaataacacaaaagattccaccagactgaagtatgcagttaaagtttcataaagggggaaaaaaaagatcaataccattgcttcagacactttcccaaagtttctccttttgagaaaaagtcccaaaacttcatattttggattatgaatcatccagtaataaaatggaagatggagtcagctattgaagtggtcatccatttctttttaagaagctcatgtggacttgttctattgcctgacctgatgaactgttaatatctggtgaggttgagttatcatgctactaatattttccaaataaatatttttatttttaaaaataagtgtaaagtatattatcaaaataagaaaataatgctcttgcataaaacaaagtggctggaaatttaaacctccacaatgatcattggtacactaatgtagctgggctctccactgccaatgcttgacaattaagtcttggttaaaattttaatttgtagaaaataaggtattaaaggtaatgtatgatatctgtaagtataggcaagaaggatgtaatggttcctttttgtgagcactctcaaccatgggatatatatatatatggatatgaactttctataagttcttgtctaggattatgctgttagttttgcttactaaagataattataccctctttgatctacatgtctatcaaatagaacctaaacttgatatgaggtttgtattagtccattatcacgctgctaataaagacatactcaagac

SEQ ID NO: 62292 - DNA, 1986 bp, Homo sapiens
tgtagggtttattgaaaatgtgtgggttaaatgctttcaggtacaccaattctttctactaaattgagctctatttgaagttctttggaatctgtggtgaaaaataattttctgatttccaaatacattaagagcattaaatgaatattaatcacctttaaagtcttttagaaaaggacttgtattggtttttggctgcatagaggggttgaataagtgtatgtatgtgtgtgcgtgtgtgtgtgtcttcttaaagaagatgtaattcacaaatagtttagctccctagcgctcagttgtagaatagaaaatagaacattattcaagttaattgaaaggtgaggtttttatacccccactaatgctgtgtatctgtctttcgtttgttaacattatttgcttaatttctttcaactcacactttggataatactatcaaaaactaaggctaaacattccttgtgtatctttaagcatgcttctcctgaaatttaactacattagtagttgacatttgtatacatatatcctaatacaagagtaggataaggtggaaatgtaatggcctgagggatggtgaagcattcttttagtatttttcatcatgttgggctcctagattgtactggggttgcccataaatcaaaccccatactcttagaattcattatattatggtgatatccgaacctagtgaatggtatgcttgggtgttttccattgagagtggatggacctctttataaagttggttgctgcaaaatccagttcttccaaaagccactttatttagggtttattcacaagtcatatccattttggtacagtgtttgtttcctaatatttattaaccaccttataccaaatgtcttgcaaagaaatgttattaaaaccttgaatttttacaaatgtaaaaaacaaaaagtgtattaatgtatttgttcaggaaaagctacataccgaagggcttttgtatatgaattctgtggtggggagacccatttgtaatctatatggcagttccatctgggttttaagtttagatttcaccgtgtcttagtgcttcattctattggtttattggaacatgtaataaataggagtagtgatgtattaaaacacaagtattcattaatgttttatatcttcactaaaattctatagttatgaaactatcaatcaaggtgttatatttcagtcagaagtgaaaatttatgaagagtatttggaagtgtgtacagaaataaactagacttacaggtaggctagatcagaacgttaacatatgaacctgcagaaatctggtaagacttaaattcagtgtgaggaataactctagttctctcctatgagcatttcctaaaagccatctgatttggcattcttactggagctgcagacagaaatctacaaagacaaaagtaaacaaaattaagttattattccactgttaggaatggaaataaacttgtgaagtctgtttattttgaagtattggtgaactaggcttgctaattgataactgcagcagtttgtgtttactccagttcatcagcttaggtcatttgaaagatataagagcttaaggcaagaaagaaataacatggaattctatttgaaggacaacagaacattcttggaaaagcagctccagttggtttttcaactgtcaaacttgaatgtgtaagtccccacagagcatggacagtcggtgcagagttccaaggaaacaattattgcctgatgaccacttccattttgtatacactctttggttcgtataggccatattccaactggctttttagtaatagaaatccagtatataatgtatcaaatacaattgaggttctaacctagtgtgttaatttatctgaatttggatttttaaaaagtaataaaaagttaaatgtacttcctttggattccttatttctttcctttttgaaacatgaaccaagcataagggataacccattattgaca

SEQ ID NO: 62293 - DNA, 3219 bp, Homo sapiens
aggcatttgtgtgtgcacttaatattactaattaatggaaggttttcttttaagctttcaataatattgggctacatcataaattcctgaggccaatggagatttcttctctgacagttcaataaccaactgcattgtcctaaagagcccttagtaggttggtacaaaagtaattgtaaagctgcaaatacttttgcaccaacctatatttgcaataaagaaccatctagttcattcattcattcaacaaatatttaccaagtatcttatatgccaggcactcttttagacacaggagataaatattttacttaacaaaacaaacatccctgatttctggtgttttaagctctggttgaggctaattgttaaaaaacaacatttcaaaacttctgacccacttacctctctgtcctgtctattcccgcaaatatgtcatccctactaccaactacacagcttctacaacttaaaaataaaaaagaagctgtcagaaaatgcctcttctctagagcttcaactgctattgggacatggttccctgtccttccttaagagaattttcagtcacttctaactatttatctattggattttgggaagatatattgatttttactttaatgacctagaatagtatatcttcaaatcaaagaaggcatgttttttgatttaacaaccttttgccattatcaaattattcttgctttataagagatgtattttaattctgtagttactgattatacaagaaataattgctacttgattagacttggcgtatgatggtcagactcagtgtattatggtatcaggtgatttgcaaagcaaatgatacagttttagtaagttcagagagaatactaacataaggatattttctttaaaaaagaataactttccagagcatagagtatttagtgtttttaaatgatggatactgctctgtatgtatttgtttcaaaacatcttattttatctttgcaggagcgattggttacatgggaacaagtgcctttgtccgaaaaatctatactaatgtgaaaattgactagagacccaagaaaacctggaactttggatcaatttctttttcataggggtggaacttgcacagcaaaaacaaacaaacgcaagaagagatttgggctttaacacactgggtactttgtgggtctctctttcgtcggtggcttaaagtaacatctatttccattgatcctaggttcttcctgactgctttctccaactgttcacagcaaatgcttggattttatgcagtaggcattactacagtacatggctaatcttcccaaaaactagctcattaaagatgaaatagaccagctctcttcagtgaagaggacaaatagtttatttaaagcatttgttccaataaaataaatagagggaaacttggatgctaaaattacatgaataggaatcttcctggcacttagtgtttctatgttattgaaaaatgatgttccagaaagattacttttttcctcttatttttactgccattgtcgacctattgtgggacatttttatatattgaatctgggttcttttttgactttttttttttcccaatccaacagcatccttttttttaaaagagagaattagaaaatattaaatcctgcatgtaatatatctgctgtcatcttagttggaccaacttcccatttatttatcttaaaactatacagttacatcttaattccatccaaagaagatacagtttgaagacagaagtgtactctctacaatgcaatttactgtacagttagaaagcaaagtgttaaatggagaagatacttgtttttattaaacattttgagatttagataaactacattttaactgaatgtctaaagtgattatcttttttccccccaagttagtcttaaatcttttgggtttgaatgaaggttttacataagaaattattaaaaacaaggggggtgggtaataaatgtatataacattaaataatgtaacgtaggtgtagattcccaaatgcatttggatgtacagatcgactacagagtacttttttcttatgatgattggtgtagaaatgtgtgatttgggtgggcttttacatcttgcctaccattgcatgaaacattggggtttcttcaaaatgtgtgtgtcatacttcttttgggaggggggttgttttcttctgtttattttctgagactcctacaggagccaaatttgtaatttagagacacttaattttgttaatcctgtctgggacacttaagtaacatctaaagcattattgctttagaatgttcaaataaaatttcctgaccaaattgttttgtggaaatagatgtgtttgcaatttgaagatatctttctgtccagaaggcaaaattaccgaatgccatttttaaaagtatgctataaactatgctactctcatacaggggacccgtattttaaaatctccagacttgcttacatctagattatccagcacaatcataaagtgaatgacaaaccctttgaatgaaattgtggcacaaaatctgttcaggttggtgtaccgtgtaaagtggggatggggtaaaagtggttaacgtactgttggatcaacaaataaaggttacagttttgtaagagaagtgatttgaatacatttttctggaactattcataatatgaagttttcctagaaccactgagtttctagtttaatagtttgctatgcaaatgaccacctaaaacaatactttatattgttatttttagaaagactcaaaacacctgtatttaaaccttaatatgaaaatcatgcaattaatagttacacaagatgttttcattacaaaatatgtacctatctattgatggactctacatcctatattgtgacatgtaagtcctttaaaaggtgaaaagtatgatttcttaccacttaagtatgattgatatgatccaacaaatttgatcagaagctgtaggtaaatcctcttctgaagccaaaatggtatattaaatataatttattggtacttccattttctcttccttcttacttgcctttaagatcttataaaaaagaaactaaaagttaatatttagttgcctatattatgtaaccttttaactatatataaagtacttttttggtttctttctcaccacttttattcaaaagtacttttaacataccaatacatagtctgtctgatggga

SEQ ID NO: 62294 - DNA, 1106 bp, Homo sapiens
aatcttaaagccttttcccttgctgtcctctgaagacagtgtgaatcttcttcaggcctgcttttcctaattttatacattattgctctaacttatttttctacttattattttattttctatttaataaaatacaaactacattgcttgaattgtgttgtatctacaaaacaatatggatacaaatacggattttttagctattttcatttgttcttttctacattatacttcttgaagcttctgttttattcagtttgtgtagaggtgaatgccctactgaagaatctgtttttcaaagattatccaagaaaatattttttgagagaattctagtggatttaattgatgaagacatggtaagagaagctgttggaagatacttgaaagaaagtcattaagtgagaaaaaaatgagaactaaaatgtgagactcacgaagagcagagtgagctttaagaataaagactggaaacctgtgtctttattgcatttacttaggtatttcatcttcacgtctttctgggcatataagatctattatgtctatggcttcatgatgctggtgctggttatcctgtgcattgtgactgtctgtgtgactattgtgtgcacatattttctactaaatgcagaagattaccggtggtaagtacctatttgtggatagaaatttggggaaccataatattttaaaataagatttcctttgaaatctatcaagtggagtaaagagctgtatagaaatgttgttacttaaaatagcatagggatttttttccagttataaaaatgatacatattttagagaaaaaatatcaaatttttaatgtattaatggagtactgtgttagaaatattttttacaaagtgcttgatatgaaaagagttttatgagaagcattgctccattctaaacacaaggaaacttagatatgaaaaaggaaatggtgtatttatggtcactggtaatagggaatctgacaaaattcaagattgagctttctaattcttagatgttttccttgttgataaatttgaataccatgtctatgcatttgttttttaaataagttttaaaggactttaaaggatgttttattaaat

SEQ ID NO: 62295 - DNA, 1078 bp, Homo sapiens
aaataagaactcataataccttaattgtataatttgtaggaaaaggaattatagaaccaaggagagagtgagcaaagagatggcaaggccacaatttgggaaacattatttcaaatggaggtctctagactcttcgtttctttccctttggctttttgtgaataaatgcctgtagagttctaagaagttatgggagtctagtagaaccagagggaacacttagagactttttgaagttctgccagtgtcagtaatttgtgttcttcatatacttgtctcagtctttaatgcagaaagaatattgattgtaacctatggctaatttgaagtcccacctatgtattgtgcctctttgggttttggcttttcattttactggtttgtttctatcctttagagatgattttttaagtgtcaagtacctgctttctgttatcagtgtttatataacatggaaatcatactagaagtttactattaattttaatattttccaggttcatggagcctgcggttattgtttgcctgggtggaattttaccttttggttcaatctttattgaaatgtaagttttgataatgtatttatgttttgagggatttgattatagtaagacaatttaggagttagggaacatgtaaagttatcagttgggagaacatctaataatctgttaattccatgattccagaaagggaataggctatataaaggtagctgttggctgtgttcttaaatattcaagtgatgtttatacctttttgtattgtattctagacctccctcacctaagaggaaatcttagaaatcaaaactatgtgttaaagaatggtagaccagcctttgatcatatgcatgatttaaggaattcctggtttttattgtattttaaaaatatttctgaggatctagggaactaggtaaaccaatacctactagtccgtctaggccctgacatcttttgatgcatagtcatttcctaggttccttccatagaggcctgcaggagtgctaggaagtgtgtatgtatttagagataagaggtatgccaccttgtgccacttactgtgctttaca

SEQ ID NO: 62296 - DNA, 1714 bp, Homo sapiens
ttctactccattttacagaagttcagagtgaaatgatcttaattagatggttggccggaaaagagctgattttataaagaaaaaaagtcacaaaaataaatgtttctaattggccactttggttctaaaatctccgtatggtcttctctgtaattttagactttgcactactaatgggcaggaaaatatttgtactattttactagtgacacatagatagcgatctccttctattaggattccaaggtagtgtaggatagaaaagagtgtgggctttgaggctggcagatctgagttgaaattttggtctggctctccactagctatgcaattatgggaagttacttatccttctctgagtctcctttccttcatttgcaaaataagaaaataacacatataaagctcttagtgcattttatgagctcaaaaagcatagccagataagtaagttggttataataatgaaagacaatggataaatatattaaaaaagcatgacagctgagagtgaaagaggagaaaaagggattgtggcagagatagtctggaagaataggaaagaatggaaaaccaaattggataagaactagttcaacttgtattcagtttagttctaatactttaaagcacacctttttgttttcattagtgtacttcttgcacaattttagctcatattgaacttaaacattttcttttgtggtcaaattgtgtttaaattgtgtctcttttatttgtttatattaatgttattgttctctgagtaatcacacatttttatttaatttacaggtggccgtttgttgcatctgtttttttgttattcttcctctaaatcttgttggtacaatacttggccgaaatctgtcaggtcagcccaactttccttgtcgtgtcaatgctgtgcctcgtcctataccggagaaaaaatggtaaagagaatgctaaatcttatgcgattgtttcacacaatatataagttcttaaggctgttgtgtacatgtaactttagaattggtatgtatttatgataatgacaatcttaagtttgagcctaagaagttcattttactatttcctttaacctacattgttaagagtaataataaattatacccttattccactttctgaatatcgtgccatttagagttaagtcaaatgcttttctatggtgtagaagtgggtgtgaactaaagctgcagttttactaatctgcaggccaaatctggcctgctccctgtttttatctataaagttttgttggaactcagccatgcccatttgtttacatattctctgtggctgcttttatagtacagcatcagagctggcagatcagtaatgtcagagatactatcacatgcagaacctgaaatatttactatctttccagatattttagtactgtacaatttagtgtacatttattacattccctatttataggaatagttgtatagtaagtagactgcatttttatgataacggagatatatatatataaagtctctgtccctagatattttaccagattataaatacagcatattcaggtgcttatacaaataggtgataattttgctctgtcccttctagacatggaggcatgtagacatttatagaaatggaggatgaataaaatagcccctatagtttgaattggccatattcttttctttccttagattggtgcttatgagagacttta

SEQ ID NO: 62297 - DNA, 1212 bp, Homo sapiens
cgttcttggctcactgccacctctgcctcccaggttcaagtagttctcctgcctcagcctctcgagtaattggaattataggcacctgccatcacacatggctaatttttgtatttttagtagaggcggggttttgccatgttggccaggctggtttcaaactcctgacctcacgtgatctgcccaccttggctttccaaagtgctcggattacaggtgtgagccactgtgcgcggcctaaaaatcattttcagcagcatgagggaaacagggaaagcctcagtgttattccatctaaaataatagtatttaatatagattatactactgttttatttctgtttgcaggcaagattcataagcagttgaatcaagttatgaaacagactattccagtcatttttcttaacagatgaacatcttgttccatattatgggattggtttacagggtcacaaaacagttttagtgtcagcttctagtatttttgccaaataaatatgaaatacttgcttagaatatatcataacatttaactgcaggataaaaaaattaggatcagccaggtatcatgtaaatgcagttttaactacaaattcattcactatagagaatcttttgagttttatttgtagtccaggttgtgatatttttgtatttctgttaaagttatctttgaaattaaactaatgctaatataatagactatgatgttttctttaaattgttggttttaattttttttttcttttttgcctttttaggaggggatcaatgctcagtacagccatatttgtctatgctgctacgtctccagtgaatggttattttggaggaagtctgtatgctagacaaggaggtaacttacgaattctcacttcatgttgttaattatagatgctaatattttactatgagattttttttgtttgttttgagagagtctcactccatcacccaggctggagtgcagtggtgcaatctctgctcactgcagtctccacctcctgggttcaagcgattctcgtgcctcagcctcctgagtagcttggaattacaggtgtgtgccaccatgcccagctaattttgtgtttttagtagagatgagatttcaccatgttagccaggctgctgtgaactcctgacctcaagtgattcggcctcccaaagtgtctggcctactgtgagatatttggaatttaaaatgtgcag

SEQ ID NO: 62298 - DNA, 1067 bp, Homo sapiens
ttctttaatataacctttctaattcatttaccgcatgagctttaaaataacccaaatctaaacttcagagttctggcgagtagttcatattttcgggcataatgtatttcagataagctggaccctaaatataagaaaacatttcacatctaccaagaagttgtgctttacattaaacactggattaagttaatcactatcgaattgacactagctgtactgtcacagtcttaagagccactagaagataatctcttctagaatccaagtttttgctgcttccttttcaaaatgttagtgttacaattcggcagctctttttttttttttttttttaaaatgcagaagctcttctacttaaagaccttcaacttttataaataagaaaccactcactaatgtataatattagcaggcaagtcatgcattgttattttagcctataattactgtaagtggtttttctgtgttgtgtttatttgaagtgaatgtaattcattacttatgtaagtactaaagcattaaggatttattattatataaaagtggccaacttattgagatttcactttaggtgtttcatgcacatttgatcccttaatcttcacatcaaccctatgaaggaaatattctatttccattctacagaccaggacactaaagctcagagaaataatctgactgagatcaatgagcaccctttactagtaaagagtgttagtgagctgggattggaacctaggcaatcttattccagaactcttttcttaatttgctatgttacggaaatgaaaatagagaaaataataatacaaagtggtgagaaaatgaaaaatttgcacacaaaattgggataagtcacttgaataggaatgattctaaaggataaagagcagataatgtaaagtaaaaattactttgcctctgtggtcactatagcaatcagaggaaaagtattttgagggtataaggtagaggatcagtatcagtgtgggtgcctgttatagtgtgatattgagaaggcatagagtttgagaaggtgaggagtaagcttgttagtgctgctg

SEQ ID NO: 62299 - DNA, 1067 bp, Homo sapiens
tagtactggttttgatactcttctctttcatttctccacctagcccctgattgtatatgagctacagctatgatgtgaatagcaagaatagtgtctgaaagtggcattaagagagtcagtgcactgttctcccaatttgaccatttctttttgttactaaaccttttctttttccgttatttgagattctctgagcacaaccagaagtcaacttcctgaacctcagcattttaacattgttattaaggcagtgatcattctaagtttggaatatactttctcaatattttgtatttctttagctataaatttggagggaggaaacttacaactgtaatttttacatactatgttttagtttgattctgaatgatttgcttttctctctctatatatatatttgtatataggatagagacctaggagatgaatatggatggaaacaggtgcatggagatgtatttagaccatcaagtcacccactgatattttcctctctgattggttctggatgtcagatatttgctgtgtctctcatcgttattattgttgcaatgatagaagatttatatactgagtaagtgcctacacttaactgtattatgtctttattgttcttaaatagttttaatcactggaatcttttaagtcaatcataattaaatcgttacttatttcctttatcttacagtttatgataaatatcataaatgcagacagacaaattaaataatgaacagtaatctgtatttttctgttacatgccaaaacttagtagcattactgaacattgtggttagttataaaggttatatgttccattaaagatatgaacagaggttactttcaatccagagctgtttgacaaagtaaatagccttttttttcctaaagttgaagatccaattagagcttcatcagaagttcaagaatttcagttactaagttacttcatatttaccttcagatctggaaaacatcagagtagaagaaaacattgtaaataatagtaaaaagagtgatgaaatagtcacataaggttagaaaaataattgatgacttctttg

SEQ ID NO: 62300 - DNA, 1049 bp, Homo sapiens
gaaaagatagttctggggcctcagggggctcatgtccatgtccatcgaatcttccatggggtggcagcacgcatttaggtgggaaagaaggcagacggagataaatgacttctgctcaagagaacagccacgcaggacagaattacaccaggcagatgtacagattcttattttaattgatttagacacttgtgatatgagcttatactaattcagttcatatcacatttatcaggtcataatatgtaagtcaacaaaagtaaacagtccttgagaactgaaatcacccctctgaggaaagttgttaagttttgtcaataaacagaaaagttgattagttttatcataatcgtttccacttctcatgttgtaagtaactttcctccatttctctagtgaattttaattctaagtgtgtgtaaatctatattttgctcagagttttgtcatcagattattaatttgtttactggcctttattttcaaatgaaaaaattttttttaggtaaaatggaaaaagtcagatgtgaaatttgaagatcgatttgacaaatatcttgatccgtccttttttcaacatcgggtaggtaaatagtgtattttaagacattgattatgtgcaccaattcgttcaacaaacattgagtatctgtcatttgcagggcactgtgttgaggactgtggattaaaagatttagctaatggtgatttaaagtatgagcttgaaatcataagggtgatggggagttttagaggagcaatcaaaaacttccttctttgtgcttgtggtttaaaccaattaagagataaacgaagaatataacatacgggaagccaaaatatcactaataaggtgaatattagatggctgcgttgcacaatgaatagcgcattggccttctaatgaggtgaatattggagaatgtggcttatatctatctgtgatcaagtgggcttcttactactgaaactcagaattagacttaacacactcagagagtatattataggcttccctacatgggcacttgcccttatacaacttacgg

SEQ ID NO: 62301 - DNA, 1050 bp, Homo sapiens
gggtagatcataggttattagagaaagtactagactagggatctggaaaccttgattttaattttggtttgaccactaatagctgggtaaccttggcagatggtgatgtaagcacttctctgaaattttgagatgttagggagtggtattagtccattctaacaccactataaagaagtacctaagactatgtaatttaaaaagaaaagaggtttaattggctcacggttctgcaggctatattggaagcatagcggcatctgcttggcttctggggagacctcaggaaacttacaatcatggcagaaggtgaagggagagtcaagagtggccagggagggagagagggcggaggtaaaaaaaaaaaaaaaaaaaacttaatgagcatttagcttgtaggatattttaaatattaagtggttttaccttgtataaagtgttttttcttttgtaggtattgttggtgaggctgatgaaaatggagaagattactatctttggacctataaaaaacttgaaataggttttaatggaaatcgaattgttgatgttaatctaactagtgaaggaaaggtgaaactggttccaaatactaaaatccagatgtcatattcagtaagtattcaaatagtttaatgtaggaagtagtgtttgtgacccgatgtcaacaatttgtggctttgaactttagtaaatgaaaatgtagcttgaaatgggatgcaacagaatattattaaaactatattttctcagtgtacgtaagtaagcctcctgaaagcaaagagaggatttgcttcaggtctgtagtattagataccagttatgcctttgcaggagctaaaccatttggtacagccaagtttactgttgtagctgggtaattagactaacccagtcatgtatttttatggttacatttttagattgcagtacttcatgttgtttccctttcctttttaatgttgcagatagaagtgatgctgtattgaaagttgctggatagatgtagtttatcatggattgctctgtcagttggaataatatactcct

SEQ ID NO: 62302 - DNA, 1836 bp, Homo sapiens
gtaagaaggtatttccctgacattcttccatgggactttaatgtttactgccatctttggtgttgtagttttggggtacccactttaggttggtctataatatgggaagctactctctctcttaaggattggggagacatactgctgggtatcttgagttataaattagattgctatttctttgagccactaaatgatgtagctacaatttatgtttaagaacttttgatcaataaaaagtttaataatgtatctttagagaaattgcatttcatgtttcaaataaccaatattatagtacaaatatagtatagaacttaaaaacaaacttgtgcttgcttttttgttcttgttcagaatgatttcttaatttttttctaattgcttaatataccaaaacaacttcttttgattgacatgtttagtatttgtaggttttttggattttcttttgttttattagaaacaggtacatttttgaaatactaggtttattaagttagaaaccatctgaatagaattatagtagcagtatctttgaaagcagtcggggtggaaaatgactcatcttgaggggactttaaggcaatttataaacagtgatgtttgctgaatagaggtttgccttttaatcttcctgcttatgaatagtcactgggtgttttcatagaatctgtggcttccagtaacttgtctttccaagaatgttaaaatcagtgtttatctcagagagatcttatagctacaaatggttatctctgtttatgaccatattcttgagcttttgtatatattaaataaaaactttgttatgtgtttaagctttttttgtttttaaaatcaatttattttgaagttactttataaattttcttgtataatttgctttgtataagggatgatttcacttaggtaatgtttgaaaataaagatgattaaaattttttcattataaaaagtcttaaagatacacaaaaaaagggaggaatagtacactgaacccacacttatttatcactcagattcagctattgtgaatagaaattttaactgtaggaaatgttggcttttttcttgtcttttttttttttaatgtaactattttgcaaactagtgggctaatttgcaatttttattttgtgcagatgatgtgatgccagccacttactgtgaaattgatttagataaagaaaagagagatgcatttgtatatgccataaaaaatcattactggtaccagatgtacatagatgatttaccaatatggggtaagtattgtatgttgtatttaagatttgggaaaatttgcataatcagaatttataaaatgactctgttaaggtgattgtgtactggatcatggtgtaaatgtgttttcactgttttttacagaatgattttaataccagttttatggtcacctgttgcttgaagaatttttgacattgccatgccttacatgaaacttgcctaaaatataacttttttatagtataacttttcagattcaagaatgagaaggtgcttagaacaatctaaaaatttcttctgcttccattttttttcatatcttaatttgttcttttaaatacagttaaagggactaataggattttgaagtttcattctgtctttttctcatgttggtactgtggtagtatggtttcttggtatgatagtttcttgaatggcttattttgctaaaaaatgtttatgtttttgcccttatttatccatattaatggagaagagctatggaatagttaatgccaatttatgaataatccaaaatcatttatgttggacttgattaaattatttataatgcaaagcaca

SEQ ID NO: 62303 - DNA, 2180 bp, Homo sapiens
tgacaggcctcccacttgtaccttggaactactcaaagtcattactgaccacacttcagatttagccatgtataatattcactgatatgtagttccataattacttattcaaagaaatatgcatatagtgcatgtctttcaggctgctaacaagatagaatgttggcttgaatggacttgtggaggttctatagcagtcttcttccttgtcctctgtagtactttgaccagtggctgtgtgaaagtctcgcaaggagatgaaattttatttatgcttgctggcaacattaggtttttttttttttttaattgattaacatgaggttctggataaacttgattttgtttcctccttccttgtccatgttagcatggtgaatcatgctggttgcaggtttgccactatttgatagtgtaaatgtaaataatagacacactcttatgagctattgggcttagttcaaacactgtcttctataaaacaagtttggaaaaggtgtatctgcctgagactacaatcagaggatataattttaaaattcacaaagtttcatttttaagatgtggacattcatcatcagattaagcttccagtatttattttatagcttcctgaacagagatgatgcacttttgtttagaacacacaacaaatattcccttaatttgaattagtgtgttttttttttttaattcttgtttgcttttcttgtttcagtatcaagataaagaggaagttgtcttatggatgaatactgttgggccctaccataatcgtcaagaaacatataagtacttttcacttccattctgtgtggggtcaaaaaaaagtatcagtcattaccatgaaactctgggagaagcacttcaaggggttgaattggaatttagtggtctggatattaaatttaaaggtaagtaaaccttaatagtccttacaatgcaatttggattgtagacaagggtttcatattttggcactattgacactggtgttggataattctttgttgtatggagctgttatgtacatgttaggatgtctagcagagtccctggcctgtaccccccagatgccagtagcaccttccagttgtgaaaaccaaaaaagtcaccagacattgctaattgctgtcagttgagaaccactactttagactctaaaatgtgttttagtctgtaaatgaggtgtattgcatttaggaaagtatattagtaattaacaaagatttcctttgaatatttataagataataaaatagataattgttaataaaattgtatttccttaacatatttccttctgaaaagtgttgtctagtaaaccccctattgattagacacatgtggcccgggaagaccttcatggatatttaacaaagtaatttctggaggtctgaggctgtaatgggatgcgtggatacttaaaattcttgtgtgacgcctcaaattcaaacttgtaccataggcttaacatgtattatttatcagtgttgtattaatttatcctgttaatacctataggatatttaaattttaagtcaaagacttgttaaatttggggaaaatacttcatcgtatctagttattatgcaggtatccatttatcaggtcctttgagtgtgtttatacttttcatttttctctgtgaagtttgtcagagagtgtatttcctgcacaggcatttttagcatggtgaacagaagcttgagtaattgaatttttgcaggatctttgattaggtgtcttggtttttgaatacatcatggatcctgtaaacaggagctttggattttaatcctccttttttttttttttggtactgtattcattttagtaaaattgtttactgcagttttgacttcattgtctccatgtgtaagatgaatagtaactgacttctggtatttttagtactaaagatgttattatttagtactttgaggagaagaatgtcagtgagattttaaagataatgttactttaatttcgatttgttaaattttattcttgtttttaaaattgctcagttattgttgaaaataggtataccgtatctatttacattctcccccctccccatccccccgtttatagtctttggggcttaattataaaattaagttgtaaatttaaaccacagtggcatggcctgtaattttatgaatcactgtaaacat

SEQ ID NO: 62304 - DNA, 1084 bp, Homo sapiens
attcctaggcctttcttgtaactttctcctcaccttccagcccctaagtgagacccccatcccgatagtctctaactaaggcagcttctgacagtaaagggtcttgacgtttcccagtcttcaggtcagggccagaaacagtcccttttgcatttggcctaaaggtgattggcagtttgtttaattggtattctcacatcaaaacgtgcatgtgaacgactcttcaaatggctttcacttagggctgtaactgtggttttcagagtggtagacttgagcaaggcaggaaggtcaggtaaattgagagtttgcttgacgagtaattgttttttatacctttaccattaatgataggagtttctatgagagactgtgtttgtactaaatcagaacgatctgagggagtcttatgtcatttctggtaagtgaggaaatgaagcagtcgtccttacctatttaatggatccgattttatttgtaatcaacaaaacttttcgctggatccttggctagctgggatcttattttagctaataaaagctctaaacttttgactgttctaccttcggtcacagccagaaacttcttacctgtgtaggtatgtatttctttagagacacaaatctcgaattggtgacatgtttttgtactgtacttgtggtgtttcacctaagataattttgttgggaggttaaacagcttaaaacgatttccttttgtgttctttcatcagataagctgtctcaaagtttaagaactgctattgtttcacatagtatacagggaccatgtatagatttgggtctttgagtatttttaaattttcagtgggcatccatccttctgtttaatgatattattactaatatatttccaattaaaaaaacacttaggaaaagttaccatatgaaactcagaactctcaatgtgtagttccgtgatacaggcatataagctcaaaagtgtactgtattctactttttaatcttgtaatcttgtgacttacactgctgtgattagggaaaccattaaaattttacaaattgggtgtatataaaggctttagaataatttacaaattaaa

SEQ ID NO: 62305 - DNA, 1048 bp, Homo sapiens
aacggtgattacaggagcccgtgattcattcacagcggcagacgagcgccaggaaagggttatttgatctgatccctcaagttccggaggcagcaggtcagacgatcggccccatttggcagccaggaaaaaagcttaagcattttggccaaggttacacaacccgaaacaccgggacgcggcccggaggcggcttcggccttgcggtccaggctaggccactgcgccggggcccagcctgctcggcgcccgcccgagtgctcggcaggcccgtagcgccgcggctcccaggagccgaggggcagccggcgcgcaggcggcggttgccgggccctccctcggcccggcggcggtggcggccccgcgtcgcgaggcacttccggcgcgtgccggggtggccggatgacgtggctgagtcagaggaagaggctgaggaggcgcggggggcgggggaggctcaggagcgggcggtgacggcgacggcggcggcagaggaggcagcggctgggccgggccccgtgcgtctgtccgcgccccgtggatgcgaatcggccgcggcggaggcggcggcggcggaggaggcggcggcgggaggaggagtcggtgagccggctccgggccggaggggcgcggaggatgaggccgctgcctggcgctcttggcgtggcggcggccgccgcgctgtggctgctgctgctgctgctgccccggacccgggcggacgagcacgaacacacggtgaggcgccccggccggcgcggccgccccgggctagctccccagttgcccactgaggcaggccccacgcagcctggagtgcccggcggcccggtggtgccccactgcggcccgaggactccttccggttgggcctggcggagcaggaaccttgggagcgtggaggaggcatttccgtgcgctcccgggacagggctccgctcccgagtgacagggtctccttcccccggtctgggcctcagtggcgccgcaccccagggtctcggggttcctgggaccctggggccaggaaggagcctgggaagggttg

SEQ ID NO: 62306 - DNA, 1322 bp, Homo sapiens
gacctggcacggtggctcacacctgtaatcccagcactttgaggggctgaggcgggaggattgtttgagctcagggttcaagaccagcctgggcaacatggtgaaacactctctctattaaaaaaaaaaaaagagctttcccaagcggctgccgaagatggcggaggtgcaggtcctggtgcttgatggtcgaggccatctcctgggccgcctggcggccatcgtggctaaacaggtactgctgggccggaaggtggtggttgtacgctgtgaaggcatcaacatttctggcaatttctacagaaacaagttgaagtacctggctttcctccgcaagcggatgaacaccaacccttcccgagtcccctaccacttccgggcccccagccgcatcttctggcggaccgtgcgaggtatgctgccccacaagaccaagcgaggccaggccgctctggaccgtctcaaggtgtttgacggcatcccaccgccctacgacaagaaaaagcggatggtggttcctgctgccctcaaggtcgtgcgtctgaagcctacaagaaagtttgcctatctggggcgcctggctcacgaggttggctggaagtaccaggcagtgacagccaccctggaggagaagaggaaagagaaagccaagatccactaccggaagaagaaacagctcatgaggctacggaaacaggccgagaagaacgtggagaagaaaattgacaaatacacagaggtcctcaagacccacggactcctggtctgagcccaataaagactgttaattcctaaaaaaaaaaaaaaaaaaaaaaaaaagaaaaaggaaaaaaaagagcacgagggaactagagactaatggaaacattctatgtcttggctatagtggttattacatgtaatacaaatttgtgacaattagtcaaagtgtatactttaagtgaatgaattgcattttatgcaaaatattcctcaaaaatgattaaaaatagaatacataagcaagaatattaagaaaaatgtggaaagtaaacaaaatcaggtggttttgattttctagctattttaatttgctataatttacattaaaactgtgcaataggccaggggcggtggctcacacctagtaaccccagcactttgggagtccgaggcaggcggatcacgagttcaggagatcgagaccatcctggccaacatggtgaaaccccgtctctactaaaaatacaaaaaattagccaggcgtggtggtggacgcctgtagtcccacctattcgggaggctgaggcaggagaatggtgtgaacctgggaggcggagttt

SEQ ID NO: 62307 - DNA, 1831 bp, Homo sapiens
ttaacttggggtggttggaaaacacattgattatttactcatcttagagttacacgttgttcatttatttgaaactgaaacgtatttcctccaaacaccgtagaaacttaaaggccgcaaaagactcacacccaccacctagcggcgaaaaaaggaagtttcaggtgatacaagatgtcctgccatcacacctgaaggatggttgtccacagccattttttaaaatctcgtattagtcctcttccttcaacactcaggacagtattatgtacccagaaactcaatacttcctggcgtcttcatttgacaatactcttaagccaatgaaatcctgtgggacgtttgcgaattttataaagatcaatgttttaagattggcggggtgggctgggagtggtgggggggaaggtgccttcctacccttgcatttgcatctcaagccacccgtacccgaggcccacccagtccatctgttcattggtagatacaccattccgccattccgccagtggctggtgcagagaaccaggaccaccacctttgaaaagacctaaatcaatactccaatgggatcctgatgtcaagtatttaacgactttgctttacctactacagtaattaaaattaagtcttcaaacttaaatttaaatttctaaaagcaggaatgcactgtccttaatcttaaacaccaaaggtgggagaaagaggccagaatcctagggtactaggcctactggtatagggcgatctcttctgcttttttctttccaccccatttcttttccctttctcctttcgtttcccatcttctctcttctcgttctcttcgaagtaacagtgacaaaattaaggtgattcaattattccaagaggcttgctcatataaaatatttctcttcaagccctttcctgaaatcccaaattaaagcatttccaatagtctctgctttaagtattcctagttaagtctacttttggaaatattaaatattctcactttggcacaatattccaaaattccttgagaagttcgcctacgatcagtcttgctagtagaaacctttttttttttttatttaaaacgctcgatttccactttttactaggtttcccaatgttggcgatgtctcccaatgacttaataacgtgtatccacttcacctttgaaaatcttagaggtcagtgcatccaccggcatccgggaatttattcttatttctgcttcttaaacaggctctggggaggagcagtttcgacggagaagttcatagcagcagttattacggaacttgcaacagttggtgccgggcgataggcaggttggaagtgataaatggggctggcgtaaaaaacaaaaagccccggggagggcgggggcagccgtggccttgggggacagtgcgaaggcggcgcggggccagcgggactgacttccggctgtgggaaggcgccgtcccgggcggccagaggcggcggcagccgcgtagaaggacggcgggatcgcagcccggcgggcggcgcgcggggcgggtgagcgggcccaggccgcccccgggccacgccggggccacggtgaggtgaggccggccctgcccccgcaccgcccccggcaggaggcgcgacgcccgggccgcgggtgcgtgcgcggccccgggcgacgcggctgggcgtgcgcggggccgcggcggaggctgggccgggcgggcggcagaagatggcgagggtgtgtaggcggcagcaatgctccgttgagagacgcggctttcggcaagaactggattcgtggcgccacaagctcattcactgtgtaggtgagaccctccgccgaccg

SEQ ID NO: 62308 - DNA, 3268 bp, Homo sapiens
cccacgcccagtcctcggggaggcccagaattccagccccttctcccccaggggaatattcttgggaaccaggtctttcccggcagaatctaggagagtctatccgttcgcttgggcccctcattccctccttcccgacagggtttcgttggaaggaattatgcaaatcctgctttctggtgtccattcagcggcaatttcatgcggtgagaagttctctttgttgtgcgagggggagaacagacactgatttaatagacatatctgttggggggaagggtggagggggtgtggagaggctcagtttggaagaattacagcacttggttagctcagtgtctttgtgtttgagccttctggcttgacaggagggtctgccctttacaatgtcccacaagggatgttttcgataatagattaaaaagcaaaattgaaactttaaacaagtgaaaaatcaggtaacctttacttaaagaatatacgcctttccatttctacagggtttcattacgaaaatgtatagcgtgagtttcgttaaggatttagactgtaacaccgaaattaatataggcaacaatgctttaaggtatctgataccagtttggttgtccaaaggttaaaagtgcattttcaaacatatgcttgtgcaaataataaaggcatgagtcagttttttggtataattcgtctcatgaatatattttaaaattcccctcctgccaatccaagaccagtgctgccctccaggaaacaaacagccttttgcctatcagttatcctgtactctgctctatctctgcttgttttattctttcaaagtattattatgcatgtactaaaatgttacgtcggtttaagtactttttgaattacttggtatttcggactatcatagaagagagcatatagcaggttttgagaagcatgaaattaatgcgttttcagaattgtgggttagtatcaaatgctggaattgttttgaagaatttttagttcttgtatgttttacatttgttagtgattggttttttcagcagggctttttagtctttgaaagatttttaaatttataatgtagtcctgtcctgtagattttctgagttccatgttgctttaatttagatggttttaattagtgtatcttattctaattctctttgcatttaatcctgggctcctgcctcaggaccccattttttcagtcattgctagttagtggttagttactgctgcttgacaagatgtgtttttgtttttgtttttgttgttgttttttctttattgagacggagtttcactcttttgcccgggctggagtgcagtggcgccatctcggctcactgcaacctccgcctcccaggttcaagcggttcttctgcgtcagcctcccgagtagctgggactacaggcgtgcgccaccacgcccagctaatttttgtacttttggtagagacggggtttcaccatattggccaggctggtctcgaactcctgacctcatgatccgcccgcctcggcttcccaaagtgctgaaatttacaggcgtgagagccactgtgcccggccgtgtttttggtttttaaaattatgactgataaattatttctgtaaatatctgaatggaatatcaacattttgattcattttttgaaggcaaattttaatctggtgatcaaatttcttaaagcatacttttaactccaaatttccactttaaagatagtaaagttcagaagattatagagtccagagtgcagagcaatattttaatctgagcagtaacatatattcatagtctctcaactaaaatcagtggggcctcatattttctcttttattatatgtaattttgttttttaagaggagagttctaagtaaattaattgtagtgttaagaactttctatatttaaaaggactggcagtgatccttaggcaattcaaaaggtaacttgtttacttccagatgtaataattttttagtgggattggttctaaacggtcaacctgtttgtttctcttgactgattatcttaatactttagggtcatttggtttctggaaggtatttaatttacagcagtttggattaaaaattaattctcatttctaaaatcgaattctcccttctattagtacttttttggagggtgtgggggcaggtggtggtggtgatgttgctgattaaatgattaggttcagttgaattggagttagtcctgggttcagacagtgattatgatcaagatggatgatatttggttaccaggtgattattaaggagtcctctgagactaggatgatcagtttagattccaggaagatctaggctctctctgcgcctgatatgatgtaaccttttgctttcctgcaccttgcccttgctgtattttcaagaagctcttcctaatgtggggaaagttgtggtgatttcagcttagctctagcttggctaaaaataggacagcagatgagtctctttgactttcagaaagttatttcagattgccctaatttcctgaaatgttcttgtagctggagcaattctaggaagtatttgaacaatgccattttttagtcttatggtgctacacaggggggcctggaatttcttacatagtgagaattggttatttgatgccacttttatttttatttagagttttttttagagacagggtttggctatgttgtccaggctggtctcaaactcctcctgtctcagcctcccaaagtcacttgcctgatagaacttgccacttcagagtacctgcctgatcatttagctgtttgtattgatgctgtttttaggatgaagggcagttaggtgtttacttcatttaaacaagcatctgttttttaccaggcactgtgggcaaacaaagtctgggaaagttgcctcaaccttcaggaacttttaaaccttagagaaaatgtaatgtaatcgatcagttattgtacaaggcatagtgtgtcatatgatggtgcaagcaaatgctaggggtgtttagaagtgaaatctctcccgagttgatggacgatttcgtgaagaaggtggtggatttttgcttcgttctgatggaaaaggcattccattcatgagaaatggcatgagcaaaagtggagaaggacagcaatgacttgtcaatttaaactgcagttcatgattagtgtaagggatatacacatgataggtttgcaaaggtaggttgtaggattttctaatgcaggttagaaagtggagactttttgttaggcaacttgcagtt

SEQ ID NO: 62309 - DNA, 1020 bp, Homo sapiens
gctgcggcacctggcctgatgtgtctctttctgtatagtaccagccaaactgagtggatagaaggacattggccaggcctgggtcatgtggcccatccctgagccagtcagtatggccagtggagtgtggttctctgacttgaccagggacaagtgcccgcttttggagaggggcttaagatcagccttcacttaagggcttgaaggagaagagtggttcttcaaatgaaaattggatgctgttatctaacagaaatggatataggttaggcaaaaattgataaatattctaaccatgaatctagatctaattttgaagaaattgactgacttgggccatgtggtgggttgaattgtgtcccccaaaaagatacaatgaagtcttaacctccagtgcctgtgaattttagcttatttatacataaggtctttgcagttaaaattaagatgaagtcatactatattagggtggcccctaatccaacaagtgataactccagaagaagggggaaatgaggatacagacacggaagatggaggcagggattagagttacactgccacaagccaaggaatgccaaggattgccaaggattgctggcaaccaccggaagctaggaagaaacaaggaaggattcttttctagagcctttggagggagcatggccatgccaataccttggtttctgacttctagcctctagaatcgcaatgttgttttcagccagttacccagtttgtggtagtgtgttccagcagtcctagaaagctaatacagactatatttggcacatgctgaaatttaattttgggtaagtccatcgttttgaaataaaatgctgaccataagttttcccggtggatatcttcagaaaatgtgatgttactttgtggttggttatatttatggaactttacattttagtctatagttacagtttagctgaacctgtgttcctagttgatggacagctaaacatttcttagtgtgtcctactcagcagtcatgtgtgaaaacta

SEQ ID NO: 62310 - DNA, 1051 bp, Homo sapiens
attgttagtgctgtggaaacgtgaagtgtgtggattgggatagcatgatcaggtttttctgaggttgacctttttcaagaaagcatagactggtgttgtgcagtctttaaactgctttaaaggagtttagaaaagttgctcaaattttgcccaaaggcttggtcttgtatttaccttaggcgtttgctaaaatactttttctctagtaagtttaagttgatatttttggtttgatttagtatgttctacagaatgctagttgccttctttcatgatgctatcttttgtctctaacctgcctattttgtcttttgtttttggcactttattctttctgtatcagttagcattatgtttactgaatgttggaggaactgttctgagcttgttggtaggaatgtcactttgtatgtttacattctgatgtgaaacacctgtccctgagcagttatgtttctacagctaatgatgccattaaatattaacttggcagtagtttatgaaccttatcgcctaatttcttaaggtccaatatcttagaaactccggaagcacatcataaaatacacaacagagattaaaggttataagaataaatgtgcccaactaagaagggaccaataggtagaagaatgaggataggaaataatgacacagaggacagtccaacattctgagagccaagttgaaaaggaagtagatactcaagtaatgactcatagatggtaatccaaaatgttctctgtcaaataaaggtgtattgactttcagttgatttttcaaacaaggaaaaatccttatttgctttggggacagtctttgtttagatggtgtggttggattgtatttttattcactgagccaaatgttctgtgaacatctttactagctaccaagcactatatggggatatggtgatgtgcaaagcagactctgttcctgctcgcatggcacttagaatataatgggaaaaacagggacatcagttacacaaggaaccagataaaagctctgaaaagagacgttgttctctgcatgtatgtatggtcat

SEQ ID NO: 62311 - DNA, 1054 bp, Homo sapiens
aactaaattacaaccataataaaatctcccaaagtccgtaggcactgacatattacagccttgccaaatcagaatagatttctcatgtgttgtcaatttaccagacacaaagagtagctcagatctcatagactcttcagatcttgtagactaatttcaagtctttttaaagttttgaaaaacatgtgctatttggaattacgtcatcctcgaatattaaacctgagctcaaaaacctattgtttgatattggaaatagttaactccagttttcttctattaagataaaattctttcatcatgtctgtgccctctaaaataatactcctattgctttgtcttccccttctcccctcctagtccttctttagtcattctatttagaatcaagtcgctcatgagtttaagaattagagcagcaagaaattgagctagagatgtacaaaagctttggacaatagtagttttgcttgtcctcattcttattagaagtgctgttaatttactgataaattctaggacggaagacaaatctttgcaactggtactatatcagtcggtaattatttgttttccttagaccatattgagctcccgaagtacagaacaatgagtagatgtgaaccaagatgctgggattttttaagtttcaaatatgtgtgtgtatatataagagacagaatcttgctctgttgtccaggcaggagtgcagtggtatgatcatagctcactgcagccttgaactctcaggctcaagagatcctcctgccttagcctctcaagtagctaggcttacaggcatgtgccacacctggcttttttttttttttcctcttgtagagacaaggtttccctgtgttgcccaggctagtctcaaactcctggccactagtgatcctcctgcgttggcctcctgagatgctgggattacagtgtgagccaccactcccaggctcaatttttttttttcctaaagaatcagagtaggaaaaagtcactttatttagacctttacttttttctttttttgaatcagggtctcactctgtcgccc

SEQ ID NO: 62312 - DNA, 1027 bp, Homo sapiens
gttgcagatatgagcaaaagaggagtgacttgtttacagttgctattttgagcaaaattagttgtgattaaatctttgtgtttataaccagattttttttgtttgcttttgttctttgtcattgctttttcatctgtgactcaaatttttgttagtattattgatcttctgcccaattttcttatgtcagattctgttcttctttaaaatttttatctcccaaagctttcatttgcatttttctttcctggcattatttcttgctatatttacttttttccttttcaagaatttacgctcagcccgaaaatttggaatttgttacaattttatataaacccaggtgaaagaatattagatttgctcttcaggataagacctacttaataatttcctttagctatttgcgttgtgtatttgatgcttgcaaggtgttgaaatactttattatttgtgaaatcagattttcttttgggagggcaggtaggggggctttaagaattggagataggctgtgggatttatttatttttttaagtcagatcgttctgaaaatatctgatctccagggccaaaataggcagtatctagcattttcttctcttctcttatcactacctccccacccccacagccctaccccaaccctttttcctccctagtgtggaagagaggggaccatagcaatttagtggaatatattttaattttagtaggtaaataatagacatagatacctcccatttgtttgagtgggtagtttgattttgttaatgtccttggaataatcttgatgggaattaaagagagttgaaaaacaattgctccctaacaataaataaaaaatctggaatctaggatatatcatatagtatagaaaaaccagctctctaattacagtgtaaataacacaaactagagattactgaaaattatggcttaataccaaggcaaagaaatcccttacattaccatcttcttcttcttatagccagataaacaaaatgccattttcagaggccatcat

SEQ ID NO: 62313 - DNA, 1060 bp, Homo sapiens
agaactggaagaaaacaccatctttttttttttatgcaaagattattcaatactagaatgaatattattgtggtaatggattttgtttttatcctttcagggtttgaaagtattcttgaagggctgtttggacctgcattattaaaagatctcagtttatttaaaggtattcaaaatatttttggtatttcaaattcttcctggtgccatacatgatacgttggtgttttaagcctcagtctcctttttattcacggtttcatgtgggttaaagctatattcatgtaagcatctttttgtgtttagttgatattgttaatatatgtatgaataatgtattaactagtgagcagttaagacttaagaatttaagagttaaaatttttaagacaaatatggcctaactacttagttttttgttaaacaatatttttgaaattaattctaatttattttcctaaaaattctcttttatgactattaatttgttactatttttgcagactgtgaacctgaaagcatttctgattggacttttgatgaaaactgtttattctgttgcttgagaagagataaagtaaaggtaactaagaagcctgtgaaacttttatttagtgtagtattttaaagttttcatcttttaaaacattgtgttactttgttggaggatttgtaggaaaaggaaggtatggtttcatacttagttatgaaagagtttgatagtaatcctgggttttgcaatttaagttatttccatcctgttgattagcctattaagaaacctatatcctaccatgcatttattgttgttattttgtttttttgcttttttgttttttttttattttgagacggagtctctctgtgatgcccaggctggagtgaaatggcacgatctctgctcactgcagccgccgcctcctgggttcaagcgattctcctgcctcagtcccgagcagctgggattacaggcacctgccaccacaccagctaatttttgtatttgtagtagagatagggttttatcatattgggcaggctggtcttgaactcctaacct

SEQ ID NO: 62314 - DNA, 1073 bp, Homo sapiens
tgaaaaataaaaagaagaaacagttactaatttttttttcaggttaggatgaggaagagagccattctatgcttggtagttgtatatagtatattcttgtaatatgattgagagttttcctttgctgtatgagggtaaaatattgtatgaattttttttaagagacagggtatcactgtgttgcccaggctggacttaagtgatcctgcttcttcaaccttccaagtagctaggactacaggtacatgccaccatacccagcttgtgtgaatatttttagaagaaaatacagatagagaaagtcatgaaatggtgaagcacttaaaacaactgttttactgtttgtagttctacagtttttagttggttttctaaatagaaataatttttccatttgacagctcagctggttctgggaaagctatttttctccgttagatactatatcctgtctttggcatttattattttcggagacagtcatacatctgtaatggaaaatagtaaaagagaaagcctatatcatgtgaattgtcagatttacagtatttctttagttgtgttagacttaaagtgtttatattggaactctttgcagtcacttggagcatcttgtccgagaaggactagagtctggaaattaagtattttttttgttttgttttttggaaatgtattatatccgttggactgaggcttgcattttaaggctggcttaagattctaaaatagaaagaactatctggagaatatggtaatagccaataggtggcagcatagagcatggtactggatcttgagtttgagattggcatggtgagataatctaggtagtatttggaaaagcacttagaaatattgacctgatatttgggaagcagcagctatgcatacttttagctagttggattttcagtaaatactaactctgtagaatggataaagcaaatacattatttatatttacctttaaaaacacgtaggtgaaaaatacgaagtagcctctttgggaagtagaacagggattcacctagagattagtaaaaatttttgaactgcacttcaggatcgcg

SEQ ID NO: 62315 - DNA, 1057 bp, Homo sapiens
tatctttttccttgaaacttttgtaggcttgttttacatttctttcaaaatacagaaaagttcttcagtcatggagtcttgaggcttatcaatccttcatagaggcattcaggtttattctttattcacaaagcataattaccatcagccagaaccttcaggaaagttcccttcatgttcctttctagtgaggagtctttacttttaagaaattctaaatggatttatacttcttagttacacttttcctccatttccaagatggtggttactgtgatgggttctaaaaaagtttcatacaaactcttgataatcttaaatattcttacttaatcttcagcagactcagtgattccattttctttaataattcttcatatgttctagtttacacctctcattcctctggaaattccctccttccctttgacattggttaaaagtctgataagtgctggttctgttgggtttctttacagttggacactagctgggcttctgcttaatgtgatcagtatttccaaaaggcggtgtgaagtgtagtgtcatataaaattaagaaatgcagagattattttctgtggcactttttttcccattttcttccattagatccctaggcagaattaaattgtttagtacatccttaattctctgtaaacacccactagcacctcctgacctaaatctcccagctgagtctcctatgtcttattatccctgcacattgctcagaattctaaaattatgttcaaaataatcattttcttagttttatgaacatctgattgttaaaagcaaatttaagtataaacaacttatagagcagttctatcagtttgcttaccaaataaaatatctttacagctcctctcctgaaggatgtacacagagtcattgatctgttgtgttgttatagcaagcttcattatctgaaaagaggacttcctctccctaatttacatggaggaaccacttttcatccactctttgcttaggggacattaataaagtcaatcataagactcctacagaaaaattctgtcgtacttttctg

SEQ ID NO: 62316 - DNA, 1087 bp, Homo sapiens
ctttggtaatgggttcacaaacggagagcgcgcttagtaaaaaattaagggctattcttccaaaacaaagtagaaaaagcatgttagatgctggacccgattcttggggctcagatgctgagcagtctacctctggacagccatatcccacatcggatcaagaaggagaccctggctccaagcagcctcggaagaaaagagggcgttacagacagtacaacagtgagatactggaggaagcaatctcagtggttatgagtggaaaaatgagtgtttccaaagctcagagtatttatgggattccccacagtacactggagtacaaagtaaaggagaggctgggcactttgaaaaaccctccaaagaaaaagatgaaattaatgaggtcggaggggccagatgtttctgtaaagattgaattagatccccagggagaggcagcacaaagtgcaaatgaatcaaaaaacgagtaggaatactgtagagtgccaattactgtacaaactgggtgagcactactgcatcattgttcagctatcattgcttgcacgtaatttcatttactgtgacacttgcttctttgcagattttgcattgacttgtgtgtacagagatgaaatgtgcattctgaatgttgcatattttaaatttttcatgtgcagtatggctcggaatatgtttggccttttgcatgtttctctacaaaagagaattgagttacctcacagagaacagatacatggaagtggactccttgcctgtagagcctgcatgcttttttgtttttttttgttgttgttgttttttcttaagttatatttgtttttactttttaaaaaagaagaggaaacaaagcccccttttagaaactacgtctgtcatactgggagctttatcactgcaaattggaaagccatcttatacaaaattattcacatttttcatctacgattcaactaatcgaaggattaaactaaagaaaaaactaagaagaacaatgaacctttgactttgagaaatttggttattcactgacataattattgggtcatttatagttacattttataattttcttctcactatt

SEQ ID NO: 62317 - DNA, 1069 bp, Homo sapiens
tgtttagcacacagttcaggacctttgagatcatgtttgtataagcactccttgaagaatatctaagctttttctgagatgggcttttaaaattataataagggaagtttattttctgcggtttttgcaagaataagcaaagcccatggaatttaatttttcattgtgatcagattaaaattactatttgtgcaaaacaaattccacaccacatgtactgtatattctaatctgctgagaaaggtggtcaggcccttctaaatgcttaaccaaaaacaaacattattggagtttcagtgtaaaataaaattaaaattggagggttggttagattgatttcagatggatactaacagtttgaggggaggtccagatatttccaaggcataaattcttgcctggaaactttggagcaattaattaaattaggttaagttttccctcagcaacctgtgtgttcaaaggttaggcacaccattgctgttactaaaatacatgcactgctcattcttgacatagcttgggtgtgggttcctcttgttttggttattttgtgtagcagtttaatcagtggataactgagcctgtttcctcttagctttctagacttcttaacagaaaaaacagtttgggttcaatagcattttatgattctacaatattttgtcacctagctggaagttgcaataaaaattccttatgaaatatatggttttcatctgtaattgaaggaaatcatagaaagtttgctgaaagcaaagggctaagcttatgaaggaatgcctcctttgttacacactcaagaatttgtcagcacacaattaattgcagccatagtacctttttgcgtaatgtttgggatattcagtagcccaggattgctacaaaaaggtcctttgagaaaattaatttgtgcttgcttttatcccctctcagaaagacatcactaaaggcccattaaaaatctggccctaaaagttcaacttttgtagagtttattgttcagagaggtttaatcctatgtggtagtctatataagtgatgtatgagttgagttatgtaaattttg

SEQ ID NO: 62318 - DNA, 3007 bp, Homo sapiens
gataggaaataatgtatttaaaataattttttgcattttcagagaccttgatgttatagggtagataagctatggcactataaaatcaaaaacactaattctgtggaaggatatctagttggtatttttatctttagctttctcatttctgagacagcatagtcatccagcttgatggtaatgtagtatattactttgttcagtgggcttataagtgactctgaattatgtttgtgatgagctatacactttttttctgttccccaaataccatgaaggacaaggtcactctttcaggaaaaataatttatatttgtgtataatactttttaatattaagtttgttgttctgaagtttagatgttgcttgataaacctttgctgcagcagatcatgaatatgagtaaggctttgtgtgataataggggtccttatgtgaagttaattactgttcagttctggtgagcaagctcaacaagtgtgaagtgtgtattagctttatttggtacacttttactttacaatatcgaagtgcttttagaactctggttatcttatataaaccattacctcaaccaattggcatttcttttccccaacatttaccttagctataatatgagctatgtgggatcagatggtaaaactataaaaggcacaatgagaagtttagttcccaagttttggagagaactctaaattagactaaaaacaactacctgttaacaccaatatcataactaccttctgtcgttaggcagtacatagcaacctttgagctgctagtgagctatctgttctccccctacccccaagtaagcacacagtgccaggcctggttctaagcctttgtgattctcttacatctcattgacccataatagtgaagcatggattcatttattttcataagacaaattgagtcagctcgatgtcagaagttgaaaatattttgagtagtttaacagttatatgagagattggcatcattttctttaacagcttttatctttgtagatttccttttgagacatgtatttttgcttttataatcctttcattaaatgccagaggttgttttcatattaatcactcttttctgtatattcaggttgctgtcattggtgatagaatatggcaatagacagaattgtgctccactttatgttttttaggagatattgaaagttataggttaaattttggccttcttgaagatatcaaagattgttttccttgttacctttaattagaatttggtcttcattaatgctttggtcaggctagcattactaaaaacttgatggcttcagcagaacagcccgtttaggagactattaagctatctagggattttttttcaaattaattgctttcaaaatctgaaaaggaaaaaagtataattgtggtacaaagaagacagatctccaggctctttcttctcagtttattttggtttaattctgtactggagacttgaataggatttgtgaacatggtgatggaaagaaaaatagaggacattatttgtgtaccctcattcctgaataatcttgcagtcaccttttaaagaagcagacattagccctgtaacacaacactgtagctataaactctaagtgttaggaaggagattggggtggggagggtggagtaggatggaaaaagcatgtagacttctgagaagaggctaaaaattctgccctataatactaaaaatgagtcacaagataatgtggtgaagttaggccatcttgatttgatagaaaaatcttttacattgtttaaaaatgagaatcgaggctaattaatgttgatttgacaatagaacatgagctaattctgcaaccgtttggggggtaattttatggtttccagttcatttagagctgtatcaagaaaagctaaaaagcaagcacttttagttaatcatagatttattggatatagcaaatattattataatatttaatctctattatttgaatgtggaaatgaactcttttaccccatcttgaactgtcattgaacatgctcaagatgatcaacactggaaatgaccctacacacataccaaaaaaatctaaagcagtaagacatatttgaagatccatacctcttaaactttttagatttgtcttgggaaagaatttatgaacctgtaaccagtattagtgcagtcttgggttccttgttctgcataattgcaccctttctcaggtatgtcctgacaacataaattttaaaataatctcattagagattagattctcagtggatagtgtgtaaggggactaggggtggggggttgggggtagttggacacaggacactgacacagtagagcagggatttttaacagtcaatagccaaatagaatttcaatctagaatatttttaccccctcagaatgagtgaaacaacttctattatttggtgtacccggtgctacactcctaaaagtcttttttttttttcatccaggtgacgttttttatttttcctgcttggtggtggaaggttatatagtaaacttcactgtcattaagaaagcgcttgtccaaaatgtttaaagtactagaaaagggataattcagcactttttctgttacaacactaaagtcttaatttatcttcagagtcttaggtactgtaagtttttggatgattatttaaaaatataaaacatactacataatatggggtcagatcacatttatataaataattcttattttaaaaaagacaataacattttgtacctttctagcaattccaagtgattgcctcattttctcttgttaagcatttcaagcttaagaatttggaatttgagagaaggtgagggggaaaattccctaaaataaaaatttgtttcaaaccattttagaaaaataaatcactaggaaaataggtagggattctctccccctttaagtcttcagggaatgagcagtatttagaatctttggctgaaattcaagcctttttactttgtaaattttta

SEQ ID NO: 62319 - DNA, 1029 bp, Homo sapiens
gtttatcagtagtgattctgccaaagttggtgttgtaacatgagtatgtaaaatgtcaaaaaaattagcagaggtctaggtctgcatatcagcagacagttttgtccgtgtattttgtagccttgaagttctcagtgacaagttttttctgatgcgaagttctaattccagtgttttagtcctttgcatctttaatgttaagacttgcctctttaaaattgcttttgttttctgcagtactatctgtggttaacaaaatagattatttctctgctttaatatttgatatcttacatctaaaataaattctctccacatataaaacccatagcctttggagatatggaaaatggtatctttcagatttctagaagttcaagtgtcatacaacaaaacaggaaccccctttactcttatggacctcatttcaatatactgtttacagtttgatggaattgtataatttaatatttctcttgtactgtagtttatatttatttacagatttttttgtactgtgtgatttgaactttttgttccttgctatgatcaatgtttatgtagtagagcacttatgatcacaaattaagttttttggtttgattgcactacattaaattttttaatgcagttctgatttttgactggactaaaactgtgtcttaatgtatgtgatgagtacttaaaattttaatccatgtggtccccccccttttttttttttttgcattgtatgtcaaaagcgcttgttctttcgtgcatgtgtaagatttaatggttccattgtattatttgaccatgacattttggagaaacattcccagctgtaatgttgtgtatggtagttctcactggatgctagagttttcaaaaccactattcttctaataaattttgttgtgaaaaactgtttttaaagcttggtttctacttcctaagattttaatgctttttgaaaaattcaaaaaatgggtaaaagttggattgtactccaactgtaaatacacatggtacaaagtgattttttta

SEQ ID NO: 62320 - DNA, 1060 bp, Homo sapiens
ctcatcaagcagttattggtagttagagagtaaatacctaaattcatcactcctaaattctagactctcagacttgtcacttcacctccatgccaaatctcttctccacttgatctttaactctaagataacataagcattgcccacccaccagtattaaccacaggaatgctttccatcagaaattaaatgttgtgttattgacttggtaggcaagttaagctgtgtctaacctatgatgtagataaatattgagtaaatcattaaagatggggttatgaaacaacaatcattcttaaactgtagcttttaaagggtttatgaatattatcttatccttttaccacacccttaacaattgggcatggaactgaagataggaagacagtggtcaaggtcatgcacaccgtttctcaccaaggagataaactgaaaactaatttaagtattggaaatccagttttttcttttcctttatgagaagtgggagtacttcctcccattaaccaatccctaggatcttactgtgctttagtggtggttttcaggtatttctgattaacgaataattcacttgactattacagagtcctcttgatgagcagaagcagcatgaactagcatgagctcaagtcatttcaacatctgttatgaattactgttcttataaagaccttatttagtcagatgtgaaggacatcgtatgatacagactataatctgcaccgaactaaaacagtgcttcctggaccttaggccaagttgaggaaatggtttgcagaacagaaaattgcctctctctggtttccctactagctgcccaacaatattctaagttaatgcaagtgctatatttagggtttgttacaaatctaaggtctcggaaaaattgaataactagaagcaaaagtaaagacaagctgtttaaaacaggaaaaactggctaacacctattttttaacataaaaaaatagtaatagaattaaatatcaggaagttgagattcatttttaaaatattcaaatgataaagtgaaattcatctaaatttaggtgctatt

SEQ ID NO: 62321 - DNA, 2453 bp, Homo sapiens
attccagcccctagacatacagtagatgtgcagcttcccagagaagacaaccctgaagaacctagcaaggaaatcacctctcacgaggaaggaggtggagacgtttcacctcgaaaagaacctcaagagcctgaggtttgccccacaaagattaagccgaacctgagcagctcccctaggtcagaggaaacgacagcctccagcctggtgtggcctctccctgctcaccttcctgaagaggacctgccagaaggtggctccacagtctcagctcccacagcaagtgggatgtcttctcctgaacacaaccaaccaccagttgcactgttggatacggaggagatgagtgtaccccaggactgtcacctccttccctccactgaaagcttttccgggggagtcagtgaagatgtcatttctaggcctcattctcctcctgaaatagtcagtagagaagaaagtcctcagtgctcagaaaatcagagttccccaatgggcttggagccccccatgagtctgggaaaggctgaggacaaccaaagcatcagtgctgaggttgagtctggagacacccaggagctaaatgtcgacccactcttgaaggaaagcagcacttttactgatgaaaaccccagtgaaactgaggaaagtgaggcagcaggtggtataggaaaattagagggagaggacggtgatgtaaaatgcctgtcagaaaaagacacgtatgatacaagcattgactcactcgaagagaatttggacaagaagaaaaaaggtaaaaaattccctgaggcctctgataggtgcctaagaagtcaactttcggattcttcctctgctgacagatgcctaagaaatcagagttcagattcttcctcagcttgtcttgaaatcaaagttcctaaaaatcctagtgcaaaacgttcaaaaaaagaagggcaccctggtgggacaacacctaagggccttctacctgacagtttccacacggaaactctggaggacacagaaaagccaagtgtcaatgaacgcccctctgagaaagatgctgagcaggagggcgaaggcggggggatcatcaccaggcagactttgaaaaacatgctggacaaagaagtcaaggagttacgaggagagattttccccagcagggaccccataaccacagctggacagccactgcctggagagagattggaaatctatgttcagtctaaaatggatgagaagaatgctcatatcccctcagaaagtattgcttgtaagagggacccagaacaggcaaaagaagagccagggcatattcccacacagcatgtggaggaggctgtgaatgaggtagacaacgaaaacacccagcagaaagatgatgagagtgatgccccatgcagctctcttgggttgtcgagtagtggaagtggtgatgctgctagggcaccaaaatcggtgccaaggcctaaaagattgacctcttcaacctacaacctaagacacgctcattctctgggctccttggatgcttcaaaagtgacttcagaaaaggaagctgcacaagtaaaccccataatgccaaaggaaaatggagcttcagagagtggagaccccctagatgaggacgatgttgacaccgtggtagatgaacagccaaagtttatggaatggtgtgctgaggaggagaaccaagagctcatcgccaacttcaatgcccagtacatgaaagttcagaagggctggatccagttggagaaagaaggacagccaacaccaagagcaaggaacaaatcagataaactgaaagagatttggaaaagcaagaaaaggtcacggaaatgtaggagttcattggagagtcagaagtgttctcctgttcagatgctctttatgacaaactttaaattatctaatgtttgtaaatggttcttagagacaactgaaacccggtctctagtcattgtgaagaagctcaatactcgccttccaggagacgttccccctgtcaagcatcctcttcagaaatacgctccttccagcctatatcccagttcactacaggctgagcgcttgaaaaagcacttgaagaaatttcctggagctacccctgctaagaataattggaaaatgcagaagctctgggccaaatttcgagagaatcctgatcaagtggagccagaagatggcagtgatgtcagccccggccctaattctgaagacagcatagaggaagtcaaggaagatagaaacagtcatcctccagcaaacctgcccactccagccagtacccggattcttagaaaatattccaatattcgaggaaagctcagagcccagcaacgtttaatcaagaatgagaaaatggaatgcccagatgctctggctgtggaaagtaagccaagtcgtaagagcgtatgcatcaaccctctgatgtcccccaagcttgccctgcaagtggatgc

SEQ ID NO: 62322 - DNA, 1443 bp, Homo sapiens
cctacacccagagctgatgttcagctgtatgctccaatgtgaatgtacttgttggagtagacgttcattctgattgattaacaccatcctagtagttaaatgcttgtagtatcactcctgccatgtcatgtcaggctctattccgtgtctcagaagtgagagccacaatgttttaatgactttgtttgcctttcccaggtgaagcctgagacaggcgcattggcttcaacctagtgcctgtgaccttgctccattattatagtgcagcgtgtacttgacttttccattgggccgctctacaaaaaaaggcttggttgttgaagcctcagtcagcttccttaaccggttctgtcaccaaaatcagcttgtatggacagctgctgccctgtcctttttatttgaaaattttccatttaggttgtttcagatctctttagataagcccagatggacttttttcatgcaaatcatgataatacaggccttctacccattctgttaaaggtttgctgtatatcatgggaacttctgatgattggataagactggagaaaagtatttgatttgtgagaaatttagaattgtgttgaatttcatagctagagaagcttgctgtcttatgaagccctgattttttttcatgtcttctctatctgatgagtctttttctttttagtatctttgactttggccattcaagagctacctacattaataaaactgctgagtgtgtatgttggcaaccctttctcagcattaagttgcacagaggcattaatgtgttttgaataggttcatttaatcttaaaaaatggttttaaggttttaaaaatgtcttttcatatagttgtcactggatattgtgtttgtggtgacttaaacagctgatgtttgccaatgtcaggcatgctgattcctgtacagaagaggtgccccgttggctgcataccgactaccttgtaaggtgcttggattaggttagggagaggtgtaaggtagtaagtgggtggaacttttccagttccaagtttgtaattcattccattccttttctaagttctttttcatttttaaaagctcagttaaagataatagccttctttcccattctaggctgtgtgtgagaaaaggtgttaatgtgtatgtatgtattttatatacctaacaatgcaatggatcatctttaaaatcaacttatactttataataaggacatttaaatagaccaagagtctacataattatgacacttaaaagtttagaattttttatatttgttgaatctcatttttgctgattcagttaattttgttaatagaagaaagaaaacagcaaaacttgagggctaatcctgcaaggccctttgatacctacagcaggtactggcaaagcagtttcccagatacctccaagctcaggtgtggtattgactcaagtctgcta

SEQ ID NO: 62323 - DNA, 1063 bp, Homo sapiens
cccatcttctatcctacgagactccctgctatagatggacatgcaggagaccactccctcacttggggtcctgagcctcacccctagcacttcctcagacaggtaacaatcttgcagcacagcaggaaggttgtgaacctttattctgctcctgaggcttccttcataggaatgctgtcagtttctgtaagtcaccagtcactagccccttggattccttgttaaagacttctgtgcagccttatctaaaatgataatcttaggctgtgagtctcctgctgtattgttcctaaaatcgtatggatagaagaggtgcccttagtcatccctttacatatgtggtgctttctaatgggatctctatgcatcacatactatgcaggtgaatttctcactgttcagataggtcatcagtaaaaggcatcacttcaagataattactttgaattgaggtttggcctcttttcctgctttgtaatgggttcggtcatgagggtgggagctgtcattcacatttatgggcagcattcctgttgattagtggacctaagagccaagtaggaaaatatagcatgctatgtgatacaagctggagatgctgtagtgttactatcagcaagttctgtgcagactgcctttcggattccagatgatctgtcaagggtctgccaactgtgggctggtcgcttgtttgtgtaaataaaatgtgtttggaatatagccacacccattttcttaagttctgtctgcggctgctttcgcactgcaagagcagagttgagtagctgcggcagagacccgtgtggcccttacagcctaagatactatctggaccttcagaaaacatctgctgatccctgcttgagaaagtcatccttttcaggaacaaatattcttgattttccttctctcttctgcccttttctctctgttcttctttacttctcattttccttgtctccattttttcttttcaaaggagacatgttatatcgatatgcactactatccccttaaacttgagcaaccttagcattccatcttcttaaaaaaaaccatcaca

SEQ ID NO: 62324 - DNA, 1921 bp, Homo sapiens
aatagaattctggcctgaggctccccaagtcttattaccttgtatgaaaaatccccatattagcctcacttaatctcaatagaagcctgctgtttaccctcagggaacaagtagttttcaaaattgagctcctccaaggtcattggccaatgctgtgtgcaggcattggtcatctttgtaaactcatggcattatttcctcatatgcattatgatactaagaaattcaaccccaacctgtatgaaaagcacagcccagggccctaattgaggctagcatgaatgcctttgaggggccagggggccataggaggcccatgcaatttaactgaagctcaggtgccacgttggatttttattcttattaggccgcaacctttctgaatgagtttagggcaggggctgctgatccggctgtggattcagggagctctaaaatgaatctctaccgttcctttaaaggtctttctggttcctcccagtgttgtcattgctgaggtcgatctcgtagttgttcagttgtgctctttttgctgtcttgtgagtcttagccagtgatccagctgcccaaggacagggcctccagagggcctagcgccctcctggtaccaagcgtgtgctcctggcctgtgtgacagtgtctttcccgaagcagtgaaatgagaaattctgcaagtggccacccggaagatcagtctgtagctcttgggcctggatttctactatgttagtgagtgtaggaatatactgtgtctttaatggatgaaaattcaatgtatgctgtgaatttgttggtttgaaacattgaaatttttcattagacaatgtttacatacctcacctgaagaacctttgagagtgtatatataaaattttaaaatatattaagttgctttaaaacaatatgtatagctataaaagttggagttattttaactttgaatatgtaccaagtctcttaaatattgaaatcttgtagacttcttgtgcttctgtgttttgctttcctatcaggccatgtaggaaactgtgttcttgttattggtagaggggccctcactgaaatccaagcttggaaggatgtcctgtgttgtttcagattctcttgtttggttttgaaggatgcggtgtggagccagaggatgtgtgggaggggtttctctaacactgacttctattccatgagctttttcaaggcgcttattttatggcagcgtattaaacttctttgatattcaagtgtgtctgtgtagtcactgaagagggcacagaacgccttgaagccgggcattcaacttgcagcctaaggcaaaattgatgagttgccagaaggaaccacaaagcaatacttccaccaagtgtcagggcttagagaaaccttgtttgctaatgtaagtaataaatcattttgtgagttctgcctaacttcagggaaaagaaaaggcaatggaggaatccttgagattcccatggcagggttggaaaggtgccagcatttcatcctgaggggcagggagcaatggagggcaaactcctgacctcaggctagccactgggaagtgtgcaggccacaggccagggctgccccagctctcaatgcccttgttggagtatggcagaaaaagtccttcgatttgctagcctcatgagtttttcattatattctttcaactctgcttgaagtgggtcagcgtaagggcccacaagcggctcatctgactgtgccatcactgtgcagaaccacatccagcaaaaataaccccacagctgactgccaggccacccctctgaatctgaagttggaagattacctcattccagattagttgttttcattgttaagatagacctcttttcctccagtagtcatcctgtagtggagtaatgaaaatactgacccaagaggtgcagactggctgcct

SEQ ID NO: 62325 - DNA, 1045 bp, Homo sapiens
ccacgtaatgtgaatatgtatagattttgtggcagaaatgtgaataagtctgattacggggctgcctcagctcctaccagcaggttgtataatatgcattgtctgaccttacgaaaatctaaaaagtgttgaattccaaaacctatctggtcccaggaggtttgggtaaaagttgttggtctgtattttcatcatggttgttattggcatatgtgaaaatgtttgttacttgaagactgctttatgaaggttacgcagttttaaaataatgcttccaactgcagttgtgcaaacgtagtctcatttctgggacctccccattccaccagtcaggccagcaaggggtggtcagggcagagcttcctggggcttgtggctgagggacccaagcctagggactcagatggagtcccccaggagccccctgtctagctggagcagcctgaggcccatgacaggaagcaagagcccaggattgttgaggcctggttccacggtaaatgggcccacaagagcctccatccaaatggtagacggacgctgtactcctgtgggggctcccaggggtggggcttggcaggcagaccaatcagcagtggcagattgggcagcatgcgccctccttggagggtggaataaggcaggactgcacgttgtccagcctggagctgctagcacagcccctcaatcacgaagggcaagcattgtgcttagctccggacccggggttgtggcacacagtggagcgttgagtgcgtgttctctcaactgcctgtcctggtggaaagatggaactgacatgttcagctgtgcctggcattacctggaacccaagatatatatccagtatatagtcattaaatggatgaataagtggtggcttagctactgtaacatttttcagactgtaactccagactcattagtagactgtgatcaattggatataaagggagccccagcccctgtttaatattaatgtcaagattaacattaaaagatgaaacaaagtatcagacagcaacatgccatcttatataataag

SEQ ID NO: 62326 - DNA, 1037 bp, Homo sapiens
agacaggacctagatctaaacctagatactagcattttgtgggattgtctagaatttggggaagatttgggttcctaagatgcacaagcgttttacaccagtggtgattaactcaactaaaacccactgtaggaagttagcttccccagacagctaatgccgagatcttctaccagcgtagagttgacagaagcaggccagcgaggaggtgtgggacataatagcctgagtgcttgggttaccatggagactggagtgtgtgaggccacagcctgtgctaaagagccatggagccctcccctggccatgtctggggacagatagaacctgttgggggaaatattccctcaccccagggttctttctgcagagcaagggttgcctttgtcctatccctgagcttgctcaacaagagaaacaaggtttcttaagtgttttggttaaagttttcattcttatttgactatgtatatgtaattgtaaagaaacgatcctatgcattgtctttcttttatattcttgtaatattctgaaattaaaattgttttgtttcatatccagaggatttgactggtctattcacattttgactgttgatgttgaagagagagtttttctcttgttctgaggaaagtgaagcctctagaaaggctcctctttggcttgtttttaggtgggtgggtgggttcaggaggagcggggcttttggctgataagaagtatgatttggagcctctgggatcctgagcttcctaatttcccatggctgagtctagaatgcttcacatagatttcagtttctcacataatttttatttcttcatttaaaaacaaggagtgatggttacaataacaggaaaacctagatgaagttttcatctgaggcaggaaggtgtgtttagacagctcatgttgaaatgttcctgctgctgtcttggtgggcttgggctgctttaacagaacaccatagactaggtggcttctcaacatcaaaaatgtgcttcttacagttctgcagtctggggagtccaagagca

SEQ ID NO: 62327 - DNA, 1776 bp, Homo sapiens
gaggaagttaggatcagaaagaagaagcaagcagcaacctctgcagggctgacaggatttaaaggagagaatgttcttatttggaagcagctgtggcttgtcaccaatgttcaaggagtgttactgttccgccctctctttgtcagaagggacacaggtggtaatttggagatggggccagagcttctggcttttggatttggtgtgttcacttgtgttggatagagcagtggcatggctttgacctagtatgaactggtgtctgcccagagagcagcatgtagcaggggggaatgctcaggtttgtgcctggctctgtggagctgtacaacccttctcaccctgtgggttggagccgagtcaggccactatggggaagcagttgccccacaaaatgtggtttgctgacctatttctaaactgttgaatatgctgcaccattgctgaaatgaaagatgactctgggggagcagagcttggccttgtgcccagctggcagccccctctgccagcctttctgctgcttttgctgctgtaacagcaatagtggagaaaaatgtaaaatttggtcttccagcttaatgcagtgtgaacaatagatggttaggaaaacaaaactgcttagaagcccctttctctagagcagttttatgtcatttgtaaaaacacatattagcaaattcgtttgcgtaggtttctattaaatatttgactttttttttcttattaagaaaatgaaatcccttacaccagatatcagttaattcaaacagaaaaccctttgggtatcaccaaattgaaatggtattcttccttaactcttccttctttcctttatttgtttagacgtgcttcatcccgaagtggtgctatggtctgttaaacagggctggcatcaggtagagggagcagagtggtgacctgatagctcctgtcatcgtgttagtttttgattctatttaagggaagtagctgagatttagacggatgtagatgctctttgggtgaatggaatcataagcaaaggttgtgttctggggtgaggatcatgagagagatatttatcacatgcacatgcctttatatagctggtctccttgggtggtttatgtgtgttttgtttatttattgaatatgttttcccttgctttaggggttttataggtcatttttcttaatagaagctgtgatcgacttagaatccaaatttgaggagtaagcagcataaccttctaccttgtaatatgtaactattctaatccagtggaatcttacggaaaacacagagaaaaccccttttatcatttgccacagaaggctgctgtctcccttctgatttggtgggcaggtattgtttttgagccagtatttaacagagttttttaatctataagattttttttgaatctatttcattgtgtttgtttttcatgttggaacaatctctctggaagtgcctcttcttgtggcttttacaacttcatttctttctggggtcacctgtgatgggctttgatgtggtgtcaatttggggccttgtgtttgtgccagagggatacacatattaaactgcaggccaccttcctggtccagactgtactgtgtgaaccccactgactaaattagtgagaaccataggcgttggaatttctcaccttttacaatgatagacttttgcattgggaccaatgaatctggtgtgaaaaaccctgctgtagtagtgaaagagcatcaggagatactgactgtacctgagggccaaaacaggagcaggta

SEQ ID NO: 62328 - DNA, 2413 bp, Homo sapiens
ttgaccttgtcatctgtggacttcctaaatggtctaataaagttcccggtattgttgatgcaatcttttgtgtaggtacatatgtgtatttttctgggggagagaatatatggttctaattagattctcaaaaatgttagtagttcagagaagtcgagataatgaatgaccctcaattggatcaggcaatggcattttcactttactctctcctggtcacttcctctatctggaaatgccttcctggtgttatgatgctacattattctcgttcttcttcctctttaattcttttccttatctgcagtggcttactgttgtttgcctattccactacatctttatttttttcaatgctctatcttaagttctgctcttaagttctgttcgtttctgcacctgcttctcctgcctctttgcagcttggtctccttccactgctcagctctgctctctgtatgataactacttccagcctggcaatgccaggtctgaactctcttcagacattggcagtctccaagcccacagatccaggtgcctgccatgtatttcttttatacaacaatgaatatacaacctcagattttttgatagtgatgtttataataaaagtaacatattctttgaagaagataatgtaattttattactgtgatcaacaacataatccaaaaagactattatttagtacaggatttctcaaccttggcacactactgacatgttggttcagataatgctttgttgtaggagctgccatgtgcactgtatgatgagcagccttcctggcctttaccccatcgatgctgggagcatccttcccccagttgtgataagtaaaagtgcttctagacattgccaaatgtcccatggtgggtgaggaggcaaagtcatctccacatgagaaccactgatttagcacctacttattatggccattattttcagtagtcaaaatcttacccattcttcaaagtctagcctaaatctcacctcctctttgaaactttctctggctaacacagccaaatataatactttttcctttgaacttattaatgctacaaaaatattgacacttagtatgatttactgtatttacttcacatattgtcttatctctgtaactagtttttcttctagaagacaaaggtcagacttagtgtatttgtggccttctgtctcctgttcttctcatcttccgaaaaatgacagtgccttgtgctgagtcggcttttagtaaacattgagtgttgagaggggcggtggtggtaggagcatgagttctgcattcagctgggcttgggttccattcccagttttgctgcttaatagcttatatattagtcctcgggcaaatgaactatgtaggctgcagattcttactctgtaaaatggtaggagtagtacctcatatactggttattgtgaggataaataatgtacataaataacttagagcagcacaaaatatgtacttactgttagctgttacggccattaagatgatttaatgaacgagattatatcaggcagatgtttatttggtagagtcacacattcttaattaaactcattagccttcagtttggagaaaatattaagtgtagaccctgtagcttttgagtgggatgtttgcaaaaagaaatatttaagaacatgtctaacgctcttgtttttccttcaacctaggatttctctgaaggatccagagttgtctcctatggtccatgcagaattttctgtttagtgggcaggtgttattcctgcccacagcaaagcttggacttgcagcttgcttgctgcattttgaattgtcaaagccaactaataccgtgacccgactgatacctctaaccccactcactggatgatgtttgcaagctgtgccttctgagagagtgcttaggccctgtctctcttttttaatattatggggaaaccactaactatccaaccagcttatacagcacactaaggtgggcttcagtgctcactcaatgtgtttaggcagattccacttttgaaaaaaaatatgaaatgtgtgctcaactgccagtaattttttaaaaagcactgtcccagtggattgatgttgtttttaatggatattttgggtttttctctgttttgatagtattgggtatttggttgtttttgtttgtttatttctttgttttaaaagccatgtttttggttgggctctaagctagatatctttccctctttttcactttgagctttgggaaaactctttatcttatgaggctgtattcctcaatacctaatttgtgtccaaagaatttatagcttttctggacattttttattatttcttgggtgtgacatcagagtatttgacctgcagtattgaaaaaggagaattcagaatgatacagtattttaacaa

SEQ ID NO: 62329 - DNA, 1010 bp, Homo sapiens
attgactcattcaacaaacaaacacattttgaattcaagaatgatatcactagtcacaagcagatgagtagtacagtacagtagctccttaaacaagtgctggaggaagcaattagttcttactggaagattccacaggtgacatttgagccaggcctcctaggctctatattacctgtggggtggtggttcaagatatcctaggcatgcctacttcattaagccagcagtaaatcagttaagattaatgagatataaatacatcagtctcagaaaaactcttcacattgaaattgaacaaataattcatttgttagtaaagtctgtctataggaatggcattagaacattgaaaccactgtacaattttcttattacagttattttctggctctccagctgtcacgatgacaccaacaagattgaagtggtctgaagggaagaaagaggggaaaaaaggtactaattgtacttactctctgttcttactaaatgtaattcctttctgcatctagtcagtagcatttgtttgaattcccaggatagtacatttgtagtcagaagtgacataaaaattacaaggccaggtccttgcccttgagttcattcaccagatggttattgaaccatttactcagcattgtcttgggtgctaagggtagagctgtgaacacagacccacatggtccctgtgttcttggacagacaggacacatgggggaaaataccttaagaatacttgcgaagcaaattaaaaacaagtgtaaatgaatttgtgaaaccaagttcaacagtgctgggagtatgcttatggaatagttaggttccttttctgtgtaggccagccctaattagtgaagctttctagatcaacagctcgtgcctaaggatcctggaagtcatatcatacagcatattttgggggctatttaggacaaagaggactatttaatgctgggactgctgattgtcccaggctcttctggtaaaagcctgctgtgccttcctct

SEQ ID NO: 62330 - DNA, 1100 bp, Homo sapiens
gggaatctcttaggaatttgacacattagagttctaattcctggagcaatgcagagactctggattcattctgggctgggaaaacagtttacaagagccacaaacatccacagatgtatgtagcccctccaaacgaagtctgggataaacaagaagaggtctttagggagatttggcttttttaaagtttatttttcaagctattcctgaccattgattgggttaaattcagattgtctatccatacctcaggaggttgaatgactcccaggaggactaccttttagtttggaagatctccaaatgctcagggacattcagatatgtctcctcaggaggtcaataggttctaaactaccctggtgaaaaaaggcaaaaacttacttgaaaggctttgtgaagggtcttttaagtgtaaagtagtctttagaccatttattttaataataatctttctgcttcctttttgcctgtcctctgctttgttttatgctaaacagacttgcgagtagagggtttgtttagagtaccgggtaatagtgtccgacagcagattttaagggatgctctcaataatggaactgacattgacttggaatcaggggaatttcactcaaatgatgttgccactttgctgaagatgtttctaggagagttgccggagcctctgctgacacataaacacttcaatgcacacctcaaaatcgctggtgagtataggaagtaagaaggagatgtaaatacatttctttcaatttagtaaagttcctaggaaatttctgttgcttgtgacccacagaaatacttctattaatattggttaagatttcgtgatgttgctggacttctctgggtactcataggtattggctagttaagtttaattttaattgaatggctttcttgataaataagctttgtattgagataaggagctggtagtaagatgtcgtctgagttttatttatttttgaatctctgatagatcctcgagtagtgtgtagaacattttagttggagacatgatctcactctgtcacttaggctggagtgcagtggtgcaaccttggctcactgcagccttgctctcccgggctcag

SEQ ID NO: 62331 - DNA, 1021 bp, Homo sapiens
agatggggtctcactatgttgcccaggctggtctcaaactcctggcctcaagcagtcctcccacctcagcctcccaaagcgctgggattacaggtgtgagccaccatgcctggccttctgtttgtttgttaaattaaatactaacacgctagatatctccttacttactagatatatgcttcttacttgaataagaagatggtctttcccttcagggaacctacagtctaatattgaacttagagagagctgattgagagttgtcctgctcgcgttttctggtgcacttccagttctaaggtttttgtttactgaccatgtgaaaatgcttgctgaattgtaaaataggatgcttgagtggttttaggtatgatgattttgtactatttgtgtgaaatatagccctgtcatatcatatggtttttcagaaaaaggagtgatatttgggtccccactgacggaggaaggcattgcccagatataccaactgattgagtatctacacaaaagtaagactacttgaaattttatcattctttgtttaatgaagaattctgttttctgttgagagctaactgccttgagttagtaggtgccaattaaccatcaacaaaggaactaaccagtgttaattttgggtggcatgtttttaaatatatttccttttaaacttcatctcatatattcatttgttttatactctcaaagtgtatataaattagaccgtgtctatgaagtcacatttacctcttgcctcagagagacacttctggaaaaatacattgtccctaaagaattgttgcatttatttaagagagcatggtaccttttttctccagaattctatgattaaaacacactctttactttttttttttttttgagacaaggtctcgttctctcacccaggctggggtgcagtggtgtgatcttggctcactgcagccttgacctcccgggctcaggtgattctcccaccttggcctccctagtaactgggatcacaagcttgcaccaccac

SEQ ID NO: 62332 - DNA, 1051 bp, Homo sapiens
cagcagcgccgatggacccaagccggggcacgcgccggcgacgacgacccgcatcggctcctccagcagctcgtgctctcgggaaacctcatcaaggaagccgtgcggagactccaacgagccgtcgccgcggttgcagccacgggccccgcaagcgcccctgggcccgggggaggccgcagcggacctgaccgcattgccctgcagccctcaggctccttgctctgacgcaggcctcctggaggaggaagtggaggccgctgcgtagacccaacagcgtccagttcctactaactctgagctgaagccgacgtcgccagcctgggagcgaccactttggctgcggggaggcgcgtggggagagatctcaaccagagaagttaccagccgcggcgaggccgtcggagaaaacttaagcgtggagaaatgtatgcgccagggtgcttccgtggggcatgagaatttcccgggccatccaagcccaaggacctgggataaactgggagaactatggcagctacttgcatcgacttgtacctcacttagcccttgggggcgtcgtgagcttggattgtttaaggagggctcaggggtaggaatcgcgatggctttataacaatacttgaaaactaacgacacgcatacattttcttattttctggtggaggagcttagtaagtggtgctacaattgctgtgcaaagaaattccagaggggagaagaatgtaaaagtttggtggtgggtggcttggcattgcccctttttcccaccgattcggtggctggtgaaggtgggagatgtgaactccaattaagggactggagagaggtgaagaattttgcaggtgggagatttggatttgaatgtggacttgtaaatgacttgaccttgccatctgtgttcaaggtcacggtttgctgtggggttcctgggagagcttactcaccccggagtcttttctttctcttgctccaagaagagccctgttggtgctttaccaccgcttggagtctcccgaggacacaaacaggcagagagggacgtgtaggg

SEQ ID NO: 62333 - DNA, 1023 bp, Homo sapiens
tctaaatgtttgttaacaaactgtacttcctttcttatgaattgtctatttcctaataagattttcctagggagtgtttcttacgtatttgcatgactcctttacataccaaatgttaacccttttcatattttgccgcaaatacgtctccaggcttttgttggctctgtacagtcattttttcccccactaaaaccaaattttcatgtaggcaaattttaaaatctctttgaaatttctaacacgatgctaaatttggagtctccttgctgccagaaagttattaaatattccattctattttctttagatttttcaaatgccttgatttttttttcaaatccatctgggattaatgttggtctttgtttcaaggagatgacatgaaattaattttttcctggagagcttgccagccaaaggtgtgtttcttcactaggacagaggtgtgagggtagcataaacacaagctgtctggtgagtttccagttgctggttaagctggtggttgtgaggagtgggtggggctgggaatgttttgatcagtctgttgtgtgaagtcaaaagaacccagaacaggttgtacaaagacctagatccaagtctcattcctgccacatcctgggtgtgggactccaggcaaatcagtttacaagtgttttcacttgtaaataggagaaataatccctgcctggcctccctctgaggattgttttcaggatcaaataagataatgggaacgggtgttgtcaggcattacacaaatgtaggattaggtccagcggtttactaacagaggtctggctcaattccagcgagtcccccctggggagcatttaacataataatgttgaagatcccccccatgcagcccactaggtgaaacgtaccctgagggtattacttctgtgcacttgccaggtttcttaaattctgcctcaggtctaccctgacctgggattgtgtagggctttactgaagtcagcccggaggctcccatgccccacagtgagtctccgcaac

SEQ ID NO: 62334 - DNA, 1552 bp, Homo sapiens
aaagcaggtggatcatctgaggtcaggagtttgagaccagcctggccaacatggtgaaaccccgtctctactaaaaatacaaaaaaattagctgggcatggtggtgcgtgcctgtaatcccagctacttgggagcctgaggcaagagaattgcttgaatttgagaggcagagatcgcagtgagccgagatcacggcactgcactccagcctgggcaacagagcaggactacatctcaaaaaaaaaaatgttttaaaatgcaagtttacactttatatatatatatgtgtgtgtgtgttttgagacaagatcttgctctgtcatccaggctggagtgcagtggcacagttacagctcactgcagcctcaaattccctggacacaaacaatcctcctgcttcagcctcctaaagtgttaggattacaggcatgagccaccatgcctggacaatttgtgttctaaatttgcacttgactaaagttcttaccgtatactaatgtaaatgcttcataaagatcatttccttttcttttcttttttgagacggagtatcactcttgttgcccaggctggagtgcaatggcgcgatcttggctcactgcaatctctgcctcccaggttcaagtgattctcctgcctcagcctcccgagtagctgggattataggtatgcaccacgacgcccagctaatttttgtatttttagtagagatggggtttctccatgttggtcagtctggtcttgaactcccaacctcaggtgatccgcccacctcggcctccccaagtgctaggattataggcatgagccactgcacccggctataaacatcattttcagtagctcagctttaaacatctgcccagcggacatagttcagtttacaaagcatctttgagtccataagtatgttgttctttgctgtatgcaggaatttaatgccatcactagatgccagaccgtgtgcaaaggagtatttagaaaatgccgtgatgactactctatgttctattttcgatatacattattgtgaatagatagatgactgtactccagaaaataaccctgatttgggacaatgtaagctggtttgccatttcctgaaattatgcttgacgtagctactgccattagaaacaccaagctgttagaggccagctgagttatccaaggccagggatgcagtggcacatttcctcctcccattccaaatctcaatgattcgtcatggaaatgcctggatttgggttttgaggccgtggtcaatcatcagtaaatactgactaagaacgtaggtagatggtgtagtggcttgctgctgcatactcattccagggctgaggactggagatcagctttacaagtctaaaattgggattgatgctgggtgcagtggcatgtgcctctagacccagctacttggaaggctgaggtgggaggatcacttgagaccaggaggttgaggctgcaatgcactttggtccagcctgttatagtcactgcactccagcctggaactctaaataaataaataaggataaaatcaggattg

SEQ ID NO: 62335 - DNA, 1405 bp, Homo sapiens
tattggtaggaaattagagttgtttccgactttggcccttaaattgggttatgtgtaggactgctttggaaactaatgttactagggaaatggtgttgtaaagttctagcttctgcgggttgtaagttacctttcaatggagggatgggtgggcagagggagctttgaccttctctggacatacattagaggaaaaatggaagggaggcctgtttccagggggataattgtgccaaagtggaatgtccaggtcaggacatgagccgtgtggaagctggaaccacgtgaggtctgcctagttcatgtgctggccaccacctggaggcccccttctcatccctgctggcgctgggggtgagccatcatttggcaacaggagggggcctcctattctcagccagatgtgacccttccgttccttggccctgcaggaagaagatgaagctgcagggacagttcaaaggcctggtgaaggctgcccggcgaggttcccaggtgggacacaaaaaccgcagaaaggatcgtcgaccctgaggcccagggcccctgggctgccctgtggtccagtctgaggccctttcagcccccaggctgccttgccaccagctccaggtgctcaagattctggcagagcctggactcaggatgacttggaactagggcttggctctcagaagtcctggattttggaaactccaaatggaatcacccttcagagacatccctggtgcctggagatgggaatgtggcctcagtgcctctgagtaggtgccatgaggcacctttgctttctgcccagagtggccatgagcaccagaacagatgatctccatttccgccagctgcctgtagccacgtggcatcctgcctgtggtctgggtgagatttactgtgaccagatgtagaataaatgtgtctcatcctgcattttttttctagaaactgtttcatagtctgccccctccaggggtaagaacagtgtgcagttgttggcagcagtggcctgacctcttcctgtctaactccttacatccagtccagggcatatcataaggctttgcccataggacaggctttggaacttgcccgggagcacccacctgtgtcaggaggggcagcgaatgccccagggctggtgtcgggagctgcagttcagcaccagggactgccccagctgtcctgggcacaagtctctccagcatctttgttcattgattcaacaaagtatttgctgagcccctctaagtgcccagcatagccttgttcattcacctccgtgtcttcccacattctttttttcccagacaaggggatctgtttgtgtaatgtgattcactgggccagctttgttggtctggagcagagaagggcatggcacagaagtcctgaggtcactgtcctgtca

SEQ ID NO: 62336 - DNA, 1443 bp, Homo sapiens
gcggcggcacttccgcatgaagcttcggaacctgttcaccaagttcatccgcaagtttgggtctgtgcactgagcaggggcgggggtagggcaagcgaggggccgaggatttccagtcctaccagggacactacatctgggtcgtgctgtctggccagtgcctctcaccagcccttccttgccacctccagatttgagctggtgaaaaggctgttgcccgaggagtaccacagagtcctggtcaacatccggaaagctgaggcccgggccaagaggcaccgagccctgagccaggctgccgtggaggaggaagaagaggaggaggaggaggaggagcccgcccagggcaaaggtgacaggtgagaccatgttagggccatgggacccggtgtccccccaacccaagggcctgcccaggcaatacccgctgacccccgcctctcctgggagcactctgactgggggctttttgtccttagcattgaggagattttagctgactcagaggacgaggaggacaatgaggaggaggaaagaagccgaggcaaggagcagcggaagctggcacgacagaggagccgggcatggctgaaagagggcggtggggacgagcccctcaacttcctggatcccaaggtggcccaacgagtcctgggtaagcacagggctggccagtgcactcagaaaacagacttgccatggtgccaggttctcaggtggtgggtagggggtggcatccatggcaggcccatggacagggctgagaggcgcccgtttgggatccctgagccgggcttgttggtcatgatgagggtgagtagcatgggactggccttccacctcctcatgccaaactctacaccccagccacgcagccagggccaggccggggcaggaagaaggaccacggcttcaaggtgagcgccgatggccggctgatcataagggaggaggcagacggcaacaagatggaggaagaggaaggtgccaaaggtgggcccaacgcgcttgtccattcattcaccgtgttcacttattccttcggtgatcacttgctgaggaagcgtggctaaaaacagaccagagaaactcttctctcggcagcttcctcaaactttttgagtttctcaaactttttttgagaaacattaagaaatctttttatgttgtaaccgagccatttatacaatacatatttaacttaaaggaaactatcggaaatggtacttccccttactgtgtgtgatacgctgttagtctcttctgtttttctcctcctcctccccctcctcttcctttctccttttcttccttcctcttttttttttttttttaatgcaaacttggctaaggccctgaagatgatttagaggcagaaagagccagaggctgaaaccctcccaacttcccaatcccaatgtctcacattgcccgggagtccct

SEQ ID NO: 62337 - DNA, 1081 bp, Homo sapiens
tgaaggaatgcgtggctccccacatggctgacattggctccgtgacctcctcggcctcaggccctgcccaatctgttgccaagatgttcaggtgaggatatggggtccatgttaggaagggatggtggtaccttgaggaaagttctatataatacgaatgctccactctccacctactgtgggccaggcctgcagtggcagtgctttacgggattgcaggctgcttactgaacatctgccggagcagctaccgtggacttgagcacctgccatgttttagccacacctcacctcttggtttcctagaggtttccccatctgaagttgggtcagataactacctcattggtttttctttaagcactagcattatctaaattaaactcttaacatagggagtgtgggcatgtcacaaatgttagttctcttctgttgtctctcctggggccccattcttgctggccagctagcgtctgtagctcagggtgctggccgttgactttctctggtggggggcacagggtggtgtgaccgtggccctgactgtgccgcccccttggcagggcagtggaggagggcctgacgtacaaattccatgcggcctggagctccgtgttgcagctgctgtgtgtcttcttcgaggcgtgtgggagacaggcccaccctgtgatgaggaaggtgagtggggagcggctggggccagggcaggaagtggtgctggctcttggactatgggctcctggagggcacgtgtctctgttatctctgcaccctgctccgcaccccaccctgacagggccatagcaggtgccccatgcagtatcccctggaaggtgactgggccaacaagggaggggcaggaaaaagggtggcagtccccccacctgctcactagtctttgctggagttactggttttgaaacttagggagtctatttgctttcccttatccccaccccttatcttttaaattttaattatctaagtttcctataaccagtgagtatagcattgaagttctaaacagccctaggtcccacggaggttcctccagtccagggttaaccatttaaggatcagg

SEQ ID NO: 62338 - DNA, 1038 bp, Homo sapiens
tgggaggctaaggcaggaggcaaggaatttgagaccagcttgggcaacatagtgagacgagactctgtctttataaaaattaaaaaattggccaggcacagtggcatgcacctgtattggtctcacccctgtatccagcaacggagcaagattctgtctcaaaaaaaaaaaaaaaaaaaatacagctgtaacagaccgtttatagcctgcttttttggctgttatgttaaaaccattttgttaatgtttctatctttgtttaagacatttaaagctttttcagtggcttccatgtcttactaaggtggcagtcctcagggtgtctctgtgtggggggcatgtgtgaggttcagggggccctcaactccctagcacacaggtggagttgaggggtccagggccagccgtgggctttgtagttcctttctaagcctgtgtgtccccctccagctggtgacagcctgtgccatgcaggcctttcacagcctcttccacgccaggcctggcctgagcaccctgtcagcagagctcaacgcccagatcatcacggtgaggcctgttggtgggatgtgggggcattaggtcgggggtggtgccttgggaggctgtgctgggggcactggccctgcgccttgtctacagagtgaggttggctgggctgggttgtcctagtggaagaggccagtagaaggggaaggaagattggagaccagccatcaaattcacatcagtgtccccaggagctgggaccttgacccttgacctagttaactttaatgaactgtttcagcatggtctcgtggtgctcatagataccttgagcagggctctcggccttagaggtctgtggatggatattgggaggggggatcagatcccccaaattgttagcaaaatgtacgtttttttttttcaaagaaggcctctggcttttgtcagactcacaaaggagtgtgtgacccatgatactccgctgctcctagaggctgttctcccaaagaattagagctgggagggcttcatggagaagggaaaggc

SEQ ID NO: 62339 - DNA, 1068 bp, Homo sapiens
gttagttgtagagcagggatttgaactgaggtttgtcttgcttcacagctcaggattctgtacacatgaaggccctggtgtagcactggatctatagtagtcagatcatcattggatctatatttcagccaaagctaattggttggtgcttgtgccggacacccaagatgctggtggaacgctgatctggccttgtctcctgctctccttgcccctcagatccggaaggctgcccagcatggagtatgctcagtcctcaagggcagtgaattcatgtttgaaaaggcccctgcccatcatcctgctgccatttccactgccaagttctgcatccaggagattgagaagtctggaggtggggaacccaaatggagggcaggtggatgggaggcagtggctggcagagcaggacagggcctgcggtagggcggggctggtgtctcaattcctcttctgtataccaggctccaaggaggccaccaccacgctgcacatgctgacgctgctgaaggacctgctgccctgcttcccggaaggcctggtgaagagctgcagtgagactctcctcagggtcatgaccttgagccatgtggtgagctcaggcccaaaagctggagaaagggggacctgcagtggtggcatttggggaactcactggtcagtcaaaatgcagggcctggggtctccctccctgactgtgttcttaagctaaaaccaacagcactacgttactctgtggtgtttggctaggccaggccatatcagagtccccttccagatggaagctgacctcagagatcaggtcagagtcagggtggatctgtagtgggctggtaaaccctccttctgcaccagctctatgtaccctataccaatttttttttttttttttttttttttttgagaccgagttttgctcttgttgcacagctggagtgcaatggcgcgatcttggctcactgcaacctctggctcccgggttcaagcgattcttctgcctcagcctcccaagtagctgggattacaggcatgcaccaccacgcccagctaattttttgtatttttagt

SEQ ID NO: 62340 - DNA, 1050 bp, Homo sapiens
ttgctcactttctgagtgactgtgccaccagcgccccttgccctgtcctccttagtaccacgaggggctgcaccagctgctcttcagggaccctctggggtgaccatctctgttctttcccacagtgttcccagccctgtgcttattaagaagttctctgatacctccaaagccttcatggatatcatgtcagctcaggccagcagcggctccacctctgtcctccgatgggttagtgtctggggtttagtttctcatctggcgactcccagagcctgtctgatttggtgatgcttagatgttccctgagaggggtttaggcaccctggggacctcagacagatgcgattttctggagtcagtgagaacctgggctcttttccctcctggccgaggctggtggcactgagggactctgactttcttccaggtcctttcctgcctggccacccttctgcggaagcaagacctggaggcctggggctaccccgtgacccttcaggtgtaccatgggctgctgagcttcacggtgcatcccaagcccaaggtgagactactagctccctagaaaatggggcaaggggacagccaccactcagcccagtgcagcccagacttggctagctgagtggcactggggagcttgccctgagtactggcttctgctttctgcttctgaggcaccatgcatttagatgcagaaggcagggcggctcttcctcctccaggaggctgttccctgtcagccctatctgagtctctggtgcctcatcagccattgccctgttgacgtggactctccccatatgtctatttacctcggcagggagggtggcatagttgggggagtcacacagacctgagttggatcctgaattcactgctcgaggtgtgaccttgggcaagttacttaatctctctgagcctcaacttcctgactatgaaatagagataattggctgaatgtggtggctcacgcctgtaatcccagcactttgggaggccaaagtgggaggatcatttgaggtcgggagtttgaaaccagcctgg

SEQ ID NO: 62341 - DNA, 1016 bp, Homo sapiens
agtttgccctaatggaaccatctatggcggccaggtctttttcaggttcccttagcgccagaagcggttggtacagtctggtgctcctggaggacgccctgtgccttaaagcagctgtaaccaaggcctctcaagaggcggctacggatcctagcggatcgacacgccacacagcctcgtccccagcagtaggtggaggccctgggggtgcctaacaagcctcagaacaccaagaaatccgcgtggttgtgcaggtctttgctgttcagtagcattccacaaatagtgtgtccaaaacgcatctgtagatgtaacttgagtgaatgaatgaatgattcgagttgctccttctacccaataaagtagataagattttatctttctcatctttccaaggcccctttatagttgggaaaagtgagtatttggaaagatgacttgtccaaggtcatatctgattcctagtccagtgtcctcgccctagtcctgggtgaagtaacaggtaggtgtgaggaactggtaggcttttggctaaggacgctgggcaaaggtggaagtggctgtgagataatgcttgcctatccaggcttgctcccgccccagtctgctctttgtggtgttggaatgctaataaggaagcattccctgctgccggcacggccaagaatccctggactgaagaggtgcttccgctgatgataggggcagatcctcctttgctcccttctaacctctggacaaagaagcagccattcacaagggtcattgatgaggcacaggtatttggcctcagattgctctcctagcttcttgccttcactgtaccatccttctcaaatgaagcaaaacgcaggacagtctggtaaatgtaaacctctgcggggtggggtgggcaggggagtgattgtttgagatggcctggtgtgacctcatcttttaggagaggctgggaaatggaaagtgctggtaaaggaggccattttctttagctctgtggcaggaagaactgtatcagt

SEQ ID NO: 62342 - DNA, 1013 bp, Homo sapiens
atctgcccgccttggcctcccaaagtgctgggattacaggtgtgagccaccacgcccagcctgattctccttatataaatccaaggaaacgggactcacttcataagtcagtagaatgaacaaagttttttctttatgagttgaggttcagtaggaagcttggtggcacttcagcttcatacccagcataaaagaggagtcgcaggcaaatctttggggtctgggctccaccaccagcttttcccttccaggtatccagatggttcccatcagctggtgtgagatgcagtgccctaagacccacactaaagaattccggaaagtagcccgagtacaacccgaattcttgcagacctaagaagccactttttaccctatggaagggggtaagctgttcctgagtataacaccaagatgctgctgtctttattcaaacacctggcgtcggccaacagccacttccagaaaaatcttccagtttacgctgtagatggaacatgtttctgtgaacctatcagtggatttcattctcttgagtaataaatcttatcttttcaaggcaccaacaaacaaaactgtgatattggaaatagcctatccctcctgacagtccttataaatacatattttttgctatgataaaacttttttactaaaaggatgttatagagtctgttgtcttaagcagagaaagacatctaaatggtgtcaggacatttcagtacttctgcttattgagtacttactgtgctaggcactgagtcaggtgctttacatacgtccccttcatttaggtacattgtgatttaatgaaaatttgaggacacgtggtgatacagatagcatgtgaggcaggcatggtggctcatgtttgtaaatcccagcactttgggaggccgagttgggttgaagtcaggagtttgagaccagcctggccaacatggtgaaaccccatctctactaaaaatacaaaaattagccgggcgtggtggcacatgcctgtaatcccaact

SEQ ID NO: 62343 - DNA, 1111 bp, Homo sapiens
atacagatttgggtgaacaaagtctgaggctagggcctctctccattagctaatggggtatgggatgccaggaaaattacatatgtagtaagtgggccgcaactgaacacacagacttttctttttttttttttttgagatggagtttcactcttgttgcccaggctggagtgcaatggcacaatctgggctcaccacaacctccgcctcctgggttcaagcaattctcctgcctcagcctcctgagtggctgggattccaggcatgtgccaccacgcctggctaattttgtatttttttagtagagaccgggtttctccatgttggtcaggctggtctcaaactcccgacctcaggtgatgtgcttgcctcagcctcccaaagtgctgggattgcaggcgtgagccaccgcacctggcccagacttttcatctcaagaaatagaagtaaagcaaaattcaaaaagatgtgtgtaggggagaaggggctaatctcagtgaacgggaggaaacagagcaaagcgcagctttactaccaccccaagcacaagcccgagtactctgatccttcagtaatagtcacaggccatactggtcatctgccaccagactggaggagattgctggccacaacactcccctcttcccatggctttaagtcacatctgtttcccaatgggaaagtcgactgaggggacagggaaggacagacggcaaagccatcagaagtcaggtgaactgagatcaaagtcgtggcgaatgtcatctggacaaagacgctgctctcaggatgtttgcaatctcaagtaggagatacccaacatcaataaagagtagcattttattcatgtgcagacctcccttctgggctaacacgctgagaagaaaaagagtaacaactttattttggggctgcttatcttttgatgacgggcccacacaaccagagttcggctttttcaaccagagaaagcttactgaagtggggatgaggggccgcgaagaggatcggaccgcaggactggaagctgcagtttaaaaaaccgggaaaaggccggaggcagtggctcatgcctgtactccctgcactttggaaggccgaggcgggcgga

SEQ ID NO: 62344 - DNA, 2731 bp, Homo sapiens
ccctttcctgtggcctgttgctttaggtgtgcatcaccttggatttgctatgcaaccatgtggtgtaatttaagtacaatttctgcaggctcagaaccatcagttttactcccttaatctggttggaacattggcactggtcagtccgtagaaaagtgaagtaaccttcctacttctcacagttggtgactggcctagctgggtcttagtcttaggtctttgccctccaagtgagtactctaggccttcccactagcggggtagggagggagggctcagactagatcctcacaatggtgtgctctcgtaggaaccatgcgaggccagcggagcctgctgctgggcccggcccgcctctgcctccgcctccttctgctgctgggttacaggcgccgctgtccacctctactccggggtctagtacagcgctggcgctacggcaaggtctgcctgcgctccctgctctacaactcctttgggggcagtgacaccgctgttgatgctgcctttgagcctgtctactggctggtagacaacgtgatccgctggtttggagtggtgagtgatgtccagggagcaggaaaaggggtgttgtggggagcagagggacatgtctctcacagacccaacccaggttttggaggccggcccccacccccagggaaactccgagtctcctttgggcatagctcttgcgccatgtctccctgaccttgctggtgttggcaggtgttcgtggtcctggtgatcgtgctgacaggctccattgtagctatcgcctacctgtgtgtcctgcctctcatcctccgaacctactcagtgccacgactctgctggcatttcttctatagccactggaatctgatcctgattgtcttccactactaccaggccatcaccactccgcctgggtacccaccccaggtgggtcctcacaggagcactgggggaagttgctggctatgggagctggtcccaggagtggggagagtatcttggtatagttttgagagacagaactggtgctgccacgttatgctctcccttcacacagggcaggaatgatatcgccaccgtctccatctgtaagaagtgcatttaccccaagccagcccgaacacaccactgcagcatctgcaacaggtgggtcttggctttgctctctgggaatcccagctgtggtccttctgtagccctagggcaaaacctaaccttgagtttgctaagacatgggtgaatcacccatcgtgtcccaggtgatgtgccctcttctcctgacacctcatccttaggatggtcctgtgagttaggcattattaccacttgtgaaaaccgaggtttggagagatgagttaccttgtccaatatcttatagccattaaactgcagagctgggtttgaagcaaggcctggctgtcttcaaagtctgtgccctttccacctcagcaggatgctggtccttgtagggaaggattggcactgacatctcaagaactttggccaccgtaacagagcctgtgtcccttcctcacaggtgtgtgctgaagatggatcaccactgccgtatccttttgctttctcttctgcctgaggccttctttagctccagagcactgtacagggttaatggccaccattttagcatcaccgtgcagagaacactggagttgaggagttgtggggcctgaccatctcctgggagagcaggaagctcacactctaggacggatcttcttggagcagggaatcttttaacacctctttcttttctagactctcatgctaacagctattggatggaaagagatgtttgggcttctgtggttgtttactgtgtacgccagatagaaccgtgggtctccagctgctgttccacacagatgtttggctaactccagctaggctgaaatattggcagattcattttactgaaggatttcagtttccgtgacttcttggtgggacctgaatgctctgaaaagctttgagcattttcacctcaaccttgggtgtgaacagtcttgtattttcttgcctttggaaagtagttcttagtgactggaagcctgaggcttgggtgatattgtcaggaaccagggatgaacctgaggggcctggacaccgcctgaaattgtgtttgattctagtccttaatcatttcccaaccagcctggctaaacaattgtgtgggccactataaccatcggtacttcttctctttctgctttttcatgactctgggctgtgtctactgcagctatggaagttgggaccttttccgggaggcttatgctgccattgaggtgagctcatcaggaacagggcagctcagtagtgcagaacttcgggatgtagaacctgtccctaaggaatggggctggtagcaccccatcctagaggcctgagagtataaccagcactgttttccgtccccttagaaaatgaaacagctcgacaagaacaaactacaggcggttgccaaccaggtgggctgtccccaccccactgcctcctgctgctcaggcctgggggtatagagttgctaaggcatctggggccgacctgcccatgtagttgtagaggctgccgagaggccactctagaccagatcaggagtgttcaggcaggctggctgtggtgggtagactaagtggcctacaggcaagctggaagtccctggtatgtgacagttttggctatctatcccgtcatcacctctctttgggtcgag

SEQ ID NO: 62345 - DNA, 1049 bp, Homo sapiens
cttgaactcagagacatttctctcttctcttctaggcactggcttactcgggtgctcttaccttctagtcacttgccccatgggaatggaatgagctgggagccccctccctgggtgactgctcactcagcctctgtgatggcagtgtgagctggactgtgtcagccacgactcgagcactcattctgctccctatgttatttcaagggcctccaagggcagcttttctcagaatccttgatcaaaaagagccagtgggcctgccttagggtaccatgcaggacaattcaaggaccagcctttttaccactgcagaagaaagacacaatgtggagaaatcttaggactgacatccctttactcaggcaaacagaagttccaaccccagactaggggtcaggcagctagctacctaccttgcccagtgctgacccggacctcctccaggatacagcactggagttggccaccacctcttctacttgctgtctgaaaaaacacctgactagtacagctgagatcttggcttctcaacagggcaaagataccaggcctgctgctgaggtcactgccacttctcacatgctgcttaagggagcacaaataaaggtattcgatttttaaagatatgtagcttctcactctctgcctcacgatagggcagggaaggggaaagtcagggtcaagacctagtgagtaggtgttctggtcatgcttcctacattttttttttttttggagatggagtctcactctgtctctcaggctgtaatgcagtggcgcgatcttgactcactgcaacctccgcctcccagtttcaagtgatttttttttttttttttttttgagacggagtctcgctctatatcacccaggctggagtgcagtggtgtgatctcggctcactgcaagctccgcctcccgggttcacgccattctcctgcctcagcctcccgagtagctgggactacaggcgcccgccaccacacccggctaatttttgtatttttagtagagacggggtttcactgtgttagccaggaggtctc

SEQ ID NO: 62346 - DNA, 1938 bp, Homo sapiens
gtgacccagaattaggtccagcagcagctgatggcttctctctgctcatgtctgactgcactgatgtgctgactcgtgctggccatgccgaagtgcggatcatgttccgccagcggttcttcacagataatgtgcctgctttggtccagggcttccatgctgctccccaaggtgaggagtctgaaagaaggtccccacatatacacatctctcctttgcttggccacattccctaagataatttagggcccgcttgcttctttagagctatattgtggtctgtgcctagaagactaaacttctagattcttgtcccacttcttcctttcatgggcgtatcttgcttattctgagcgtgaagggctctttcacccgtttgtaggctgatgtctcagcctcaccacagattggaattgatttctcaagctatatatctaagtccaatttctcccctaagcctttccattttttacagatgtgaagccaaactacttgaagggtctttctcatgtacttaacaggctgcccaagcctgtactcttgccagagctgcccacggtaagtcccacaggcagagcttctaagcaaaggacaaagctattcttccccagatggggctagaaaggggagggaacaagaaccaggatcttcatgatgtggccatcccctaccttgcccattgccccttagcttctttccttgctgctggaggccctgtcctgccctgactgtgtggtgcagctctccaccctcagctgccttcagcctcttctactggaagcaccccaagtcatgagtcttcacgtggacaccctcgtcaccaagtttctgaacctcagctctagcccttccatggtgcgttgagccccagcaactcttaggcaccagcatctctccctgggcatgctctcacctccttgtggttgtgttccaggctgtccggatcgccgcactgcagtgcatgcatgctctcactcgcctgcccacccctgtggtaagtacctcaggtgtccttccctggcctgggaacatctcaagagacacataagtacctttttgccttagtcaggtgggcttggccaccctggtgtgtaattgagatctgaattacaaggtacagatcttgtaattctgggcccaaggattcttttccttgggcccagaaggtaacagaaaggccatcctgccacttaacatcccttggaatcactaaagatgttttgctttcctcagaatattagttgtacagaatcaaaaaagcggtactttcagttgccttggatgagcaaggttgattatatcctctgactccacagctgctgccgtacaaaccacaggtgattcgggccttagccaaacccctggatgacaagaagagactggtgcgcaaggaagcagtgtcagccagaggggagtggtgagtttctaggtcgtggggagagatgggaccaagatgagcctcatcactaatgctgccaactttctttttgcctacaggtttctgttggggagccctggcagctgagccctcagtcctggcctagactgttctgacaatctaacctgggattactaactgttgagccatcttccccaaagcagggaaaccactggtctctgactgcctttcccacagacacagcacaaatgctaggcctctgttgcatggctgtacaaagaacataagagtccatatttctagtggatttgtaaaataagtgtgtgtgagacacttgcgtttgaagaaagatctagggtcctgggtctcttgcatttatatgtcagaaaaggggcgatatgctgctgaggggtgagtgcatatgagtgtggccctgaggaccagggctggcagatgttgtctacctgctgaagaataaagatttcttttggtaatggggctgtcagatatttcccccaccccacatatgcctcatataa

SEQ ID NO: 62347 - DNA, 1032 bp, Homo sapiens
tccttggtcatacctagtactctgcccccaggttagctgcccagagtgtgacacacattgtgcccctcttcttggatggcaacgtgtcctttctgcctgaaaacagcttcccgagcagattccagccattccaggtaacagtcttagaacttacatccttcaagctggtttttttttagggctaatctggaatgggtagaggggcagacaagcttattgctggcaggcttgatcgggctctccttcctttataggatggctcctcagggcagaggcggctgattgcactgcttatggcctttgtctgctccctgcctcgaaatgtaagtgagcacatttgggaagtactgttatttaaccttgacaaggtgactccgggctgaaatttgccacaggctaagctgatcttttacttcccccaccagagaagttagttctcatccgtcccggtccctgctgccactatgtactggttctcttggagttcaagtgttctctgggtccattacatggccaggttttctgtaggtggaaatccctcagctgaaccaactcatgcgggagcttttggaactgagctgctgccacagctgccccttttcttccaccgctgctgccaagtgctttgcaggactcctcaacaagcaccctgcaggtactgagatcagactatgtaaggagcctcccagaatcaactacccatgaaatcttatagctcagtactcattctctttttaaaaggagcttgctaataacattaacagggcttcaactgctcaagcactgtcctgggactgcccgtgggaaaagcgtcaagaccacagttgggcagagctttatagtacctaagaagagaagggagcacaaagagtctagttctgccgtcctactccctacagtggggctagtgtggataattctttattggaagtagatgaccctctcttttcaaatggcagcacctctgtattatgagaataccaggctcttatgcaggtgtccaatcattttgtccacaggcaaaaatgatat

SEQ ID NO: 62348 - DNA, 1081 bp, Homo sapiens
cccactgtggttgatccagcagctgttacatagtagaatgaatactagacttggattataacttgggcttgattcctgactttgcacttcctgtgaccctggaaaagccactgatcatgtatttcattgtgcctccatgtccttctctatagagtgagggaaatgatacttctaaggttgttatgaaaaataaggagagaatatatacaagtgcttctgctgcagagcctgggacagagcaagtctcaactatgaagtctgaatagatcagaaagaacagccaggagaataaagtgactcagctttttaataaggcactcttggtcccttcagtcactcttctttgttcctctcatctgctgtgtaattggaaacacctgaaagtgcttttaagcaaaccttacagagaacactttctcatcaacagggaatatggttgcacaatccagtgacgttattgctgtctgtcagagcctcagacagatggcagaaaaatgtcagcaggaccctgagagttgctggtatttccaccagacagctataccttgcctgcttgccttggctgtgcaggcctctatgccaggtaactttccacctctccttcctggcctttgggaactttgccctctgctggtgttgaacagcaccaccctctgggtattggtggtactgtattttgtaccatcagaggtttattttcaatcctttgtcctcagagtgagatttcacttcatagcaaagggtgccaccctgaccagtggcaggaaccaaaatccactagtgttagcaacattcaaaagaatgcacaccttttccccatgaagtgctatgtgattagtttacttagaattggactctggagtcaagcccacctggttgggttttatcctcaactctaccacttgctaacttaggtgaagatattcagcctttccacgcttcaatttcctcacttgtaagatggagataaagagtaccgtctaggctggcgccatggttcacacctgtaatcccagcacttcaggaggccaagatgggaggatcacttgagtccaggagtttgagaccagcctgggcaaca

SEQ ID NO: 62349 - DNA, 1054 bp, Homo sapiens
ctgccgggctcaagtgatcctctcgtctgtctcccaaaattctgggattacaggtgtgagccaccacacccaacctgaatgcacagttttctacttcctgagtagaaacctttctacaggtttttatcctggggatcctgttaagagtgaccttatttttttccccttactctgagttatatacactcttacccttgaggttcaatacaactgtcatggccagaactcttccactttctgcttgttgctgcttagattatttctagtatgtttcagtataatctccgtagagcaattttgaggataagtcacttccttgttgcttcagtccagcttctcctatatcaataatcctacctagttaactagttaaagctatattctggccctcttactttgtaaccttccagttataaagttttggtttttcatgttttcttttactctaggaacttggtggtgattctgagcaattttttttccttagcattaatttacagaaatacacgtattctccttgttttggtggaagctgcagctgccaatcatctctcaaaccctgtgggtagctgctaagctgtatttcagaggaatgtcacaatcataccactggggagaaagagtaagcacagtgcttattaggtgccaaactggggtacctggaggcagaaacctctgttggctcttggtgtcacgtgtgcctctaaatgatgccacttcagtctgaggatcgctcttaagccttctgtccttactggtatctgtaatgccgttacctcaggaacaccttcctgggctgtttttactcttaacagggcttggctctgcttccatgcccagggggtgagtgtgactaatgtaaaatgtttatttcttcaaacatttgaactgggtaattgcaggttctctctatcctgttttcccctaggtcctctctagagaatccagaaccccgaactcgggcacgagcaatccagcttttgtcacaggtgctactccactgtcacaccttgctcctggagaaggaaggtactggtgtcactaataggaatgt

SEQ ID NO: 62350 - DNA, 1054 bp, Homo sapiens
tctcctgaaaaaagtttcatgctgtctggctgaggcttctttagtatttgggagcacacagcctgtaggccacatcaactcctggcacagcccatggctttgggatgaggtacgtggttgaaggccatcagctgttgttgattcctttgtgcatctgtagacccacctacctccatgggatgctagcctgcctagacctgactcagaacaagctgtgggccctgtgtggggagttcccaggaggctgaccctgctgcagatccctactaggaggaaaggctttgggaaacagctgataaagcagtgttacagcttgggattctaagcacttagaggaagtacgtgcttgtagtctaatgcctactttcctcgtatttcataattggtatagaccatttaaattgacaagtcttattagtaagagttgttaattgtgacagcatgtcttctaaaacagaaaactagaaaactgggggaaattaaaaaacaaagtcactgttacacatttctcccacataacagactatttgacctttctgctcacattgtggtggccttggtccattaaaaaaaatatatacagtattggctgggtgcagtggctcatacctgtgatcccagcactttgagaggccgaagaaggtggattgcctgagctcaggagtttaagaccagcctgggcaacaaggtgaaaccctgtctctaccaaaaatacaaaaaattagctaggcgtggtggcatgcgcctgtggtcccagctacccggaaggctgaggtgggaggatcactggagtctgggaggtggaggttgtggtaaacaggtcatgccactgcattccaacccaggtgacagagtgagacccccatcaaaaaatatatataggccaggtgcggtggctcatgcctgtaatcccagcagtttgggaggccgaggtgggcggatcatgaggtcaggagatcgagaccatcctggctagcacggtgaaaccccatctctactaaaaatacaaaaaattagccgggcatggtggcgggcgcctgtagttccagctact

SEQ ID NO: 62351 - DNA, 1511 bp, Homo sapiens
actcaactgatttaagactgtaacactagccctgttgtaatttagccctcctaagaaaagaaagttggtggtgggcacagtggctcacgcctgtaatgccaacactttgagagaacaaggtaggcggattgcttgagcccaggagtttgagaccagcctggccaacatggtgaaaccccgctctactgaaaatacaaaaattagccaggcatggtggtgcatgcctgtaatcccagctactcaggaggctgaggctggagaatcgcttgagcctgggaggcagaggctgccgtgagcggagatcgcgcccctgcactccagcctgggcaacagagcgagactccgtctcaaaaaaacaaaaagaaaagaaagttggtacaaaggaatagtaacagataaaagttgaaaaggtttggtagggttggattgtgtataactttggattccaggcagagaaatttgaatgacctgttatctgtactaagagttgttgtagatccttgagccagggagccataaaatgaaaacaaatttgacaaggattaagttaatattgtcaatcttagatcacagccctagttagggttgttgaaggataacagagtgttgaagcgtttatagaataagatgtgctttctaatctttcagcctaaatcaagctttgttagcgctaaagggaccagctagcttcctgttcagtcactcagagtagcagcctgcaaatttaaatgcagaaggagcaccctttgatcacaaaagcagctgctgccacctttgttttgtacctgggttcctggtgaaagtgtcagctgtaaagaagctgcaggcgatgggagggaaataacctggcagcctaagggttaaaggcctcttgggcaagccttcaaagcctgccactacctggccccagcctttttttctcactgctccctggacgtttaattccaggcagccacctttattcgtagttccctgagtgctttccttcccaattcccttcactagctctgtgtaatcgaagttagacctgagagtcaaggcccagcttgagttccctacccctccccaagggtttcctgattaacccagccagacagcatctcatacgtcagaatctttgtagtacgcacttatttctcaaccactcatgtatttagtggactagtttagtagctgttgctgtatacatctccacatcctaccctcccagttgtaccaccagaatctcctgaaattggcatcagtaggtacacaataaaaactgcttgagtgaatgcaatgagaaatgttgaaggaagaatctgtggaatttgagttctaactagttattatagggcttgaaggagatagaggactctaagaagaccccaaggttttgaaccagaggatgaggaaaagaaatactttgtccaaaattaggacgagagctgattttcagagaatgtgatttttgaacacgttgaatttgcaggtgatggatataatttttttccttttagttatttggattt

SEQ ID NO: 62352 - DNA, 1058 bp, Homo sapiens
cgtgaccccggcgccccgcccccttgcgcttccccggagattggctcgggaggcgcatgcgcggagagcccgtctcgagccaccgcccatatcccctcccacggtctctagttcgcgttatggccgctgccgcggctgtggaggcggcggcgcctatgggtgccctatggggcctcgtgcacgacttcgtcgtgggtcagcaagagggccccgctgaccaggtggctgcaggtacggcagacggcgccgcgcgccttccgcatgggggccaacaggagggagcggcctcagtacaggcgccgggcgggaagggaggagcggggtgactttgagagattggtctcaaggctggttagtgagcaccgcgaggttcagagccgtaacaagttagagagttgcctgtgtcttccttaaaaccatttacacttctcatctccctgtagccaattatagggaatcattacattttacagatgaggaaactgaggctcagcgagggcaagaggacttgcgcagggctgcagaccaggcaggagggggaggtgggactcggacccaggcgttcaggtccgaaccgggtgctcacgccacgaagccatgctgtttgtgggaggttgacgtgtggaggtgcatcctcgcagcgtccgctcccgtcgcgtggcatcctgggagtggcagatggccccgcgctctgactggctggaattaagaggagttgaggagacgggccaggaggagctggagatgttctgggtgtcctccttaagactttctctccgtttcttgctaaagttcttgattagtttgctccatgacgttttatgtggcgtttgtttttgtcttcttcccagacccccactttcctgcttttgaccagttcagagatctcttagttcagacagcttatctaaaattagaataaaacgatttccaggcttccgtggagttctgagactttgctcttctaggaaaaaaaaaaaactactaaaaagttattgaatgttaggaggccttcagatcttgggtttaagtaacaatataaaattatctaatgagta

SEQ ID NO: 62353 - DNA, 1075 bp, Homo sapiens
cattggtggaaaatgaagcctggggtctctgctccttcctagttgtttgtgtgactttggacaagcctcttgatctctttgagcctcagtttccccatttgtgccatgaggtgactgccaccctgatcacctttcagagaggttgtaagattaaagtgagaccctggatgaaaagagattttgtgatcttagaaagtttctattattccaagctaccaggatttttacacacaaaagccatagccagtgatttttcccactagatcattgaagcttactcttttttaaggagcaaaactataaaagaaatgtttaaaaactatttttggatgggaatctttctgaaacgaatgatatgcttctgagcaaaatattaatatacagctcagaaagaacctctggtttgggactaggggttgttgagttcataccggtgtgtacagagcgcctgcttggtgagagtgggaccacaaaaggttctttctctcaaaagtgttacctcccaaagaagagacctggggtgggggagggacctagtggtgggcagagggaaattgctgggggagagcccactccgggagtgccctgcctcaaggttccaagtagcaacactggcactgcaggaaggctcttaaatcctgttcaaggctctgagtgggaagagccagtcctacccggtcagttactgtgcttatagtagtgtgaggccacggggcttgtgagactctagggcagtgggccccaaactacgtggttcccagctgttgggctttgggggttcatgtttccacctacaatcattgctgtgtcttctgcctggtagacagtagtcacttctcttttttttctttcctttttctttttttttaagtggttacctagatatgacataaaatttacttgtatgtaacagcaaatttttcagtctatagttttgtagcatgagtacattctttgtatttattgttgtacaaccatcccagtacccatctccagaactttttcattttccccaactgaaactcttttacccattaagcactatccatttcttcatccccccaaccactggcaa

SEQ ID NO: 62354 - DNA, 1072 bp, Homo sapiens
tccccctgagggagatctcctttcccaaaggagagtggtctgacgtgggaacgggctgcctctgagagcccagcctccaggggtggtgagggtcactcccagggattcttgcgtcagctggggcacacgctgcagagccttccacgacctctctgactccagtgggatctggctctgcaaaagttaagcccttctgccatagcctggtagaggctttttctaaatcaagctgggagggccaccctcaggcaggcaggagcagcagcctccagactaaccagatcctggagctctgtgttctgggtccctgatctccctgaagccccagctacggagtttggtccagatttcccccagcagcagctgggcagcagtgtgtgcctggccccctttggagtgggtcacacacccacctggccaggctctggcatggaggctggcactagaatgggcttcagggatagcatgcacctgttttgtgctgctgttgtcaagtagctggccttgggcttcttggaactacagatgtttgcgtcattggactgattgtcctttgactttttctttgccatactgactttctgtggccatatggttagctttggatacagagaggtgtgaggtggtcccacagtgcctgccacaacatcaagtttctatagatgggagcccttccgtaaacctcagaaggtggcaagagcatgtctgacagtgattggaattgagctctgcaagacatagacaagatcacctcttcaactccagagtgttgtggcagggcaccagagctggaaaagcctgaaaggtcatgtccagctgcccacgcaatgtggggtcgttccacttagcacccttgccaggcattcagccagactttctttgggcgaggctagcttttgaacgcactgaatgcgttggcctgtctctctgtagagtgagtgcctgtgccctgtctcattgcccacaccatggccttgtgagagcagctccctccgatcagtgtgaacttggctgagcccaagtgtgcttcctttgtgtctctcactcactggttctgcctgagaagtttgtt

SEQ ID NO: 62355 - DNA, 1030 bp, Homo sapiens
tctccaccaaaaaaaaaacgaaaaccagtcaggcgtgcaggcactcggcaggctgaggcaggagaatcaggcagggaggttgcagtgagccgagatggcagcagcacagtccagcttcggctcggcatgagagggagaccgtggaaagagagggagagggagaccgtggggagagggagaccgtggggagagggagagggactgggactgatctgcccttctttggcttcattctgaccacctcctgcctcgtgtgatctacctggcagcactgcttgcagctccacaaacctgagcccagagtaggctcacactgcctcctctgtctggcgagcccagcccccttgcccttttgcctggctaactccagcttgttctttggtacttggagcaaactttaagaccttccgcagagggggtgagaccacattcacgtgtccccctgattcctgtgcatatcactccccttgcatgtgtgcattagtttctaacaatctcctgacatgtctgtctccctcactagctctgaccttgagagccttagtgactttgtgtccgtgttccccagcacggggcctggtgcatactagaagctcaatacatgtttcttgaatgaatgaatgaatgaatgaatggatggatgaatcgatgaatgaatgaagaatgatgcaagctctttattataagaaatgcatcctgagctgtgcatggtggcttacacctttaatcccagtgactcaggaggctgaggcagggggaatgctggagcccaggagtttgaggctgcagtgagttacagtcgcgccactgcactccagcctgggctacagagtgagaccccatctcaaaaaaatttttacaaaagcatactttatagtgctcagcacatatttgctcaataaatatttattagatgattctgtgtgaagtaaaaacaggatttttttgaagtgttatatttattctatattttctttatgtcctgagtcgatttctaaggatagaacctagggaagagggggcacaggta

SEQ ID NO: 62356 - DNA, 1772 bp, Homo sapiens
gttgcagtgagctgagattgcgtcactgtactctggtctgggcaacagagcaagactccgtctcaaaaaaagactaaacgaaaaccctagagttagatcctgaagatttgggggctctgtttgtaattgatatcagataggccagttttcctctggaaatgggtcgggggatggctggtcagtgcccagctctgggagaccacccttccccgagcccggccagatgtggccagggcccccaggctggactcacggaccagagagcagaaaaaggcctgctctccctgagcccagccaggcagccgaccccgtgaatgtgtacgttgtatgcagcaccatgaaagcacaccctgtctcacgcatgtgtgcccccttgtccgtatctgtggctgcccgcacactgaggccttgggtaggtctgtttctcttggctgcaattttgtctctctcatggccacagaggatccgggcctgcctcctccagcaggtttcctcactgtacacctacctcagtgactggttttgtccctcctggactcccacctccacccactccctttctttctgcctcttcctattcagtgaggcttgttcacaaaacatagtcctctgttccccctttgcaggggtttcttgcagacagctctgtctactctcccatctgatctgtgcctcccctctccagctcctccttcttttcctaaactgcctgcccatttcactcgcccgtgcagcatgccaggcattaactctgtctgtaggatcaaaaagatgaactggaggatgtcccagcctcaggcagacaaacaagatcattgcagagaatttctgttgccatgggctgggcatcatcctagagccgagaagggggctctcaggggtgccaccctgccttgatccttcagctctgctcaggaccacctgggacccactgtacctctagagatgcccggtaagaagcctggcccatcacttagcaactggctccacccctttccctccctgagctggggcccgagaggaggaaaggcccacaggcctgtaaagaggccaccaaatcccagagcatgggaggccccagctgaccagagctgggccagcactttcccttcaaaagttacctaggctctgagggtcatctctgctaagtctaactataaatatcgcgcttcctgaagggattacctgggcaccacaccccctggctcccccctccccgcctgggctgatccttcttctgggccctgtgttcttcctgaccccttgttcccgctgccaggtgggacacttcagactacctgtgtttcagctgtgactgctggggtgggaggagagaaacaagagattcgagtctgtatcctggccagagggcccttgccggccagctgttgggacaaggaggctcttgttcctgccttctcccgtctggtgtgagagccgtgtctctcacaccagccagagcaagcccagacttgtcacataatcggtgcatctgggaaggacactgttggccccatccctggagtaagggcctggggacagaacttggtaaccgagtgtggaacagcttggggattgccgcaggtataaatagggctgtttcctggcttgggtggcctgactggggaaatctctgctccctttggctggtctcagatttggtgtcacatcccagtggctcacttattccagtccctgaagtcacaagaaccatctcctggggtctgagatcaagaattgaaggaggggccagcccgctgcagacctctccc

SEQ ID NO: 62357 - DNA, 1048 bp, Homo sapiens
gaacactttaaattaaatatttggctttagagttttctgcccctacaggtaactgtgaattcagatggtgaactacaggatttagtcagacctgaggtggaaccctcactcacttactatgtgacctggggcaagtcatttaatctctctaaatctgtcatatcacctgtgaaatagcaataataatacctactgcctaaggctactgcaagaatgaaatgggatcatgtatataaataaaggcttgcctggggttctttctcagcggagatcgctgcctgcaattctcttccttgcttccttttgccccagccagtgggagcagcctggtggtggcccccagcctcagttcttccactcactgtaggacctgagttatagtggaagcagagtgcttcacatctcactcctgtggctcactctgcctttagttttgagatgactgagcctccaaaagcctttgagagatacctctgccctcagtcttggctgtggtttggagttgtcttggaggtcacttggagctgggtaacaagaaaaatgacatttgacagaattgttttctttgtcagatgctgcaggaatttttgggggagtttgttggtcatgattgcttaaaaaatcctttttttaagtgggacattagtaacaagatgttaaaattgttaataattttttttttgagacatggtttcgctgtgttgcccaggatggagtgcagtggcatgaccacagctcactgcagcctcaacctcccaggctcaagtgattctcccatctcagcctcccaagtagctggaactagaggagcgtgccatcatgcctggctaatttttaaaatttttttgtagaaacagggttttaccatgttgccctgggtggtctagaactgccgggctcaagcaatcctactgcctcccaaagtgctgggattacaggcgtgagccaccgcgccctgccccacatcatgtgggaagggtgcggtggctcacgcctgtaatcccagtacttcgggaggctgaggcgggtggatcacgaggtcaggagt

SEQ ID NO: 62358 - DNA, 1026 bp, Homo sapiens
agacttttataaaaggtaatttctgtatatttcactgtgcgatgtgaatgatatgcttgaactgtcttacattttaggttcttggagaaaggacctcttttagcatagcatgacaccctcctccttgtcattgctgattagatataggaaccccgctgggttccaggttccagtaattttttgttgttgtttgttttgagaggggggtctagctctgttgcccaggctggagtgcagtggtgtgatcttggctcactgcaacttccacctcctgggttcaagcgattctcccgcctcagcctcctgagtagctggtactacaggtgcatgccaccatgcccggctaattttttctattttttttttttgtagagatggggtttcaccatgttggccaggctggtcttgaactcctgacctcaaatgatccacctgccttggcctcccaagtgctgggattataagtgtgagccactgcgctgggctcaggttccagtaattggttgtgggttctgacaccagctggtgcatggcctcttgctttcttgtgtgatttggtttttattcccaacttcatggactgctactgcttaagctatctgtacctcacccctcctttgttaaaaggggagattagtaaatgggtgttaagaaaagttgtttttataatattggcatcaaactgaagctctctcctagatataataaaggaattgaaaatctattaagagaaaaaaaacacaaaatattaaagaagagagtggatggtgaggaaaaattaggcagtagtcattttcttttccagctaaatactggtgggtgtctttccaatttgagtggttttagagtttgttctccatgaatgagaagagtattcttgattattcagtagcatagttgattttatgaagtgaacattggaaattaggccagagggtattttacctctctgtctaggaaagccaccaaatgcctgcagaatgcttgcacatcgttctccacaggctaggtcctgagcaaatgcta

SEQ ID NO: 62359 - DNA, 1036 bp, Homo sapiens
ccacaatccctttcgtccctatctttggtcttcctctttccctgttagagaaccttcacgaggcctgaggatcttttgcatcagaaagtcagcaacaacaaaaatacttgtcttggctgggctcattggctcacgcctgtaatcccagcactttgggaggcctaagtgggtggatcacctcaggtcaggagttcgagaccagcctggccaacagggtgaaaccctgtctctactaaaaatacaaaacttagctgagcatggtggtgcgtgcctgtaatcccagctacttgggaggctgaggcaggagaatcgcttgaacctggaaggcagaggttgcagtgagctgagattgtgccaccacactctatcctgggcaacagagcgagactccgtctcaaaaaaaaaaaatacttgtcttccatgagactgagatgagacagaactttggaagcttaacatatagctgctggagaatagtaagaggactcctctccctgtctccccaactcttgtgacaggactctatccagttgatcagagcatctgtcattatagaaacaaggttcacattgcattggaacttcaaatggtaaggctctaattctcactcactggctgtctctgctctctgctcctatgaggtttcaggttatgatagtttcattagtcatggggaaaaagtggtttgttaggaagaatgatagaaaataaatatgatgggggcaaaaggggatttatggcttgagagagccaggagtttcactgtggacactggcaaggtagccttaggaaagctctttttccttcattcctatgcctgagttttctgatttgtaaggcagggagtgcctactacagtaccatgcacatccattttaggtagtctattaatactagatggtagcatggagcgatagatgagaggcagttattttgcctctcaggttcatgggaaaaaaaatagttatttgtaataaattttacaaggcttaggaaaatacctttcttataagtttgattttaggtatttatatgc

SEQ ID NO: 62360 - DNA, 1131 bp, Homo sapiens
tcttgccctgtcgcccaggctggagtgcagtggcgcgatctcggctcactgcaacctcctcctcctgggttcacaccattctcctgcctcagcctcccgagtagctgggactacaggcacccgccaccatgcccagctaatttttgtatttttagtagagacagggtttcagtgtgttagccaagatgatctcaatctcctgaccttgtgatccacccgccttggcctcccaaagtgctgggattacaggcatgagccactgcgcccggcccttttttaattttttaatttgttattttattgttttagtgtatatttcctgaaatatctttttttttcctgttatctgaggactgtctttccataatttattctaattgtgcctctaaatataagcttcctatcagtgttctgtcttccttgttccatctcctaccctgttgtaactgagaagcttctggaaaggaggagaaataaatgtagggagtcagtagccccttttgcagcattagtcttccttttcagaaggaccatctcagcgtctcagtggcaagtagttgcttctagaccttgcatcttggaaggtcatgtaatgtctgagaatgagctctgacattaggcagccctgggtttgaaccctggttcctctactgactagctgtgtaacctttacagttaagagcacttgtaagtttttgtttctgttgtatgtcagggaagaggggttctcctttagaaagtgccttgactggtggaggacacagatgagcagggacttttccaacaccagctttgcctttgacttttcctcttttcagatcctttttactgggcctggttgccccaggcgaaagtcccattttctcaggagatcaaagatctgatccttccaaagatatcggaccctaacttcgtcaaggacttggaagaggacctatatgaactcttcaaggttagccctgggaacctcagccctattatcatatgggagaaggaatttttaatggtttttttaattggtcctgacaaaagccaagaggaaatggctaacacctttctgacttgagttagccaacgaatagcaagatttccacatgtggacagcaggacctggtttggatgggtttgaga

SEQ ID NO: 62361 - DNA, 1059 bp, Homo sapiens
ctttaaagggcaagaggatcttctcagccttaattctgcatttacttcttcctgccatttatctaaagacctctgatgacagcacctcctgggtttgctgagcccatttttccctggaagggggttggacagaggttttttttttcttttgagacagagtctcactctgtcacccaggctggagtgcagtggtgcgatcttggctcactgcaaccttcacctcccaggttcaagtgattctcctgcctcagcctcccaagtagctgggattacaggtgcatggcaccacacctggctaatttttgtatttttagtagagatggggtttcaccatgttggccagggtggtctcaaactcctgatctcaggtgatctgcctgcctcggcctcccaaagtgctgggattacaggagtgagccactgagcccggcctggacagaggttttaagaactacaattattgtagctgtctgaataccagtaacatggtattcctacatttcccaagtaatgtaagggcccaattaggctggcagaatttttggaagcattaaaagccatgtgatagactcagatgttatggaactcagcataaaggagtaaactggcttctccagttgatataggctgtgcctctgtccgtattgcaatgtcttatctaattccatcccagctcagtcccttgccaacccttctcccattactcagatagtgccattattcaggatggtagggaggttggggtagtgcagttttatttatctccatcttgtgctcctaatgtcttcagaggagcttttggtatcttgtaacctaaagtgcctactaccttagggtgaccatccagctccttccaacatgtacatggccagtatatcactcatgtgcttacttgtctaccattcacacatcaaagcaaaatgtgtgcactacaaaatttctgcactacagaaatctgacaaagcacagagaaaagaggtcataaccctgtctacatagctgagccattattgcaggatgggctgtagtacaagggccctgagatgtagggaaagagtg

SEQ ID NO: 62362 - DNA, 1898 bp, Homo sapiens
gggacagtcccttccttccctgaaaccctgctctattgcaattccctattatattctgcatcagaaaaacaaacaaaacaaaaacaactttaaatgcttgtagcagaaccccgggtcatctcatgtcagaaacctttaatccaggcctaaatttgcatagacctgacattcagctgccttgcagttgcttcctcccatgagccaaggtggtgtcagagggcaactggatgactcgcagtaccacagcactgggacagacagaagccacacctttcttttgggtttttgccaagcctcctccatctcccatcagtgctgtgggctggctgcaagcctcgaaacagttctcctggaagggaggtttttgctttacccccgccagcacttccgcacacaatcatagagaacctctctgctctctgctggcctacagcttgtctgtttctcaagcagaggcaggaagagctagtcttagcatttatattttaataggaagttgactcccagcatgtaaaagtgatccacgcagccggagtgtatgccgggagctaagtggtctatgggtgaacatatcccaccttgcttcctgagtccttggtcccaatcttctcatttgttcctctcgttttaaattttttccccccaactcttttgatgtaagagttcagtttgtcttcgggagtgggtctctgcaagggctctgggatgagtcttggcttccaagaggacaggctattaggttcttggacttttttctgtgctaccgctgctgcttggtggaagtaacaggacgtggattctgcctcataagtggcagtttcccttttctctctgacttgtcctaggccgatttctctatggcttccctgagaaaggtgaggcccaaaggagagaggccttcaaactgtcccaggtcctgcgcagctcagtgcgtatcttcttgcttccatgtgtcttttcccctgctgcctcactccccacccccacttgccaggtgtttgagccatttctacaccaaagcaaagtacggcctcaggagggagtaaaaagggtgccatctgtgtctggaggggcagctgtgttcatgccctgtgctactggacatttcacaattctggcaccttgcgattggtcagtcaacctcagaaagtaactatcttgaaggtttgaaaaacaaccaaagaaagggagtgaggactatggctgcatgtcctctgcttgcccggctgcagagcagagatgtgcagccctctggtcagctggtccaggctggtccccgccggtccccttccagtccagccaccaagagtccacttgtcccgggcttccacctggctgacaggaagaatttctgagagctggatgtgcatgccctgtggacgaaggtacagctcgcctgcctgccccaatcccagccccgacaatcacatgcagctgactcggacactggccttgggaacaatgttcgagagaacacttgccccttgactgtaggagccagaaggggacccaggtgtgcatagctctctgtagacatttttacccaaacctgttggtaaagtgcccatctggtgctcaagagagcctgggggtctaacagggagcccggctgcctcacctggccacagcctccacaccagatctccacattgtcttgatccagaccagctctgtgatcagaaggaaattgggtccagtgtaggagagagctggtcctgggcctggcaggcaagagtgtgggcatcctttcctggcctttctccactctccctcaagcctgtgctcaggttgccttgaatgtggactctggaagagccaggggcccagaatgccgggggaggcttctgagtggcactcatggaacaccgtccctctgccagccataggccctgcctcca

SEQ ID NO: 62363 - DNA, 1081 bp, Homo sapiens
tgccattcctggctctttccctggatcagtgtctgatctggtggaggtagcttgtggggcctgacttcctccagttccggcggatcctggcacttttcttcctagagtgcagatactgctcactggaggctgtctctgtggcactctgtgggttggccagtgcagagtggggctccaggattctgcagagaacaagtgtatgattagccaacatcaataggaagaatggaatggggacttcaagagatttcgtcatggtggaccataaaacatatgatttggagcaaaatgagagcggggctctgctctggtctttccccctctgagaactgtctgactagacaaagtttacagatttctctgcagtagaaagggttggaccagatcaggttgtgcaaaactcaacatttcttcatcctcatcctgtactcatggcagatgtcataagtcatgctattaaactggtttgataagcagtgactactaattaactggagttaaatacaagctatgacactgacttgccatctcaggacctgatgacctccaaaggcctgtttaggtctgatgttctgattgtgggccccagagaaggcagcagagagatgaagcccagagcatcacccatagtgattggttgaggccaagtggttcagctccatccctttgggttcactcttcctgggctggcagtggcctaggcaaagaagtggcccaccagggagactggggagagatctcaaggtaaaagttttcaacaatttttaacccataatgcctcgacagtacattcctaggctatattctctgtaatcccccagccaagattttaattaggcttaaaaaaaaaaaaaaaagagaatctcactctgtcactcaggtcactcaggctggagtgcagtgacaggatcatagcttactgcagcctcaaactcctggcctcaagtgatcctcctacctcagcccctggagtagctgggaccgcaggtgcatgccaccatgcctggctaatttctcttttttttggcggggggagggtgtgtgtgtgtgtgtgtgtgtgtgtgtgtgtgtgtgtgtgtgt

SEQ ID NO: 62364 - DNA, 1078 bp, Homo sapiens
gaaaaggaacattaaaatatttttaaattaaaatatttacatgctcatcataagaggcaaacagtacaaaagcttatatataaaaacttttccaatttcctatcaacccacttgcagaagtaacccttcccctaacctgccttttgttctctgtaagagtttgaattgtctccgccccactcatactcccaaaatatgactcccccccttgccctggccttctccgctcctcacctcaatagtcaccctcattatcccaatcatttctatgctcactctgtcccagtttccaggccttctatcataaaaactccaccctgttttcaaaagatttaacaactacaataaagctgcagaagacttccagatgagttaacgtcatgaaaattgtattttatttggaaaatggaaatttaaaaatctgcctctccttaggtgctattatgaaaatccagttaaaacctaatctatatggtaattaagcccccagagctggatgacataaacacactgtgacaagaagacaacagtcgccaagtaacacttttaggctgataaaaagaaaagctaactatgggatatttactctggatcaggcaatacgtatgatatcctttaatcctcaaaacaattctaggagttagggactgttatcccatttcacagggaagtaaagggaagctaagatgcaaatatgagtaccagtggcttagccgaggccagaggtggttcaaatgactgcagcccatgcttttatttttattttttttttgagagtgagttttgctcttgttgtccaggttggagtgcagtgttgcaatctcagctcactgcaacctctacctcctgagttcaagtgattctcctgcctcagcctcccgaatagctgggattacaggcgtcccccaccactcccgactaattttttgtatttttagtaaagacagggtttcaccatgttggtcaggctggtcttgaactcctgacctcaggtgatccacccgccttggcctcccaaagtgttgtgattacaggtgtgagccactgcgcccggtcagcccacgcttttaaacccccg

SEQ ID NO: 62365 - DNA, 1120 bp, Homo sapiens
ttttccagaagttaaagggtttttattcagagcaagttggagaggtgacggtaataaccacaatatctacagagttgtgaaaattcaacctttttgctaaatccttcaatggtctgctcttttattttttctttctcttttgttttgtttttgaggcagtcttactgggtcacccacgctggagtgcagtgatgtgattatggctcaatgcagtctcgacctcccagactgaagcgatcctctcacctcagcctcccgggtagctgggactacaggcacataccaccatgcctggctagtttttaaatttttgtagagacagggccccattgtattttgcatgctggtctcgaactcctgggctcaagagatcctcccgtctcagcctcccagagtgttgggattacagatctcagccactgtgcctggccaggtctgctgtttgaaaaggctcaaccttctctggattagaaactagaagaggggaggctgcgtgtttttgtgagcttgtttttaaagcttaggtgcacaggtgttagctttctctgtggaggctgcaaaggtgtagtttcagggtgtgtgaagcatgaatgtagttctagatatgttgccatcagagcacctatgtagctctattatatggttggcacgtctcaaagcattttataggtgtccattgattctctcagtaaccctaatgaggtgggttctaatgtcattgccatattccaaatgaggaggttgaatcccagagaggttaaataccttgcccaaggtctcccagctaatgagtggtagaggtaggatttgaaccctggcagcctggcctcttcatgaccaggctatactctatatagtagggtatcaatacatgttagatactgttaatgtagctattttttaaattgtggtaaaatatacataaaatttaccatcttaaccatttttaagtgtatagttcagtggcattaagaacattcacagctagtcgcagtggctcatgtctgtaatcccagcactttggggggccgaggcttgagactaggagtcccctcagccccaagtgctggtgcagtgagagcctggggtgagacacttggggtgctttggaagccctttg

SEQ ID NO: 62366 - DNA, 1318 bp, Homo sapiens
cagtccagagttgggggtgttggcagagacttcccagagtaagggagtgatgtttaagctgatacctgaaggatgagtaggaattaaccaggtaaagagtgggagaaaaatgttccaggacatcatttcatttcagcccatgggctgcctcgctgcagcgatcatttatgcttggtttttatgatttttagttttgatggatctttggggaaaagagcattggatggagagtacaaagaacaggattttaggtctgaatagttcactttcccttgctcacaggtttactgttggcaccacctgaatctgtaggtagaattgtgttgaggactagacgtgcaatgcaaatgttgggaattattatggttacaggatgcagacatcagaacgtgaggggagtgggccggagctgagccccagcgtgatgcccgaggctcccctggagtctccaccttttcctaccaagtccccagcgtttgaccttttcaacttggttctctcctacaagaggctggagatctacctggaacccttgaaggatgcaggtgatggtgttcgatacttgctcaggtacagactttgtggagttgctctggtctgctctgccttctgccgtcctgctctgtagtaactaacactgaccatttaggcagtggctgggctgtcctttctgccctagtgaggagcagttctgggaggtctgttcggcctctgggtttatctaggcctaccctgtgtctcaggcccagcccaggagaggcagatactgggaatgatcctgcctttcagcaaggttcttctttgtgactgaataagctccttcctctggactgctggacaaccttgaacatcacgccttctacagcttagagcaggcttaattttttcctttgcccccaatattagcataattaatattaaaaaattagggtataattttgaacaaaaattaaagaaatacaaaaacctgtgaataagcagataccattttcactactttttttttttttgagacagaatcttgctgtattgtccaggctggaatgcagtcgtgtgaacatggctcactgtagcctcagcctcttcagctcaagcgatcctcctacctcagccaccatgcctggctaattaaaaaaaaaaaaaaattgtagagaggctctcactgtgttgcccaggctggtcttgaactgttgggctcaagtgatcctcctgcctcagcctcccaaagtgctgggattacaggtgtgagccactgtgcccagcccatttttactaatttattgagattatggatcttaactttttccctcctatcctg

SEQ ID NO: 62367 - DNA, 1630 bp, Homo sapiens
atattccatttcctcagttgtaccatctcttttggctaaatcacatttcagtccaggagtgtgcattgtttgtacttattatgtcttttaagtcttttttcagtctaagacaatctctctcgtgacattgatttgctgaagagactgagcctgaactgactttcctggagaatttactaccgagatttgtctggtttcttccttgtggtgcagactagaagttagatttaaaggttggatttgattgaagttagaaaagtgtttttttttttttttgcaaaggtaaatgttgtgcccctggtgttgcattgcatcaggagtcacacaaaaacctgattgtcctaaagagcagaggtttttaacttggagcctatgggtgagttttagggatcagtgaatcccctgaaactgcatgtaaaattatgtgtctgcacatgtgtgtatttctagggaaaagcttctggttttcatcagattctcataaagaccctcagtcctctgaaatacatgagagagactggtaggaagcagggtgagtggagttacgttaacctctgaggatgccattgagtatttatccatgcctcagtctggaaatagtggatgttttgttactagttctctggcaaaggccctacatttttcttgttcacctaatttatgtctgtatccgtagaggtgagctagtcagtgttccagagctgtgttctctactgtaagatcactgtgctcttcccacaaggggtagggagacagtatgaggagaggctgttttctccttttataatctcagcatgatgtgaagtttggtcttctttaggagagaggctgtgcccccggcacattctttgtatgtgtgtgttgctctttgtggcaaagtacgaaagttaagtgtatcctgtcctgcccgtctccttttcctctactagtccgtagtgcgtcttagcacactaatgtgttagggtttttccattttatggaattaaaaattggaggatgtggtaggattggttaaagcaggatgcaggaggagcattggacttaaaagcccccaggagcctgcagtttctgtgctgctgggagagggagcactggtccatgaaagtggctgtcacgttagtttgtgcttttgattgttcttttcttagtaaagaggatttgactttgaagagggacctaatcttgggctctggctattaggtctgaagcctagagctgcagtaaattgttaacagactctctcctgggatcagctactctactgcttgggtctcctgggaccaaagtgtcagtaaagacattttatagaagggaagaggctttaaaatgaaagtgacttgagtggtggtgtttttatttccaaaatgggattggcttttatttcgcttttaccctggtagctgccactagaggttctgaggcgtaattagggtggtacaggtggagtgtgttgaatttcaggagaaagacacagatgtcatttcattcccttactcataaatttcattaaaaagtaaaagcccctttacactgttggtggcagtgtacattagttcaaccattgtggaagacaatgtggcgattcctcaaggatctggaagcagaaataccattttacccagcaatccca

SEQ ID NO: 62368 - DNA, 1135 bp, Homo sapiens
ttctgtcctgcccactcaccaaagcccctgtgtctgtagcttgatccagctggaggccttcctgagccgcctgtgctgcacatgtgaagccgcctaccgcgtgctgcactgggagaaccccgtcgtgtcctcacagtgagtgacccctcctctcccgccaccaccctataggaatttgcagcttgagcccgagcaaagccagctgccttgagaggacctctgcccctcttacctcaggggaagagctcgcctcctgggctcttgtgtgtatatctgcacatatgcttgcgggctctaatgtactgcttttgtttagatgcttgcttttatgtgtggtaaaaataataatagaaaaataactcaccatataatccaccatgcagccgaatctcttgtttgttttgcctgctagaatttgtcacatgcatctactttacggatgtatagtttcatagtgtatgttcaatttttcttttgttttccacttatcattatattaaagatgattttctttgttgctatatagcttttggaattatttataataccagattaatatagatggcaaatataatttgtgaaaccattctgttacagatttagtcaatttcccttttcattactaaccccatggtaaacatttttatggatttagctttaatgttttagaaaatttttcttggagtaaattcaaggatgaaactaccatatcaaacagaatgggtgtttttgaggctctttaatatgaataatagtgataactaatgtttgttgtgttcacctggtgccaggcactgctcaacactccctctgtattatctcactcttatagtaactctattaggtaggcgctacttcagtccccatcttacacgggaagggagctgtgcccagagaaccaagagacttctcagaatgagaagtggcagagctggattcaaatcccagtctgtcttactctagacttcagagtctagaccttaaggagtgatgatggttgaaccagtttatgtgccaccagctgacaccactttggcctcaccagcatcaggtgtttgcaccggtgacttgggatagttctcagtcttcatcgccattttccgctggtttgatgagcggctcttgtcagtttatt

SEQ ID NO: 62369 - DNA, 1756 bp, Homo sapiens
ctttccttttctgttctattcaaataaagacctactaaattattttcacccagtttgagaaactgtagtacctagctttctccaaggctgtttgatgctgggatcctcttgtggggggcgtctgtcaatgtcaccatttgggaagtgcgcagagctcagagcagcgcttccatgcttccttctgcttgggggcccctccaggtagcttctttcttcttgctatctttttctttctgttttctctcctcttccccgcaccttgggaggcaggagacccacttggtggtgctggtaagtggaagccttggtgggtgggcaggggctgggctggggagggtggctgaaccggctgctgccacacctcgtgggggctgccgcgcaggatgcctctgcacacgggtcctgcagccttgcaagaggtgggcaggactggaaggagctgttcccacaggaggatgatgagggcgccccgtgcccagcagaggatgagctggccctgcaggacaacgggttcctgagcaagaatgaggtgctgcgcagcaaggtgtctcggctcacggagcggctccgcaagcgctaccccaccaacaacttcggtgcggccaggggacagggctgggctggtgggggagtgggggtggacttctgggactctagtggggaacacccagccacaggggcagagtctcagaactgtgggtactgacttgtgacaagagcagggagtgaaggtgtgtccgcgggaccccggggagctagcagatgcccggcaggactgctgagggagtgggtgtgggttccttcttgtccctccatcctgattggacattcagttgtgggaagacaaggaactcagtttgggaaatgccatcccaggactgtagagaaccataatcctgacagaacttcagaaggcagtgtagcatgatggtgaggaacagagtagagtctcactgcctgctgcaaatcccagctcagccaggtgtccttgagcaaattatttcacaccccgtgcctcagtttccccttctgtaaaagggggatcatcattcttacctcatagggttgttacaggtctcatgtcaaatgagacagtagtacttacgaagggctagcacagtgctggttggttcatagtaagtagtgggtgcggttaatgtgggaggccctgacccacgctgtgggttcctaggatcctgtcttggtctttcttatccagctggaagcaagttgaagcaaacattgtttctctggacgtgatagagccctgagttcacctctccccagccagtccttattttactgagggtcgggggagagcggtcaaggaaggcagctttggagaagggtggacttgacagcacagcttagagacctggctcagatcagcagcgctgagagctgagccacatacaattatggtggaaacctagagtagctaggttgacctgggagctgctgtgctcctgaggaagggccctcctgcctgctgtcagatgggagcagggtaagggggcagtactgtgtgttctggtgttgagtgagttctagggtctgtgccctggaagaagacaatggagtttatcttgaggaatttgactcagggcccccagggtcctgccttcctacccctgcagcagccagggcagttgttttctcaggattagatgtcctggacaggctctttctttctgctgtgtgaatgtcccccagttattcaagatccctttttttttttttttttgagacaaggtct

SEQ ID NO: 62370 - DNA, 1077 bp, Homo sapiens
aaatctctcatcacagttctggaggctggaagtccaagatcagggtgtcagcaggatcaggttctggtgaggtccatttccgtcgtcatagacagcaccttctcactgtgtcctcatgagaaggtgggaggggcacggcagttctctggggcctcttttataagggcactaatcccattcacgagggctccaccctcatgacccggtcacctcccaggggccctgctttgggtgttaggattccacatgtgaatgttaggggactgtggtgggggctattctatttacccctgccagtggatgagggggtgcatggggagaatgagggcagactgcaaaggagcttctctgtggcctccgtatgggagaggtcttggtggggagggcccccctttgtcctggaggctccatgactgttgccctggcaggccccactgggccttagtgcccctgctgtcatggcctcggtggcatcgtcacgtggtgagtgaggatgggtgagtccaggctgttgctgagaaggggcagaaagagttggtaggtgttggaagggaacgtcacctggctgagctgctctcagctcccagagccctccctggctccggtctgtgagtgggttcacagctgtctccccagcccacttggctgccctggggtgcttggccctgacattccattcagtttagaggagaccttgggctcaggtcagtgtcagtctttgagtagctccttttgcctgtcccattccccttgtgtcccttgctaaggagaggctggggcaggctgccttccccaaattcttggtgtagggacagaatcttggagcagccagtttcctggtttggcaccagcagtaggcttgttcttctctttccctggctgactgacagggtgggcatttacctgaagcaccttggcctcagatttcccctggctctagcagaggtcttcctttccctgaacctagggagtctcctttagcaagaacttcaggtgattttggctggacagaggaagggaccacatgtagccgtcaataaagctttggggcctttctgtgaaagtgaggcctggtgc

SEQ ID NO: 62371 - DNA, 1233 bp, Homo sapiens
aatagctggacagacctcggcctcccctcgaagacacctcaattcacagactctcagcccacacaatgccccagtgtccccagctccgctggagcagctgcagggcacttggatcacaacttctgcaccctctgtccagagtctagggcagtcctccactggcccagcactccagtttcctttccctgcctcttgtccaatggagtgggaggccaggtgagtggagcagaggtcctgaagcccttgacccctgggggcctgggtagtgtaggatctcgctgggctgggtcctggattccagggctattccctggaggacagtctcagttatgggataaggccccctgggggtctccatttctttccaacagtttcatgttcactactggactcttacgggctcagtatctctcccttagccatgagctggctcaggcatcccttcccttccctggagctgccctgcctttctcaagtatttatttatttattgcatggttcctgggaacatgtggcacaagtaatgggatgaggaggaattgggggtgggggtcttctacctaggactcttccctggagtcatgggctgcctgggacccaggacccatgagggggctgagaggtttctacactcgaggagcaggggtccagagaggcaggctggggaggcaagggacccatcctaggcccgctttcttgccgagccaagcagcttagctggggctgtgcagccaggggcttacccaggccagtggaggtgccacagccctggggagccagacaggctttggtatcgtatcgcctctgtgtccttttaagagaggagagttcagtaccccgtgctttctttacactggagaggaactaaaaggatctctgtgtctatggagaattgtcaataaaaaggcctcaagcttcttgtttttgtcatgtctttgtgttggcattttccctgaggctggaagaccagatctctctggcactgctggagttttgcaggcctgggcaattcctgcaggaccaggctgaggggcgggcctttggggcaccatggtggcaggggcgtgggggctgcagcctggtctgggtatgagctgggggccaagaggaggaaagctgtgccttgcacgcaggagaggctcagcaaatgcttgtcggattgacttgaggcccagtcttgtgacccaattgtgagggcccagcactgggggttggggttgggactagaacttg

SEQ ID NO: 62372 - DNA, 1040 bp, Homo sapiens
gctctgtcctgggtggcttagaacagtgatttattttttttaaaccagagtgtaattttagatgattcttcagagaagagtatcagagaggcacaagtgtagtttggaaaagcagtcaatgcattttatttttggaaaatgaaaatgccaaatgttggtgaaatctcaaccataacagcagtaacttgaagtctgtgcctgcaggcatggattacagagatgggagaagcatgagtttccatccttgggtaacagcctccgagaaggggatgctagagggccttgtccccttgaggtgcccctgagagtaggcaggggacataactttaaattgcaggtaccgctgggaagcgaagtcacggagggattgtgcttcacaactggctgcgtccacagcatggagaggacctgcacgtgggtggcctacaagacaaactgtccatgtttgaaaaaaaaaccaatttgttctcaggcccctgaggaggggatggggaaccagactgctgcagccctcgtgcctgctggggcaggtctggggctccagctcccacagcctggcgtgggctgagggctctgccaatcctttttgtggttggttgtgttgagcagcctcccgtgagccatggccgaccttgagctggcagtggtttctgggatcttcaggattttcagccctcggggctgaagccatatgaagttctgtcttcatccccttgtctccctggaacctttgaggcaccccctaagagaggccctggcccagcatctgtcttacagctggtggccctcaggataacacctacattgatggagcacctgtgccaggcaccatgctgagtgcatcatctcatcgagacctcatgacaatctccaaaagtaggttctgttgttaactctgtttaactgacgagtaaaaggaggtgtggggaggttagggaacctgcccaaggtcacatagctagtaagtcgtggagccgggatgtgaattatgccacatgagcttgcaggggcctcataagagaacctttggaggaacagag

SEQ ID NO: 62373 - DNA, 1106 bp, Homo sapiens
tttcatcgcccaacaggcagttatgtgcctcgtacacagcaagtgtcatgctgggagctggggatgtaggccaagtgccacccccgcgcctccacaagaggggcatccattctagtggagggagacagaccctgaacgcatgaccacacacctggacaagatgatttcagaaccctctgagcaaggtgctccctggagactgttccagagagagtggtcagggagggcctcggggggaagactctgagctgagacctgaaggatgagaaggatctaggcccagaaagagttgagggaagggcaggagtgaaaagcgggagacaggacaaaggctttgtgtgttgaaggagcaggagggatgccagtatggcctggagatgatggagagtccatgaggcccctgtagggagtctgaattttgctcttaggagccttagaagctaaactggggagtgacatgatgtgattcacatttttaaaggctccctccagctgctgaattgcagagtggattggagggaagaggggaagccaggtattctgtgaggaggcagctgcagaaatccaggcaagaggtcacgatggcaggaaattgggtggtggcagaggaatgagaaagaggtgacagagagaggtggactggtggactgcggggcagagtggacaggctctgctgtgaaattgcacagggggcaagaaagacggagaaatcaggggtcgctctgatttccccttgagcagctgattgatgatgggggtgttgattgagctagagaagacagaacagagggccagaatatgggcagggcagggcagaatctggagttctattttggacatattaagcatgaggtgcatcttagacatccaagtggagctgtcaagtaggtcatgggttattgtattcgtgagtctggagccacggggagaggttgtgactggagatagaactttcggaatcatccatgcatgaagagatcacctagaacgattgtagtagacagaagagaggacccaggaccaagcctgagtgcccaccccctgcccccagcatgtagagaccaagtacaggaggagccagccaagggaactgaagcagggaaact

SEQ ID NO: 62374 - DNA, 1013 bp, Homo sapiens
acacagcagcagcagaagccacttcccaggtacgtggctgtgccccaagtccctgtggcagatggctgggtcctgagcacgcagcagagaggacagcgagaggggctgcatctgggactggcactcagctggcagctctggaagtttaacccccaactgtcccacaccacgggggcttttcacctgtcactgaacaggcactgtgggctccttggccctggtgctctccaggaacatgccaggaactctgtggggacataaagcctcagtgtgcttgagtctgcacgtcctttaatgatacctgcagcacccagggaactcagcacccaaacagtcacttaatgagagtgaaagggagccctcttaataattacagcaaaaaaaagaagaaggaaaaaagaaaaagaatcacagaggcaaaaaggcatgaacaaggacactcctaggccaactgcggtgtgcagggtcaccccctttcacatctagccatgtctccaacctgctcttcactctccaccatgacaccactcctggtctcccacggagattcctgcacctcccccagctgctctccttgtctctagtcctgcagacagagccgttgaaaatgcaagtctggccacacccctttcccaccgaaaaccttctagaagctccccattgcctttggatgaagtccaaactctttgacacaatccacatagcccagcttggctgcgtctccagccttgtcactttctacttccctgtttacatctaagcagcaggcacaacaagctttcttcagttctgggctatgccaggcctcaccctcaggctgcccactccctctagcccccaattatccctcttcatctgagcgacatgtgctcactcaccatggtggtctcagcttagctgacccttcctctagggagacttccctgattgcccgaatctgggtgagcttccccaactctggactccccatgacccactctccctaggccttcagccctctgaacggtggttcc

SEQ ID NO: 62375 - DNA, 1040 bp, Homo sapiens
gatgcacagagatttccggtgcccacccagcttctgactcagcacagaggaggaagggtgcctaggagaaagggcacagagtccggaatcagaagccctggcctccccactcagtagctgtgacatcgcagttcccctccttctccaggactcagttacctcacccgtcaaatgggaaggctaatgtctgtactgcctcaagggatggacagaagggatggacaggtgtgatccagactagggatcggctaagcacttcactggtgtctagcacgactgttattcttccctccttcttctcgtacaagcagcctgaggtctgtgtggtcctaaaggcagcccccaggtcctttgcgggaggcaggagaggagcttttgggttggactgtctcttatttttaattgcccccacactccatagaggagagctggcctcccgccccagcccactctcctgccactgacccccagccttgtttcctccaggacatcgcctcacccaagttctccatgccctcccctgtccgcacggtcatcaccgccgactttgacaatgaccaggagctggagatcttcttcaacaacattgcctaccgcagctcctcagccaaccgcctcttccggtagatgctccatcctggctcgtggctcttcatccttgacagctggtgggaggaacggtcagggagaaggtttaagaatcagaaggggagggttcccagggccagggggtcaggccaaggtcaacacaggtcccctgatgaagaaacagaaaggaaggaaggacgaggactgggcaagaggctgtgggaatgcagggcaaagcctggccaaggagccggcctctgctattgcagggaaagggaagggaaatgtggcccaaagtgtgcccagaacccaagcgccacaagatacaaagccacactaccacaaaaaggggctacagggtccaatcactaccaggaaaaggggctacggggtccaatcactaccaggaaaaggggctacggggtccaatcactaccaggaaaaggggctac

SEQ ID NO: 62376 - DNA, 1248 bp, Homo sapiens
aagcatggtcactttggggaaacctctgccccatccagaggcgggcctggcctttctttacacaggtgtacttgagctttcgtttatttttttaaaaatcaagttcttctggagtgctctgataactcttcttattatagtaaacaaccctttagagcagtacttttcaaactttaatgcgcacataaaccacccaggggtcttgttagaatgcaggttctgatttcattaggggcctgagattctgcaattctagcaagctcccaggtgacattcctgcaactgcttctcagacctggctctgagcagcaaggctgcagcgtccacagagccctttcatacagctcatcgtacaacatgatgttttgaaataatgtagacattgtggaatggctaagtcgagctaatcaacatatgcattatctcacatacttttttgggggtgacaacacttaaaatctactctcttagcaagttcaagtatatagtgcattcttattaactaaagtcaccatgttgtacaatggatctcttgaacttattcctcccgttaaactgaagtgttgtatcctttgaccaacatttccccaacacccctacccctagcccctagtaaacactattctactctcttcttctatgagttcaacttttttagattccacatataagtgagatcatgtggtatttgcttctctgtgcctggcttatttcacttagcataatgtcctccaggttcatccacgttgtcacaaatgacaggattttcttctttaaggctgagtaatactctattatgtatatatatcacgttttctttatgtattcatccattgatggacacttcgtatcttcattccatatcttggctattgtgaataatgctgcagtgaacctcagagtgcaggtatctcttcaacacactgatttcatttcctttggatatatatacctagtagtgggattgctggatcatatggcagttctatttttaatttttaaggagccttatactgttttttataatgtctgtactcatttacattcccaccaacagtatacaagggtacccttttctctacacccttgccaacacatgtagtctttcatatttttgataatggtcattctgacaggtgcatcttacctcatttggtcctctcaaaaccccaaagtagaaaaagcaggtcggactctcccccattttacaaatgaggaaactgaggctcaagggtaacgtaaattgcc

SEQ ID NO: 62377 - DNA, 2097 bp, Homo sapiens
ccctggaacctcttgccccactgcctctggtaacctcaatgatgggtgagcaggttctgtaggagaaaactgacaaatcacaaaagccgagatttaaagcattctttattgccaaatcgcagatgaaattatttacttacacataagcaaccaggaattgagtgctaaatccctaggcttcagctgggtcccgtctcggataactgagctcaaagaattgagttcttgttccaaaacctctccagcacttttttttgaaggcacgctctcccctcatctttctggttgggggacctattgtcagactctctgacagggagatctttctagggaaggctgtttttctaattccagcacggctgctgactaaactctgataatctgccaatagactgctgatggcagagcaatccagttcctgttttgggtgccaaaaatcaggaagccagagctgtacacaacaacttgtcatgtgaacttaagccacattcataccagacctgcacttgggacagagagatcctcttgttggtcggccttcccaacatacccatcccaacgtgtgcagcagaggcttccaaagtggcagcctccctcagtctgaatcctggggctggaaggatggttgaggggtcctttggggtaccaccctgcctccagacacctgggtggtggcatcatctcaaagtcctgcccagaaagggttgtcactgcctctcctgagtttacaatgcctttccctagccacttttcaccctggtgaaagggggagattaatgttgacctgtcttacaaagtttgtgggaacaaatgactagacaataaaatggttagcacagctcaagccccatctaagtgcctgagagctccgcgcgtgaaggtaccatggaaaggctgtatcagtaataaactatgtttcccccggaaaagaaataaacatgcaggcgcttcagcctagatttgtacagtcaattttttctgcatagttgccagttctgtgcactgggctggcttggcaattaagtgccttgatcttgcaagggaaggggggtgcactggggggatgaagcacttgaaaatgacaaggtggaagggaggcaaggactgggagagcaggctagacacagaataaaagaatctggaggttgcggctgggtttgagcatgaagggggcattgttcacgctggctgggctggcacagaaccgaggagcgggaaggaggagacccagaggaggcagatgaggagcacagtggggatggaagcaccagccaactgtgccggctgggctggaaggacgggcagttcaaggaagaagcagcagctttggtggaggaacagagggaggctggggcagctggcgtgcccagaggacgtgttcgaacagctctgcagacttccaaaagccatttggctgacaagaacctatttggcccaccatgttactattctgtctgcgcgccttctccagcccaccctttccctgcccgccaagccccccaacactaccctgtagccccccttgtcactcagctaatgacacatggacgtctggctggaaaactagcccggagtgtcccccacccccgagccccaggaatggaccccaaatgtaagggccgccatgctgagcccggcctgatggctgaggctttgggcgcgtggccagcgctcagcaccactgtggtgccagggggcctgagaagctgggaggaaagcaggcagaaggggcaggccatgtccagatgtgcactcagggagctgggaggtccctggagccaagccacacagcacctgcctgctagagagctgtatgacctgggagaacctcccattttacaaagaacagacggagatccagggaggagaagggactcgcccaaggtcacacaggaggttggtagagagctagcacttagagccccatctcctcctgatgcttaaactgccacagcccgctgacctttccgatgacctccaacttaagaaccctaccagcctgcaagacaggaggggctgtgaggggaggcccacacccactgggatgacagccccaggctggcacccggacttgaggcagccccacccgggttgttg

SEQ ID NO: 62378 - DNA, 1364 bp, Homo sapiens
tgggatctgtgttctaaaaaagacacctctaaaaaagagagcagacataaaggagacacaagcaccaagtacgcatggaaactcaccagttactgttaaaattagacgctagcctgaagtaggtgcttatcctagaggaaggagtgggatcaatgcatggagcattggtcttgaactcctagctgcaagcaatcctcccaccgtggcctcccagactactggggctttataggcatgagccactgcatccagtcaatgaatggaaccttggaagtctatgtttaaattgagtccagaattctcttccttagccatcaccaacctaagaggagaaagaactagaaaagagtgtatttgagccttggggcttagggtcataaggccctatagaggttaatttctccaagatcctgtgtcttgctcggtctcctccctgttcacatgctgagtctctcccctcctttcactctgacccaagatccagactcgtaatttgtgttttctaatatagctcatatattttggttgatttttttaaaaaattatattaaaaagttttaaacatatacaaaagtagacagaataggataatgaaacctctgtaatttctgtgagtttttcatgacgttttcccccctaagtaatgatgtcctggggtgcagtgttgttatacttcttggaagtaacaaaagatgagaaaaaggataggttgtttggggatagaatatcatgttgttaagagagaaagaagatagaagttacaagttctgttgactttcatcttctccatagggttgggggtggggtcttcaagcaggtagaaccaataacctgttaaggaaactccagcctaaggcaggtgaggctcacacgtggccattacaagaccattctcaggctagtgttgctaaaataaaattaaaaaaaaattacaagaccagttgcacacaatgacacgatggtcctggaaaatggggcagccagggaagagaacaggaaaattatatttcaaacatgaagaaaaaaagagtggatctgaaaattaaagaacagtgagttcaaacaaatggcttatacatttttaggacatagtgtggggatcaggagctaacactggctgcctaagaataatctgtacacactacccttgtttccctgcaaggaggcatttggctggtagattggcaggatgctgtagacatagtttatttttgttttagcgaagcagttaacagtctttctacacattttacattgaatatgttgacccataagccagatgatcattctcttagccagaatcatgccccaaaggtggattctagagctggaagaaaggctctgtccagggtcctgccttgttg

SEQ ID NO: 62379 - DNA, 1034 bp, Homo sapiens
gcagcagaccacgctggccctgaggacaggttgctcagtctggcttctttctctgagtgagaagaaagccgttaggagaaggattttgagccaaggggtgacatgatgcgacttgcactttaaaaggatgctctgattttcatgttgagaatagactgaaggaaggaaagggggaagctgagagctgtcaggaagttcttgcagtaatccaaatgaaaaatgatgggcttaaaccagagattagcagagtgtgagaaataaccatgttctgtgtattaatatattgtaaggtagagccgacaggatttgccaataggaattgggtatgggatgggagaggaatccagttagactcggagcttttggcctgagcacctggaagctagaagttgggaaaggaaagacagcaggagtaggtctagaagagctactgggagctcagtttttgataagttaagtttgaaatatctattaaacattcaagagcaatgttgagtaggcagttggatatatgagtctggagttcagggaagaggtctggggtggagatataaatttgagagttgtcagcgggtagatggtatttaaagccctgatactgtgtgaggtcaccaaggagtgaaaatggatgggagaggagatacccaatgactaagcctactgcctccagcgtcagcaaccatttgcaccctttgctgtggttttggcattttgagggttaccaagctgggagtaggtctgggtggggagataaggcatgatcagatctgtgtttctgatcaatggctctgtggggtcgtccatggtctatctcatcactcctgagcgtggagggattataagagcttcctatctgaggtccccagcaggcaatggttaatgtctcagatttccatggttacatttgtccaaagatcagctaacttttaatctcaagagtcatcatcaacaagcaaagcacattggcagccctttgatattgacagggaaaaatgcagacttgggagaaagagaggaggagaaagagaaaggaa

SEQ ID NO: 62380 - DNA, 2096 bp, Homo sapiens
gaatgcgataaattctggattagaggctgggtcagagtggagtaggagaggataaattctaactgaagaagtctggaacaattttgtggaagcagtggcaatggatcggtttgctcatgaatagatagaatttcaactgagggatgagcatttttagtaaaactaaaaattgctgcgatgtagtaaggtctttccatgtatccgacaccattccaagtgctttgtatgtgttagctcatctgatcatctctttaaccccatgaggtttgatgcatgtgattcccactttaaccccatgaggtttgatgcatgtgatttccactttataggtgagacaggtgaagcctagcaagatcaggaaacctgcctcaggccaaatactaccctatggggagctgggatttgaacccaggcagcctggagccagtgcccatgctgttaattatgaaacacttttgcttctacatgcaagatatttggttttctttcttattatcctcactttaaaatcactgatcaactctgttaagctttgttagaagtggaatgagcgcagaggacctactgaagatgtttgtttattcctcgctgtgggctttggagccacctataatcagtgaaggtctggatgagagtacgctgcggcggcctgcctttccgagctctagatggccaggaacaggctctccaggcacgcacctccctgtccctggagtgtctttctggtcctcagaggcagctaagctgtctctcttcctctgggtttgggggctccacgtcagtggtctctataggggcccgaagatgtaagatgtggttcggggaacgggccacacaccaggtagatggttcctctttcttccaaggcttcatgacctcaaggggcagccgggagctagctcctcattgggggcccaggagcacgctcaccgagtgtgcgtagcttccctggcaggtggagaggctcttggcacagagggcggaggagcatttagacagggcctctgtataggagtgaggggctggaagcccagtcttccctcgtctcccccagccctacccccgtgtgaggctgtgcaggcttggaggaaggggcgcctttttgtcattcacagggagagtccatcttagaactatgcagaagactggctgccagttgtaacagaaatggtgccccacgtcctttaggaaaaggtgactccattccgactgggccaaaatgccgacagggtaatcctctttctgctcttggatgccaagagatgttgagtcttccagctgcttcttccctgaagaagaagaagaaagcgaggtctgccggctccccatcccgcccctccacgccccatgcagccagcatctctgtgcacagggccccggaggtctgaagtcttttgaaccctccagccaggaggcgggtcaggaaccggccctggcgcctcccgcagcacccgtgctccgtgagggggctgaggacagccgcatcagtcagccgggccccgggtccctctgcgacctgggattgagccaagagcattttgtgttaaatgccgacatataaatttgtagacgatccttgtgcgcaaattggattccttcgcagggcccttaaatgctgccgtttagccagatttaactgtaggctccggcccctccgccgctcctcccgggccggccctccaccgccacccgggaatcgatcccgcgccagtccctgcccgcgctccggcctcctcccgcgggctccacgttctccggtctcctcctcccccactgcccgctcccttctccccagcgtctccctctgcccgcctccccttcccctccgtctctccctcctcctgtctgcgccgaggcagctgcttccaatgcagcgagatgcaccaattcattcagcctcgcagactctttaaggtcgttactaaatatatcaagaagaagaaaggggtcttttttcctatctctgaacagggagcataaatgctggccttaggatccgagcctgtcctggctccctgagtccagcttctccgggctcccggcagaggcaggggtgaccccgagcggaggggcagaggggaagcggaggggacccg

SEQ ID NO: 62381 - DNA, 1026 bp, Homo sapiens
tgctgggtaaaccatgtgaaccttcaattctagactctcaagatgactctgatatgctaacgtggtgactgagtgtgctcaggagaatggcaaaacaatattttagagaataagcaccaaacaagtatgaaacatgccaaagggcaatggtgatgcccactacagggaggaagtctacctttggagaaagcccaccagtagactctcctcagttaccagggaagccacagagagagttatggaatgccctggaatgcccttagaagtcatcccactcacccataaatacttagtgagcacctacactgtgcttacattcaagaagacaggtttagagaggttaaataatctgtccaaggtcagacagacagttaaagccaagacatctactgaaaaactagcatttcaattttttatgacaagagatagaaaaagaatgtttgacagaaatgagttacagaacaaataaataatccaagactgtcttagagcctgccaaaagtagagattctcctctccctcccctcattgggttgtgctcttttgatcacaaagagatagaaatttcaagacaccaagggacagaaatcaattctgagagcttcattcttcctttgtttctctatcaaaagacacatcaagaactaccacatttcttcttccttgtgtctgaaagtagaattcttctactgttgaaatgatccaggaccctaggcctggcaatggcatagtggtagaagacagaagattcatctattcctctggcctatgtgtgtgggtgtggccgggtgaccatatcaagatgcgggtgaagtagggtgtgttccacccactctcttgtttccatctggggcctgcagtgtcatccaaaaatacgtatgcatataacacacagcatacacacatttttttattttgggaaacctaatggcaaatatttttctaatctaaaagaaagttaagaagcaaggaaacatgatgcctatgcaaggggctttaaccagaggtttgccaatggatgttaca

SEQ ID NO: 62382 - DNA, 1090 bp, Homo sapiens
taccttcacagaagcaccagaaacaatgattaatctgggcacctgtggcctactcaaattgacacatgaaactgaccatcacaatagttaaaataatgcacacaaaatgcttggtcctatgtctgacatgtggaaagtactcagatattagccagtactgccatcataatttctttttttgctttttttagagacggagtcttgctctgttgcccaggctggagtgcaatgatgtgatctcggctcaccgcaacctccgcctcccgggttcaagcaattctcttgcctcagcctcccgagtagttgggattacaggcacatgctgccacacccggctaatttttatatttttagtagagacggagtcaccatgttggccaggatggtctcaaaattctgacctcaagtgatccgcctgcctcggcctcccaaagtgctgggattacaggcatgagccaccacacccagccaccatcataatttcttactgtcccaccttgtgtctacccatgagatcgttcagagtcttacccatctgcaaatgtctgagtgctactttttggttaatcttcatctttaatgaactggattagtcagaactcttttgattgcaatagaagaaactgtttgctacccacccctccccaccccaaaaaagagaggatctagaggaggcatactggggcacacacagaactcaaagttaagaccagattaactgagccttgagaaagcagcaaagggacagcaggggctgtcaggacagacaggagccagagaccaaatgtggccaggatcgctctctgtgtccctgcttctcatccccatgtctgtgccttggcctgtccacttaattatttcagagcatctttctccataagtctggcaccaaaactgctggcaatcctggcatatatcttcccagcctgaccaccagagagaaagttccaattacaagaaaagaattctgggtgaccatatgcccatccctgtgtttcagggacattgtgtggttgggaaagggggtaggattgatcttcaaatgcaaagggggtctgttcctagatccaagatggaagagtgctgagca

SEQ ID NO: 62383 - DNA, 1043 bp, Homo sapiens
tgtaacaagccaagcaggtaggagtaagacggatggttatctggattctcccatatattttaaagtagggaatgccaacctagaggtcacagagttattacatgacatctgagaatccatctgtgcatgggctttttatcaatagatgctagtacagctaccattatatggagattctttaacattaaaaggtatcgtcacacctgaaagtgttcaagaccatagtcttaaaatatatgcttatgtactgtcataaaaatgggattaaaaggagccggagaagggtcactgaaagaagagggaatgagagatttcagacaagacatggagaaagaatgagagaacagaagagtgagaaaagaagaacagagagaagaactgtacacaagatgtaggagagaaatgatggagtcacgcaatctgtggttacacaaatctgtggttaaactctaactccttcccttcctagctgtgggaccttagaacgagttacctagcctctctgagttttggttttctcatctataaagtagagacaataatagctaatagcctacttcatagcactatggtagtggcggtattaaagttctccaataagagaaaagaactaataggagttatggcatgcaacgtgtaacattttggccaaaggtgaaccacatgtacaatggtggtcccacaagataataaaattgtatctttattgtaccttttctatatttagatacacagatacttaccattgtgtgacaattacctacagtattcagtacagtaacatgctgtgcaggtttgtagcctaggatcaataggctataccatctagcctaggtgtgtagtaggcagtttatgtagtaggcagtttgtgtaagtaagactaggtttgtgtaagtacacactatgatgtttgcacaaagacaaaatcacctaacaacacatctctcagaacgtatctcagttgtttacatatgactctgtgtgtgcgttgggtggggggagagagagagagattgatttatttattatgaggaatcggcatg

SEQ ID NO: 62384 - DNA, 1172 bp, Homo sapiens
gcttttaccagagaggatttgtatccacctctagggccgaggggtcctactgacctgagaataccctagctctctccaagtgtcccggcttaatgtagggttctgtaaccctatcttgccaccagttcaaggattagtaatactctttatggtactcagagtccctcatttccatgtatttaccattcattgctgccaggtctaatttcagctcacttttctgtggggtgggatggttcttggagattttccttaagtttgtgaacccagtaatacactaaaaatatagttcattggggatctacttgttctgtagtggtagggtccttcagaggtctgcataccattggaaacagaaaaatagacttaggaaatccaaagcttgtgttctttctatcaccaagaagacattggagggtacgtgaaactaaaggaagtaggatttaagaggtccttccccttagcttttcagagatgctcgaactctcttcttgcaaaatagaaagagttctacagcatggaagtcttgggtataagacagatgaggaggggtgtgtgtgtgtgtttgtgtgtatgttgggggagagaagcatgtatgtgcaggaagccccatgcaccaagaaaagccaggccagactgtggtccttggactgttcctctctagaagagcatggagttcaaaatcagaatctgttcacagcacagatgataccatccactggtgtttggctatgccaagcaaagaaacatgaactgtgcacatcagaaaagattccttccccctcagcagccatcttcccatgttgtttataaaatacctatagccatatgaggtcatggacaactacacagtatcctttgatgtgcccagctgttgcagtcattctgtatgctgtccatgattgggcagtggaaggggattctccctgcttgggagctatcctggaaagcagcaatgcattccagagctcctcacacaggataaggtggccggatctgctccttgggcctccacaggaccttcattccttctgggaagaatactcctcctctggagaactgttccaatcacaggatcctgtggggctgccaatcaaagtagccctttggccactagggattagtccagtatctaatcagtatcttgatctgaaattttctatcttgaagga

SEQ ID NO: 62385 - DNA, 1044 bp, Homo sapiens
tttttctctttctctttcaagaaatgtgcctttgtgtcctctgtgctagtgaagctagaccatcatttgcactgactacaaggtttagaagtctcaaccttgtctagcttgctgtttatgtgggtcctataggactttggagtcatcctccggaaacaagaactagaccatcctgggtcttgatgtgaaatcagccatttagagagacccctatctcttcttccagggcagggttgagcaaagcagcctctgtctgagaaagcttaggctgctggatgttattctgaaagatgatatttattgctcacccccagcaaagaataagagttacacagaagacaggatggcaaaattgggcagtctcccagctccaggtcaggctttctttgtggctgttgtgaagcattgcgaattctcagcgcatcagaaagacacattctaatttgagtaccaaaatacattccaaaggcaaatataactttttattatcttcagctttggatgatttgtcactgtctccttttttgggctggataaccaaaagtggactatacagacatatttaaatcaggaccttgggaggtcatttggtccaccccttgccttacaataagaccacacctatagtattcggaggctccatttactttgagccatccaagcgaacgtggcaatcctactgtaatccagctcgatagttacttatgtcaagaaccgatttgactaatctgaatcccacatattagagtttaataagccatttcttttaggttttgttttgctattgcctttgaagatataaaccagatgatcactgtcttttcaaacaatgaaagctaggatcactgccctgcctttcatcctatgtggactttttgacatttctgattttgactcttagatttcatccaccctaaacctatatttaattctgctttattatctgtctgattgtcaactcactgtttaagaatcatgtagcaggagttgaaattttgaaaaattgcatttgaaatcttcatcaggggcacctatggttcagtt

SEQ ID NO: 62386 - DNA, 1055 bp, Homo sapiens
gcaccctttctttccttccatctggaaccatgggaaaagagtacaaaagagtggggggtggggtgggggggcacccaacgggtctcctgcaacagccagggcagaaagagggagagccagaccatgagaagcagagttggctgctcattgtaggggcaggggctgggggaggagtgcaaggtactgaaatcagagacagctttgcagtggagacagggagaggctttccatgctctgaaaggctttccatgctctgcaatctggctagctccttccagatgtccaggtcccagaaggagaagaaaatagggtgaagacactttctgttcatatctcaggtcttacttttttccacattaacctgagggaatacgagagtataccatcttccaagatgaaaggagggcataatagtagcaacttggggggcgaggaggaggagagaaggacggttgccttgccattctctgtcctctgtcagtccccagggtctatcaggggaggccagggtcaccaagtaggaggcagggcaaccatccaaacagaacatctcagagatgcatcaaagtcctttaaccagagattctggcagggtggcacatggctctgggagtcagtttgggtatggacttagtgaggagggtgtctccctgattcagagagcaactggacagtcacagaactggacacaggcaaggctgattaactgcaaccctgctcaggtcaccccaggtaaaaagcgtcattacaatgattccatttctccttttctgtcatattcagctctttagttttttccttctaaaagcccagaactgtactgtccaattcaaatgtggctatttttaattaaaataaaagaaaatttaaaaattcagttccttggtcacactagccatttcacatactcagtagctacgtgtggctggtggattccatactggacagcaccaacacagaacatttacatcatcacagaaaatgcttctggatagcacaccaatctacatctagaaggcctagaattgagcaactctactctttgcagtgtagaa

SEQ ID NO: 62387 - DNA, 1209 bp, Homo sapiens
caggatgggaggtaggaagtcacttgaggctcccctgagaggactgaggtgacatccctcccttcccacatgggagcgtcactatgtagattcctgccatgaatcttctgtgtgtcctgaagcaggtcccttagcctctggaggtcagtccctgtaatcagaggagctgggtggcaggctctttccgtcaccggcagtctcttcctctaaggggtggcacattccctttcactctggtctctaagaacaggctctttcttagaaatcatcatcatgcacctctcatctgagaagctgtgtatatccaaagaggcttttttcaggtggggaaataagagtcctcaaggagaaatgctgccttgtaaacagtatgagggagacaccgtcatttgttctcagccacaaattcagtgcctagcatggcacttggcatgtggaggggctcagtaggtgctcagtgggtgcacaaatgagtaagtgaatgttggtggccattctggggcagaggtgacccttggtattcgatttgatctccaaacccgccttccatctagctccttcccagagctggcacaaggactatgtaaacctccaaaggtcccctgatcaagcagcgcttgaggactccaggcaaggcccactccatgagatggtggctggctctgagcctggagcaaggctgagtttctcttcctctttacctccctttgctgttttccctctccttcccgcccccttcccacctggctgctgcagggaagctcagtgcaggtttactttgcttgaagctgatagactgcatggaaatttggacttccactggagacaaactaggaagtgaatcacaaatatatatctgggaggatccttttaaatagtggggtccacgagtgcattttaaattatttagggaaaaaacttgacacgtaaactattaggcctggaaaagaactttggaggtcatccagtgccctaccccacccctggccccaggatgttcaaatcctctctgtgatactctcactcactcttcagaaacacggtctatccatcctgcacactgctgcctgaagtctaaaatgccctttcaaaaatgcaagtctgatcctgtctctgcccgacttcaaaacttccctcatggtgtgactccaggctccttaccgtggcatagcaggctctccaggccccagctgctgccccacataagac

SEQ ID NO: 62388 - DNA, 1035 bp, Homo sapiens
ttccctgcagcagccaggtgggaagggggcgggaaggagagggaaaacagcaaagggaggtaaagaggaagagaaactcagccttgctccaggctcagagccagccaccatctcatggagtgggccttgcctggagtcctcaagcgctgcttgatcaggggacctttggaggtttacatagtccttgtgccagctctgggaaggagctagatggaaggcgggtttggagatcaaatcgaataccaagggtcacctctgccccagaatggccaccaacattcacttactcatttgtgcacccactgagcacctactgagcccctccacatgccaagtgccatgctaggcactgaatttgtggctgagaacaaatgacggtgtctccctcatactgtttacaaggcagcatttctccttgaggactcttatttccccacctgaaaaaagcctctttggatatacacagcttctcagatgagaggtgcatgatgatgatttctaagaaagagcctgttcttagagaccagagtgaaagggaatgtgccaccccttagaggaagagactgccggtgacggaaagagcctgccacccagctcctctgattacagggactgacctccagaggctaagggacctgcttcaggacacacagaagattcatggcaggaatctacatagtgacgctcccatgtgggaagggagggatgtcacctcagtcctctcaggggagcctcaagtgacttcctacctcccatcctgagcacaaggaggacaagaccagggtcagacctcatgtgaaaaacaccaaccaaggctgttcccaccaatcctataagagcgcctctgcccttctgggaggggaacttccagctcccaggcctgttccccttcctaagagctgtgttaaaatttgcacaacatgatgcttcctttaagacaggtctacatcaatagagggctggaatgccaaagcaggaatctccaccgaggtggctgctctctaggtaggtgaaggctgatgtaaggaaagaaag

SEQ ID NO: 62389 - DNA, 1057 bp, Homo sapiens
cttggtgccgctgtgttctttgaactctttaagggttcatggagttccagaacattagagccagaagcaaggagccttggagagcatctcatccaaccccattccatcccaacactcacatgcacatttaatttacagatgagaaaactgaagctggataaagccaaggtcacatggctatttggtggaagacatggaactaggccctaggattcccactgctcgattcagagctgtttccactccagcggcctgcttcctcttcactataaagatggacatactttctctatacagtaggcactcatagttattgactgaccaggctttggtaaattaatacatcccatacagttggggagattctattttgaatctgtttttcagagtgaggaggtgaggagaaaatacagttcttgtcatggacatacacaggtcatagaaattcctaattattctttccctgcctctacaatctcgtctcattattccaagtggtgttttaagcaaaagccatgcaagtccaggtttcagtctgtgcatttaggagtcagaagtgccgagtccctcactgtggtcttggaacccaggtctggagcgccaaggaatgttggcgtggggtctctctgcttgcagtcacaccactgctggtgagacctcccagattcagattatagatggattggagagtttccaaagagtatttgcctatttcccccacccttgctgctcccagctcaaggtcagagtgctaggacattctatttttgccaaatccttatgtttggacttcttcggtgacctgcaagatactaccatttccattgccctttcttctgttccgagagcctggctgtcgacatctgagctgggctctgggaaacaggtttgctgagtggcctgtgggcggccccctttgttctcttttttttttttttgagacggagtctcgctctgtcgcccaggctggagtgcagtggcgcaatctcggctcactgcaagctccgcctcccgggttcacgccattctcctgcctcagcctcccgagtagctggga

SEQ ID NO: 62390 - DNA, 1115 bp, Homo sapiens
gccgctgctgctgctggtgggtgcacccagtgtggcttctgcacatcccaggagatgcttccgttctcctgacaggacacattcttgagttgcacttgaggtgtcttctgggatgggtgcaggactttccacgtgaagccaagtggaaaagaagggaagagggtcccaggacaggggacagttctatagtgttttcttgagtcaggggagaactcatgtgggaagagataagcgattgacggagatttggaacccagacgacttggggctggagatgtccaagactgaattagagctcattgagagtcacagagtacctcaccctcagccatgggggagaggtggaggctggaaaagtgggaacatggtggctgttccagcatggttcttgagaaaatgttctctctctctctctgacttggttaagaacatccttctggcagtaggtcctaaagtcaatttaagaggtaatgaagggagttgagggtcttgatgatggcacagaggaccacaattagaacatttccatttccggtgggtactaatggactctggaaaaggtcgaaacggtgtgtagggagtctggggaacctgctctgtggctgctcatttgagcctgaatcctccaccttatcccatccctgaatgtaggtggatgttcaaactcctagggtacctgcttcagcctggagatattttatgggtgctatcaatctatatcccaacccccagctccatcgttgtctgctgcagtcaacatttttctgctgcatttcccaagaccttctctccactggggatttgtgcagcgaaatacctgcttgttgctctttcttcccttctccatctgggctgcacctggtgttctgaaccctggtgtttattccttggtaccttgatgtttggttaagacgtcctatggctgcgcaggggtgcccctgtaaatctgtggaccaatggcctgtgtaattctagggagtgcaatagacttctatagaaagaataccaccaaccgggaaggcagtcctactaaacagcttgtgacagcctctcatgctcaagcgctcccttgcttccgtgctgaggcggtggaagcctaaaggtggagcagactc

SEQ ID NO: 62391 - DNA, 1555 bp, Homo sapiens
cctgtgctatgttttgccagcttctttcttacctttagttatgaatcagcaagataactattttttcacaccagacttgtatacaaagctatgacaatagaaagtcacttccattaaaatctactttgtatgctataatgtgttaatttttcctttatgttttaatcttaaacacttttggctgggcctggtagctcactcttgtactttcagcattttgagatcctctgaggtaggctcatttgaggccaagagttcaagaccagcctgggcaacaaagtgagacttcatctttattaaaaaaaaaaaatcaattaaacacttttgttccttgactgttttttacttaaaaggaatttttggaaggtatgctaattctcatctatagtgtgtgagtatgtatagtggatgctcagtaatgagtgtgctgaatagttctgaataggaacattttgttgattgtcctaggtcactgaggtgcactctggagaggccatgtagcattgtggcaataacctatgctttggagtcaagacagaccaaggtctgaatccaggctcactagatgtaactttggttcatatgatcattctgaattcagtttctcatcatctggaagacagattagactaaccctgcatggttgagaagattaaagattattcgaatgaggcacatattagccaggtttagtataatattaaagattggggtggtgttgttattactatttttaatttttattttttttctgaaaggtatggattttgttgatacatctatattcattcccctaatgcttcaatgatcagtgtgtttcttagccaaggttaaggttgttgactgtgaccatggaacctagaaacacacagcaaagctaattggccagcatggagtttgagtctgtgaccttgtcctcattagctccataagctaactattcacaaatatctcaccagaatgaatgaaaagactggtatattttttatttggccctaatgcaactcattagacataagtaaatgaactagtgccagaagcaaaagtatagatttttcattagcttatataaatatatgattagccgtcacactatgtataaaactcgtgacctgtaggatgatctttgacaaccccagtaacctaagcttataatttagacatttcttttagttgttgaattatatttgttgtagacttctcacctataggagaagtgagaagaaatggagctaggctattcatgccttgaaagagtaccctccttctgttgtgctacccacgaggaaatgtgctcttcgctagtgcagaaaacatttagaattatccagtaatgagcccagcaggatggatgaagcttggggaactcctaagagcttattgaattacagagaaattccagttgtcaaagcattagatagaggaaaagttatagggtgttacttagcagcagtaagcctgcatttggagagaattttcttttctcttaataaaacatggaccaattgcttcgagtctgtggtgtccatttttcactgtctcatgctagccttct

SEQ ID NO: 62392 - DNA, 1076 bp, Homo sapiens
tatatacaatgtttaccacagtccctgtcatgtagtaagcactctgtaaatggtagctgattattcttctttctcttcctctactactactaaatcactgctctaccactacttcacttttgcttgtagggcctaaactgtaatgaaacagaaaacacaattagacatggttcatcgcggcagattttgaaaaatatgtcattgttctcttgggcatggcttaatagttctttcttaactaagtagaaactataaaaagactttttaaaatgaaagataagaatctttgtcttggtttaagatagctttgcaaatgagtgtacaaaactagttattctaaaatgtatttgcttaatgcaaataaatcagcctttatatgagcttagggaatatgtaaaactaacagctcgaagaattgtcattccttattactcacctaacacaacctttttttttttttttttttggagtgagtgcttttttttgggaattgtttgaagtttttttcttgtgccaagaatagtcacagtagaagtcttgtccagtgtatgaggcacatttttgggggaatgggatggaaaaatcaccctgatcatttatccttaatggtaatgagtattagtgtggataatatatttggatttgatgtgcattatgtgattatttcttcagcacaattaacttcctgattaaactttgctcagcatatattgtgagcatatactcggtggaaaactgataatactgctataatggtggtaaaactgctagtttagttgatagacaatctgggttctggtcttagttactaccactctaatagtcttagataaatccctcaaccagatgattttcaaaggctcttttcagctataagctttttgttggtttgttttgagactgggtcttgctctgtcacccaggctggagtacagtgtcacaatcatagttcactgcaccctcaaattcatgggctcaagcagtctccctccctctcagccttccaagtagtgagggttacaggtatgtgctaccgttcccagctaattttttatcttgttttaattttttagaga

SEQ ID NO: 62393 - DNA, 1043 bp, Homo sapiens
attggttccaagactttccttggataccacaatttgaggatgttcaagtctctgatataaaacggcagtatttgtatataacctatgtacatcctcctttttactttatatcatctctagattacttatacctaatacaatataaatgctaggtaaatatttgttagacttcattgttagggaataataacgaggaaaatctgtgcatgttcagtacagacacaatttttttaactgaatatttccatctctgggttggttgaatccatagacccatggatatggagggccagttgtactgtacttgtgattgacattgaaagtgggaagaccttgaaagtgtggaaaggattgggtatattttttattttattattttattattctaattttattctgtcaaagaatcttccaattttttactcatgttttctcttttaccttgctctacaaccagaattacaaattatttgaaacagaaaatattttctatgcctgttgtatacttttctgacattgaatatgctgtttagaatagtatttcaaaacttttattcaagtgaaatcaacttagtgaataaatagatcttaaattgtaagaattttaaaagccttaaattgtaaaaagtgaagaagaattctagattaaaagtaatagtagtgcatatattaagggtaagtattttatggacttttttattattatactttaagttctacagtacatgtgcacaacctgcacgtttgatacataggtatgcatgtgccatgttggtttgcttcacccatcaaattatcatttacattaggtatttcacctaatgctatccctcccccagtcccccaccccccgacaggccccagtgtgtgatgttcactgccatgtgtccaagtgatctcattgttcagttcctacctatgagtgagaacatgtggtgtttggttttctgtccttgtgatagtttgctgagaatgatggtttccaccttcatccatgtccctgcaaaggacatgaactcatcctttttttcggctgcatagta

SEQ ID NO: 62394 - DNA, 1021 bp, Homo sapiens
aacaatagcgtatctttaaattttagtgattttttttttaattacaagaatactgcctgttctttttgtaacaaatttaaacaatactgtggcatatgttgtataaaaagatgataattctttataattctttttcctgtttcagttcctgctctcccagttgtaatcagtgttagcagtttagataatagctttttttttcctcattaggaatatacacttaagagaaattcttgctaattgagaaaattagtatttggaaaatacctcttaaaagtaaacctattaaaaatggagacaagatttattagttattaatgaaaacgacttgttagggacagtattcagaaatgaaaacattttactatatgtatatcatttttctatatgtttaacaaaatttaaattgtaactgcagctgtgctaattctcagaatcaacaaagaatgatgtgatatcttcctggcataatttttccagtagaattgtataatagtctgatagcatccttcattttgtgtttcatttatctagcatttgttatataaaatagacttgtgtatcagtcttatcaaaactcttgagggtttcaccagtttctcaagatattttcttaaccctttctcaattcttattctatcatcgtccttctttagttgttgagtgaattgttctatctttagttgttgagtggtttgattctgccagaatcaaaggatgttgctgtgagatgagcattttctttaatattattttcatagacttcatgaaatcctgcattcttttgagggtttgtattttcacattactactgagttgcattgtatttacttcgtgtgattgagtatttacagcaataggctattagtgagaaattgataaacaaaaccaggatacatggttgcaataggtgttagtgtctagtagaaacagatatcaggggacattatgaatactagtgtatcataagggccttgactccgtctgcaaacttgtaacttaagggattcaatgtccattt

SEQ ID NO: 62395 - DNA, 1050 bp, Homo sapiens
actttgagagaccacattcacgtaacttttatatattatatataacaatattacgtatcgttatacttgttctgttttattagttattaatcttttcctgtgcctaatttataaattaaaatttatcataggtatgtatgtgtagtaaaagacaatatatttggggtttggtactatccatggtccaggcatccattggggatcttggtacatatctgccgcagataagagtggggactactgtatcctgacagtccacaagaatggggatgcttctccttttttgtgtctgtgagttatgaaaaaatgggcatactggtggattggagtgtctcctactggcctgagacctgattgttaaaattttaggaattctgcaaactgattgttaaacacagctattattaaaaactaaagaacataggcttactattaaaattacattttaaaagctaataaatacttcaaactcatcacttcctaattattttactacattttattataatctatgcttttcaagctatttatgtaagtatatcatacctctggttgaaataatagaatggtgtgcttttgtacatttttttccccaactctatatttggtgatctcacaatgataactagaaattagctatgggaagaatgtttacgctacagagattgtcaaatgccataaatagggcttgatttcttatttcttgattgtctagacttaaagtgatggagaaaatgctgctaataaaaatgtgtcatgcctttagttattatattgtaactaaaaaaaagtatatattcttccattcttaaaaaatgattacttcagctaagaagtcgctcacatcattgacatcagtgacataaagaaaaacatcaagtaatactacaaaggacacttggaaagctgattgctgaatatttgccagcacactgctggtcatggcacagtcgaaatcattgctttggtaggaaatagataataatataaatttattatactgattttcagctataggaaatagtattacatgtgagcattatttaagaa

SEQ ID NO: 62396 - DNA, 1032 bp, Homo sapiens
gttcctggaagtccagatggtgtctttgatcaaacttgcgtagattttgaagttgagagtgtaggtggtatagccaatagtacaggtttcatcttagatcaaaaagatacagattccattcctgcaactatgggtcacatctctctgtcagagagcacaaatgacactgttagtccagtaatgattagagaatgtgagaagaatgacagcactgctgatgagttacatgtaaagcacgaacctcctgatacagctgtccttgctcatgaaacacatagagatagtggatttaagaatgtaggtgacattaccaataaagcatgtatgatggacactacaggtatgtcctgtagtgatcatgtaactgttgatagcccttatgtagttgcagttagaatagctgatgagacctctattaatacacgaagtttctcaaagtttgtaggaatgagtgcagatgcaacccctcttcatgtagctagaagtgggaatgacactgaagatttcagcaacccttctgcttgctcagatatttatggtgagagtatttcatctcattttacagagtcaacaggaaagttgatagagagcttgtcagattgtgcttcctccttacctataaaaaagattgctggtagtaattataacacttttttggactctgaactcagtatgttaaatgggacaaaagttctttcagacagtgccgtgggcattgacctgggtagtactggtgatacaacagaagcattgcacgaactaagaactgccgaagagttcaaaacagaagagcaagatgactcagggagtatagaatttggtgtatcttttcctgatagggaatcatcatctatggaaacatccatcgaaccaaaagcaactgaaacttctcacacagagggaattactgccattgaggagagctgggagtctatgtttaacgatgatggtgactgcctggatccacgtcttctacaagaggtatgtttaattgaaattgcttgatgcttagttagtttataaattaggatt

SEQ ID NO: 62397 - DNA, 1495 bp, Homo sapiens
ggtgaatatagagatgttattaagaactaaagcattgagagaaggctttagtctgagaaaagaaacagtgttcgcaagagttggtgaaaggactgcatgaggaatagagagagcacatgaacatggaggagagatgaacagcttcctccaaaagaagagcgtggctctcatggccttttacacatggtgtagtactcagtaaatatttatccaatggatggcgttgatagggcagagttgggggctctgtctttttagggtggcttccaggggctttcaaaacatcaggggctggaacttggattcagtggggtagcttatggatatggcttgtgtattggaagagggggagttcaggtgtacaactcagtttttcaggtctttccagtgtttaggtgtaagataatttaggcaacaactcagtatttcgaggagcatagtaacataaagaggacattgggatgacctaaagctgggattgggaggaaaacagagaatatagtattttaagctgaagatggacagtgtctgggtgttgtgtttggcttatgtttggaggtacttggaaaagagtagggtctgtgttgaggaatgagcataactgagagcaggaaggagggaaatggattgagaatgcaagtagcagatccaactcctctgctttgggttttagaaaatgtaataatgatactgttattaaaagatgtcacaaatccagcaacattaatagccctttgatgacttctggtttattatttttattgctccaaacatactttattaagtgctaaagcagagtgagtgcctgcctcccttgaaaactttccaactaaaggtttttggctatcatcccagctggcctgtttcttgattgatagcagctagacatatggaggtatgtctaatacttctaatagtcaggtatgctgtagagcaaggtgtgacagccattggcttgtgaagcaatttcctgtgacatttgaacctccaaaactgccttagggggttagagtataagtaggtcattattgagctcccagaactgcaactcttgatgagtctccaagaatcacacttagtctcctaaagccacggtatggaatgcccagaaacttaaggtggtaattgatgaaggagatgatattggcatgactttttttagccctctgaattcttggtagaagaacacaggagttatttttcattagaaaatactttcatagccctactgccatctgtactgatcatcagatctgttggtaggaggattaatgggataccaagaacataacattgatgttgatagataccagcatttgttaccttcattgtcatttctggcactgatttgaatttttagataggggtaaatatttaagtagtatctcctaaactttttaagaatttgaggccttcccttggttacagaaggccactaatattataccaccatattctataatagtatgtagaccataatgggtaagagaagagt

SEQ ID NO: 62398 - DNA, 1089 bp, Homo sapiens
aactataaaacattgttggaggaaattaaggacttagagaaatggaaagacatcccatgtttatctactggagaacttaatattgttcagatatttcctaagttgatttacatattcagtgcaatcccagctgcctggttggcagaaaattttttgcagaaattgacaagcagatcctcaaattctctggaaatgcaaagtgccctaaataatcaaaagtgattttgaaaagaacaaagttggaggactcaggctttctagtaagcttcttgatttcaaagagtactataaagctacagtaaccaaaacagtgtggcactggcataaggattgacttgcaagttattgcagactccttttgtccctggcctctgagttattccaaactgttaacactaatctactctagacgtttaagaatttattaaagtttaactgatatcttcttgcccacttatgtggtgatcacttcttccagtggtctgccaaaggcaaaacagtttatgtattctgtttctctttgggagagacttgtcattgtatggattttaagataagcagtttcccttgttatcttacaaactcagctctctggtaaactcaagaaaagttatgattttatagatcagctggtcttttctcttgttacagtgggaagaacattctcttctgctttctacatcctaagcagagtggaactaatatggtgtttggcatgtaacagacttagcacttggttaaaattcttttaaagtgggtttactttactgaatacttatgtgccaagcagtatgctaagcacttaccatatcatctcctttagtccatgcacttatctatgaagtataggtactgttattattcccatgttttacatgtaaaactgaggcttagtagagaaaaggaactggaggcacaggaataaataataatttttattgatattatccaaatcaccttcctccttctcccaataaaactcttgaatccatttttcaacttttccaaggaaaggagatatatattcctggcattgcaagttcttattttcctcatttgatgggaaaagagacacagtattaaaaccag

SEQ ID NO: 62399 - DNA, 1048 bp, Homo sapiens
tcttaaaactaaggatcattttgttgatgtctagaatttcttgaagatcaattaactcttacaaactatttacttccctttgctttgtttcttgataatctcacctgcaggaccatgtttctatcaaattcaaaaacattccccaaagagaaaaattttaaaggattatgaaattttgaagtataaaaggccctctagaacccatctgtgatttataaaaatgaaaatattaatattgatgaacattgctattaataataaaagtaatgaacaccattaatttattagatgcccatgaagtgctcaacaccatcttctttgccttgtcatggatgatctcatttccattttcacaacaactctgtggggaacatactttcttcatttttacagaggagccgacctagcttcaagagaggttaaacttgcccagggtctcaaggtggcagaaccctgagtccatgagcatttttaagctcttagctgaaaaatataactgttatgtcatcatcctgacattccttgtgctcactaggtagttgttctccaaaataaaagtgtttttctagtacttaaatgttcattcttttgatgctttctaatctggtctgatatttctcttatcatgattcctttcatccttaatttttctgactttgccacataattctttctaattttttcttatttttttaacctcccttctgcaacaagtgaagaatagatcagcctctctgattatagttgcccccttttttccccgttacttgacttttttaaaaaaattgaataacatcttcagtataatctcccctaccccattctcttctctttctgtctctgtcctcaaggacagagtttacatttgcattaaatccaggtgaccttccctgcctacctactcctcttatattctacccctcctctgcttcctctttccatttcttctcattccctgcccataagaacatctcttgtaaatagtgcattaaatactttacatccccaagggacttgtgaggattaattagttgatgtctataaaatg

SEQ ID NO: 62400 - DNA, 1627 bp, Homo sapiens
taaatacaatattttaggctttgtggagcatcaggtctctgtcactacttaactctgctgttggagcaagaaagcagccatagacaatatacaaaccaaatgggcatggctctgcttcagtaaaataataaaattactttgtaaataaatataaaaacaggtggttggctggatttggtcatggagccatagtttgctgatacctgatctaaaataattactgccacgttgatctttagatctgtctcttttgcttgctttgaaaaaaaagcataacatctaggaaatactaagagctatccctagtttttcctttgcatcactctacttcatgtcttctgcttccttttattcctctttgcagctcgtgatgcgttgggtattaaacacaccatggtgaagattcgtcccttgtcacaggccacaagagcagccaaggccaaagctagagcttatgctggtgagtctataatctctgggtttttttcttgctgatggtggtattattgttctttccagaagttttatagcatccagacatctaaagacatatcacttttatttttagtgttaaaagaaatatgtttttaagaaaaaataaataaaagggaaatgaccatgttggaaatatggcatctgagcagccacttggagtgtgtgagaactaactgcaggcaatgcagcaatcagtttctgatgacatccctacctagtttacctctgtgtttagctgcctgatagagtcactgtaagatactttgttaatgcagataatgaagccagggttgtttgtgctttgccatgttaatttcctctgatcatcatctatcagacttgtattaattactgctgatgcagcccttgttagtctattttgtatgttaattactgagttaaatcacttgaagctagagtgctctctcttcttgactccttcctactcccttcctttcttcgattcagagttcctccagccagcaaaggagcgtcctgagacttcagcagccctagccagaaggttagtcatcagtgcccttggggttcgaagtaagcagagcaaaaccgaacgagaagcagagctcaagaaactgcaagaagccagaggtgagctgaaagggtggtgttcttctctaggcccttcagaactcactgtaaggcatgtgtttaaaaaaaaatgaatgaagcccattccatttttgtcgtttctgtttcctagaagcctcctaagtgtatagaaattttcatgccttacgtccaggagaagatgtttcaggattgtctgcctgtttcacgcaccaagacattctaatccacgctcctactgttgttttccaagagataggtttggtcttctcagctcatccatggcttttcctacagtttttctatgagaaaaattttcctgtgaaaacagatagtgtcctagggagaaaacatttgctatggttttactgggccacgattgccatgatattgccctaatgttatcaaatggtttagatctgaggtagaagacaaatttaggaaaagccagcaactgacgttgatgataacaactgtaggaggtatttttgtctttttaagacagtcctgagtggctccattagagtacatctagatttacctg

SEQ ID NO: 62401 - DNA, 1055 bp, Homo sapiens
gcagattgtttagaaatgaggaaatctgggctctaatagagcttttgccattaactagctgcgtggccatgggcaagtcagttatacttctctgtgccccctggtttccagcaaagcgaaagtactcctcagcctacctaatcatggagaattttttgagcacagaataagttaacatatgtaaaaatgtttggaaaagtgctttacaaattcaggatatgattattgatatgactgttaagaatttaatgttcattataatatgagcttgtaatgacaaatacgtattatatactgctactctccatccattacaagtggcagatattgttaaatcagtcatgacattctttcttggtgagttttgacatgaccattgccaatttatcagaattagcatgggaattgaaatctatatatcatcctgttataatatggtataataatctcccagcctttctttctcccgcttgaagacttctgctgtctagcaacagtgcctggtacataaaaagatactcagtacatgttcattgaccaaatacatggatgacattggttactctaatttttctttgtaaatcttgactctactctgaatgctaagtcctccatgtttttctttataaaacccagaatgtgaaaccttcctaattaagaattttgaatttgtgattttgagttttaagtacttttctgctatatttttcactctactttgattatttatttatttattgagacagggtctcactttgtcacccaggctggagtgcagtggcacgatcacagctctctgcagcctcaacgtcccaggcataaggaatccttccacctcagcctcctgagtagctgggactacaggcatgtgccaccatgctggctaattttttccttttagtagtgatggggtctctctgtgttgcctaggctagtctcaaactcttggactcaagtgatctcctgccttggcctcctaaagtgctggagttacagacctgagccactgtgcccagcctaaaaccacattttaaagaccaaactcagggccaggc

SEQ ID NO: 62402 - DNA, 1050 bp, Homo sapiens
gtttgaacatcactcaatgaaagggataattccatgaatcagaaaatgtttccatagccttcagataagatgatccttccagagctctatgtacatgcagatgtgcatgttaaagagataaagtgatcgagacaaggactgactgggtatagaaggaagacagactcctgtcttcactcctaaatgcagttctttggaatcaccctactgtggtgggcgtagtagggagccatcagctaggaagaaacgtgggagatgtgaattccaagagttgcctggacagggcaagtcatgttagcgtgggtcacacttccaagatatttaaagcaaatacaaaacagaacagaggattcaaaccgcaagtatgggagatttaggccctgcagaggcagaccattccttagtatctcacaaagcagagtaatactggaggcagagtagggggtggttggagagcagttagtacaaagaggcagaacagtgtctggtttacttggcatacacagaatctgcactgccggttccagaactgcaaagttggtgaactacaggagatgtgggtatttagactccaaagtttatactgagctcagtgcctgggaccgctccagctgcactgcagccaggggggataccagcttcattcctcagagtaaaccaaccttgggagctgtgtgccagttccagtgtaagcagtaataccatgttgtaagagggaacattaaagcccattttatgacatatatcactgtggtgtttgttggtttttgtcattccaacaaagaaataggagagcagctttcttcttatcctcatgcctataaggctgtgcataagttaaatggatctgttgtttttattgaatcccagtgagtagagaattgatcatatctctgcctcagtatactacaaaagtgattatcctgggactgctatgtggtagctcctctccccttcatatcttccttgtacaccctcattccaacctttttcttgctttctgctatctctgcaaatctgataccctgaagaagacatgtggcacaccag

SEQ ID NO: 62403 - DNA, 1045 bp, Homo sapiens
cctctcccctggccagcccccaataggagaatacttcttctccagcaaagattacagaactgaggtctggggctctgcaaagaaacagacctgggaggaaatccagttccatcacatgtaaccttaggcaagttactcgacctctctgaggctcagttttctcgtctgtcagatggggagaatcatagtatccgacctcatagggttgttatgagtcttccatgagataatgcgtgtaactcattgagaacagactccagcgaaaagagagtactcagtaaagtttagctgcaatcttctccatttgtacagagctttacagtttataaagcattttcacattgacttgacaatctaatcctaaaggtagaccccagggggcctctaaattcatcaagaactggacattcgaaggtaggaattatccttgttttacagaaaagcccaaggctcagaaagattacacaacaggcccaaggcagggccaagcctgtgtgacactggagaacgtgccctagtcatggtgccaggctatttctcaaccaaggaaaaatgtcaccacacccatgaaggcatttaattttgccacagccttggggatctaagttacttccttgcactggctgtgctgggtaaacagctttatcaatgtgtcacctccaagaagaggccacagatacacgaggccaaggcttggatgttgtgatactgtcaacagctgcccacccattttcatcctgcaaataagtgcctggagtctggccagtggggcaaggtgacctcagtagagatgaaagtggagccctgttgaccaaagcccccaagctagaggccaaatggcccctccccgtgttgttttccagtgtgttttctctgttaaaatttaggctgcatcagtcccctgttggaaattgtgctattgcatatgttatgaaagctgtggccatgtttgtgtgccccaaacactcgtatgctgacccaagggatctctttagcgaaaaggctgaaagccctgagtaatccccaattttgaaagacgcccttt

SEQ ID NO: 62404 - DNA, 1044 bp, Homo sapiens
gctgctgggagagggctggatggtggcagggaagggctgaagatcaagatggaaaggaatagttgcacctggaactctggggagatgagatcccacctccaggatctgagtcggatggtctgtccacaggtatgtgctgctgcaccatgtgatggggggcctggagggaatgcagggggcctggggctacgtccaggggggcatgggtgccctctctgatgcgatcgcaagctcagccaccacacatggagcaagcatcttcactgaaaaggtgaacggcccctctaccccaccccaattattagtaaggatcccaggacagaacaaagtctcagatttggaaggtcccttgttttaccaatgaacagaggggccatgaggggatgggttgcagaatcaagagattaaggtcatgcagtctgttagtggctaaccacccccttggaattccctggtcactgaactgagactgagtgtttcatggagaagctgaggcttcatggagaagctgcagaacttggtgggatgggtttgggatgaagaagttgtgaatgcctaggagcagcacagaccatggaaatcccggaagatctaacatggatttcccttcctgcggtttctggggccttgttctggtgggctctagacagtggcgaaggtgcaggtgaacagtgaaggctgtgttcaaggagttgtgctggaagatggcacagaggtgagaagcaaaatggtgctgtccaacacatcaccgcagatcaccttcctgaagctgacgccacaggtgaggctgtgggcaggagggtggagcttagatgtctgccaaaacaggggttagaaatcgtggggattgagggagccaggattgcatcagggtgtgagatgcaaaagccaagtctctgcatttgggaaacaggggggtaagggcaggtagcaaacggggaagaagcctcacaggtggggagaaggggccagagaggtgaagtgaccaagattccggccattggcagagccagagctagaacccaggtctgactttcaatctag

SEQ ID NO: 62405 - DNA, 1012 bp, Homo sapiens
tcttgatctcaggcactgcgaagagaagcgggtggaggatgctgattaagaccagtggactgggaggcctgctcacctgcgtgtgttcagtatggggccactgtcagaggggctgtgcctgctgagttcaagaggaaatgcactggcacgttcttacactggcgtgtgcttcatgcccctccagctttcaggcagagttccaggtgtttgtccacattaaagcacatgaaagccaaaaaggaggatgagggaagatcagagaaaattaaggataaataaactgaatcaggaacttaggacaggagagttctaaatatttattcagtgtggcatcccaaggctccctcctggctgcccaaggcaacaaagtgtccatgatggtgtgcaggtctggtgacaggatgaacacatgtcggatggagaatgcacttttttcccttggaactgcattctaggaacctgctgggtggccttgtctagatgagccactgagttccgtaagggccctgccacagttggttctgtggatatagaaagattatttgaatggccattttgtaccaagcctggatattagctgagatgtagcattaaatcatatctcagtggagacatttttataagaagaacctaggttaatagaacccatgtacattgcttttgttgtgttaatctattgctgggtaaaacttagagaaccacagacacacagcctacatgtctcttccaccagcagttttcaaacctggctgatgatcagaatcacctgaggagcttagccttttattttgttattttattttatttgtttttgagacagggtctcactctgttgcccaggctagagtgcagtggtgcgatcttggctcactgtaacctctgcctcccgggttcaagcaatcctcctgcctcagccacctgagtagctgggattacaggcattcaccaccatgcccggctatgttatttttaatttttttgtagagacaaaagtctcactatgttgcccagg

SEQ ID NO: 62406 - DNA, 1012 bp, Homo sapiens
ccatgtgctgacaagtgctttggagaaaaatattgcagggtgagggggcagggagtgcgggggaggcctggctgataaggtggcattccagccaagacctcgagtcgtgaggttgcaggccacggatctggagaaggaagcctctcgacagcagaaactggaggcggcacaggccccttttgttttatctgtgcctgctttgaagaagtggatgtgctcttggaaaattctgtgtgctaatcaaatatttgtaaatcaaatcatattttaaatgcatcaaagaaacttccatttaaagtgaccctggagtaaatgagtctgcaaagtaaataaaatgttctgatgtgaataatttatctaccttgtaagtatagattttcacataaccattgcttgattgtgtctttctaaatttaattatttatttctgaagtggggcagttacagaccggtgctgagagctggggctttgcagttacagagctgtggttttgaaacccagacctacctcctaaagtgacctgggacaaattatttaactcctatgagcctctcgtgttgcttttgtacaatgaggataataagacagccatgtgccaccatgttggtcaacgatagactatatacagtggtggtcccataagcttacaatggagctgaaaaaattcccgtcccctagcgatgccatagttgcactgcaacatattattcatgtgtttgtggtgataagcctactgtgtggccagttgtcaaaaagtctagtacatataattatatacagtacataatacttgatagtaaatgactttgtcactggctaatgtatttattatactatacttttattattattttagagagtattccttttccttatttaaaaaattcactgtcaaacagcctcaggcaggtctgtcaggaggtatccagcaaaaggcattgctctctaggagatgacagtgccacgtgttactgtccctgaagaccctgcagtggggcaggatgtagaggt

SEQ ID NO: 62407 - DNA, 1043 bp, Homo sapiens
caaccaagttttattttgaaatttgacgagttaattaattgtatttgtgccttgcccatctccagaagtacattgctccttgagggcaggggccaggctccacactcctttaacctgcctgccccgtctcctgctgggcatgtgctgatgggtggccatgctcctgtgtctgcagccacagtgccagctccctgcgcccggccgacctgcttgccctcatcctcctggttcaggacctctaccccagcgagagcacagcagaggacgacattcaggtctcagggcagctttctgggcagagggaggccattagggaggtagttcagaaaacctgcctgaagatggtgggcaggctccccctggggactccatgttttctaagtcacaattctgggtgtgtggttgggcgtgacttctttcccactgctttcagatgtaaggggaattctggagtgcacatggtccagtgggttaaaagtgcagatttttcaagtcagccatggttcgaaacccagcttcaacacctggctgtgtgagctgagcccgtacttgcacccccagagcctcagtgcccttatctgtgcaatgggaataacaaagcatctacttctcaggggtatttggagggacaaaaggggtggttcccacagaacctggcactgcctggggcatagtgaatgcttagtgagtgtcagccaccaccatcgctgttgacctcatcaccaggggtagtggtgggttggataccattgtgttggaatttctcgaatttccacagaacagaccgcctagaatcgaatccctgggaagtctgaggaccacacacccaggactgcacccggaacgggtggaggggtggaggggtggaggcttctctgtgaagcgctgggaggcagaaggggtggagggagccaggtcagataggagctaaccagcctctcccctgccctgcacagccttccccgcggagggcccggagcagccagaacatccccgtgcagcaggcctggagccctcactccacgggcccaactggggggagc

SEQ ID NO: 62408 - DNA, 1066 bp, Homo sapiens
aggcagcgtgtgcccagcccctgtgaagctgccatttttcacatactgcccccagctgggtccctaggtcagagaaacagctcaagtgaaccttggagaccatctggtctgaccctctgactttatatctggtgaaacagagcagagaatggaactcacttgcctggggtcatctagctggttggtggccacatccaaactggatatttgagctcaggactctcagtccagtgctctttccatcctcccaacatcatcacccgtcattacaaatctggtctgagctagtcctctctggcttctcaagcttcagactctctctccagaaaaacacaaacccatgcacattcatacagtctcgtgaaggttttctcaggagacagaccttaaaacctgtctctgggcccacagtaaagaacttggggaaagagaatcatggttcagagtatacactgaggtgggagggaccccagaaaaggcttgtagttgaaatgtagacctagaaaagagaagttcgtagtatcaccaccccctgattctctaagatggattgggaagctgcggagtgtgaagctctgggactttagttttgtggcgatatgagcaactacccatattgaggcatttctcaaatgcacaaacattgtttcatgagtcattttagcccagataggtcatggtgtcagtggcaaatgctgcaggtggcagatgcctgttacatgaatcacagtggccagtgcagacgttgccagcatccgagatggctgcgaccctgagtagggccctgatgatggaccagatctttctgtgttcagtggcctctgtgtgagaagcttaagcatcaccctggctctctctagctggctttgtatgacatgtgtttgtgtgacagaggctgaggagtgaggtgatttgctcagctgcctgccttccggctccgtgcctatcccaccccactccacagttagagctcggccggaaacctggccccctttcccagctgtgtgggcaggtcatatgggctcaccaagctctgatgctgagctgagactgtggtcctttggtt

SEQ ID NO: 62409 - DNA, 1042 bp, Homo sapiens
tccttgcatatctgatgcggtcaacactgaccttcagatctcaattctcccaccccatgccttccagaggcaggcctcgctctccatatagaagcctcctactcacttattcactcagtcattctagcaaagggagggggcctgctccctctggcctatcagatctggacctagcccaaacttacccatgtggggccaggcctggatctcttctctgcctagctctccattgggagcaatttacaacacacttatctctgggaattcactgctctattgggcatgggtctgattatctctctctaaagcagtctatcattcatagcacagaaggaacactaaacaaagacctctatatcaatttataacattctattctctttacagctcagatgatgtcacggcaatgttatcacactggaggttgggcaaggcccagaaacagtcatcactatgcaatgttgattttctgagggtgactcacaaccttatttccagctggtggcctgtttctggccttttctgctgacccataaaactaagcttccacctgggtgcatggctgtcaggaacagctggaacattatctggattctggtaccataggtcaaggataggtggcatttccctctatccagcataagatgagctgtttctcttttctaagtttgctatgtatgtagtcccccttctcagggtgaaagtggctggctatacagaaaggataaaagcaagatagatgaattgtgatcacaaatgcctactttatcacttactttgctgttttgctaaatggaaacatctgttaatattaaatatgaaaactcattttttgttttttttagggacagagtttctctgtcacccaggatggagtatagtggtgtaatcttggctcactgcagcctcaacctcccaggctcaagtgatcttcccacttcaaactcctgagtagccaccatgccaggctaattttgcttttatattgtttgtagaaatggggtctcgctatgttgctcaggctagtctcaaactcctggac

SEQ ID NO: 62410 - DNA, 1006 bp, Homo sapiens
gttatagaatatgcacaaaaggtaatgagaaaggaatttaaacatttcactaaaaaatatcaactaaacacaaaagaagatagtgatataggaaaggaggtacaaaaaagctgtaacatagaaaacagcaaaatgacagatgtccctccttatcagtagttactttaaatgtaaattgattaaactctccagtcaaaagacagaggttggcagaaaagattttaaaagaaaaacaggatccaactctatgctgtctgcacagagattcactttagacccaaaaacacaaacagattgaaaggatggaaaaatatattccataaaaatagtaaccaaaagagagtaggggcagctttattaatatcagacaaaatagattttaaattttaaaagattataagagacaaagaaggaaattatatattaataaaagtttcagtgcagcaataatatataacattatgtttacacacctgattacagatcacaaaaaaatatgaagtgaaagttgccagaattgaaagagaaacagacacttctgcaataacagttgaagacttcaatatcccattctcaataatgataagaaaacaatacagaaataaagaagtagaggagttaaacaacataataaaccaactagatctaacagacacaccaaacactttacccagcaacaatagcatatacattttttctcattgcatatgggacattttgcaggataagccatgtgttaggctgcaaattaagttcaaatgtggtatacaaatgcaatggaatattattcagccttacaaaagaagaaaattctgacatatgctacaacatggatgaaccttgaggacactatgctaagtgaaataagccagtcacaaaaagacaaatactatgagttcatttatatgagatacttagaatagtcacagaggcagaaagtggaacgatggttgccagagattgggggagggggaatgaagagttaatgtttaatgggtacagagtt

SEQ ID NO: 62411 - DNA, 1036 bp, Homo sapiens
cataggagcatctaatatacaggatcggtgctgttactggagtgttacatcaaaaaattgaagttcaaatattattcatggttggtgttaaaagctgccaaataatactttactttgctgccaaatttctgagttcttttatggaggtaaaatattgaagagtctttctgccagtctcagccctctgagttacatgccccccaacccatcccactcccatatttcacttcctgcacttgcgagatccaaaggccacccaggtaaatagcggtcaccacaacagcccagaggcctgctttgctttctctagaatttgtgggtctcacccatcaaactcaattttcaccaaaggaagatcctcccatttcccttaaccagcagctgccatggttttctcttctgtagcttttcctttcattgtcaaaaagccactgtggggctcccttaggcccgtcttcccagcaggtagtccgtaagtgtctcttctgtttttcagactcctattccattttatggcatatgcctatgaattgtatgacaagacgaaggagatgttgtgatggcgaagagttgtttgggtggggactaaatgggccatgaaatgcgggacctctacattttaaaagtgccgttaggcccagcgcagtggctcatgcctgtaatcccagcactttgggaggccaaggcgggcagatttcctgaggtcaggagttccagaccagactgggcaacatagtgaaaccccgtctctactaaaaatacaaaaattagctggggatggtggtgggcacctgtaatcccagctacacaggaggctgaggcaggagaatcacttgaactcaggaggtggaggttgcagtgagccaagatcgtgccattgcactccagcctgggcgacaagagtgaaattctatctgtaaataaataaatgtgccattaaaggtcccaaaatgtaaagctttgtcttttcttccagtctctctcctgatctgtcatggtatttttaatgtgctatttaacattgttctacgtaaag

SEQ ID NO: 62412 - DNA, 1051 bp, Homo sapiens
catatgccatggggtcatggctttatgagtgtttccatgacatggtattattacaccccaaatctctcacctcatatgtcactcaagcattctctgtcaggaaaccaaggaataaacatccaaaaagaagattaatattagagagactaaaagagtaaagttcacccaaccatctggttcagctcagaagggatgtatgtgagcccttctctctcttccttcatccctgccttacacctcatcctgtctcacactacagtaggaatccctttaccactgtgttgcttgggctacctgtgtcagagtcggtggggaagcttataaaaaatgcagcttcctgggaatcataatttctgggatatgacttaggaatctgcatttcacaagctccccaagagatatctgtgcactgcagactaccttatccccttcctgagaagcaagtcatctacgagtgtatgagtacagttagccatgtagaactcactacttccttgggcagctaagtctagtaaaagattatggtaatgaggggaaaaatatcttttattgagaagaatttgaccttctataattctcacccatttttcttttcattattactcttccatctggagtgacaggaactaagtcacctccccttccataggagagcctctaactcaaacccttctgtgtcccaccttaggaagtggagaaatgaacccagttctcaaacataagcacattgtgttcaggggcaagttttccccagctctccagctcatgctgtctcacaccttccctgggcacatgggcaggttactgatggcctgatgttgtgctgccttcgcacaaagtcttggagaaaatgggcagaaaatctacgtgctatgaaaataaatttgacttttaaaaagccatggttgcttctgtgtccctaggtctttagcgtggccttctagagaacaggtaaggaacttacataaaaggtgtagcttgaaggccactagaaaggttctccatccccaaatgcctcccgtgcatgtgcaatggtggccaaaatccccct

SEQ ID NO: 62413 - DNA, 1041 bp, Homo sapiens
actatgagataggtatcatctccttttacaattgaggaaaataaagttaagtaactggcccaagatcactcagatctgttgccccaaatctagtgccctttctgctacaccatgctgtaatctgtgtattttagtcttgaatattgtgccaaggaccttagagctctttgaggtcaggaaccatagtcgattaatccctgtctcatccaccactcctagcagggtgctgggcacacagtcagttcctagtacacgtcagtagaaatactctcttagaaccctccacttcacttagtctgggcaggccttgcctgttcgtggccacgtaccacctgaggcatctgagtcttgttggggggatttcacacaggaggcatgtggagcctgtgactaactccaagaagggattttctttttaaaaagaggatgttaggaaaagtctaaagggaaatgttaggaaattaaaatctgtagaatcagcatgaaggctgcttatggattgcattagtcatggaaggtgagttcactctcgagaaagcagaaaagtggagagatgggaggatgcagtttgcaggatgcaaatgacaggtataagagttcacgaaataccttgagaaggaagaaatccaaccccaggcatccgtaatgcacatgagcgtgtgtggatcaggtcaggaaggagagaaaattagagcaagcagccaaagcagaaagatccacattgagatatggttatatgttcacagaaacaaataaaactgacctctggaacatgcagatgctatccccagggaataaataaatcatcaattatagtatctctccttaatggaaaatatatactatatttagaaagaagttttgttttgaaattagaaataaaaccaggtaagaaaagaaaaggccaggcacagtggctcacgcctgtaatcccagcactttgggagctgaggtgggcagatcacctgaggtcaggagttcgagaccagcctggccaacatagtgaaacctcatctctactaaaaatacaaaaagtagctg

SEQ ID NO: 62414 - DNA, 1034 bp, Homo sapiens
ctgaatgctgtccagtagtgttgaagagctgatccttcaagtctcaaatagacatatccttctttacttatgggactgcatcagagctgctgatgcaattctgggtcttttaagtcattctccgggtcttgccattcttcgttctccatccaattttttgcagctgagattcccactgacatataagctaattggtatagatctgggagccccacattatatacaattaaaactattttaaattcctgtgtaaatttcacaatatcttatctaggctttggaaagtcttttttcaatggctctcagctcagattgagacaaggaattaaaagccaggggttttcctgttctgaaaggggtttaattttaaggggtaactgagctttgagagtttctggctagccaggagaggaggggaatgcatctgaagaagaaagagaagcagagggaaatggaggagcataggatgagggaagaggaataggaagatgaaggcggtttgtgtctcaagttgtgagttgtagggggtatctaaaggaaaaaaattttaagtgtttcacaatttttcctttgctttggccaaggaatctgttaaagaagtaattttataattttaatttcttttgtatgcttgtttatactaatcaaaaatgcagactatttgatatttactttgttttttattctgaagtgtttctcaagtgaacatttttgttcctattaaaaattctgtcattctaaattatacttgatgaaattgtgccatttagaaaggaagttcacaaatttggattttatttaagaacatgtaaaaagcaggagtgtggcccagaagattgaagcattcgatttagactgagacaaacccatgagagtgtggaaatagttggttgaaagtgtcgctgtgcacctcatgacttgggtccccatccaaaagactgggccatctccaatggaaaatttgatgaattttcagttcccatgggacagaaggtttagagaggagatctcatcaagaatcagagtctcagaga

SEQ ID NO: 62415 - DNA, 1008 bp, Homo sapiens
aaggaagaccccaacaatgtaggtaatttacccagagatcactcacagcctaccctgtcttcatatcttactcacctctaaactctatgaagcccatctcagcaatgtgtctcaaatccaagccatccactgtcattactttagtctctgtcatcagtcagagcctctatatttcttgtctggatcatcacagcagtcttctgaatcttcccctgcctatagtttctttcacttccaatctgtcttccacattatcatagttaaacatatgattatatcattctttgtatttaaaaaaaaaaaccttcgttggatcccctttgcctacataatgccccagactcctaagcatgccatccaacgctttccataatctggattttcgctgcctttggaatcttattccaatgagccagtcccagattgcatgtcttccactgtagccacctactcttaattacccacaacatactcagtaattcctaagtgcagccatatttccatattccctgatgtctccaataggaatttctggttctttcatagcactttgattatatgttacatttagttccttctatcatagtttaaatagatggatcaatttttccttttaaacaatgagcaaattgaaggcaggaaatattatgacttattgtacctagcacataagaggtacatagtgaagtattattaaattggctgggattaaattgaaatgagttttaattttgaatgaatcagccattagaagccatagcccactctgaggagcagttatagctgctgcataaaagaatcctgatgataaattatttaatcactctctatactgtaagataccctccattcaggcagttatatatcaactataaaatggacagaatggcatctcagatattcaggatgactttttgaagtatcttgccagcactgaaaagcacctgggtagagttccataccaactcaaataaaacgcaagaaggaatttgaagggcaagagaggta

SEQ ID NO: 62416 - DNA, 1037 bp, Homo sapiens
ctcactgaaaacactaaacaattatctaaaaatgacctgagaagaaagagagggagggagagagggagggagggagggagagagggagggagggagggagggagaaagaaaaagaaaggaaagcaggaagaggaaaaaaagaaatgtcctttgctaggttggaaggcacttttgtgaatgccacgatatgacaaatttaagaatatttcatcttaaagactatattggcaaacattaagggcacaacgatgtctggttgtgacctgtaggaaccaaaaaataagccgctgatagaaccaagataatacgttatgtttttttctaactcaattatggttttgtgcttgtttaaataaaagcaaaagtctttattaaaaaatagaacaaataaaaataaattctgctttttaattcttatttaaatgtactacactataacatttttttaaaaaaatctgtcagtcattagatacctcacttactaactttcaattattatcaatctctgcttatttcatccttgatttggttttaagcattgaaaggattcaatagaacacaccatttttatttaccctaaatttgacggcagaagacctgccttctattctaaaattcaccctcgtcttgttgtcacaatccttatagcctttctttgttagagcagtggttctcaagcctggctgaacattatagtcacctcgggagcttcttaaaaatacctgtgcttaggcaccaaccccagagattcctgttcaagttgatccgtagaggatcccaggtgttgatatttttttaaagtccaagtgattcaacgtgaagccagaattgagaactgtattagaggtttacattgccctaattaaattaactacctttttatttttctctactcctctgtactcaactcttgcttcaatttttgagatattaacaaaatatttagtactgtctatcattcattcatttgacaactatttattgagtacctagtatgtgccagacacttgtagattctgatgaaatggaggtgaagg

SEQ ID NO: 62417 - DNA, 1071 bp, Homo sapiens
ttcatgaaaggtcttgtttttgttttaattttcacctctctcttatataatctttccttatgtgtttgatatatgttcttaagaggcatgtgtcattatagggtatttagtgttattaggtgtgaatgagcaattttataagtaatattgtgccataaatctcactcagtgtgtttttttttaatttaacactaaacctttaaagactattcatgatgttggatttacattgactttattgttttaactgctgcataatattgtatagtgtatatccacattttatttttccattcttctagcagtggacatctgctacagtgacatagaaagaattctcattcttacctctttagagacctgaagaagaatttctttggtgtgtatgtctaggagagtagctggggggccataggacctaaatacactattttctttatccagcctcattagtgcatagctggcatcctcccagtcccacctcctactctagccatcattgtagagatcagggctgggccagcatgcaggctgcagccagctaggtgtcagtgtactacgtagtacctcacttcttatttccttctctgaggcagagatgaggaacactcagagaatctgctcagcactcaggcctgcacatgaaatagggatagaggggcaaggggttaatggtcacaaggctactcatgctttcccttgtatccccttgggggtcagttctgagacacagtctgtaaggctcttaccaagatccctgtgagactgagtttttgccagcaatggttgtcaatttgaaaatgcatccttgtcttagttttcccttcttccctatttcagtcccccagtccctcattcctgctccttggtattatttcttgagtgaactacctataaacaagcctttgactcaggttctgcttttaggggctacccagtatacaatcttactcctaagtgccgattgcagccccaagcatctgcacactgatctgaatagtttggtcagtcttcatcttgtgggtcagagactaggccatttcaaatcttcagtgtgccacctttcgacag

SEQ ID NO: 62418 - DNA, 1090 bp, Homo sapiens
ggacatgtaatttctttgaagtaattaatagattttaaaagaaattcttgcttttaaccagctttccagtttacctgcttatttgatcctcttagtaaataagaagaaaagagcaaaacaaacaaacaaaaacccacttcttcttgagcaccatagaataactcgaggcacaattaaaggaaacatgaggacaatgataatattagtcttctctaatggagaaaactggaaaatgaaaacacattactagggtaagaacagtagtatcaccacaaaaatcagtatttgtttgattaattcattaattccctcattcatttggcaatattgactgcttatttcaatgtcccagtgcctatcacatagcaggtgctcaatacatgttggagggaaggatgcacaaagcgaggggcaggtgaatgagcagaataaagcacctgaagtataaaagaagtaatgtcttatctcattcacatttatatgtgctgtctttgctgttcacactgcagaagaaacttatctgctgctaactttgtggtagtgttgaatagatggaaatcagtttagacagccctatgagctatgcctatgtatagacatagtaggaaagtatcttcagtgtatctatttaggagtgatggaaaagtctttttgtggccccgaataatatttcagtctgtttgtttcagacatttcatttgagtgaacaatctttcattctacattaggatgatgatgaagaatgtaagcaatctgggaagaggtagactacactggcttaaattcacactaaggctttaaaggtaaatagaagatcctttcccaagagcaggttttgatggaggggaagagaaacacgcgccaaggaaatacagttggcccttgaataacatgagggttagaggcgctgactcccttgcatagtcgaaaattcatttacagcttttgactcccccaaaacttaactgctaatagcctgctgttgaccagaagccttactgataacataacagaagactcactgataacataacataagcctaactgataaacatattttgtctgttacctgtatcatctgctatatttt

SEQ ID NO: 62419 - DNA, 1031 bp, Homo sapiens
gacttttagggaagaggaaatattctatattagattataatagtagatgcatgtcattatacagttttccaaacttacagaatgtactacacgaagagtgaaccctaaggtaaaccatggactttgggtgacaatgataatcaatgtaggttcatcagaagaaatgtaccactctggtgggagatgctggtaacagaggagactatgcatgtgcagggacagggcatatataggaaatctgtggaacttgctctctattttgctgtgggtccaaaactgctttttttttttttttaaagacacttaaaaacaaaaaagaagaactagtaaaaaaaaaaatcaaaagaagtgatattaaagctcaatgaattcaactttacatcattgacatgacagattggcaaactctaccaaaaccagttcaaccaactggatgctgcccccttgtaatagtaacttgtggcagagaccatgtagccatgacaagcttggagcctgcattatgttgtcactactaggtaaagcacacatataaaaagatagtatcttctgaagacctactctgtctttagaccactgatgttctacatatacttcaacatatactgctgtatctccttatctggctcataacagatactcaagaaattacaatagtggatgcatgtcattatacaattgtccaaacttatagaatgtactgtatttactcaataaatttattgagtgtctgggccgggtgcggtggcacgcctgtaatccctgcactttgggaggctgaggcaggcggatcacgaggtcaggagatcgagaccatcctggctaacatggtgaaaccccgtctctactaaaaaatacaaaacttagctgggcgtggtggcacacgcctgtagtcccagctactctggaggctgaggcaggagaattgcttgaacccgggaggcagaagttgcagcgagttgagatcgtgccactgcactccagcctgggtgacagagcaagacttcgtctcaaaaaaaaaaaaaaaatta

SEQ ID NO: 62420 - DNA, 2016 bp, Homo sapiens
tcttctttctcctcttctctatctgttgtgttccctggaatacctaatgtggtggctgagctctagtagccatcttagaccatgggagaaagggtattcactaggtatggtagagatttggaaagcctgagtctctgatgaatttgtgaggctctacaatagccccgagctatctacctctatgcttcttttaaatgagagagaaataagttttatcttacttaatccactgttattttaggttagtttgtatatgcagccaaacttattccaaaccaatttaacatatcatgtttcctgcctgaacacaccatgctctatcataccattattctctggtttgtcttcttcatggcttgtttaatgactggaaattctcattattttcttttttttattgtttgtccttcctgctttaaatataagctttgtgggaagagtcctcatcttccttgtttactgtgttgtcttcagagagaaaacaatgtctaataggtactcaataacaaattactttttgtttttgtttttttaaaatttaatttaagttctgggatacatgtgcaggatgttcaagtttgttacatgggtaaacgtgtgccatggtggtttgctgtacctatcaacccattgcctaggtaataagcccacattcatcaactgtttatcctgatgctctccctccccttcactcctgagaggccctggtgtgtgttgttcccctccctgtgtccatgtgttcttgttgttcagctcccacttataagtgagaacatgcagtgtttggttttctgttcctgcatcagtgtgctgaggataatggcttccagctccatccatgtccctgcaaaggacataatctcatttctttttatggctgcatagtattccatggtatatatgtaccacattttctttatgcagtctatgattgatgggcatttgggttgattcgatgtctttgctattgtgaatagtgctgcagtgaacatacatgtgcatgtatctttataatagaatgatttatattcttttgggtatatacctagtaatgggattgctgggtcaaatggtatttctgattctaggtctttgaagaatcgccactgtcttccacaatggttgaactaatttatattcctacaaacagtgtaaaaccattcctgtttctccacagcctcaccagcatctgttgtttcttaactttctaataatcaccattctgactggcatgcaatggtatctcattgtggttttgatttgcatttctctaatgatcactgattttgagctttttaaaaaaatatgtttgtccacataaatggctacttttgggaaatatctgttcacgtcctttgctcactttttaatgtggttgtttgtttttctcttgtaaatttgttcaagtttcttgtagattctagatattagacctttctcagatggatagattgcaaaaaatttctcctattctgtaggttgtctaataacaaattgctgagtgaatgaaatccataggttaaaattccttccacttatatcagcatttgtctctatgattctgttccatggctgaccagtgaatcaccattcttttggatagagtaatatatataaataggtctttctagccttagagttatatataaataaatatgtatatatatatataaatatgtatatatatatataaaattgatgcttagatccactgagtattgaatactcaactttcacttctaagtgtttttttgggagacatccactgtcatctctaagcatgtacaccaatcaaattgggttattggtagtttcactatcacataacctaagctatatatataatgaaacgaaacaaggtggaaaatgcggagtttatattgtactgaccttatgtttatgactgttgcctcaaatcaaatggaattttttcattcaatttatttcttcctaaagtgatcaatggggtaaggttagtgctttcaggatcccagtggctacgtgatgccgaaaggt

SEQ ID NO: 62421 - DNA, 1039 bp, Homo sapiens
agagtagggggtataggaaccttcatattctgctggtgggattgtacactggtatagctattctggaaaacaaatgaagggtatgctcactctttgaatttgaaatttcacttatgtgtttatgcccccacgggaattctcatgtgggtctataaagggccagatatgagggtatttgttgtagctttatttgtggtggggagttgtgacaatctggatgttcatttcaaggagaatgcatagataaaatgtaatgattgcacaacaaggaatgttatgcaacacttaaaagcaaacagtttgatgttatatctaacaacatgagtgaataacattgtgaaataaacgggcagcaatatatagtacaataacatttacatgaattaaaaatacatgctcagataataatacacatttataaaagcatatgtaaggaaaaatatattaaacacatttaagtggttgtctggcttatgaatggggatatgaatgtgttatgggtacaaagagaattaaaaaatgaaagagagaggctttgcaaggatcaatgatgatgaagtgtcattaactgagtagaattaattatatcctctgcatttgagatcacaagtaaaaatgatgttaacaatgtcataacaacaacagaattttttaaaaaatccacaattcctctacaaattctaagttgtttggaagaatggattatgttgttattcttgttagtccctgtaactctggtgcctcacatgtagtagtcagtattaaacgtttgttaatttaatgaataaatgaatggatggatgaatagaactaattattttcagtaattctgtattccttacagttgttatcaaattttaaactgctttgaatcagggaaataaatatagcctctgtaatgtacaccatatcacaaactgtgaagatgataccagaggcttctttctgaaatgcagatttaattgcttacatgattaaatattttattggttttatttaaggtttttagggggaaataactttttaaaatttaacaggc

SEQ ID NO: 62422 - DNA, 1074 bp, Homo sapiens
gattatagttgagccactgtgtctggcctcagttctcttttaatagccttcagaacatttctaaaagcttttgcactgaaaaactacataattgaaccaaaaatgcagattttcataattcccctcaactgttgcaaagtttttggttcaaacttgacacagcagcaggaactttcaggttgaagttatgaaagtggtttcagttaatagtaaattgcaattctacaataatggatgtttttagaaataggactgaactctgttgtgacaataaagggatcatttaagaaaagcttatcaaaactatcttcaggggtgcttcattttatttccattttagtccctatatacatttcagtcccttaagcactgagtctggctgctttagaattgaaacagatggacttgagggtttctgtatctaattttacagtagcatatctctcgattattgacacattaaacgcaatatatttctagtttagaaatctgatgctaattggctttggaatattttgtttaaaaacattttccaaatggggctgtgaattgttcagtttctttattcaggattaaagaaagcattaattctgccaggaaaagattgtccagtggggcagaaacattagagccttggagtttacctgtcaatcttgtattttcatgtcctttgtctagaaacaagcctacaagctaattgacttctgtttctttccttttggcctctcatttttctgaacataaagactcaagttaaaacaaagataaaattccaggggaagctggcgttgatcaaggtttggattaaattaaattaagtgctttttattgaactcagcagtattagttattaaaaccagaaggctttatccttgctagtgtaaaaaaagaaaacaatgactcatgctggggcacagattttattgggaagttaaagcactcgttttctcttattccattaaaacttttgcagataaacacatgtaaacaagatcaggagatggaaagcagtgaggagtcagtccttctgggctctggtgctctatgggttctagccttcagctgcaagaactt

SEQ ID NO: 62423 - DNA, 1029 bp, Homo sapiens
tatgtacttatcttaaaaaccaaggtagaatcatataaaggtaagaccattaccttggactatttagtgtcaatcagaaataagagaaagtccaattcttcatgtgttgaaataaatttgggggcttccataaagggttgtagggaaactaaagaattctgcaggagaaattaactcccatatagtgagatgcctctgatgcagaggacatcttgaagtaatatgcaacacttgatgacacctcttcaacacttagtaaatctgacctttcctttcatctgtcgttatgctgaatcacatggcccagcaagcagctaacacattgcaaccaaacttcacaattgcaggctgggaacatgtgcttccttacattgattagtgatattaccagtgtttaagcccatttcctgtcaccttggaggatggaggttacttgacaggaagtcattctgctgtcatccagcagggctgccaatgaattctttaaacttgtcaatgagtagaaacgcagccggctttactctggcttaaagcttttgcatatgttgagtatgcatttagtacatcatggaagcacctagttttgatactaatggaatgtgcatttctttgaaatttctaaattcccaaagctttaggcaaatgctgacatgaaaactgttttagttaaaaatgagcttactttatgcttaaagggtcattttgcattagctgtgtcttcgagtcgattttgaaaaatcacctctttgaggagtgggcaaaaaaggagtcccaagaggtagtccatttcctttaataaattcaagcaactttttctttgtattgaagatattatttgtcatacattttccttgtcatattgagcattcccagaccatcatttaaaacagattggtaatttggcccttaattttggcacctgtacatcttttaaagctctgggctgtgtttggaaactttactactctgtaagttaatacccttttagggcctaaacactaccattaacagcaaattggcctctcagga

SEQ ID NO: 62424 - DNA, 1025 bp, Homo sapiens
ggttcatgccattctcctgcctcggcctccggagtagctgggactataggcacccgccaccacacctggctaatttttttgtatttttcgtagagacagggtttcactgtgttagccaggatggtctcgatctcctgatcttgtgatccgctcgcctcggcctcccaaagtgctgggattacaggcgtgagccactgcacctggcttggctgtgcaattttaagaatgtaaatttagattttattttctatttcatatcacatataaattccagatgaattaagaatctaaatagagttccttttgtaactatagagatgttactatactatagagatgtggaagttttttttatttttgggtataaatattcaagtcataaaacattgaaataatgacataaatgagcggcagatttgattgcataaaagtacacttcagttttacaaaatgatatgtaaagttaaaatgatatgtaaagttaaaagatgaaaaacagattagaagaaaatggatacgaatatagaagacaaagtgttggtgaacatgtgtcaaaatggactctactggtgagaatataaattggtatacaaattaagagatacactcttaataatcctaaatctaggactctatttcatagaaaagtaccatgagtatattaatatacattttctttatagcatactttaaaatgacaaaatattagaaataattaaatgtgcattaatagagtaacgattaggtaaattttggtatatccattcaattgaaatacatacaactattaaaaagaatgcagtagaactatatgtgctgatatggaaagatgcctgtgatatattttaaaatgagaaatgcaatttgaagaattatctgtgtagcattacccgacctctacaaaaagaaaactgtacctatgaaggtctatgtatacaaatatgtgtgtatgtaatcaataatctatctggataatcatagaaaaattatggaagagtgaatattatacaggcaacagcagttac

SEQ ID NO: 62425 - DNA, 1122 bp, Homo sapiens
ttgaaaatgacatgcatttgtcgttcccagaaaataaatctattaagatagatatgctgatttatttggggggacatgttaatatttttatttaaaaaaggagagagaaaagaaaggtactggtacctgtattagcctttattaataccaaaataaacactagtaaatacttgaaaatgcccatgatcaccaagagactactttttctttatgccaatgagaatgaaagaaaatgtataaaaagaatgggcaagtagagaatttttgaaagtttgaaagtagtgaagaaatttatttcagatatatatttatttagacttccagacatctgctgatcctgagagcgaaaaattcacagttcttcttagtagaattgaacacttaaaaaaatctattctgggtaagataccatgtaagactcttactgcaaccattgtggaattctaaagctgaaacttgtataatggtctttactggtatgttacaaggattggtaaactatggcccatgggccaaatctggcctgcttcctgttttagtatggtctgcaaactgagaatggttttaacatttttaaatgattgaaaaaaatcaaaggaaggataatatttcatgacatgtgaaaagtatatgaaatccaaatttcagtattcataaattggaacacagccatgctcattcatttacatattgtctatggttgcttttatgctacaacagcaaagttgaatagttgtaacagagcccatatggctcacaaagcctaaaataattactatctcccctccaaaaaggtgggtagcagactgaggcagaatttctttcctgttaccttttatttcttcccttgcccccatttccaagtaagctctattcttctttctctttcacacatccccacccaactccaccttcaaattcacaaacacatatatgtttgtgaaaaaaagaaaaatcaaagtctttcattattatgacagttactggttgctcttagtttttaaaatcatattttcttttactgcttaaaatatagagtttggatcatcttggaaagagctgaggatctcagtatgtaggctctccatttggcaatacctaaacgaagtgctaagactagtc

SEQ ID NO: 62426 - DNA, 1047 bp, Homo sapiens
gggtctttttctccttaattgtctactctgacatgtggaaaaggagagaaagttaggtgtttctgtcttttggggaaatgtggtatcttccatttaaacttactctcatattgttttgctttcttggcctgtttatataaatacaagaagccagaagccggtaaaaataaaaatcatgaagttatccatgagacatgcagaagcagcctccttgtatgataaacaagctcagctgcaggaagatctgtggtctgatattcattactgaaaaacttgcattggatggacagtttgtctggatgagttaattaattttaagagttctctgtcttcttagaaatataccattccagattggctgaaagcatgtttattttcaacattcatcagtaattctgggtcagccactccacagtttggtttgccttggtgccagctgcatgtggcagaaaagttaattagatgtctcttgtgttaaaagaggaaaaagtcatgtggaggaacaggactcttgcagagaagggagtgtagaatttccaattttcctcaggactgagaagtcatgagcacacagactagtccatgaggagctcagggagtttttccaaggatagcttctcatctctgcaaatgaatttacatttcgatgttataaaaatatttaaacaaattatttcacttgtccaaaagctctttttctgtctcacatttatcctgccttccaagtcctatttgagtcctacttttactcccaaacattctcttattacagtggctttaagattaagcctcctctttgaagttctaaagaactaggagatgatagccatgcttttttccaatatgttgtatgatttgctgttgtttccagtatatttagtagatatctcaattagatttaggcgaggaattaccctgtgaatgggtaaaacaagagataacctttgcaaatgattttaaaagaattcctgttccttctcctcctcttccctatcacctttaaattggtcaacattattaggtaaaatttgccaatttttaagtata

SEQ ID NO: 62427 - DNA, 1050 bp, Homo sapiens
taaggagaattatctttaaggaacagagttgagaaccaaaggtggcttttgttatgtactaatgttaaaatgaatggatagttgtagcattgagcaaaaagcttccacttttctggttaatccgtttatattgctaccctgataagtttttttttttttttcgatatggagtctcctcttttgcccaggctagagggcagtggcattatcttgatttactgcaatctctacctcccaggtagagtgattttcgtgcctcagcctcttcagtagctgggattacaggtgtgcgtcaccatgcctcgctaatttttgtatttttagtagagatgggatttcaccatgttggccaggctggtcttgaactcctgacctcaactgatctgcccagttcagcctccccaaagtgctgggattacagacatgagccactgtgcctggccccgatgtgattttgttgttccccttgttttcccatgaattaataatgcaattaacaactcatgtgtcttctgttttccagatactttctgagcacattaatgcaactgtattttctctaactttgtaaaaccactgtttatgtatcactttgggagcttcactggttactcctttaatgcagttaactattctactctatgcttaggcaccttgaattatatacacaaatagtgatgatggaagaagtaaaaatagagttgttctttatacccaaggaatcttactgttgcctaacttcctttttgttctatgtaatgttatgctttacctgctctcaacaaggaaatcttgggttattcttctgttcttaagtttatttttttccagtcttcccctctttgtattgtattcaatgtgatttatttgtatgcatgtttttttaagaccataactgcatctttaatgaagatgtacaccattttttaaatgtacatcaaaagccagcttaatatttctaaaatgtcatattcatcatgttgctcttttgctaaaaaactatggttatttttggattgcttacataatatgttcaaactcctcaacctg

SEQ ID NO: 62428 - DNA, 1037 bp, Homo sapiens
atgaaaggcaatctgatttttttcccagggatattacacataaaaattctcaggtattttcaataacaaacatccccaaagtgtagtcagtagagctgccaattattttctccttcagcattccatatggagaaagtgttgtcatcccttgcttctcctggcaggacagagacagtccttgatggcaaaataacatactttgtaaccagggttctcttgtactgtcctttgcctattcctgttttccctttcctagtagaaaatcaaagacatataaaacctactctaatttcttccttaaaagatgctaatcacaggcagaagagcctacatgattaaaatatgtggtatagacttgtttgaccacgtttattaacaccatattatattagatagagttcaccttttgtttcaggtttaccactaagtcattcatgtataacttaattcttaccatagtcattagttaaggggatgtatttgtggcacgtgtgggagacaggaaataagaatgaataagaaagcgatagcacaattgtataattttttttatttttttgagataaggtctcgttctgttacccaggctagagtgcagtggcatgatctcatagctcactgtagccttgaactcccgggctttagtgattcttcccacctcaatctcctgagtaggttggactacaggcatgtgccaccatacccggataatgttttaaacattttgtagagacagagtctcactgtgttgctcaggttggtctcaaactcctgggctcgagcaatcctcccgtcttagccttccaaagtgctgggattagcatgagccactgtgcctgattgattgtatattttagaatttataaagtactttccccgtacataaacttactaattattgctttactcttggatattatatcagtttgacagataaggcagctgaggcttagaaccattaaaaattttatccaagtttacaagactagatctggtaaagtcaggacttaaacctagagcctccaactcctgctcta

SEQ ID NO: 62429 - DNA, 1111 bp, Homo sapiens
gcgaggctatagttacttcagacttcagagagtagaactactgagtgaaaatgtgtgtgtgttttgagactgagtctcactctgttgcccaggctggagtgcagtggcgccatctcgactcactgcaacctccacttaccaggttcaaacaatgcccctgcctcagcctcctgagtagctgggattacaggcgtggtggtacacgcctgattttttgtatttttattagctgattttttttgtatttttagtagagacagggttgcactatgttggccaggctggtctcaaactcctgacctcagatgatctaccggcctcggcctcccaaagtgctgagattacaggtgtgagtcatcacgcccggccaaagtgtacttttttaaagctcttgaaatatctctcccagtagattgctaatttacaacttgccagtcccacttacaatgtcttagaatgagtattgctctgtcctgtgaatgctgttggtaaagtataataaatatagcgcagcaacatatatataatatgtatttatatataaatatattatatattattatatatgttaatatattatatgtatatattatatattatatgtatatattatatatttatatattatatattatatatgtatgtattatatactatataatatataaaaatttacatataatatataaatacataaacatatagcacagctcatctctctctctgtctctatatatatatgtgtacatataaattagaatatgtatcttcataagagtggggattatcgaaaccctggtggtctaatgctcaagtctgcactctttaccaccatcctattttgagtgttaagatgtgttaatttaggtgcaatcttattagatataaatttttagaacataatccactggtcagacactactgccgcattcacctgagataaatatcttgaggaagggtcattcatgccctaagtaggtttagtagcaggtgaagactgaggaggaaacctgaatctggtttggagtttaagatgttagccttgtccatcagtgctggacctggacaagaatttgtccaggcatttggacaaggattttgtctgatagac

SEQ ID NO: 62430 - DNA, 1308 bp, Homo sapiens
gctctaggtacccaaagcaatttctctcctatggtactaaaaacccaaggaagactctacctcttggctccctggctattttcatctcacttctgcctcacttcttgctcctgattgagccccaggcctctttcctctctacttgattcacaagatgcaccatattccttatttgttccattctaccaggtttttccaaggcctaccaaatgtcagatactgtgtaggtgggagatagcccttgaaggtcattgcatagctccccacctattacaggagacacctctgcaggttcccatacaagcagcctttgctttaaactcctcccagggccgaaagctcactatttacagagcaaactaattccattgctggacagctccagtggctgacaatgtttcctcatatagagcagaatttgtgtctccaaatccttctacctcttctgccttttgaatcatgtagactaaacccagacaccttagacgttcttccccatacttaatttcccatcaggtattgattgcacacatatcaagtactcaggtccagggccgggcgcggcggctcatgcttctaatcccagcactttgggaagctgaggcgggaggattactcgagcccaggagttcaaagctgcaatgagctgtaatcccaccactgtacaaaagagcaagaccctgtctttgcccgggggggagggaagtactcaggttgggggttaaaagttgactaaggcagtaggatccttgtaagtctgggaactgtggtcctgtgaaataggatagatctggacctgaagaaatattctgggtagaggagatcctagaaaacttgcatacccaaatgagtggggtttccttcagcgcagtcaccatcttccaactctcctccccaaactcaagcttgatgtcatgcttataacatgtttacttcatgtctgagtttgtcttcagaaagtgccttctggtgactacaaattcactcaagaaaaatcagcctggatacattagagtcacccctcttggcattacacagtttgaccgcccccctagttcaccagatttggcccagaacccttgattgttttttaaaatcaaatctactttcaagagtcaacactgagagcattcaaaagactatctcacaaaccctgaaagcaacaccagacatcataatttgaaaacagggacataattagaataagtgtagaacttcccagaatgactcctttgaaggaggcattcatctgatatgagttggaatgtttattaaaaacaaaaaccaaaaaaatcaatcccttgactt

SEQ ID NO: 62431 - DNA, 1118 bp, Homo sapiens
ctcactaagatgtattccccaagctttcagtagccccctatgcctgcacccaagccagcagttcccccacccgacctgtcagacctacttcagtccatagtataagacctctcaagtccagagcaacaacctgaaaaagtgctccaagatttttaaagttggccgggcacggtggctcatgcctgtaatcccagcactttgggaggcccaggcaggcggatcacctaaggctaggggttcgagaccagtctgaccaacatggtgaaaccctgtctctactaaaaaaaacaaaaattagccgggtgtggtggtgggtgcctgtaatcccagctactcggaaggctgaggcaggagaatcgcttgaacctgggaagctgaggttgcagtgaggcgagatggcgccattgcactctagcctgggtgacagagtgagattccatctcaaaaaaaaaaaaaaaaaaaaaaatttaaagtcaacaagacaatatgtttgaacttgtggctgacccagaaaatctgggacatacatagtcactgttccaggacctgaatttagaactgatgttccttttctgcccccaacaccaaatctagtagctaaagcacatagcaagaaaatgtaacaaaggaataagaatgaaggcgatggagtggtcttggagatcatctagtccaccctcgtcctgtgacatttgaggaccctggaggcctagagaagggaaataacttgctcaagtccaaaaactgcatcagaagcaggctcagcctcatggcttcagtgcagtgccatttccaacacaccgctctgccttaggtttttatttgcattggtggtaaggcttggccccttctgggctctcagattctgtaactctttgaattcccattgagtcctgcgggagaagacaggggcattgttgttgaaccctgtggctttccagggtttgtgcaaatataccaaggagacctccacctatcctcacgtgtgcttttagtctggcaaatagactgggtggagaacacattgttctctaaaccctctctcttgccaaacagtgtttgagaagagggaatgatttctgactttgcatggatcgttggattccggctcctgttct

SEQ ID NO: 62432 - DNA, 1186 bp, Homo sapiens
ctccactgctttaaggatcccctctgctctgattatgtcttcttttggttttcaacagccaagcaggttgagtatctggtcaatgaaaagcacatctacctgctgccaagtggtcgaatcaacgtgagtggcttaaccaccaaaaatctagattacgtggccacctccatccatgaagcagtcaccaaaatccagtgaagaaacaccacccgtccagtaccaccaaagtagttctctgtcatgtgtgttccctgcctgcacaaacctacatgtacataccatggattagagacacttgcaggactgaaaggctgctctggtgaggcagcctctgtttaaaccggccccacatgaagagaacatcccttgagacgaatttggagactgggattagagcctttggaggtcaaagcaaattaagatttttatttaagaataaaagagtactttgatcatgagacataggtatcttgtccctctcactaaaaaggagtgttgtgtgtggcggccacgtgcttctatgtggtgtttgactctgtacaaattctagtcccaaagatcaagttgtctgaaggagccaaagtgtgaatgtgggtgtcggctgcggcattaaattcatcatctcaacccagagtgtctggtctccctgctctttctgcatggttgtgtccctagtcctaagctttggttctttagggtgactgtggtaagaaggatatttaatcatgacatgcacggacacgtacatatttaactgaaacaagttttaccaaacagtatttactcgtgatgtgcgtagtgcattctgatatttttgagccattctattgtgttctacttcacctaaaaaaataaaataaaaatgttgatcaagacatggagttgattttatgaccactaatgggttgtgacccacagtttaaaatgaatgctttagagggttttactagtggctaaaggaaaaactacaatgtgttcttacagtatagcttccttcagtgaactcaccatataactccctggtgattttgcgggcttgtcatttggaggccagctgtcttatgttacttaagaaactggacttcttggactgtgagaggagatgacatcactcaggttgattatagaacatcagcccgttccctgctgtcagagtccctcctggtttattgaaacagaaccacaa

SEQ ID NO: 62433 - DNA, 1393 bp, Homo sapiens
aactttctaggtgggaattcctagctgaaagtgtgtatattcttccttaacgagtttgtagaatacttattaaggaactgctgtgtattggacactgtgggaatacactattgaatggagcagatgcagtccctaccctcaaagacagacagcctgtttggggagatggacgagtactaaggcagctgtgatgctgtgagatagctgtgttgacagtgttataggggggtacatagcccagactttgggcagtgtatatgtgggagttggcgggttggtggcaggaaccttcctggaagcagtggtttctatgttgagtcctgtaggatggggaggagctaagaaggcatcagcagacaggggttgacagggaagggatgtgctctgcagaggacggagcatggtcagaagccccaggcagacatcatggggagtgtgagtgatgaggctagagtgaataggggcagggtctgtgctgaggcttggactttattctcagggcagtgcggagccactgaaatcttggatgtcggggagtgacatgattggatgtgcatggtcttaaggccaccctgatgtcatagcagggaatgggtcagagagaggcaagactagacaggccgtgggagcagttaggagaccattgccatagcccaggtaggagttgatggtgacctggatgaagtaggtagcagtggggacagtgagatgcaaaaggatttgggagctctgaagagacaggactgatgagacttggggagtgccaggatgtgggggatgagctgcagagttaggagtccagattccccccagtcccacctagtcaagataaacctaagagatgggaatcaaagtacaaccaaagatttggacagttccggggagggaagtggtgtccactcagagagcacagctgtagaagcaggttccctgtggagagctctttgaggagatgagtgacaggaatggaggctactctgttcccttcctcttgagtacctagcagaatagcccatgaggagccctggggataccaagcctacacttgactaaggctctcacgccagaaattcacagaggaaaatccacaatgtaggacattgtctccttgcatcaaaagtaagccctgtttctctaagctgaattgggacactctaggacaatttacttttaaaaagtaaagtttacggaaaaggttacacttgttggttgtagagagaaatggatgtaaagtggagcttgggtgcatatagtcaagaaataggagaaatggacagcatttgaaattccctccaggcatcagctggggaaggaaggccggtgtctgaggttggtgccagaaggatttcctgccctgactcactttgcttccccgcagcaccggtttctgttc

SEQ ID NO: 62434 - DNA, 1996 bp, Homo sapiens
tgactccatctagaatggaaaacctggatttgtgctgagctgtgccactcacaactgtgtatcctttgggaaaaacatgtctctgaatcagttcctcatgtttcaggggatatagacttgactttagagggcatgtgggcattgagtatacatgaaagcattttgtaaatgataaaatataggaatagaaaaccaaacacctcatgttctcacttaaaagtgggagctgaacaatgagaacacgtggacacagggaggggaacatcacacacgggggcctatcggtgggtgggaggcaaggggagggagagcattaggacaaatacctaatgcatgcggggcttaaaacctagatgacgggttgatgggtgccacaaaccaccatggcacatgtatagctatgtaacaaacctgcacattctgcacacatatcccagaacttaaagtaaaataaataaataaataaataaataaaatatggcttttattattgcctatgttaggtcactttaggatgagaggaagccagccaggcgcagtggctcacacctgtaatcccagcagtttgagaggccaaggcaggcagatcacaaggtcaggagttcgagaccaacctggccaaaatggtgaaaccccgtctctactaaatatacaaaaaattagccgggcatggtggcaggcgcctgtagtcccagctactcgggaggctgaggcaggagaatcacttgaacctgggaggcggaagttgcagttagctgagaccatgccactgcactccaacctaggtgacagaatgagactgtctcaaaaagaaaaaaaaaaaaaatgagaggaagccaaggagaagaaagtagtactcatgcatcacctctgttttgttagaacatacttctaaggattaataagcctgaattctagagatgaggagtagcacagattgatgtcaatgacaagttaggaacactgttttagaggcttatgctagagggtaagtttgatcttaggatgggtgctgaagagatgggtttgccttccaaggcatgtgcgtgcatgcacacacacacacacacacacactaatgtggcctcggtgtgtcctctacctctgtgttcagaagggaagcttcttctagtgtcagacctcctgggttgaagactggcactcctgctcagtagctggtaactttgagcaaggttcttcacctctctcagcctcagtttcctcagttgtaaacatgggcaaatcatagtacctttttcatgtagtagttgtaaggttttgatgagataatacaattaaaagccttagcacagagcaggcatagagtaagtgctcattattaccttatttttgtaaatattatctgacctcaccattatcagcctgtgaccctgtttcttctctttcaggtaggaggtgtgcaatctttggggggaacaggtgcacttcgaattggagctgatttcttagcgcgttggtacaatggaacaaacaacaagaacacacctgtctatgtgtcctcaccaacctggggtgagtctttcagctgaagtgagaggaaaaacagaaaccagagagaattatcctcatgactctccctggttacacagaaaatgtaatccagccctagaacaactgactgttgggaatggcttgaacagtgggttatggcagtgcatgagaaacctgctgctcaaaatcaagttaagaatactctttctcaagactcttagtagacttgtatctaccaaggctatgttgaaactccccagaggaggcatagaatgtagatgcaggaagtatcattgtagtagaatataagtctggcattaatgtgactggttgaacttgttcttggttacaatcattcctctacatcttaacccccagcctggatgatgcccagtggacattgagcctgggagggccctggaagctgacttgcatcctttccactcatgcctcctagtgtttgtaaagtgcttaactttttact

SEQ ID NO: 62435 - DNA, 1114 bp, Homo sapiens
cttcaagagctgatcaagggtcacttccacactgaatccttaggtattttaggcagagcttgttgtttaagctctctgagttatcacaggactttgttcacagcttgggaataacagtacttaactgttcttactataatggataattttataagtcttcatctcccacaaggccctaactttccccaggagagtgatcattgcttatttaccttgcagattttcagcatttggctcctatccgggtacctcaggttccaaaggtttggattcattcattcctttagtcatcagatgcccactactagagccaggcactgttctagatgctggagcacagcagtgactcaaacacacagaatcccctgcccttgcattcagtttcggggagaggaacagactctaaatgtaatctttttgactatatcagtaagaaaatgatgtagtatactaaagatgataaatgctataaaaatggagcaggaggtggcatgttaggaattctaggagtggatacagttttaactagggtggttatgatagaaatagaaatgacatttgagccaaaacttaaagacgagacataaatgaaagaatgagtgaacaagtaaaccaacagtaattgtttcttcccttagatttttcttctccagattcaacatttccagatcctttacccattttgaggagacctattttctagactcctcactgccttgtattacttttccactttcagatcttaggatccagacagaaatgtcgatttttcatctctggcatagtgctgtttcagctttgagattactgagcattgtaggaaggagggctcatgggtcataactcattgtcacatcatgacatcccactctcgctttgattgcctctaggcgacttggggcttctgctgtggctcagatcttttcaccactgtcttctttcttcatctagttcagcacatgcttatgtagtaccatgtgccagatgccgtgagagatgctgggggcacccagatgaatgcagcatggctctggccacaggcagctcctggttgctctcctattcctcatggtgaagtcatagtatcggcaaattgttatctcagacaagggtt

SEQ ID NO: 62436 - DNA, 1656 bp, Homo sapiens
gtttctgtagcgcgagttcaggaacctgatagcgcaaataatgtggccatgtacaaagcacggctttttcacttgttcagttttgcccagtagatcatcagattttagctactgcatttgaagcagtcagtggagatgccaagtagaaagaatttaatggagtgataaagacaccagggttctagatccaactctgccactacttttgatcataggcaagtcatttagccctctgggctcacatacacatgttagaaaaagaccacatagtgcgagtctgtgatcccatgaggagcacttgcgtagggaattgtttaaggggcctctgagtcccctgaaattatatgcagaattttgtgtgtacttatttcttgggagaaggtgcatagcttttagcagattttcaaaaggtgtctgtggcccttcaagggttcaggagctactagtagatgctgtctaaagtccctgccagttctaatattctttaatacttctactgttgatctcagcacctatcatttaagtgcttcctggtatatagtctgtgtgtaactggagatacatggaggaagaacacatttggaagtagacacagtgagataggctgtgtgttccaggaagtggaacagattctcagtgttgtaggaattcagaggggagggagacctatgagtgctggagatggcacttgagctgaatcttagagaatgtgtgagcgaggccgggacactggttctcagctccagctggatgttagtattacctggggagtttttaaaaacatactgtggctgggccctgtggaccccatgccaggccaggtaaatcagaatcttggaggcaccacccttctcccctctctttcactcccttttcttctcccccatgggcatattttttaaatactccccaggtgttttcaaagtatagccagttttgagaaccataaaatatggaagaggggcaagaggaaggatattcatcttgcatggtaggagtccagggacagaggcaagagctaagcaggtctagcttgtaaagagacctacctgatgagagctgggaacatgttggataggttaggcaggctgattctggcagccagggcaggagaagccaactgaaggttggagcagaggagttacccaataaaagtgttgtttgaagaagataagtctgattgggtgggtgggaaaaagaagagctcagatttttgcactagtccagttgggaattgcacagtttaaaccagtggccattatcattcccctgggtcagtgttgtgatgtagcctgtaattcatgcattgaggaaaccacatcttggagtcatctgatttattccccacatgctgtgtacagtaggttttccttttatatatcatgttacccagatgccctgataagcagaatggcagaggacaataaaggttgcacacccatacatttgtacatgtaccaggaagcagggaaggccctggtgaaggtcttgggactcaggtccatgattaggcaagtaatgaacttcattaaggttttgtatggattggaatgagagactatgatttgcctcaatgaactgaagtcatatggttagaatagttaagagtatagagattattaatcatattgggaagtttttctgaaaatccagtgt

SEQ ID NO: 62437 - DNA, 1661 bp, Homo sapiens
ctgaggcaagagaattgcttgagcccagggggttgaagctgcagtgagctgtgttcgtgccactgcactctcacctgggcaacagagtgagaccctgtctcaaaaaaagaaaaaaatattgtgagttagattcaccagagccggagggtagactatgagtggtatgagagtattgtttgattcacctacccagaggcatttggtcagtggctctgtcagtctgtagccctgtccacatttctattactaacttgaaatgtttctcagatttgcagatgacatattcctggagggtagagttagctgatcattcaaaatgatcttataaagtctttttactgtatatcctgtgacctaataaattaacatttagatatttttcctaagaaaacactcatgaatatgtgtaaatatatgaacatttatcacaatgtttataatagcaaataatttaaagcaacacagttaataaattatatataaaacaaatattatttatccactaaactgatgttgtaaatggctcatatttatgaaaaatacccaattgcattcataataagataaatgcaaattaaaactacttgacatattatattggcaaaaatacactcagtgcgtaaggctgtgtggaagcaaacgctcttaaacagtgctggtgggaatgtaaattgatataattcctgtatcaattgggacaatttggaaatatttgtcaaaattacaaaaacacatacttcttagcccactcttttgttttccacccagcatcttacagatatatttgcatacatgtgagatgacgtatgtacagggtcgttcactgaagtattgttttaatagccaaagattgtaaacaactcaaatgtccaacaagagactggcaaagtaaaatatggtacattcatcagctaagcagctgtaaaaaagaacaaggacgctctctatgcgcaaatgtaaaatgattttcaagtggaaaaagcaaggaacacaaaacagtgtatagtatgccgtatgctaccttttgtttaaaagggcatatgtaagaagctgtgtttgcttgtgtaggcatagggaaatgcaggaaggatatgtaagaaactaacagttgttatttatggagggagggatttgagaactaggtagatagaggataagaatgggatggagacatgcaaacatgtcacctattagaagaatagttaatgaggaggaaaaatgcatagtatatatttaaatggaaaaaagcatgttgaaattctatgtacagtttgatccatattttataaaagaatatgcccatcaaaaataaagcttagaaggttgtacaccaaaattttcatactccttgtctctgagtactgggattatatgttatgttagttctcacactgctataaagaactacctgagactgggtaatttataaagaaaagaggtttaatggactcatagttccaccggccatataagaaacatggttgggaggcctcaggaaacttacaatcatggaggaagagtgaagcgcaagcaagcaccttcacatggcccagcaggagagagagcaaagcgggaggtgctatacacttttaaaaaaccagatgtagtgagaactcactcactgtcacaagaacagcaaggcagaaatctgcccccatggt

SEQ ID NO: 62438 - DNA, 2034 bp, Homo sapiens
gacatcacaatatctattttgtgggttgctatccaaattaaatgagagtaaagaaatgtatttagtgcagtaccttgtatgtacaaagtatttagtaaatccgtgttgttatttctctgccctcaggttccgtcaatgtctttctccatgccccagacctcatctctgaatgtcaggcctacagtggacacatcctacaactccctcaaattcagcatgttcaaagcacagctcatcatttccaccttccccttgatcttttcttctatcttccccttgtgttctaggtcttggtcgaccccactaccaccatccactcattatccagacttgagggagaccttggagtcaacagcagccctttccccaatcccctgtctttttatttggtcaataggttctgtcttttctacctcgaatctatttccaatggcaccccttttcttcatccctgctgccattgtgtgaattcaaggcctcattatttcgcttctggaatattgcagtagctttctactccttctacttctagtaactcacccttcttaactactgtctctgtccttctctctggtttattttctgtggtgtcactcaaatgatcccattaaaatgtgcagctgctcatgttactctcttgcttaaatgctttcagtggttacccattgaaactgaagttccctaaaagagactccaggattcttttagccactcccagctaatccttagtggattccacatcagagtcatgaaaatgcagatcctcaaagacctcatgctccccaggcctctggggccttgcacaggtgtgccctctcgcatgcccttcttcccttgtttaccttttaaactcttattcatctttcattcttcattctctgtaaaatcttctctgattcctcaaattagaattaaaggctctatctatgctctgtgtttcttggagggcagatgggatcttattttatcaatctctatagcttctactagccagtgcctggctcatggtgagacttagtaagtacttgttatgtgagcgagtgaatgaaagagtgaatgagaaactcaagggtccaacaaataggaataaaaattcttggggacagcaggaatagtggttgttgttaatgcctgaccccactgctccagtcacccaagaggaatctggttctgcttcactagggcagttaggagaggcatcaggaacaaatctagaactcaacctgggaaaaactgggcaatggagaaggaaggggagttgtaaattggccagtttttttttagtcacagtatagacacaatgcctctccaaccatccccaacccaagtagtagtattggaattttagagtttcacagagtattcagtagtggtaagaacagcagtattccagtcttttctttctctttcatattttatttattcatagcacattatttgtgaatgacatattatcataaatataaacacatagcctaataatgttatagaatagatataacacccagacacagaactgaaacataacagaactggtttttctataaacatcccaaatttttttgcatctacctagtatcctttgtaggtagttcaaatatgcttttcttgttccaagatttctagaaaccccttttagactagctatcaaggcatgtaggacccacacaagggatcattttttaaaataattgttctccgtaagttttacccagcttattcactcactcttttcaatggagatgatgcaaatgctattcccgaaaaataattgactttcaaaggacaaagatttggcactattgaggctattcaaaataatgagatgttgcctctagaaacaattccaaaagaagtttcaagaatattttgaacaatggtaacgttgtgatcatagatatgttgatgtgctttagggacaactcttacttggaagtagctattttggtacatctttagagaagccagaccaaatcccagctggcgaaggaggctttttgaacttgttgagaagtttggtggactaaggggtat

SEQ ID NO: 62439 - DNA, 1056 bp, Homo sapiens
ggtgcacactggtagtcacagctacttgggaggctgaagcaggagaatcgcttgaacctgggaggtggcggttgcagtgagccaagatcacgccattgtactccagcctgggtaacagagtgagactccgtctcaagaaagaaagaaaaaaaaaaacaaaaaaccacgtcagatttattttattaattcaatttacctttgaactatcttacagggtttctgtgaggattaagtacatttaaagtgtttatagctgtatttggcacataagtaggatttatataagtgttaggtattactgttattgttgttttggcatttctttgagtgattctcataaaagatattgaataaaaattttcagttcaagaactgcaaaatgaactaatttatgaccttggttcagaaataaactgctcctgcagagaaaaagcaccccgacagcacaggccagaagcaatggactcagaattggagtcattgactcagacggccacctcagctgtgaaggtgcctttgtcatgttttccaggaactccaactccttaccatgagcaaattatttatgcatgtaatctcactgaatgctcacaactctggagggtggtttattactattactgtttagaggcaaggaagccgaagactggagaggtgaagcaatttgccccaggtcatttgaccactgggtggtagagctgggaatccaggccaggtctctcaggcctcagagtctctgcccacacctgtatttcaggtacctccaggtggtagccagtacactgtagtgggaagagccaggagacctaggtacaggcccagcaccgtggtccagccatgtgacttggaagggttgtttaacatccctggggctcatctgttaaatgaggagccaagattgaatgacctctctcccaaattctactcttaagattctactgggccaggcatggtggctcacgcctgtaatcccaacgctttgggaggccgaggcgggcggatcacgaggtcaggagattgagaccatcctggctaacacggtgaaaccccgtctct

SEQ ID NO: 62440 - DNA, 1056 bp, Homo sapiens
aaccaggtgtagcagccaagacacaaactcagtctttccgattccccattctgccttctttatactgcatcctcctaagaaatgaggctgccggagcttgtagagagaggtagaaaaataggaagcctgataggcttagggttctggttgctaggaaatgggtaaaggagaacttttaacgctagaaagctctgttctgagtcggtaaatatttgagtgaccaccgagtatcaatcagccaccttattaagctttgtagggggagactgaggcttgattttgcccttaaggatttaaaaatctgctggtgttacacaatgctttgagacaggttaatgctgcccccggggggtctggggagatggttctggccgtcacagatgtggtaggaatgggtagagatggtggaaaggagtggagagaagtatggatggtagaagcttactttccacacatcctatcttcatttcttgattcaagtgattctcttctgtaccttggacagctcagagcatgggcctcagtttccccatctgccaagaagatttatattggagtgcctctcaaattttttacccctaaccctctctgatgaatttgttattcttctcactatcatttggatgtttgaagccccacagacacttattttctccatttggattttgccacgtgcaaagaccagccagagagatgaaaatgggtaggataaagtcttatgctaggtaatagacttagaataaaaggactagaaattgtggaaagagaaggtggaatcattttgtagcagagtgtgacatgaaggacgctcagaatcaggtttctcatagataacgttttgtctgtgcatagcatttgttaaaaaaaaaaaaaaaaagtcggccgggcgcggtggctcaggcctgtaatcccagcactttgggaggctgagacgggcggatcacgaggtcaggagatgagaccatcgtggctaacacggtgaaaccccatctctactaaaaatacaaaaaagtatccgggcgtggtgttggccgcctatagtcccaggtactcggg

SEQ ID NO: 62441 - DNA, 3079 bp, Homo sapiens
gacaacgggccgcttcaaccctgccttttcctttggggcacctcaacaaagggttacagtatcctcccttacctaccagcttgacttgttcctctcatctccctggcatcaacttctaatgccctggtaatgtggagacacactgaactacccccagtctatgtttgacagttgggtggtgtcctgctccttagggcaggattggaggcgacccagccagccacccaaggaagatactaatgaagcccctgctttttgcctcaccttttcaggatcccaactcaccagaggcagtttgtgttgagaacatgacaaagcctcatgacaaaatgaatgggggtggggccaaggaactgcatgaagaaaccagaaggttgtgtggaagtaagagaaaggatagcagcctagggctttaggaccggctggaaaccaagttgagtgtggagaggatgaggggtagagtagttcaggacctgaacgaaagatctttgtagacaaatgttaggctctgcaaatgggttctgcggcaggactgaggtgggattctgtggtgaggttctgtgagatctgaccacctggcccccgtatctccctccactggtggcaggtgatgtgctggcatccctaggcagcagtgtatctgcttcctgtctggggtgtgagctgcatttattctcagaatgatctttattgataagacttgagctggccttcctatcatggatgtggaatacattagtgaccttacaaagttggtgggaacagatactttaccttcttaaacaggagtttaggagcagtgggtccccatcttttggactagctcttaacgttacttttccccgctgtagtgtagcacagccactccccttcactgggggacctcaatgagttggtcagctctcttggccttacatgtggcagttgttttcttgtttgcaggtgcggccgggtgtgtggcaacattacttcatgatgcagccatgaaccctgcggaaggtaatgattcctcaacctatcactctgtgggcagctgcacctgtatttctttacagtttgcagaagaaagcacatcagttttggtgggaaattctgttaccttgttttaccactagagggtgctccctccatgtttttggtacctaacgaggcaccctcttggacaggaagcagattcactgggattttactaatccctggggcttccctagaaaaagatgtctccatgtggcctgtttttgggctttcctgggagcctcctttgtcgtagatttgatctgtcctgaaagtttagcagattcatttttcttcaaagaggtgaagatggattctgactttttttttcccccttatgatttgcaggaattgacacttaaatatattgcctttcttattggaatgaagctagttgggataggaatgaaaggttaaatcatagaactcagtccctgcatttctgctgggatcttggcttttcagtcggaggaaaattctccaaaaacattctccatgtgaggatgagcaaatatgaagggatagcattgttgccacgttcattttctgtctgggcaaggccatggggtggaaagagccaaagctaagctgaagctccacagagctcacaccatgttatctacttgagggagtgggaggtgtttgaagactaaagccaactctttttggctaagaatcttttctttggtagaacttctgtctcctcccctctaggaggatcaccatctcacattttaaaagttaggtgctctttgtatgcgaggattgggattgttaggggcctgtgttcgtgatgatcactatcatggagtcatttcttgttgggaattgttagagggtaagatcagagataggtacttagttcaagaagactctctgaagctcccaaactgtagatatgtcctgtgtgcgaactggctggctttacagaagtcctgatggaagtgggtttattgttttttgactcgttaccaaccctctgcttactccttcccctcaaaaaagggaagctgacttctcaggttagccagcagctcactcatacttttttctctctctattccattggctgatctgctgacttggggctctgaatctggatactctccatcaccggttggctgctgtcaccatttccttcctcgttgatggcactactagtggtcaagcagaggatgcagatgtacaactcaccataccaccgggtgacagactgtgtacgggcagtgtggcaaaatgaaggggccggggccttttaccgcagctacaccacccagctgaccatgaacgttcctttccaagccattcacttcatgacctatgaattcctgcaggagcactttaacccccagagacggtacaacccaagctcccacgtcctctctggagcttgcgcaggagctgtagctgccgcagccacaaccccactggacgtttgcaaaacactgctcaacacccaggagtccttggctttgaactcacacattacaggacatatcacaggcatggctagtgccttcaggacggtatatcaagtaggtggggtgaccgcctatttccgaggggtgcaggccagagtaatttaccagatcccctccacagccatcgcatggtctgtgtatgagttcttcaaatacctaatcactaaaaggcaagaagagtggagggctggcaagtgaagtagcactgaacgaagccaggggttcagatgacactgctgcatcctggtcacattctctgtctcctggaatgctcccacctcaagtggagttagaaggaaggtagaggggctctcccccaggattttggtgttttgactaacaccagttcctgccaacctctgttgccaccacctttccttccaggccctaagcacgtgcagcaaagcacaccacagcacctttgataacctctctccatcctgggcctgatgacctgctctagactgttatagagggataagcagctcattcccctggttcctaataaaaagcctttaaattaaatggtttcattgggtttgtcttgctaaaggggaagtgaaatgctgttaactgttcttgac

SEQ ID NO: 62442 - DNA, 1049 bp, Homo sapiens
ggttttttgttggtagcaggcaggagaaaataaccagaggaatgtggattgcttgcagctaaccgggacctgttcatctggttagtttcttttctcccatgctcttgaggaaaggtattactcttggattccagttggccaagaggaaggttcaagctttttttttttttttttttgagatggagttttgctcttgttgcccaggctgccgtgcagtggctcaaaccagcgaaggctcactacaacctccgcctcacaggttcaagcgattctcctgcctcctgagtagctgggattacaggtgcacaccaccatgcccggctaatttttttgtatttttaatagagacggggtttcaccatgttggctaggctggtctcgaactcctgacctcaggtgatctgctcgccttggcctctcaaagtgctgggattacagacgtgagccaccgtgcctggccgaaggttcaagcttttaaatccaaatagaatctagtgattagattgatgcagaaatttaaactgtacttgggcatcacttgcttccattggctcaccagtgattgtagctgatacagttatgtgacaaaagattcattcatttagcaaacaaatcagaggtgcttattgtgtgtcaggcaccagacattgatttttctttttagacattgattttatattaactattagtttccatgttactttaccttgaattgggtcagtagatgagaaattttcctggggagacacactcttcagaaaaggtctaatttagggaggtgttttgaataagattaatttcccaaatttcaacaaaactttgtccaagaacatcatacaaagtgtctaccctacgcttttattccaatcatcaaatcctttagagagattccaaggattatgtttcactgagactgattttatttgctaatgccaattttgggattcaatcagtttaaattagaaatctggaagggcccttcaggattggagactagattggtttctagctagacactcccacctttgcagtttcagggtaaactttct

SEQ ID NO: 62443 - DNA, 1803 bp, Homo sapiens
ccgcgcacagggaccgcagctctgcaggcgctagtgaggggcccgaagtcggcccctagagtccctgggcgcgtcgctctttctgtagccaatcggggaccgacgtggtgcgggccaatggccgcggtcaaagtatcaagagtggttgagcctatcaaagttcagccttaagtttctcccgcccttctaaaagtcagaggcgggttgatcgcacatgtcggccaatcagtgaccaataaacaagaagcttctaagatcaaaggggaaaaggtgggatgtaggcgctagcaacgcctcagggcggaggaatgacaggcgacttcgctaatactaccggctgatttttcgtacgtaaggaaaggggtgggtctaacttggcgtctccaccaatggttgcttggggggcgtgtccgcggggccaagcgggagccggaggccccgggctctctgggccgcgcctgaggcggacactacggggccggggggcggcggcggcagtggtggcagcggcggcgggggtgggcgccgcagctggcccgggtggatggagttggaggggcggggtgctggcggtgtggcgggggggccggcggcagggcccgggcggagccccggggagtcggcgctgctggacgggtggctgcagcggggcgtgggccggggggccggcggcggggaggccggggcctgcaggcccccggtacgacaagatccggactccggcccggactacgaggcgctgccggctggagccactgtcaccacgcacatggtggcaggcgccgtggcagggatcctggagcactgcgtgatgtaccccatcgactgcgtcaaggtgagacctgcacccggcttcgaacccgacctggggctgacccgacccctgggtcttgtccggagccaggatcccggctgagagccggagccgacatgggttccttcctggctcctgccactaccacatgattcgaaccgacactccattcaagcaaggtcccagctgggagttgatcccagtcaggaaccaggacctatttctaaccgtcagtgaaatctgaatcgggactcaggatcgaaaatctgtcagccaaagccctggaccccacctgggactaaacaggaatagggtgggatggggtatcccgaagctcaggtaagtgctactaactcgattaaggtgaagccaactggcgtgaaccagaccctgaaatggatctaacggcttgagatgttttctgggctagtgcttttacaaactccttgctgtatcttcccttactgacggggcaggaacccgaatctgggatctctcagctagataaaggacttacatgttaaatcttaacacatgagtgattggaaatcattgtgcagtgagaatgcagaattccagactggaagtaatgtgggaaagatcgtattcaggaataggtttcagtttctctgtgaagcaagcatgataccccacctatttcctgaacatgaaaattgagctgggattaggactgtatgttcagggagcacatcagcctccaaacaagagagatgaaactgatagcatatttctttggccacctgaagttggcaaaaagggagaagttgcctagaaaggaagtgtgacggtattagaaagtagatgtaagtatgaagaaaatggaaagagatcaacaagaggacacgattcttgtgaaagtaaaactaattgcattcacaaccaagcaggatgatttatgtgtactgaagtcaggtccttctgaagaaagctgggtgaagaaagaaacagattattgttctttacagttc

SEQ ID NO: 62444 - DNA, 1062 bp, Homo sapiens
gtgtccttaacaccatgaggcatcctatcacctcagaccacttgtgctcagacatgagaaagcttgttaagcaattgctgttaatgggaatctttgttacagcaggtgaatttatatcctagagaagctgctcttccttagaatgcatttccccctttgttcttatcaaatttctcattattgaaggttcaaaacaggtcctactgctgcgtccggcttacactacccccttctctgaactgccatcatacctgggcatgtgatatgagtgtagtataaaatgagattgattccagcagccacacatgaaaataagactgctaaccttacagccacttaaaaagaaactgattcctaaatggtgaagaaacagaacataagagctacaggaattcagagatggggtaagcagtgaggactgaaaggatcaggagatatcattatttatctcattagttttcaaactggagactgtgtacaggaagactttccaagggttatttaggaaacattgtttcaagggaattaatttgctactcctcatctggattaattctttcctaaaattcctcttcctgaaaaagccgttgaaacaattcttctttcctttctcccctttctcaatctgtccttttatcttacaaaagaaaagtgtgacctgactcacttctcatcttattatcatttattcgctgggtgcataaaaacacccaggttgtcaaacaatccttgtgctggcaaagccttcaatcaagatataacagtagacttcatgtctttccctgacttacatatattcctgttaagggcaaaacatggctttaagaatggaaatttcagcccatgtgggatattctgtgtacataaatatggtacagtggagcagtgtttttttttttttaatttgtaattctcatttattgaggaaaatataagtagagggcagttttcagtcccaccgttagtccttcttccccagattccttattccacttttgtctgtctgatgagtcactttcattctttaaccctgccctttgtatttttttaaaaaaataatta

SEQ ID NO: 62445 - DNA, 1031 bp, Homo sapiens
ttttaaaacgatatttaagcactcagttgtagaaatgtttcagacttactaatgtttgtctaatttcaggatcagtttttcctacctctgcccagcctcctggtacttcactgtgcccacagtgagtccatttctccgtcagcgggtggcattcctgggactcttcttcatatcctgtctccttttacttatgttaatcatagactttcgacattggagtgcttcattaccacgagataggcaatacgaaaggtgagtcagctttagattttggcactcaagtcataaatattttcataagctgtttaacacactactgactttgacccttttgggtgatactgtacttttattagtaaaattgcatgccatttattacataaagaagattttaagccctattttggcaatatgcagtttggtacaggaatactgatactgcatgaaaggcatctttgtgttttcttgttttggtgggctgaaacttattgtgtgtataaatgtttaggactgtattatacctttatgaatggacccctttatcattattaaatgattttctttatccttgattatatactttgctctgaaatctactagtctggtattaatatagctactccaactttcttttgattaacattagcatgacagatatttcttctatagttttagttttagcctattggtgtctttatataagtgggcttcttgtagtcagtgtttggttgggtcttgtttttttatccaatctgactatctctgcagttaattggggtgttcgggccatttatatttaatctgattatttagtatgtttagttttaatcttgctatgtgtttttcatttgtcacatttgttcttgttctttttcctctttttccctcttcttttcagttgagcacagtttttatgtttccattttatctctcatgttggcttattagatataacttcttctttttttagtggttactttaaagtttatagtgtcatctttaattatcacaatcttccttcaagtaatatt

SEQ ID NO: 62446 - DNA, 1042 bp, Homo sapiens
gagagaagctataatttaatctgtgaggaactaaatgacaggagattggtgctaatacgggggaccaagctttgtccaagtgaagcaggcttcgactccttctgagaggtctggtgtgttcctagaatctcaccttttcttcccttgctaaagcatgaagtttggcatttggcacactggaagcctggttgaaatgaaatttgtagcatctgatacaaagccagagacattctagcaagtgcagcagccccttctttctctgtaacagagatatcatttatgtggagatccacaacctttaacagggatccaagatctttgcagttcaatcgaccacataggaatttccaggcaccaaaatgatataacttccttgcttccttgacaaagaagccatcatgggtgtgatccaagatccctgtcgtagtgttgatgatgttagtacatgattttaaaggttagaaccccttctaaatgaatggtctgtggaagattttagtatcttatctgatgcctggtatgatgaggatagaaaatttttccatttttatgtgcctcacaggctgtttgggcattaattttgctttttgagccttaagtgtgttagtaggatggagaaactgtgatggggactgggaacctggatttgtctgattttaggtcactgttccctgggcctgtttttgtgagcccttacacaggaagatataaagagagttctttcatttcactgctaaaatcagtatgtagtatggggaatgtatttgggttgtttttaaagaaaaggggaacagaatcaggagagtgggcaaaggcaataaaatcaaagttcttattaattatttctgagaaatagaagtttctcaatttatgactcttggaatgtctgaaagggagcaaatttggaatagatcaatctgttaataagccatctggcaactttcagaacctctattaagagactgctgagtcacaaacagcacttccattaatgaagcgagaggaaaagccataataattacatcttcacccactacccttc

SEQ ID NO: 62447 - DNA, 1189 bp, Homo sapiens
tcacttccgtattcagtcaacaaacatttattgagcatttggggaagacagataacgcacaatagaaacataatgtgctagatgatatttagtgccatgaagaaaaataaattagggtcaggagacagaaagtgggctaggatcatcaagcgaaatctctttggtaaggtgacatctgagtggaagctgaggaaataagggagtcagtcatgcagacatctgtgggagagcatttctaaaataaatcagtagcactcagtggcggggtgaggagggcatcaaaatcactaagggaatttttctaagctaataagcctctccccctccccccacaccacagcctctactccacttctctagaggaagcagaatcttggggtgggagcaggtaaggatgcagagatttgaagtttccttggtgattgtgatgtatcttctctgttggagaactcctgttgcagatatgtctattattctctgactgttcccttagtttaactctgggataacagactttttctatatcagaactagtatttggtctcttcttcctctcattttaataaataccatttaccttggaatacaggggcttttgtggcagggctagatgctgggcttgtttataactcctttcccaaaatgggagaatcctggatcccggaggacctctttaccttctcccccatcctgaggaatgtttttgagaatcccaccatggtgcagtttgatcaccggattctggtaagtgtagttggtggttacctgccagagagcacaggagcctatcataggctttggggtgtcagtgaagcactgatggcaacactgagagggtagagcaggaactatatttcctgctctctttggaagaaattttaggaccatttctctaatctaatgtctttgtcctcattattcacccctgtccccctaccccaaccccagccaaattctagctttcaggacgttgccagcttcttaaaagttcaaatgtgccttttaccacttggcaagtgataacctccctcaattctgcacgtacctagaaagtcatttcagcagaaatgtggttgagtagagaagcgaatgcggagaccatagctgctaagcacgtagctctcggagctaaaccagaagctcaaggagccaggagcttcaccagtacttttcattctatttaagcgaa

SEQ ID NO: 62448 - DNA, 1030 bp, Homo sapiens
gaggctgaggcagaagaattgattgaaccggggaggcggaggttgcagcgagctgagaggttgcaccactgcactccagcctgggcaacagagcaagactctggctcaaaaaaaataaataaagaaagaagggattaaggagggagatgagagagaagaaatagaggcagcagaaacaataatcaaagtctaatagtaaccagagaaaggcatgtagaacaaaatgaaagttaacattttagaattagaaaaacaagccaacactgaaaacactattagggaggcagaaattaaagatgtcagataaggtatgggagaagaaagtgggctagtgaatcaactgtgtacgtcttcatctttcaatgtctcttgcagatgaaatcaaggtaattagaatatccagggtaatcttgaaaggggagagaaatgcccaaaaagatttcctgaagagtatatatttagaagtggcagagtccacctctttgacctgattctactggcaagtgggagtgaaagggctgtcttatttcatatgattggaactaacaattgtttggttaattgaaaaagccagttaaagcagagaatcatagaatatgatacataacataaacttttaaacttaaatctgtacgttcattaccaacttttacaaaatcaaggccttttctttgactatgcgtccccagattggcattcaactgcaggtttcttatatccccataaactgtggttttgcttaaagcggagtgggaacttagatatttgcaaagcgatctgcatgcaaaaccttattgatttttatgattttcccctgaaacttttataattgtcttattccaacctaacttgacagtagatgtttttaagcatttacctttattaagtttctccaaaacattcaatctagttttatgagatatatccatggacctttttttttttttaaagctcatcagctactgttagtgttagtgtattttatgcatggcccaagacaattcttccagtgtggcccagggaagccaaa

SEQ ID NO: 62449 - DNA, 1035 bp, Homo sapiens
gctagggcacaatggtgcaattggctcactgcagtctcgaccccttaggctcaggtgatcctcccatctcagcctctcgagtagctgggactataggtgcacaccaccatgcccagataatttttgtattgtagatatggggtcttgccacattgcccaggctggtctcaaactcctgcgctcaagtgatctccccacctcggcctcccaaaatgccaagattataggcacgagccactgcacctggccctaccttcactaatttcaggctgccagtggattaacaatctgacttgcagaattcttgagtgtttaataattggcctttgtaagccagtacaagctaggtccagcatgccactgcatgtatactacattttgggaaactctgcgttagagatacctgttcaaaattcacatcagttttatttatttcagcctttgacatggttcatgatccaatggcagctctggagaccctcttaaccttgggatttgaacgcgtgttgaccagtggatgtgacagttcagcattagaagggctacccctaataaagcgactcattgagcaggtacgtggactttatctttttttcccctaagactctgttgtggttactcctgacattctgctgtttagccagtttgtgagactatatattactgactttgtggttactctgtaggaaaagcaagcaggcaataatgtatataattcttatttctttcacacaagcctttttaataaccaaggctttcaagatcaaattacatatagatagtgcctaaagatctgatctaacttggataagcacagcaaattttaccttttctctgccatgggcattgcagttttttttactttttatttttattttttagtttagatataaggtcttgctgtgttgcccaggctggtctcgaactcttgggctcaagccatctgccttccttgccctcccagagtgctgggattacaggcatgaggcactgcgcccagccagcattgcagttttaagccacatcttttcattg

SEQ ID NO: 62450 - DNA, 1025 bp, Homo sapiens
cttccggggctgagttcggtggagattaggagatgccagctgtggcaaatagaaaatcatggactaacgacaaagtcaaaatctctctgcttgtgctcgttactgactttaattcttgagatcctttgtgtccttctctaggccagtgtttccacagagcggctagagaagtacttgggaggggatgacttggacacatctgccattcgacatgactgcaattttggtaaataaatttggaagttgcttcccaaacttattcgcagtactggtgccagaattttgataatacaagagcttagtagcagcaaactgagagagagtgtggagatttgtcttgagcctatgcttgcataagatacaaactgttcttacttgaattatgtttacacttagagcagattgctcaactagattgctaagtaaagctgggccagctcttctgaggataagcagggaatcctgcaaaagatccagaaagcagaagtcaggatagagccaagtgtgtgggattgggaaggtagcctggagtgaaagaatactcagattctgaaggtttaaagattgggggccagccatggccagagtgggcataggactggaatccatagtggggaggatttatatatggaggtggaattcatacaaggggactgggcaacagagggcctgagagtatacccagagtatccataggtcaggaatctgggctaccagtaggcttgggagttctgaataaaaaaggactttagccgggtgcggtggctcatgcctgtaatcccagcattttggaaggccgaggtgggtggatcacctgaggtcaggagttcgagacaagcctgaccaacatggagaaaccctgtctctactaaaaacacaaaattagctgagtgtggtggtgcatgcctgtaatcccagctactcaggaggctgaggcaggagaatcacttgaacctgggaggcagaggttgtggtgagctgagattgcgccattgcactccagcctaggcaacaagagtgaaact

SEQ ID NO: 62451 - DNA, 1011 bp, Homo sapiens
cctaatttctaaagtccctaaagcactacattctgtaaccttgtttcttttactccattcccagattagttatgcaaaattcaactgcgttctacttttagaagtgtttagggtctttattttctgttgacccttcatctgaaagattctcttcccttgttaggtacaatcactgcccccccgcttttttttttgagatggggtcttgctatgttgcccaggctggtcttaaacgcctgggctcaagcaaccctcccgcctccctgctgagattacaggtgtaagccaccataccgcaacctcaatgacacctttctgatggtctttacacagtctgtgatgtctggtggcccccctgccctggactcaataattgatagattttcctagagtaacagtatgagagctccagccattccattaaaagtattagttctgctttgagctgaaaccagttgagcctaatggaagactggatgtctttcttcttcatccaagcaccctaatgactgtttagttacatccatagatgcagacaacataacacctgtgacttacttgaattgggataagccattccagaagtagcttatcctagacttggaaataagatttttttcaccactaacttccatgcttcagagatgacattcaaagccagattcccaagtgcctgatcatacctcccagtctcaggaagatatttgcttaccccttagaccaagaatcttaagatcttccccagctatgaagcctatcttggaatgggaaaccatgaaatttgtcttttaaaagaaagggaagaaatagccttacagcccctgttcctccaagtgcacatttagccttaaaatcctgggagtcgggagacaccgtggagtcctaacatccacagtgtctgctggtcgtggtcagaaggcagtaatgcaagagtccttttgtgaagagtgtttctatgtagagatgtttatatttaagtagttcttttataaataaaagcatttctaatgg

SEQ ID NO: 62452 - DNA, 1001 bp, Homo sapiens
tttgtagtatgcccatgctgaggaaagtgcttttctgacttactccctagtcctcaagtaccgtaagggtgatgaagatagccttatggagaaaatttccaaactgaacatccactccatcatcaagaaatccaaccgagttagcagtcacctgaagcatctcactggctttgctcctcaggtgagatccccatcctggaaggcttagcgcatctttgacagcttttcagggctccatgagacagcctgcctggcgtcaattggcgtggttcccttcctcagacgtcctccggttttacgagctggtggagacagggccctccagctgctggttacaaaggcaaattagagggtcagatcagttgacatgtaataattatggtagttttcaccacctctaaggagcttataattgatttggtgggacaaaactatagttgtagacttactaagctagcaggaatttaagagatcacctagttggatacatgatgttacaaagaaggaaacgttaagtgtaagagattgaatggattgaaaaacagtttatcggcgatgctgaaagttgacctgaagtctgcagacatcattctgctatactatatatattaaggtacaattcatggaaaatataagccagaaaatagtccattgttaggttttgtattttgttctccaaatgctgtagtattttagaaaaacagttcagtgagagcaagagtcatgttgacctgagccttataggaagggggcaggcatgccacagggagggagaagacctgccaggcaggggaacctcatgaggaacagtcctaggttcagcagacatggcagtgctggggtgaagagggcagcctggccagagcagagggcttgcaaagaaggtttaaaggagggcctgtgtgtattttggaggtcttttgaaaccacatgcaggtgtttaaatcaattcactatgattcaggaaaacattaaaggtttaaaatttgaacaaaagatgt

SEQ ID NO: 62453 - DNA, 1018 bp, Homo sapiens
aggtgatgggaagttttattcgagcacgggcagtttcctcctcacctcatttatggagctcctctggagtccatgcatagacttttttctaagtgtctaattggatgtcttactacctctactaaagctaggacttcttgtcttttagaaaaccccaatctgctcacctttcttgtcctgtcttcactgcccatgcccagtgacctctctgggttgagtccctcacctcccctcctaaaacagtcagttgcccacccacccactccttcttcataacactgaatgcactcatcaggtctcttgaggccctaacttgagcattcagtgagtatatatagcacagtgactgtgctgagctcatttattattcatatcaagatataatacagtgtaacctttttgtctttccattcttctccacactttaaagttatctaaaatcatttctctgccttctacttcaactgtgtcacccgcattaggatgggatgttgactgtggcttctaaagctctctggtcatccagccctttcccttggttcaaatctcctaatgcgatgtagtctccaacttctacaaccaggtatacctttttgctgcctcccagtcttccccttgccacccttctacttttatctctacacttttctgtaggttgtgcctaatgtttaacatggtaattaaattactgctgtatagcattttactatgggagacgattggatatcaatatctcatttgtgtatggcaccatttaagatggccttacaagtattgctttctgcattttattgaagaggaaaatgagactcaaggtaaaatgactgatttaatgccataccttaagtggcagacccaggcattgacttcagatttccttaagttctttcccttaacaccctctgctgttttcctccttgtctctggcccctctcctggctgcccattgtctctctgctgtgcttcagatatcatgtctgtccataaatcattatttggattaatattttgttataag

SEQ ID NO: 62454 - DNA, 1050 bp, Homo sapiens
tcttcctttatagacaaacctagaagtagactcaccttgctgggttttctttcgtagcacttatccccaagggaacactttacttatctgtttattgcctatcttctcctaccaggacagggacttttggggttactattaaatccccagcacctagaacagtacctggtgtttattagatgaatacatgttgaatgactgaaattggaaagtagggtaaaagaatagagagcaatatttaggaacaaatcctgcccataggtgtacattattattatgttaaaaaaaagttttttttaaggtggggtctcacgatgttcccaggctgggcgctatattattgatagcttactaaagtcttttttccttctcttacaggggatgcacaaattatattaacctgggctccttcctcatcaaaccagtacagagagtaatgcgttacccgctgttgctaatggagttgctgaattccaccccagaatcccacccagataaagtgcctttaaccaatgcagtccttgcggtcaaggaaatcaacgttaacattaatgaatataaacggcgaaaggacctgggtaagaacagcataattgctgaaaaggaggtatgccctttgagaatgcttttcttctcaaaacaattcattacttcgctagagttggacaaggcaggtggtaggtataatagggctgtgatgaagaaatggtagaatttgggggaaatatgatattttattattattttttttgagacagagtcttgctctgtcccccaggctggagtgcagtggtgctatctcagctcactgcaacctccacctcccatgttcaagcaattctcccacttcagcctcccaagtagttggaattacaggcatgtggcaccatgcccagctaatttttgtatttttagtagagacagggtttcaccatgttggccaagctggtctggaactctcagcctcccaaagtgctgtgattataggcgtgagccactgcacccggcccaaaatgtggtatttattaaaggcagaagtaacgataaaaa

SEQ ID NO: 62455 - DNA, 1092 bp, Homo sapiens
gctggcaactccaatcacatgcatactagttactcattatcttctggcctctggagaaagatagagtagctcgctgattggatcctgaggttgaaataactccacatctcactgcgctccgactagagcaacgagaagagtgtctggaatggttgggagacattttaagcaggacaaatccagccttaggctagactgcacctgtccacagcccagcccaggcccatggaaaagaatagtaaaacctttgtctttaagcacatagaatatgtgtgaaacccagaaggctagaaaagaaagggaagtggaggagaaaaggcactgggactccagctgggagtatgaagactacgggagtgtacggaaaaggaaccttacagtgctggatggactctacagagaaaatgacttggatcccaggtactgggccaagggacagcatcagccctacagaaaaagggattgtggatactgggattttgaacagagtgaaccaagctatatggactgtggggaagcacatgaaagtggaaagggctgtgtgtaccacggaggtcatgatggttataggagtccagaaaatgtagattatgagagtctcagccctgggacgaaggataattcacctacgagaagcccagatgtgacctcgaaagctggtggatacggggaggcaaatggctactcagactgtaagaatctgaattataatcctgaggactctaaaaaagctgaacagttgactgactgtaggggtttggatgattcttcagcgaatttaggtcaacctcagttgtggtatatagaccatgagaatgttaaccataatcttgaggattgttgggcaactaatttttattgtagagaacacagcaatttatatcatgttcctgggagttatcctgatggtcagcctgtgagcttttcagattcgaatggtgtcaatgaagataaggaatttatcaaataccatgaaggggacaggaatgttcatcaaaatgacaacatgtatcccaaagcaaagactcatattatggatcagggtgattttgatacagaaaataaaggctatgatgctttatttgcaaactg

SEQ ID NO: 62456 - DNA, 1036 bp, Homo sapiens
aagctctgatcaggactacctagtgctaccctatctcttggtgaggttcacacacctgaatttgaaaagagggtgtgcattcatttctttattcagtgtatatttcttgagcacacatgatgagccaggcactagctacacgttgattaatttaaaaaaacatagtcatattatcattcatatttatgtgtgtttgaaaccccagtgatcatattgatattgacctctacagctaattatgctctttcctgctgccttggaatcatgaccaatggctactttcggtgtgggtcagttccggaaccccattgttctaaatcagtgcaatggatgccaaactacagagtgagtcaggaaccttgctcctcaactttcctctttttggcctttaagataatgtcaaaggaaggttgaccagagactctacaagtaattttcagtgatgtctgttgcaaattaaatcagaacatgtttttcaggaaaataatatttccccagtctactgggtagcatctaagatgcactaaagacagccagtagattaacaagctggagaatgactgatatggaacaataacgtctttatactaaagtgatacgtaatattctagacagatttttaaaattttaaagtgtaactgttttatatgcagaagcaatttgtcattctgcagcctccttggaatcccttaggtataagaattatttctcagccgggcatggtggctcatacctgtgtgtggtagttcatgcctcccagccctttgggagaccaaggtaggaggattgctttaagaccagcccaggcaacatggtgagaccccgttcctaaaagaaatacaaaaatagctggatatggtggtgtacacctgtagttccagctactagggagactgaggtgggaggattgggtgagcccaggaggccgaggctgcagtgagctgtcatcatatcattgcactccacactccaacctgggtgacagagtgaaactgtctcaaaaaaacaaacaaacaaacaaacaaacaaacaaaaa

SEQ ID NO: 62457 - DNA, 1026 bp, Homo sapiens
acactctgaaaactacaggtttatagaactgctccaattcaataaattgtcaaaattgttcatgctcctaaagctctaggtgtatttccttgaatttggtagctgtttaaaatgagaggttgcactattagtcgtgataatgttctgctgggtgatgactgaggtcaccatctctgctcctcttttctttaggtgacctggtgattctcgatggcattcccactgcaggctggctgcagggccgaagctgctggggcgcacggggcttcttcccatcttcatgtgtccgcgagctctgcctctcctcacagagccggcagtggcactcccagagcgccctgtttcagattccggaatattccatgggacaagcccgggccctaatggggctttctgctcagctggatgaagagctggacttcagggaaggggatgtgatcaccattattggagttcctgaaccaggctggtttgaaggggagttagagggccgaagaggcatttttccagaaggttttgtagagctgttggggcccctgaggactgtggatgagtcagtaagttctggaaatcaagatgactgcattgttaatggtgaagtagatacccctgtaggagaagaagagatagggccggatgaggatgaggaggagccagggacctatggggtcgccctgtacagattccaagccctggagccaaatgagctggatttcgaggtcggggataaaatccgaattctggcgaccttggaagatggctggctggaaggatccctgaagggcaggacaggcatctttccttaccggtttgtgaaattatgtcctgacacacgggtggaggaaaccatggctctgccccaggaaggcagccttgccaggatcccggaaacttctttggattgtttggagaacaccttaggagtagaggaacaaagacatgaaaccagtgaccatgaggccgaggagcctgactgcattatttctgaagcacccacttctcccctcggtcatctgacttcagagt

SEQ ID NO: 62458 - DNA, 1052 bp, Homo sapiens
tacatatataatttgtggaaagcatctcaagattccaatacaagtttatttcaccattaggtcagctttttcctcctggcattacgagtcagaatttaaatagctgatgtgaaaaatgagagaaagagccatactcaggatgataagttttgttgtcagcatgattgtaaatataagatatgtaaaattatagtttccttactctgtggatcggtctttacttcaggcataaatcttactaaattatatctcaagaaatattgaggtggctcgtcagtagagccatagatagctgtttagcagcactaactgctagggtgttgggcagtgaattctcatggccagctcttctctctctttctttttctttctttttagactagccattttttttcctaattgtgaaattatacctctttattacagagcatctgtaaaatatagaaaagcgaatctataatcctgccttttagcaccaacccctgctaaaacgttggttatttctctgtctctgttttttattggggtgggggagcatgttgaggaggagagggcacttaacattgcactatatcattttctatcacccctcctttttcagggctagatcattaactcatgttcattttgctttgattggctctctggggaaaaatcgatagaaaacttacaattaacttgtagcagtggggtgatagcttgctcctctcttggaacagtttatgcctgagggagcctccgtgcacaaacagcccagagtcattgtcagaacttggagcaatcctagccctaagcccaacagaccaaaaactagcttaagggtgtggaggggagaagtacttttgaggtctctttgcttcagttcagtcctcccaggttgtcaccttccttatctagaccacacttgctttaatctttcagaaaataaatagaatggagaaaatagtcatttattttcttttgactctgaaaacctagcacaggccacgtacggtggctcacacctgtaatcccggcactttggtaggccaaggcgggcggatcacttgagc

SEQ ID NO: 62459 - DNA, 1058 bp, Homo sapiens
ttttacagatgttcggagccttacggcataggaggccgtgattctgtgtcagggagacagggacagatggcttccgaagcaagggttagacctgttcagctggagatgcagctttggtcatggtggagttttgcagaaacccgcggacacccgcgttcctgctgcaggcacagatgtccaccgggcatctgtgtctcaaagggtggtgatgctgtcactttagtaaaggaatattgaggttaccaaacaggccggggcctgatgcagatgaggagtatagacttaaattttaagtgcaaaaacaactttaaatgcagtctcattattactgcctgtctcatttgtactgtaatgaagggtgaatatttttggcactcacttattctggaatatgggtaacttgcctttaggtctgttttatagtaattcttttacacaaacatgaagatcttgtattaaaacactttcataactaatgatgctgtagtatgtggcaggcgagtggtaacgctaatatttagggtttgagcatagtctagctctgcttgtttacatagctgagttaaacggatgagcaggactgattaatctgtagtagtttttgcaagactgaagtacctgacagcattcggggatcatttctcagttggtgttccgtttattactttcacagcatgaataccgacacggtgatcagcaagttagtttatcctctacccatttttctctaaaatattgaattaaaggatctctaaggtcctcttctgtctcgagttctccgattttacatgttaacttgaaacacgtcactcattgtgataataaaaatgttttaagaagaaaagatttttagaattctgcataatggggcatagcgaatcttcaaattcattattctcagctctctcagtcactttatcagggttgggctaaaataagtgaaaagtgacttttcaaattgcagatacttacgtgttaaattcacttaaattcagaggctgcaatggagtgatttctggagggtggagagtagctcaagtctggcttgggaacggggt

SEQ ID NO: 62460 - DNA, 1050 bp, Homo sapiens
agccagtgaatttaattttccatgagaaacaacagagttaacctgtggcattaggagacctacttcatgtggaccctttttttccttcagtttaacttttctggagcagtgtgctgcgtagttcggcctgagtttgtgcagcttgttaagacaactcttgtgtacgctatgttgaagctcaacaaaaaagtcatgggaccacttctagaaatctttcagctgtcaggcctgtcagtctcatgacagtttgttggttgtgccaaacactttatttgggaaaggaaagcccagatttgaatgggtctttcccctgggccttatcctatagaggcatttgtaatatggagaaaataatttttcatttttgctcatttaattctataaattctctttataaatgaattttgtgttctttagttctccttaaaagaacttttgaattataaaaataaaatctttacctgtcgaattgttgctgcagatgattgttgtggaaaatctggatcattgacctctgtgctttcattcctagagatgttttatagttacatgagcaaaagctgttgccccaaagtgatggccctggaggcggggctgaggaacagggaaatgccgctgtgaagtcttaaagcacttctgcttaaactcccatgtgtgaggagtgtgcctccctgtgccctctcagctctgaggctggccgtctttcggggtgttccttttggcaaatatacactgtaatcttgagtctaaatttatatgttgaaatgctaccttttttaaaataagaaactaaataaaattattttactatcagtgatttgtgtttttttttcccacgtcttcatttttctgtcatcttaacatgctcctaaggctgtcttgcacatttcaactagggagccagtttatttgcgggtttaacttaactgtagaggcttttgttatactcttgccagaatactgcctacctggtataagaatgtttaaaacaaggtgtccactctttgctgactcctggaatttaacaaggggtgttcttctaatcctttg

SEQ ID NO: 62461 - DNA, 1014 bp, Homo sapiens
atcaacagaaactccagaccaattccaggttgaattcaactagatgaaatgaaagtcactttagaaatattagttattatcattagttatcacaaattgttttccaactcccccatccttttattaaaaagtgaacagcttctcttgcattaagtcaggagcttaatgaaggaattttaagtcaggaacgcagctgttaatgtgatagccactctccaaagtgagagagggtcattggcagttattcagacttgactcatgatactcaggagagcaataggtgaaatgtatatagggagagagaagactgttgcaccagagtattctgatgcctttgctcttgtttgctcccacacagcacaagttgaccccggaatatctggagctcaaaaagtaccaggccattgcttctaacagtaagatctattttggcagcaacatccctaacatgttcgtggactcctcatgtgctttgaaatattcagatattaggactggaagagaaagctcactcccctctaaggaggctcttgaaccctctggagagaacgtcatccaaaacaaagagagcacaggttgatgcaagaggtggaaatgttctccatatcaagatgtggcccaaggggttaagtgggaacaatcattatacggactcttcagatttacagagaacttacacttcatctgttccacctctcctgcgatagtcctgggtgctccactgattggaggatagagccagctgtctgacacacaaatggtcttttcagccacagtcttatcaagtatcctatatgtattcctttctaaactgctactcatgaatgaggaaagtctgatgctaagatactgcctgcactggaatgttaaacactaaatatataacaagctgtgttttcctaagctgagatctgttgaataatgtttacattcgtcccccggggaaatgtatgctcagccaccattcaagagatgactgagaaggagatggtaagttcaagaagactgattgca

SEQ ID NO: 62462 - DNA, 1880 bp, Homo sapiens
cagatgctgaatattatgctgcacacaaatatgccacctcaaacaaggtgactggctccctggccactttcctaatgatgcatttcggggttttgctttctcttttcaggagctctgatatgatagaagtgattttatccattgtcaagaaagtgtagtgaccaagacatcctccagaattagtcagttagcaagaaatatttcacattgattgggtagggacacaggccaaatgccgtaattccattcatttgtactgctatataaggctgaataattaattaagttgaaggtcttctgaaataagagtgacagaagagtaaagtctatttagaattgctttccaaataaggtagtttttttggtagatacttagcttgattagagcagtatttctcatcaaaggcattcctggcatttggggttgagatactttttcattgttgaagaccatctcatgcattgtaggatattttgtatccctggcccttgtctactgaatgtcagtagtggtcaccagttgttttaactgccacacacacatgcatgtatttccatatgccccttgttgagtactccttgtttattggatttaaaaaactattccagtcatgaggaatttcatgtgggataacttgagaaggcaggttgggtgatatataggtgataatttggtgtaaggactggggtaagctggctagacggtacagggctagtgagcaggggctatttaagaggcagctagaactccgatagtattctgagaagggaagggtatgtccaagatttataaggttatcgtggagcagattggaacagataaagggttgagaaagagattactaaagtggatgatgcagtttgaaggattagagtcaagttttaagatatagacagggcttttaatttagaaaggaacaacataatccgtatttagaagaaatgataagatgatagaatgagagttgtcagtactttgaaaaccaatataaattttaaaatgaacataacattgaaagacacagttctatagacacagaatggaatttggccaaaagaaaggcatgacaggaaactccagttgaggaaactaggagtccaaatctaatgggagaagctcgtcaggcacaagtttcaagaccttgccattgaggtctaccttattcagaaaggggcagtagttttatgccattttgaaaaatgtgactcagatactaacctatattaaaaaggcttgaggaagaaatgtggttgtgcactatgaccagatttgattggagtgtttcgacagaggatatgaatcacctggagaagatagagatccaaagagtgaaagatgtcaaagtgtagaaaataaatgctgtaggactgtgaaggacaagatggacttttgcctgggggacaggccaggactcaagataaggagaggatcacagagcagggtctgaggggctttgaaaggcatatgttacagggaacagtggaaatgggttttaatcaaatccagatagattctggttagatacatcttggcatcctgatttagacaaaacaaaacagtgtgacagagggagatctggtggtcgacgagttttaatcaaacccagataggttctggttagatacatcttggcatcctgatttaaacaaaacactgtcacatagatctggtggtcgacaaacatctgtctgtcacaagcagcttaaacatccagcttctggggaaaggcagaaggccagatcaggtgacaacttgagattttattctagttctagaatttgttcaagaaaagcagaatcacagctaatgataagataatgagcaccagcccttcctttgaagttctgctctcatccactgacctgtgtatctctctcaa

SEQ ID NO: 62463 - DNA, 1049 bp, Homo sapiens
aaaatctcttttgatgcaacttactcatggtatctgtacagtaagtgtttatgttttcacatatttgaaaatctgtgagatttcccaagattggcaagcacaatgtagtatgttcttcagcctcattcagcaaaataggagtcttcaaaagacagtcctggccgagtgtggtggctcacgcctgtaatcccagcactttgggaggccgaggtggttggatcacctgagttcaggagttcgagaccagcttgaccaacacagtgaaaccctgtctctactaaaaaacaatacaaaaattagtcgggcttggtggcgcatgcctgtaatcccagcaactaaggaggctgaggcagaagaatcgcttgaacctgggaggcggaggttgcagtgaactgagattgcaccaccgcactccagcctgggtaacaagagcaaaactccatctcaaaaaaaaaaaaaaaagtcctactttacgcttcttttaataaggctaaaaagatatgtggccagtctcttaattaaatgcagtatgacagtgcttccttgaatcatattaatccatattggaagtaatcttatgtctgctagtcacatggtgaaatctgacatctcacaaaatctggtcctgaatttttatttgtcttctgcatgtctccactgagttgtgaggcctcacatgtgtcactgccagtgtgttgtgagttttttccacacagccttcagctgcttattccattccactgtaatccttatatttagttatgattgtcctcaaaattacctacaaatttgactcatctatttcatataggaaatgctatatcgcttaaaagttttaaaagcctttaaagaagactaagtgcttaaaggctttgttattcttaaaaggttagccagttttcagaaggaaaacttcttcagaccagcaaagtgttttttgtgtgtgtttgcagtataggtggggcggcggggtatcgtatgtttagtaaaatcaaaagcttttgagagatcaagtccttgatgtagaaaagtcagccttcaaaaaacag

SEQ ID NO: 62464 - DNA, 1001 bp, Homo sapiens
cctagtctctctttacctcttagctaaacttttgcagtaattgccttatgctttccctgcctctgatctttatgcttctcagttcatcttcacactgctggccaaagcgtaaatctgactgtcatgcccttgcttgaaacctttgatagttccttattacctccaaaataatggatactttagtgtggactttaaagttagcccctgtttgatgggctaaccagcaggtgtttggcattagtattacaaatgcaagggtatttggaaaattgagcacaagcaacacatcaagatttgttagttgtggtttttggtttcactattttgttggcacttttcctcatgtgtaatatatcaccctgacttttaccctggctgaatttgaaggtacctgtgtcattgttgggtaaaacaaacatgggttgtacctctccttcagtgtttgatatcgtgaggaactatactgcagattatgacaagaccttaatcttcaataaaatccaccatgagctgaaccagttctgcagtgcccacacacttcaggaagtttacattgaattgtttggtaagtgtcttaattcttatgtatgtaaatagccaattggaaatctttgttcagcttacttattgaggttatattggtaaaccttagtgctatttaagcatttcttctgaatttatcatagagcaattgtctttaaaatattttttatcttaagtttaaaattttttatataacttgttagagattggaaaaactactcagactgtattctgtttttactgtaataacttagtgaaaattagctttgttgatgttttaatagataatttgaaaaatttagaaacctgtgtcttgaggctcccatttttgatgatttggtaggagactgacaggactcagcacatagttgtgttcacagctaagatttattacagccaaagggtacaaagcaaaatcagcgagaggcaaaggcacaccagcaaaatgcagaggaaag

SEQ ID NO: 62465 - DNA, 1049 bp, Homo sapiens
aagcgacttgcctccaaaggagcctgcgcggcccgcggctaggagaattttgtcccatgcgctccccgtctcactagccgcgggccggggctacgccgtgtgcgtccccgcgcagccgcagtgctgggcgagtgggcggggccggctgttggcggcggttggctcggcgcgggagtcggctgcacgtgcgggcgggggcgatgcgtcactgatcggtgaggcgcggccgaggggtcggctttcctcgcgagcctgcggctgggcttcttctcagttagtgccttccacccgggagcgacccttgggagagggagtttcaggaagctcaccgagcaggggcggcccactggcctccgggggcggaggagttggcaaggggtcagcgggctcagccagaagggaagaatgaggggacaggggtactggactccccggctcagcctgcgagagagcgccaagtttccggagggagagggtagaaactggagggggtggacctgtcactcacgggactgagggtccttttctcccgctcccaggaggaacgagaatgaatatgactcaagcccgggttctggtggctgcagtggtggggttggtggctgtcctgctctacgcctccatccacaagattgaggagggccatctggctgtgtactacaggtgagcggcatgtgcagtcagttagggctctagagcagattaaaagggtactccagagtggagtctgggaagttgttccctctgcaacgttcgggggcgcatgtcccatctctagggagagcacgggggtcgaagcgggcttttgcggagcaccctccagatgttggacagttttagtgctatgttcgttttgttgcagagattaagtctccctacggttattcctatacacagcaaactcaattatttgtagaaaaatgaagaaggaagaaaggaagtagtcactctacctctaactgaagagatggataaattatagttcgttcaactgtacaggctttagtttgccgctgtagatgctgtatgtttatggttgtttcttagac

SEQ ID NO: 62466 - DNA, 1106 bp, Homo sapiens
caggttctcttcctggcatcataaggagttggtgtaatcattttaaattccactgaaaatttaacagtatccccttctcatcgaagggattgtgtatctgtgcttctaatattagttggctttcataaatcatgttgttgtgtgtatatgtatttaagatgtacatttaataatatcaaagagaagatgcctgttaatttataatgtatttgaaaattacatgttttttcatttgtaaaaatgagtcatttgtttaaacaatctttcatgtcttgtcatacaaatttataaaggtctgcactcctttatctgtaattgtaattccaaaatccaaaaagctctgaaaacaaggtttccataagcttggtgacaaaattcatttgcttgcaatctaatctgaactgaccttgaatctttttatcccatttagtgtgaatattcctttattttgctgcttgatgatgagagggagggctgctgccacagactgtggtgagggctggttaatgtagtatggtatatgcacaaaactacttttctaaaatctaaaatttcataattctgaaacaacttgccccaagggtttcagagaaaggactgtggacctctatcatctgctaagtaatttagaagatattatttgtcttaaaaaatgtgaaatgcttttatattctaatagtttttcactttgtgtattaaatggtttttaaattactttcttgatctctattcattataaaaatcagattataataaaacagttgaatatggcttaggaaaatatgaaggttccatgaagtggaattaagagcatagaataactgtactttccttaggaataataggacttatggtaaaggtagtattgggcaacttctttaagagtgttttcctctgagatgtcctatcaccactatctacatctaaaaaacatgctcgattcttgccctataaactgatgtcacagccccaccatccccatttttgctagtggtatcattttcctagtcaaccaaattttttagtcatcacatatcactgttcgtcatctattataataggcagtctctctcttgtttccctggttttagaagattttagtaata

SEQ ID NO: 62467 - DNA, 1576 bp, Homo sapiens
tttcaggtgcgtgccaccatacctggctaatttttgtattttagtaaagacggagtttcaccatgttggccaggctggtctcgaactcctgacctcaagtaatccacctgcctcggcctccaaaagtgctggaattacaggcatgagccaccatgtccagccagaatacattgtataagaaaattgatttcaattataatgtacctgtggtacttaactaccaaggattgggaactgtttgaccataatttttccatctgttggataagagctgaatcagaatgtcattctaagctaatagtggctatcatccatgacctaaaacggactcttgttaggggactgaagattggcaaagggagaagctagaggccatatagaagaggaaagcatgaaggtagaaaccacaatcaggactgccttcaaatatgaacttccagggatacttcttggttctgggtagctcccccaccacactgttttcttttgctgtcctcaggaatcagcttgcttgtttcgtttcattgctatcatctgtagtttctaatgagtttttcactttctgtgatctctacagaacagattttacttttctctcttctcccctacatttgtgtctgtgaagtatgcatgctggtgtttttactacttttaaggaaagagaagtatttagaaacaaaaacgtatttcatctgtctttgccacaaggattttttcctccctagttacattttcacgggaaaaacaagttgtacataagtgcatcttacatttcagaggaaagtcagactggagttatagtggacttcttatcattagttaggtagaggtagaggcagcagcctggtcttaacaggactctgcctctgtagggagggatgaggaaactaaagactacaggagtcaactgcactggggtactgggttacaggaaggctagtgatcttgctaacctagaagactagaaagtagaggaaattcatatgcccttttcctgagtttgaaaaggctttgttctttcatctcacagggagacttcagcacaaatgatagaagaaaatttgaactgccttggccatttaagcactattattcatgaggcaaatgaggaacagggcaatagtatgatggtaagttttgtgtggatatgggtgcctgctttggctatgttgggtgcaaaaggtttaactttccatgctagccttatctggcatttgggatgcatatgggaaatagaagaactcaagaggaaagagcatttggggaatatcctcaaccttaaatccttatctgccgttactcagggatatactaggattatgtcatcaattatcttcaataatagcatttttggtcaaattaaatgagtggtaagcttcttcacaatgtgaccattgaaattgaatggtttgttctgtacctttttgcttcagcaatcaattttctccattaagatgggacttgtactttaattcagatatggtacctcccgaatagaaaataaattatgttaatatagttgtaataataagtgtgtgttaagatttggttactataaactactgatttgttaaaa

SEQ ID NO: 62468 - DNA, 1022 bp, Homo sapiens
ggctgctgccagttggctttaagatgtcatactgccctcaaatggaactttcaggatgtctacaggtccctttactagttggtttcaatgagcttttttcaaagtttttctgggttgtaaacagacggataaacatgaaattccaagcaacctagttcaagggcctccttcctttaggtaatgaaagtttgatgaattgtcctactgtttctaaatatgtggttaatcatccaagaaaaattgttcccttggccagaggctgcatttgtgtctagggcttgggttagtatgggttaaagatagccaagactattgttctcaagcacaggcaactaaggtctcttactgataaatttatatatacattatacacctgcaaactttattttttatatataactagattttatttataggtaatctttatatcttttatcttaacccaatttttaatttaaatggagatgtttattaattaaaattagtttcagagtttcagggatttttgaggaattttttgtttggaggctgatatgttacagaagaaaggttatatccactgactgatgtcttttatagatcactcctacagtgacagcacagagatggtgaaaatcattgtgcacactgtgcagagtcaggaccgtgtgctcaaggagctgtttggtcatttgaggtaggaaaattgcttcatttcctactgaaaaaccaggatacgtttatcttgttcctctcaaagtacaaaagccctctttggtaaagtatacttacccaggaagaattctgaaggtaccttgggtagcttggccatagctatctgcatttatgtgtccttttgtatgcattactttggagataagtcattaaatctgatgctgattgtggttcatttcctcagctgggttttgggaatatggtgtacagtcttggggcatgtgaaagtgtctgacactgatttaatctctccagcaagttgttgggctgtaagcagaagattattgatctactccctaaggtggaag

SEQ ID NO: 62469 - DNA, 1068 bp, Homo sapiens
caggagttcaaaaccagcttggccaacatggtgaaaccccatctctactaaaaatagaaaagttagctgggcatgttggcatgtgcctgtaatcccagctacttgggaggatgaggcaggagaatcgcttgaacctgggaagaggaggttgcagtgagccaagatcacaccactgcactccagcctgggtgacagagcgagattctgtctcaaaacaaaacaaaaaaatattatagaggttggaaagaatttgaggcagtgggttcaggtatggaatggttagagggaaggcctgtgctgttctaggccaaagcagattgctttgaaaataatgccttcatctgcactggtcactgatgacttgttttgttggcaaaataattccagttgaacatctgctaaatactgagcaaggtctgctggaaagagtactggatggggaatcagaggcttgaattctagattgagtaatttactgaccgttacctcaggcaaatctgcgtttcccatttccttcttctgcaaaatggggttgaaacctagctttcctactcagtgagtatattgtgacagtgtatttaagaggatgtttgtgaaaatgctttgaaaactataaactattatgtacttgcaagatattatcatttagttaaaaatttgttttgaagggtaacagaagaaataaagtctgtgccctaatgtgcattatacttaaatgcatgttaaaaaaagatatacttttacactttaaaatttgtagacacatagcaacacatgcaaattaatatacatgtgaaattgtatttcatatactattttcacatttaaaaaataacattatctcctcttatactgcttttattttactgaaatgtattcagtttagtctgaccagcagttctcaaaatgtggcatatggacctgtgagaatccttgaaactttgtcagagagtctgtgaggttagaaccattttcataataagatgttatttgcatttttcaccatgttgacattttcattgatggtgcaacataaaatggctttcaccttagtatgaatcaaggcac

SEQ ID NO: 62470 - DNA, 1024 bp, Homo sapiens
gagcttcagtttcctttatttatttattttttgaaacagggtctcactctgttgcccaggttggagtgtagtggcatgatcaaagctcactgcagcctcgacttcccaggctcaagcagtcctcccatcttagcctcctgtgtagctgggacaagaggtgcaccaccatgcctggctaacttttacattttttgtagagacggggtctcactatgttgtccaggcttgtatcaaactcctgggcttaagcaatcctcccacctcagcctcccatagagctgggattataggcatgagccaccacatccagctagtttccatattatagggacaatttcttttctagtagggttatgaagattaaatgggagtcagtaatggtagttgtcactattatttttgtgactggtttagataggatggctgcacatcctggtttacctgggactgtcccagtttatacttaatgtcttgccataattatcagtagtagtccctttcactctcaaaattatgccggtttggacaataaattatatggtgtccctaggtatagctcattctctaggtggcagattttttccccttatcctgtacatttgtccacggtcctaagttattacactccttaatgtcagtacttaccctgaggatgtgggtggggatacccatggtgtcctggggtgggaaatccaagttctttatctttttgtgtccctattcaaggtagtggggaccagggggcagtcaaaatcatagagccaagatacaagtaataccaatggttttggtggtcctttttctttcttgttagttgatacctgttgtagctttttgcttctccggaggtaaaagcaaatactagtagtttactgttgtcaggagagaaaagagagaagactaagactaagtatgttcttatgtgaaagattaagtgtcagaatctgaagaatagaaaggctttaacaaaatcagtgtttcgtattatattatttagttctctaatgaagcagcaagtcattct

SEQ ID NO: 62471 - DNA, 1068 bp, Homo sapiens
ttccattaacagtccattaactgttaatctccattctgtccaccccaggaaaccaggaatctattttttatctccacaagtttgccttttctgaacattccatataaatggaattatgtaatatatagtcttgtgtctgactttttttacttgccttgtatttttgaagcccgtgcatgttgtagcatgtatcagtacttcattcgttttgattaccgattagttttttcactgtatatatctttttgcatttgttctttgggttttggtgattgttcactttagcccatacaaaagtttgggtcttttttcctcaacaaaagtttggactctgttatctgtaagagatatggtaatacacattgattttgttcatttgcatttcaaagtaggaaatctggtgcataagtatttagaaaacctaggattttcaaagatccttgaacaggattttaactgtttgtttctttttcagagaggctgtgatagctatatggtttatttgtttgataaaagtaaaactgtatatgaagggccatttgcttccagaagtttatctgattgtgtaaattatattggtaagtccagtccatttagtggctgagctttaaacatgaattaatataactttgactctcagtatgattagtagaaatggacttttggtgttgtgttctgtatctcatacttgaagtttctatatggagttatatgagaactctgaaaaatggatttatatagtttggaaggtgaaaaggtagatattaaatctccatgagatcattcaagagaagatttactttcttgaggatagggctctcacaggagaatgaaacttcactattagttgaacctgctttttaattgtctcttcatagtctaagcatgttcaagtatttatttcatttttcctgtgaatactgcttgatgttcaaatgttttaatttatcctgtgaaaattattcttttcttttgaacaagttaagtgtttgatcactgtatatctgtccaaataaagtaaagcacaaaattgtaaaatcaagaacaaaattgagcagaggggctaaa

SEQ ID NO: 62472 - DNA, 1022 bp, Homo sapiens
ctaacactgaaaagatacctggcttcttcttgatttggtttccttctaatgtgccaaagaataaattatccctcagtgtgttaggaaagcagggctttagttctgtgttgcctctgaaacatttcagctgtgaatgaaccacatctcgcatttgtttcatacttgtcataggaatcatagcatagtttctgctctgaagggcatctgtgagcctcttgttatagggcacggggaaagagtccacattatggagtttatagtttacagactttaattcagtttgcagcaccactatttacctatctgtgaacctgagcaaatgtctctctatctcaaggacagtaatatcttcctcaaagcatcaatattattatgaggttatgcagaataaggtatgtataaggtactagttatagtagttcaagaagcttcaaggatgcttgttagacatgataataggactgaattttgaagaatgagagtttttagggaaagggtgagggcgggagagatttataggcagcagagcatcatgagcaaaagtacagaagcatgaactgcaaaacagcttggtgttactgtaggacattttcccaaaatgtttatatatattgtacaagaaaggaatgatgtctgtttgattttcacttaaaaaaggaagcaacaaaacagttactgaaatatttcccttttgaaaaaatagcttagcaagtctgattgtatgcatattttccaactgtttattatgaacatctttagatatgtagaagagttgaaagaagtgtactgaacctaccactaaaaataatgatgaaacagtagcatttaattattatttttttttgcctcctctttcacgcccctaaatgtaactatattctgagtctcttcttggttctctctttttccattacatttcctttcttttattaggcagcctcttcaactgtatagctttacttataaactacatatggctaactcctaaagttatttatctctgtagctgtgactcttctgcc

SEQ ID NO: 62473 - DNA, 1663 bp, Homo sapiens
atcacatgcctagttaagtggtggcactcagacttgaaatatttttgtgttattacagagcccaaggtcctcaccactaccctgtctacagcctcgtaaggatattgttgtctttcctttttaaatttctctaccatttaatacttaatctgtcttattattttgcagataatacataaaataattgatctgggatatgccaaagatgttgatcaaggaagtctgtgtacatcttttgtgggaacactgcagtatctggtgagacctgttttgtttctttgaatttaagtgtgtataggattctcttatttctgaagatcatgaatatagtaggtcaaaaataaagtagcttttcccatacagtgttggtgtttaaagcattttctcttttgaaggccccagagctctttgagaataagccttacacagccactgttgattattggagctttgggaccatggtatttgaatgtattgctggatataggccttttttgcatcatctgcagccatttacctggtaagaaatggatgagaacttgggcatgcttaatgggaatggaaattttttcatttgtctttttttttctttctttaattgtttaattgcctttgaaatatacaattaaatataattaaatggcaagaaatcttaatttgtgagaatcactttgtcaactgaggtagcttttgattttataggcatgagaagattaagaagaaggatccaaagtgtatatttgcatgtgaagagatgtcaggagaagttcggtttagtagccatttacctcaaccaaatagcctttgtaggtaagtatattttagttaaggaagtttgcctcagtttctccagagttgtaaaggagcaggagagtagttgtctgtttcaagttgcattatccagtagaactttctgtgatgatgtagaaaccttctatatttctgttggccacatgaggttattgactacttgacatgtagctagtttggctagagaacgaattttgaataaatagtaaatataaatagccacttgggactagtggctaccattttggacagcacaggtctggtggaaacaagaactgccatttaactgtttgacatatgtcctaagaaggctcttaggataatgaagtaaatgggttatttgcagaatggatttggactcatccgtcagagttgtcagtaactaacatatgtggagttttgagtagtttttgatggaaaaaagtttgtcccctgtcatttcatgaatttgaaagtaatttatgaaatggtacagacaagtgatgtgggaaagaaaatggacaacctgcaaaattacctttctaacagtataaagggaaattggaacataatgatttgattttcaccctattttgtatgttttctagtttagtagtagaacccatggaaaactggctacagttgatgttgaattgggaccctcagcagagaggaggacctgttgaccttactttgaagcagccaagatgttttgtattaatggatcacattttgaatttgaaggttagtcttaatgggtctactgcataagaccagcattgaaagtaacaagtttatttggaaaattagcataaatacagtttaataatcttttcctgttgcttatttatttatttattttgagacagggtct

SEQ ID NO: 62474 - DNA, 1343 bp, Homo sapiens
ttcaagcgattctcctgcctcagcctcccgagtagctgggattacaggtgcccgccatcacacctggctaatttttgtatttttaacagagacggggtttcactgtgttggccaggctggtctcaaactcctgacctcgtgatctgcccgcctcggcctcccaaagtgctgggattacaagcgtgagccaccgcacccagccaagtcaactcttcagggtgaaaaatctctgcttaatcagaatgactccagaaaaattcctaaaataaccagtacctaaccttttggaggaacctcaaaaaccaaaaatttgtttccccatagattttggttttgcctcttttccaaggtcatgagggctaaagtccaattgaaatgagtgatttaggtgggagaaagaggcttataagagtttcagggattttcccaattgcttgttgcatttctatttggtgttaattctaatgagttaaatgaacatatagtataattttgtagtatttgtttaatgttacttttttttctgtgaagaaaacctggacactgtagtattagttgtgtagttacgatgatccatataaacttgagcatcagagtagatttgtacaaaatgtgaggtgaatttttcttttaactcaatgatttctgttactttaaagtatattttaaactttatttagggtctgggattcgatatttgcatgaaaacaaaattatacatcgagatctaaaacctgaaaacatagttcttcaggatgttggtggaaaggtaggtgaaacctgaagtaatgtttcatgcctattgaatatagtctctctgatatagttagtccttgagctttggtgtctttgctgtatgcccataacagtcttactttttccatttcagacctcaccacactgaactgtagttttgtgtttagtttttttgtcccttctgctaaacagtggttccatcagagaaggaacagcacctgctttttttttctttttcttttttttcatttttcatacttaacccagctcctagacttcacctgtcttgttcaagtctgtttttccatcatagtatctagcaaagatacaggctgtgaatacataatatgttaacacttattattttattcttatgaagcacatccaaaacacatacatgcacatcctgggtccactttaagaaaaaaaagaaagtatatatatttttaaaacttattttccttcccccaatttaaatgagtcatctggagaagaaccagaaattgtgaattgactcttaaaatgttcatttcattggtaacttaagcagttttcttgtttccagcatccaaatttcattccaataa

SEQ ID NO: 62475 - DNA, 1049 bp, Homo sapiens
ttggaaataattttttttattgtaatgtttttctttcttattaggttgaaccatgccaatgttgtaaaggcctgtgatgttcctgaagaattgaatattttgattcatgatgtgcctcttctagcaatggaatactgttctggaggagatctccgaaaggtagtgtggatgttttgagatgagagagagtaaatcacaaactttagcaatgtttgaatcatgttaaatataataaactagaataagaatcggaaaaactatggtctgcttcctgttttgtaaataaagttttattggaacacagccacattcatttctttacacattgtctatggctgctttcttatggctgcagaagtgagtagttttaacagagactatgtgacttgcaaaacctaaagtatttaccatatggttccttacagaaaatgttgactcctgatttagaaaatgcatttttgttgttgctgtttgatgggactatagcaatggtgttagatgaaaatttcagtggttaaggtgcttataaaaagttgttttctgtattgcaatcttttttttctacctaattttaaatgtgcccatatgaccatttttatatatatccatgagatttgtcagccttttccagtttcaaatgctttttgcctctttttacttttatgagccttatcatgaaatttacatgccctcagtatggatttggtaattttattcccttgtattttattatgacttattttctcatttgaatattcttttagagtatagtaattaatgtgtggtcactattgcagcccagcaatttgcagaacagatttttagatttctttctttttttagctgctcaacaaaccagaaaattgttgtggacttaaagaaagccagatactttctttactaagtgatataggtacgtatcagtattaaaataccattgtaatgtaatgtccctttggcccataaaagatctttttgggaattcaggagaattgttgatacactatacaaagtctatagaatttcaacatctataagaagttataaaa

SEQ ID NO: 62476 - DNA, 1043 bp, Homo sapiens
atattggtcggagctgcagtaatccaaaggcttgactggggctggagtatctgcttccatgctcacttatatgaatgttggccaaaagcatcagttcttcgccatgtgggcctcttcatggggaagcttgaatgttttcatgacatggaagctagctttccccagaaagatcttttcctcagaaagagtgagtgatctgagagagagagagagagagagagagtgaacgagcgagcaagatgaaaaccgacgtatcttttatgatctttacttggaagtgagactccatccttttccaccacattctgtttgttacagtgagtcactaagtacagcctacattcaaggggaggagagttaagctcttaaaaagagaagtagacatattttaaaacttccacaggtagtgtgctaagtactttacagatcattcttccagttatcacagcaatcttatatttaggtattattttgcaaatgaggaagttgaagcttatagaatcacatagctggtggttggtaaagtgtggatttgaaataaatactttctgactctaatatctgtgcttaattccattttgattctcaaacttggttatgtggcagaatcaccaggaaagcttaatagtataaattatcaggtcctacatgtacatggaaattctgtttgcttctttttctttttttctttttttttttaaaagagatgtggtcttgctatgttacccaggcttgacttgaactcctgggctcaagcagtcctcccacctcagcctctggagtagctgggactataggcatgcgccaccacacccggctaatttttaattttttgtagagatgaggtctcactgtgttacccatgctgatctcgaactcctggcctcaagcaatcctcccacctcagcctcccaaattgttgggattacagttacaactacacccagcctagaacgccagatttgacttactcactgtgtgatcttgttacttagccaatttgtgcttcaattttctcctgtgtggtgaaagtattaataaat

SEQ ID NO: 62477 - DNA, 1397 bp, Homo sapiens
ctgctcataacaaaaggaagattgaagggagtgagaactgtgggtaggctagcatgcagtctatcctagtttccttcttctctatgcaccaggtatcatcttatctctagcttcttttttcctctcaccctccaattcacactaccctatccaagctatgtcttgcttccccacctataatatattttttctgtcctggcccctgggctcttctctctgtattcatacacagcctttattacaactctggtttgtgtcagagattacatatgttggaaattcttttgaactctccttgtgatatcagaaacatagtgtagcctgtttagccctgactgctatttctgagctgcattattaatgttgccagaatatgatggggtctggctatttcctgtaatatgcatcagaatgggtttaatttcagtcagaattggctaaattactagtcacaggcaagagatgttaggttcattatgtagctatggaagcagaagtacactcattggtaggattttttttcttcatgtcatttgaaatgcatacattaggattggagttttttgctttaggcttggttatattaaaactttctcttgctgtttggagtccaggaagccctgaattaccttcttcattttagttatgctagaagctggggcacatattagttgtcttgattaagctctgaaaggggtttgctgaggagacaggatctttttttttctaacattatatatgagagagagttctgaaaagacctgttataaaatcagtttcaggcacttttcccttgtatgctgttgtgtgtttgaaggtcagttttaaagcattggtgtaatagtctcatggtttatctttttaaaaagcattgcctcaagagagctgtggataaatatatttaattagtaaagctaaaaagttttgttgtcttaagttatttctttggtagcaaataaatcttcacaagaacctaattttttttttctgttgattttctattttggcaggaacttgatctcaaaatagcaattaagtcttgtcgcctagagctaagtaccaaaaacagagaacgatggtgccatgaaatccagattatgaagaagtaagtgtattccttgacttacatttccctggttctacagcccaaccagatgtcatcatggggaaagaggccaggaatccactcttctcaggatctttttgggaacatatatttttttctctcattaaatatattctatttcaaataataatatcacattaagattaagaaggtttagttaaaatcagctaggacacttacacactgttggtgggaatgtaaaattgtgcaactgttacggaaaacagtacggtgattcctaaaaaattaaaaatagaattaccatatgatc

SEQ ID NO: 62478 - DNA, 1058 bp, Homo sapiens
aattttactttgatttaatagagaatgtttaaccattgtagtagcagttaaaaaatcatatttgggtcttgtttgtttgtttttgtttttgagacggagtctcactctgtcgcccaggctggaatgcagggcgcgatctcggctcactgcagcctcctcctcccgagttcaagcgattctcctgccacagcctcctgagtagctgggattacaggcgcccgccaccgtgcctggctaatttttttgtatttttagtagagacggggtttcaccatgttggccaggctggtctcgaactcctgacctcaggcgatccacctgtctcaggctcccaaagtgcagagattataggcgtgagccacggcaccaggcctgggacatgtattttttgatataccgataaaagctgtgaaccctttccccagaaaaatgcacagatgcacattcacacaaccatgcattgccatttgagaggttcgtgccttcctaaaggacattttaggtaaatagaccctggactaataattcctgtaatataggctttgttttgttgcctgtaaagtaagtatagtataataattacatgcatcatggatttgagagttaaataaaatagtaatgtgtgtaaagctaaatacggtacctgacccatgaaagccctcaactgttagcacctgctgctactttgttgttgttgctgctatgatcataatgctcctcattaattggccttaaggaaatgtcaagataaaaagtgttgttctaggaaaatggttttgtaaaggataaatttgagtggaacaacatatgggacaagatgaacaggtaagatcttactaaaatgcctgggcttggcttgtgaatagagaagttaattcaagaggaaaagtaataatttgttatctaaaggaacatgggtgtagtgagaaagctcgtaatttggggtgggagaaaggggagataggagtctaccttgggaaaataggcatatttagggtaattagaatgacaactgaaactgttagaactgaggaagttttgtgaaccaggtttctaga

SEQ ID NO: 62479 - DNA, 1209 bp, Homo sapiens
ggagaatagcttgaacctgggaggcagaggttgcagtgagccgagattgtgccactgcactccagcctgggcaacagagcgagactccatctttaaaaaaaaaattatataaagtttagctttaatatgtaaaatatttaatatttttatattaatatttaaataacattcatttaaaaagtttttaaagagtatctggtggtaaccccagagacttcacagggaagtgtgtggtcagtacatgtaaacagcatagatagtaagttccttgtttagaaaaggaatgggtagttgaggaagttccaaggaagatgtggggcttgctggataagaatttggaagaaagtgagtattttgtgtggaggcccagcatgagggaaagcttagtggtaggaaatagtctcaaagcctgcatggggctagcagctcagaaaatcagattgtaaatcatttgtagttgtggtggttttctttttggcacatttgttaagttttcaaatgggcctaactctgccacatatataatatcggagatggcaaaggcttgtgacggagatatctctcttaagcctttcctgcatcagagaatggctcccacatgtgtcaggctatctcataagtttaagtccttacagacaggctgacacaggcttgtctggcctgaggatattctgtgctgaggggtgtttctccacccctgtgatggatttgctacttctcagagactgtgcaggcacaacttctctgggacctgcacaaggaatttctcctgtctccccaacccccaggtcattcctgtcccaatcagctgctctactactgatgacattaaagatgccttcattacccaggcacaggagcagcagatagagctgttggaaatcccagagcactctgacatcaagcaggtgaaacaggggatggtgatattcagggaagagtaaatatctgttttttttgttgttgtttgttgtttgtttgtttgtttgagacagagtcttgctctgttgcctaggttggagtgcagtggcatgatcttggctcactgcaacctccgccttccgggttcaagtgattctcctgcctcagcctccccagtagctgggactacaggcatgcgccaccatacctggctactttttgtatttttagtcgagacggggtttcaccatattggccaggctggtctcgaactcctgaccttgtgat

SEQ ID NO: 62480 - DNA, 1049 bp, Homo sapiens
agtttatgctatttttctctcccacacaatttgtatagtaagttaggctttgaattgccttctgtttgggaagcttcaataggttcaagatcacacgcaggagataagagatttggaatgtgtgacatagctcagtgctgctctaggcctcagtgagaagtgacttttcttttccattcatctttctattgtccaggttactctaactcagggtgtgggcctgggcaacaatcaaggaaacctgttttcttctcatctaggcctgaaactagaggggaaaaaggtcttgtttgtggcccaacccaacatcccaagtaggccacatgagtatttcagcctagagtctacactgtccttaggtagaaacctcttacaaacctgtaatgacctttgggtgtctgtggaagagtttgggatctcctccctgcaattattctttttgattgcctttttttgttttttaaattttttccctggctttctctttgtcgtgccttcctcaaaggtagtacatagaattgtgctgatggtccatagccacagattagtaaaaagggggaagggctgctgagagtgtaaaataattattgcaaaatcaatgcattttacttacggggagaaccatttatccaggtcctatttacacatggttagagataattctagtatagaacagattagaaggtgagagtttgaaagagagaggagattaggcaagcgtgaaactattcacaaaaattgcaagtacaggattagagatggtgcagaggagctctttagtttagacatcattacctaaagaatgcacatcataatagagaagctgatgtttatggcagtgaccttctgacaaaaatagctagacgactcaggcttctagagtaaccttttaaacaaatacaatataaagtggttattatacaaataaaaaaaagtttttagtgcctgtgaggttttcatcaactttagtcatctggaaaattaactttgtcaatatgctcagtcctctctgccaaacaaatcaaggacaatcatgctttagtatcttt

SEQ ID NO: 62481 - DNA, 1054 bp, Homo sapiens
gagctgctggagagtttacacttcagacatgtaaaatggcagggacataggagagtcatgggagattcatccccctattgatggcttttcattctgcaattctgactaaaatttgttcatttttctttgaacccaggtcgtaaaggtatcttcactggaagctcggggctgcagattgtgtacctcagtgggacagaatccttaaatgagccagtaccaggttatagttttagtcccaaggatgtgtcttctctgagaatgatgctgtgtacaacctcccagtttaagggtgttgatatcttgctcacatccccatggcccaagtgtgtggggaactttgggaattcttctgtgagtagtgtttgtttagttggaatttctaaaagcaaattgcactggcttgagttgggacttttttcttttcctgtttatattgagtattttagctcttgggtaccttttattagaagtcttctgtgaaaattttcaggattctaaaagttctgtcaactgatcaaagcaaaagttaatttcatgaaagtgtgattcatagatgagactgctgaaatcttaattataaaggaatggttttttatattctctgcttcaagtgccctttcctaagcctcttaatgttttgaggcttcactgatttttttgttttttgttttttgtttttttttgagatggagtctcactctgtcgcccaggttggagtgcagtggtgcgatcttggctcactgcaacctcctcctcccgggttcaaatgattctcctgcctcagcctcctgagtagctaagattataggcatgcgccaccacgcctggctaattttttttttttttttttgagatggagttttgctgtgtcacccaggctggagggcagtggcgccatctctgctcaccacaacctctgcctcctgggttcaagcaattcacctgcctcagcctcccaagtagctgggactataggcgcacactgccatgcctggctaattttttgtattttattagagatggggtttcagcatgttgcccaggctagtcatga

SEQ ID NO: 62482 - DNA, 1024 bp, Homo sapiens
ttttccccccacctgctggcagtctgctgcctcttagatcattcaactcttttttttttttttttttaagacagtgtcttgctctgttgctcaggctggagtgcagtggcatgatctcggcttactgcaacatccgactccctggttcaagtgattctcctgcctcagccttccgagtagctgggattacaggcacgcactaccatacccagctaatttttgtatttttagtagagacgggatttcaccatgttggccaggatggtctcgatctcctgacctggtgacccgcctgcctcagcctcccaaagtgctgggattacaggtgtgagccactgtgctcggcttttttttttttttttagttgaatttactattcttcacatttcctccttgttggtcttatttctctagaaaacttcttcatttcctttgctgtaaatgtcctctctctccttccccatcatagttcatcttggcctttagtctttatttggctatggccctcccgttaccagtcttattttgcactaatcctgtgggacttctttaagcaaaaattgaaggaaggactttatttgttttgttgttttaatatggaactcttcatgaatttgcatgtcatccttgtgcaggtgccgtgctaatattctctttatctttccagttttagtatatgtgctgctgaagtgagcactgtttagttttaactacacatatcagatacgcattttgaaattctgttgtagattttaacatgagcctgacttatgcagttcttggtatagtttgtagatttggattaagggcattactgtagatatttggcagccattttactatatgaatttagtgccaggaaaggaaagagcagctaaggtacttgggttatttctgtgaaatagattttttggatccagtaggaggatcaagcagtgaacttggtagtgaacatgtgatagtgagcttgaaatactggtaggacatccaacatatagttggaagtgagagttattattattat

SEQ ID NO: 62483 - DNA, 2503 bp, Homo sapiens
ggtgttggtgagaccctcagtggatctgcccagtggtttacgtgcactgaaccttgcaaggtaactgcagagagactagatcatgtatctatctaatccaaaagaccagtatataccaaacccggcaggcccatttgtttcctgaattgctataatgtttatctctttgtttgcagcttggcttgtggagatgttgaaggaaagtttgatattttattcaatagagttcaagcaattcagaagaaaagtggaaactttgatgtaagatgtttgtttttactgaatttaattttacctttgtagtcacacataaaaataaagtttgcactcctttaagtcttgattgaacacataccatttttgttaaattgagttcccttcatgagcataggaacttagtagctgctgagtggctgggggagggagacctatttactgtttactattgatctttatattttttgaatttgaatattgttactttatcactgtacaaaaaactgaaaacagactagcaacacttccctaagtgattctgacctctgggtttgggaagcacagatctatttcatgaatgtgatgaggattaagtcaggtaacatacataccaacccatcacaagcttaaaagctctatatgaatgttgtgtatggttgccaactagactgtaaactcctaagagtacagaagagagtattccaggtatgaggataatttgttcattgggttaaaggttgggtaaagacaacaggcaggaaatgtgttttttataccttgtatttctcagattctaatattttaagtttttttgtttcacacggggattctttaaagatctatttctatgtgactgtatattccagggaaggatatgtggagagagccatgaatggcagagtgggactgggaatttgaggagcacttgaattctaacttactttaaaagtttagttccttgactctctcttacccatctctaacttgaatttgacagccaaagagccaaaacttaataattcatagaatcagtaactgttaacagttgctgctaaagaattgtatattgaaatctgcaaattgattaagaattaaaaactgatttgaaactattaaataactagttgaatattactatcaattatgtactgtttgatattttaaaatctcatatatctgtttaaaaaactcattttagctgctgttgtgtgtaggaaatttctttggctccacccaagatgctgaatgggaggagtataagactggcatcaagaaaggtatagaaattatttttatttaacatatgatttctaataaaatttcaagggccagagttcttgcagagttgtttttcattatttaagaatttaagagttattttcagtatttaagaatttaagttgcttttcattattaagactatccggcgcagtggctcacacctgtaatccccgcactttgggaggccgaggcatgtggatcacctgaggtcaggggttcaagaccagcctggccaacatggtgaaaccgtgtgtctactaaaaatataaaaattagcagggcatggtggcgcatgcctgtaatcccagctcctcgggagactgaggcaggagaattgcttgaacctgggaggcggagattgcagtgagccgagattgcaccactgcacttcaccctgggcgacagagcaaggctctgtctcaaaaaaaaaaaaataaaataaataaaatagccaagctacaaggttgggtgtagtatatccttagtggatagctgttccacatttaggattgctaaatatggggaatgtgaatgcatggactatttacttttaatataagtattttttctatagagaggcatatcttaagttctaaagcagatctggtaactatatggtgtcatgtctgtttccctcactagctcctattcagacatatgtgcttggtgctaataaccaggaaacagtaaaatatttccaggatgctgatggatgtgaattagctgaaaacattacttatctgggtaagctgatacttgttgtattttttttttgttttttgttttttgtttttgagacggagtcttgctctgtcacccaggctggagtgcagtggcgcaatcttggctcactgtaacctccacctcccgggttcaagtgattctcctgcctcagcctcctgagtagcttggattacaggcgtgtgtgaccatacccggctaattttttttatatttttagtagagacagggtttcaccgtgttagtcaggatcatctcgatctccttacctcgtgatccgcccacctcggcctcccagagtgctgggattacaggcgtgagccaccgcgcctggccgatatttgttgtatttgtaatgaacataatatagtgttctcaggaattagtctcccaggaaatttttggctagatttttcagtgattgcagcctgagataatggggtttggagggttttttcccagagtctgtatatgtgctgctgtg

SEQ ID NO: 62484 - DNA, 1070 bp, Homo sapiens
taaagacattacatcttctgtttaattttcaagccaccagtgaagactataagctcctggaaaatatgaataaactcaccagcttgaagtatcttgaaatgaaagatattgctataaacattagtaggaacttaaaggacttaaaccagaaatgtaagtaataatatttgtaattaaacatgtttgtatttaatgttcttttgtgcttggggccatggagaagaggagggaacatgacatccttgtcttgtgggagcttgttttctaaaaatgaattccaaatttaagatgaatttcttccattctgaggattagcatgttttgtttgtatgggtatttttgcttctaaatcttgattttatcagtttattcctggaatgggagggggcaaaggaagggtggccagattctaatgaattgatttacaaatccataaaggattactctataagcagaaaaccaaaaactctataatggaaaacactaatttagagtagtcgaatatattttttccattgacttattatttttgtgtttcttttctctagggtgctctttcttggtatgggagtacccaagaaacagaatcagtaatggaaagattgctcaaggagcaagaaattaaaaagaatggaaaattagtagatgagagacactaagtctgggccacagtcgtgcctgatcaactagctactgtcttctaaagcatctgccctgctagtgctcagaatcatgtcacgccacctaatctgtcttagcatagctggagagacactagcattattacttttccactcttttcctatattctttgttaataaagccatataaacatgaagtttttctttgtttttaaagatgctggactgcagccttatctggatcagatcaatgtcattgaagagcaggtagcagctcttgagcaggcagcttacaagttggatgcatattcaaaaaaactgggtaaccgtttttacttctgttttgatgtaataaagactgcttcttgccagcatattcttagtaaacataatagttaacatttatggtgtgcctacagtgatctatta

SEQ ID NO: 62485 - DNA, 1162 bp, Homo sapiens
ggagaggagaggaagtgggaggagccgtcccagcgaaggctccactggaggtcatctccccctccccctataggctggtggtggagtttccagctacaggaggtgccatcccatcctggcaaatccgcacagtcaagctgatccgctatgtcagcaactgggacttctttatcgttggctgtgaggtcatcttctgcgtcttcatcttctactatgtggtggaagagatcctggagctccacattcaccggcttcgctacctcagcagcatctggaacatactggacctggtggtcatcttggtgagggacagatatctaggacttgggacattctggggtgaggagggagttccaccctaataggggctccaggttcttccttttggagccctaagccctccttctgacttttggtcaaatcatcatttaacagctccctaagtgagagggacatgttcccctctctcagcccttgggaaaccctgtctctcacatctcctctcctcctcacctgtcatctgagccctgtgttttttttttttagtgtactatattctgctcctctcttgtcttttgtctttatgacctgttctgtggaaacccatgccttttgtcttctattcaaatattctgccccttcatcttcatctccctcctattaacaagacacattcaattcctgaccaaagcttggaagtggtgggagcggaaggaaatgactggttccagttccctacagccctttacaatctatacattaatatttaccattgtccccaatgccttctcttgggctttggaacacttaagatgctccccagtcatcctaccaagttccatttgaaactgagatagtgaacaagtcagcaaggatggcttttttcccacctgtcttacctaccctgactctcccttggggcctcatcttggaacttcccttgagatccccttgccttctctgacacccccatgacccctgtgtgacagctctccattgtggctgtgggcttccacatattccgaaccctcgaggtgaatcggctcatggggaagctcctgcagcagccaaacacgtatgcagactttgagttcctcgccttctggcagacacagtacaacaacatgaatgctgtcaacctcttcttcgcctggatcaaggt

SEQ ID NO: 62486 - DNA, 1934 bp, Homo sapiens
cccgcgtcccccaagctccagatcctggggtggctgccacgtctccctgccacgcgcctggggggacggaagacgggacggagatgttagtggtgggcgccccccgagggttcaccactgtttcctgagaaacttccccagtgcccacccacccgttctccgtgtgcccgagggccggtcctgggctaggctccgcgccccagccccaaaccgggtccccagccccttccagagagaaagctcccgacgcgggatgccgggcagaggcccagcggcgggtggaagagaagctgagaaggagaaacagaggggagggggagcgaggagctggcggcagagggaacagcagattgcgccgagccaatggcaacggcaggacgaggtggcaccaaattcccttcggccaatgacgagccggagtttacagaagcctcattagcatttccccagaggcaggggcaggggcagaggccgggtggtgtggtgtcggtgtcggcagcatccccggcgccctgctgcggtcgccgcgagcctcggcctctgtctcctccccctcccgcccttacctccacgcgggaccgcccgcgccagtcaactcctcgcactttgcccctgcttggcagcggataaaagggggctgaggaaataccggacacggtcacccgttgccagctctagcctttaaattcccggctcggggacctccacgcaccgcggctagcgccgacaaccagctagcgtgcaaggcgccgcggctcagcgcgtaccggcgggcttcgaaaccgcagtcctccggcgaccccgaactccgctccggagcctcagccccctggaaagtgatcccggcatccgagagccaagatgccggcccacttgctgcaggacgatgtgagtttcccagcctggccccgtaccgccgggtcgcaggcgcgggctgggcttccaggggacgggttggtggcagaagagaggggagagctccgcggaggacttggtcatctttttcgagttgtgctgccttccgtgagttgggaatgtggattgtaatttggggacttgagtctccaactttagtttcttaagctttaaagaaaaatccggtcgtgctggtgcttttatgaattatgcgggttttcctttgtcttcgtggggatgtgagtgctttacttctccttcctactgccgcctcccgataggtttcgcgcccctcgtccccctcgccctccgcccctaatgtatctgtacagtttcagggaacttttctccgttgcgtctcggatacaccctaccctcagtgaactacggcgctgcggaagggtccgtactgtccacccttcccccagcgtgattagagagcggagtggccccagctgcctccacgtgtctcttctcctgactctcctcttcctcccccttccagatctctagctcctataccaccaccaccaccattacagcgcctccctccagggtcctgcagaatggaggagataagttggagacgatgcccctctacttggaagacgacattcgccctgatataaaagatgatatatatgaccccacctacaaggataaggaaggcccaagccccaaggttgaatatgtctggagaaacatcatccttatgtctctgctacacttgggagccctgtatgggatcactttgattcctacctgcaagttctacacctggctttggggtaagcagcctccctgtcctcctgacctagtcctccaggtactcactgctcttttaataaggtaggatcttacagaggacaccagcccctcccagcctcccggttggggtttttctcaggcatttctctttggttgcttcaggcctagtgggctgggaagaacctgggggtactgagatgcaggactgtcaatgctgggggttgagagctttggaaccttgtgcttgtggg

SEQ ID NO: 62487 - DNA, 1049 bp, Homo sapiens
cttttccaacattccttgcttaaagaattgcaatgttctcacttcttgaaactctctgagctctgtatgatttacctccgttccacccaccatataactttcaagaaacagcagttctattgctatggtcctgggactttaagttgcttttttctacttaagcttcagtggcaagttgggagaagaagggaggcaactccatgactcctttggagcccagattcctgggtattttgtgaggttgggctgagcgccttgggctcttgatacctgtccattgggattctcctaatagggtgtctatcctcaagccttacattcctcttctctctctccccagaatgatgtctatgaatgggctcgtgaccaccgtgcccaccacaagttttcagaaacacatgctgatcctcataattcccgacgtggctttttcttctctcacgtgggttggctgcttgtgcgcaaacacccagctgtcaaagagaaggggagtacgctagacttgtctgacctagaagctgagaaactggtgatgttccagaggaggtgagtgaagccctgatggaggtggggatatggccctggcacctggtcattagggaccccattttttctcctgagactttcaaaatataagctgagaaatttgctgggtttgcatgttcacaatcttaatttaaaatcccaatttttaacatcccacgggcccgtagccatagactattgctccatttctttctctctgactatcttaattaaacccattacattcaagagatgtttattgtcctaggacagtcatagattcaaagatgattatagcctagttgcctaggtttgtttgtttgtttttgtgtttgtgtttcaacagtctttctctcttgcccaggctggagtgcagtggcacaatcatggctcactgcagccttgacttcccaggctcaagcaatccttctacctcaacctcctgagtatctgggactacaggcacacaccgccatgcctggctaattttttgtggggacaaggtctcactcactatattgccc

SEQ ID NO: 62488 - DNA, 5002 bp, Homo sapiens
acagagccttgagggcagggccaagagtgaatttggaattttccaacctgatacccattcccaaaagtaggagcttctctctagtcattttatcctctgagaaactgtcagttctcctcccacaaggctcccagacagccacgggtgaccagggtctccaatcactccttaagatgcctttgactggctgggcgcagtgactcatgactgtaatcctagcactttgggtggtcaacgtgggagggttgcttgcaacatggcaagaccccgtctctacaaaaaaagtaaaataataaaagtaaagatgcctctgaggggatctgtttggttcatattaaaagagactgaattcatccattcaacaatagcgagtttctcccaggtgtgaggtaccctgctagctaactggtgtgcacaaatcaagaaaacctcaatgcaccgtcactccataacttctcgcttttgtttcaggtgagggcttccacaactaccaccactcctttccctatgactactctgccagtgagtaccgctggcacatcaacttcaccacattcttcattgattgcatggccgccctcggtctggcctatgaccggaagaaagtctccaaggccgccatcttggccaggattaaaagaaccggagatggaaactacaagagtggctgagtttggggtccctcaggttcctttttcaaaaaccagccaggcagaggttttaatgtctgtttattaactactgaataatgctaccaggatgctaaagatgatgatgttaacccattccagtacagtattcttttaaaattcaaaagtattgaaagccaacaactctgcctttatgatgctaagctgatattatttcttctcttatcctctctctcttctaggcccattgtcctccttttcactttattgctatcgccctcctttcccttattgcctcccaggcaagcagctggtcagtctttgctcagtgtccagcttccaaagcctagacaacctttctgtagcctaaaacgaatggtctttgctccagataactctctttccttgagctgttgtgagctttgaagtaggtggcttgagctagagataaaacagaatcttctgggtagtcccctgttgattatcttcagcccaggcttttgctagatggaatggaaaagcaacttcatttgacacaaagcttctaaagcaggtaaattgtcgggggagagagttagcatgtatgaatgtaaggatgagggaagcgaagcaagaggaacctctcgccatgatcagacatacagctgcctacctaatgaggacttcaagccccaccacatagcatgcttcctttctctcctggctcggggtaaaaagtggctgcggtgtttggcaatgctaattcaatgccgcaacatatagttgaggccgaggataaagaaaagacattttaagtttgtagtaaaagtggtctctgctggggaagggttttcttttctttttttctttaataacaaggagatttcttagttcatatatcaagaagtcttgaagttgggtgtttccagaattggtaaaaacagcagctcatagaattttgagtattccatgagctgctcattacagttctttcctctttctgctctgccatcttcaggatattggttcttcccctcatagtaataagatggctgtggcatttccaaacatccaaaaaaagggaaggatttaaggaggtgaagtcgggtcaaaaataaaatatatatacatatatacattgcttagaacgttaaactattagagtatttcccttccaaagagggatgtttggaaaaaactctgaaggagaggaggaattagttgggatgccaatttcctctccactgctggacatgagatggagaggctgagggacaggatctataggcagcttctaagagcgaacttcacataggaagggatctgagaacacgttgccaggggcttgagaaggttactgagtgagttattgggagtcttaataaaataaactagatattaggtccattcattaattagttccagtttctccttgaaatgagtaaaaactagaaggcttctctccacagtgttgtgccccttcactcatttttttttgaggagaagggggtctctgttaacatctagcctaaagtatacaactgcctggggggcagggttaggaatctcttcactaccctgattcttgattcctggctctaccctgtctgtcccttttctttgaccagatctttctcttccctgaacgttttcttctttccctggacaggcagcctcctttgtgtgtattcagaggcagtgatgacttgctgtccaggcagctccctcctgcacacagaatgctcagggtcactgaaccactgcttctcttttgaaagtagagctagctgccactttcacgtggcctccgcagtgtctccacctacacccctgtgctcccctgccacactgatggctcaagacaaggctggcaaaccctcccagaaacatctctggcccagaaagcctctctctccctccctctctcatgaggcacagccaagccaagcgctcatgttgagccagtgggccagccacagagcaaaagagggtttattttcagtcccctctctctgggtcagaaccagagggcatgctgaatgccccctgcttacttggtgagggtgccccgcctgagtcagtgctctcagctggcagtgcaatgcttgtagaagtaggaggaaacagttctcactgggaagaagcaagggcaagaacccaagtgcctcacctcgaaaggaggccctgttccctggagtcagggtgaactgcaaagctttggctgagacctgggatttgagataccacaaaccctgctgaacacagtgtctgttcagcaaactaaccagcattccctacagcctagggcagacaatagtatagaagtctggaaaaaaacaaaaacagaatttgagaaccttggaccactcctgtccctgtagctcagtcatcaaagcagaagtctggctttgctctattaagattggaaatgtacactaccaaacactcagtccactgttgagccccagtgctggaagggaggaaggcctttcttctgtgttaattgcgtagaggctacaggggttagcctggactaaaggcatccttgtcttttgagctattcacctcagtagaaaaggatctaagggaagatcactgtagtttagttctgttgacctgtgcacctaccccttggaaatgtctgctggtatttctaattccacaggtcatcagatgcctgcttgataatatataaacaataaaaacaactttcacttcttcctattgtaatcgtgtgccatggatctgatctgtaccatgaccctacataaggctggatggcacctcaggctgagggccccaatgtatgtgtggctgtgggtgtgggtgggagtgtgtctgctgagtaaggaacacgattttcaagattctaaagctcaattcaagtgacacattaatgataaactcagatctgatcaagagtccggatttctaacagtccttgctttggggggtgtgctgacaacttagctcaggtgccttacatcttttctaatcacagtgttgcatatgagcctgccctcactccctctgcagaatccctttgcacctgagaccctactgaagtggctggtagaaaaaggggcctgagtggaggattatcagtatcacgatttgcaggattcccttctgggcttcattctggaaacttttgttagggctgcttttcttaagtgcccacatttgatggagggtggaaataatttgaatgtatttgatttataagttttttttttttttttgggttaaaagatggttgtagcatttaaaatggaaaattttctccttggtttgctagtatcttgggtgtattctctgtaagtgtagctcaaataggtcatcatgaaaggttaaaaaagcgaggtggccatgttatgctggtggttaaggccagggcctctccaaccactgtgccactgacttgctgtgtgaccctgggcaagtcacttaactataaggtgcctcagttttccttctgttaaaatggggataataatactgacctacctcaaagggcagttttgaggcatgactaatgctttttagaaagcattttgggatccttcagcacaggaattctcaagacctgagtattttttataataggaatgtccaccatgaacttgatacgtccgtgtgtcccagatgctgtcattagtctatatggttctccaagaaactgaatgaatccattggagaagcggtggataactagccagacaaaatttgagaatacataaacaacgcattgccacggaaacatacagaggatgccttttctgtgattgggtgggattttttccctttttatgtgggatatagtagttacttgtgacaagaataattttggaataatttctattaatatcaactctgaagctaattgtactaatctgagattgtgtttgttcataataaaagtgaagtgaatctgattgcactgggtctgggagtttcttttggctgtgattcaaagtcttgggatttgtctctggctcatatctatgtctgtacctttaagagtataaaagaagtagaagttacaatggttgactcataccccattaacctgccctgctgtcctaaaggtaactttaggttaaactctgggacgcaggaagccaggagtctgctgccattaaatcaaacacattaacaccagctggcaacttggccctggggaagtgccagggttctcgggtgtgtcacgtggtcggtcacatagacctaagataaagacactgggagaggaaaagaccagcaggagaagcgctccctgggaaagcagttttttgctcttgcccaggctggagtgcaatggtgtgatctgggctcactgcaaattctgcctcttggattcaagcattctcctg

SEQ ID NO: 62489 - DNA, 1053 bp, Homo sapiens
actcttttccttgctgccaggtatgtgatgctgtaggcttggctccaaaccagctgagtgcctgctttttactcctttatgtctggccttctaggatctgtccaagacactctcaggcctggaggcagggcatagaatcagttcttcactctccctaatactacactctgtaaggacctggggcaggatatcttctcccccagggatcttctatttaagtggcttctgagagggtgaacaggattgttacttttaagcctacctctgctgtgacccatcatgtgggtcttttgtttctcccttctgtggtttatgagcctgcccttaccttttccctgcctctgacttggtatttccaggtccgtatttctctgtagcccagggtctggggtagagctgactgctgttcaccctttgaacaactcatggacgtgagggatgggtgctgagcagaaccaagagaggaaactttggcgctgttaaaatggaatttctcatctgccggcattattaagggtgggctaggttggatggaaggtgaaagggatgaactgccttttgctggaagctgtcttaggctgtgagacaggagcaggggaaccacagcctatggggaactgcccttgactccacctatgttggagccttagcccaaggccattccttctgtgatgataaagcccagttctggaattggagccatattaaggaatgattctcttccagcgctgctcctcaagggttgggggtccttctccctcgcagccaccacatgtctcagggctaccttctccgattggatttgcatttgtggcactgtctttgatgcagtgatgtacttaatggtgcaataaagctgcttcgatttggtttcctctgtcatctcccagtcattgcctcctctgggttctattttgccattacctttctagtcctctttattcttgcttcctgcaccctagtaaggcaggggagaggcttagggagagataaatcaagaaagttaaaggaaggtgtccattcccactgaattaggttctctccttgcagcat

SEQ ID NO: 62490 - DNA, 2117 bp, Homo sapiens
ttaacccaagtcaaaattaacctctctctataatcccacagacttatactttggtaacgatacattctaactatactaaagttatttatatacatatatgcatattaccctactaagtaatagactccttaaggatagggactatgtcttgctgatttttatatccccaaagcggtgcttcacaaactattaatgtgcatccacatcacttggggatcttattaaaattcagaaactggttcattgagttggaagtaaggcccaagattctgatttttcagcaggctcccagttgatgtccttgcagctggtcggaggactagcactttgaatgacaaggccctgaagcacttggtacaatgctttaaatattaggtttgaattgaaaacagatgtataaaagcggaagttcttgttttcaaagccaacggttttactggggaggcaagactaacacattcaataggctgtgagcttaaaaagaaaaagaagtagggaggtaaagaattctgaggtcaagaggcctgaattcttatcatagctctgtcatttattagctgggtaaccttgaacaattcatttaacctctcaggacttaaccgttcttatcggtaaaacagggatagtgatgcctgcccagaaaattaacatgaaccacaaataagaatatatgtacacactttgtaaaactatcaagtactatataaatcaaaagttaaaatggttttgtttagcactaatctgtggtgtagattttgtgctgcagaagtcacggtaaataagaattctgactgggagagttcattaggaggtggatattgggaaaagaaatggtgaatagttagggagtaaagcaatagttatcaacgccaaataatctgtacaacaaacccccatgacacaagtttaccatataacaaacatggacatttactgcattggattgaatttttttaacctaaagtaaaaattaaaaaaaaaaaaaagttgtcggccaggcgctggtggcttactcctgtaatcccagcactttgggaggccgaggcaggtggatcacctgaggtcggggagttcgagaccagcctgaccaacatggagaaacccctgtctctactaaaaatacaaaattagccgggcgtggtggtgcatacctgtaatcccagctacttgggaggctgaggcaggagaatcgagtgaacctgggaggcggaggttacggtgagccgagattgcgccattatactccagcctgggcaacaagaacaaaactccatctcaaaaaaaaaaaaaaaagttgtcagccttggatacacattggaataacctgaataattcaaaaaatactgatgcctagtcccatccccagagtttctgattgtattgtctggggtgtggcctggcaagtctggattgttctccatgtggttttaatatgcagccaatgttgagaactgctggagtaaaaagggtttttctaaggtcctgttttgtgccagatgctttatataaggcatctaatttggtgagacggatactccaggtgggggtgttgtgggtaaaggcacagaagcaggaacacaccaggcattttagggatgtggagcaattataataaacaagcagggagagagatgctgggaaagataggtttggccctgattttgcagaggtttgtgcactgcaggaaggggagcttaagctctttcctgtggccttgtgaaaccacacaggctcctgaatagcagcaggttggtacaagcaatagagggatagtctaaggcttaattagaggagggaaaagaacagaaggctagcaaactattttagtaatctgggggtactggcactgggaatgggatggaggggacctgcatgaaagacagtgaacaagaataggtaggactttgtcgttgcttggctatagggggtatgaagactttgctaatgctgaggtatttagcccaggtgactgggagaatggtggtaccaggacaggttagcagaaggtgagtcttgtgtggtgaagtttgaagtgggtggtcctaagagtgcagaagtggttttggtagggagacgaattcaatactaaattcctgatcctattccaccccccagga

SEQ ID NO: 62491 - DNA, 1074 bp, Homo sapiens
ataatggcagaagctgacagagatgcccatcctgtgcttactgacatgaacctaagtttgtactgatgccagttcctcctctttataggtttcacaagctggtctgggggagctttggcagtgggcttctggaaagctccggggttattgttggcggcggggacaatggcatgcttattctatacaatgtgacccacatcctgtcttcggggaaggagcctgtgattgctcagaaacagaagcacacgggggctgtcagagccctcgacttgaatcctttccaggtactacatttcagttagtcaaacatggccaagccagggagcaacagatctgagtggaagcattcatttgtggcctccagtctgtaactctgacccctttccaggctgtttcaggggaggcttttgatagccccaaatttgggcttctttcctcctttcttgctctgtttcttcctagggtggtatgtctccaaacactttttattcatacagggcaacctcctggcttcaggggccagcgattctgaaatcttcatttgggatctgaataacttgaatgtgccaatgaccctgggatccaagtcacaggtgagcagcacccccactacccaaccctggagtgtgcagctgattctcctaagtaaaagtcttgagttctggagccaatcagagctcaagagatatcaaactttaccactggagggcaataaagctccacagactaacatgctaccagccagataagagttaggatggctggtgggtggagggtgtatatggggtagttggtttgtgctcattactcgttctaagagtttctgggaggcagatgaaagttggggagagcaaaagacaccacaagaagggatgggagtgctgtttatcacagtagagctttcgcagggttgggtagggcattgggcccagcaaagagggaggaagagtaggaccccagacataccattgtcctttttatggaggggggggtcagctttgttctccctgtatgtggctctgccatgcagttgggggtctggtcttctgtcttggagaggctgtctgtcaatct

SEQ ID NO: 62492 - DNA, 1024 bp, Homo sapiens
ttgctgggccactttagtggtggaaccattagaggctgagtgacttaaaggagattgagtctgtctcgaccccgagagagagtgggatggatggatgcatcgtctcatttagaaagtgttgcctctgactctaacacactcttctctctttctttacctccctccctgtcttcctcccttcccctcctttccctaacccccttccctccccctttctccttctctctcacagtgtaggcaccacttctcttacaatttaggctttctctctgccttgggctgagtgaggaagaggagtgctgttcctgccttcctagcccagctgggtctgaccagaggctactgtgtacccatttaccatgcgtgattgttaactcagagtggggtgtagccaggtattgactgaatgtatgttcttgctgacctgtgtttttttctgtagggaccaaagcagtatccttacaataatctgtacctggaacgaggcggtgatccctccaaagaaccagagcgggtggttcactatgagatctgaggaggcttcgtgggcttttgggtcctctaactaggactccctcattcctagaaatttaaccttaatgaaatccctaataaaactcagtgctgtgttatttgtgcctcatttccccaggaatagtcactgccttgaggaacctcatccttttccctttttttctgcttgatgtctgctgtcttccctgttttctttttctgaaatttaaaggataagagggtggggtggatggggacttaggcacaaaatgttaatttgttaatttcacttgggttgtaaaggtacttaagggttttagctgtgtggaggtgttaagggtccctccttttcccatttacagggtcaaggaagaaatgttcctaactttccaagttggaacaagatttatttcacataaaaaacctttctagtctgggtctggtagctcacgcctattatcccaacactttgggaggctgaggtggaaggattgcttgaagctcaggactt

SEQ ID NO: 62493 - DNA, 1050 bp, Homo sapiens
cctccacttcttgggttcaagtgattctcctgcctcagcctcctgagtagctgatattacaggcacctgccaccacacccagctaatttttgtatttttagtaaaggtggggtttcaccatgttgaccagtctggtcttgaattcctgaccttaggtgatctgcccacctcagcctctcaaagtgctgggattataggcatgagccaccacacctggcccagggaaggcttatgtacattaaaatatttcagagtttgccatgaacttttaaatacagtgtggacttctatggttaattctgtgcttagtgactagaacttgagctcttgccttgaggtttagttcctttgtccttaggtgaggcagttatctctgtcactttgtttctcatctataagatgaggagactctgaattgtctgaggctgctcacagccctttccagaagttcttgctgtctttcaggtatggcgactacccgaagctccctgaccgctcacagcatgagagagatccatggtatagctgggaccagccgggcctgaggttgaactggggtgaaccggtaagagaaccatatctcatttgaccttccttctctctttgtcttcttggcgattctttagctcagatggcacttctttgaccaagtaacactaagctttcctgctcaaggaagcaaggtccagtgatgtgagatctgagattgcatgtggcacactgaatgggacgtctgggaatcatgaaactctgtactgtgaaagttgtgcacttccatgatggagctgtccctattcagcagaacctagacagaggccagcatctaatcctgtagggcagtgtgcctcagacctggttctcagcatattgtcccagggcagtagaatgcttctgtctagccttgtatcaggctctaatcactggggacttgcctgcattttgcaggaagagtagtatgtgacagctatttgtctttctgcctcagatgcactggcacctagacatgtacaacaggaaccgtgtggatacatcccccacacctgtttcttg

SEQ ID NO: 62494 - DNA, 1050 bp, Homo sapiens
gcttcctccgtcacgtttggcccggctcagccgccgtgacaggcctttgcgcatgtgcagaagggaaacgtgaagaaggtgaagatggcggtggccagggccggggtcttgggagtccagtggctgcaaagggcatcccggaacgtgatgccgctgggcgcacggacaggtccgcgagaacgggcgagacctcagtgtgggaagggggtacctgaaatttggtgtatcgggaggggggatcgtagatgccgcggcggcagcctccgggtagggagtggaggtggcgttgatatatccagaaaatggggtggaggatcgcactgatcctgcgaagtcccgggctcggacctctgcagcccctgcgacttgaagccttcggagcggctggagagcgggctcgcttctgacctgttctcttctgcgttctagcctcccacatgaccaaggacatgttcccggggccctatcctaggaccccagaagaacgggccgccgccgccaagaagtataatatgcgtgtggaagactacgaaccttacccggatgatggcatggggtgagacagagagggtatgctcgcacccaagtagtgatgggagaaggccggctgggttgggtggcttgactgtgaccctttttcccgaaccttctcgtgacccctcagagtcaatggagtgggtgcttttctctgtggagggaggtgggaggggggtgggtgagcagctgcagctgagaggacttcaattttctccttggctcaggctgtttcctcaaatgaggaagccgaggttttaatggctccctcgaggacccccgaatagcaggagccttccttggctctatccagagcgtcgagtttcatttagattgagcatctgctgcgctcaggtgctgtcatccaggcatgtgaccaggctggagctggactcctgtcatgagaatcttatttgtaaacggagtactctatatttgtgtgtatgtctctttaaaaaaaatgtttttctgttagtgctgtggaaatcgtagcaactattaagcagattaaacagc

SEQ ID NO: 62495 - DNA, 2000 bp, Homo sapiens
ggcctttacctaataagctatcttccttactttagctgtagaaggctgcaacaggataggtggctgaatcagttaagataaactaggcttcaagccagagctcgggctagaaacaacagaggcttatttctcacttactacatgttgatcatgggtaatgtcatattgttctttacatcatcttacttgctctggcacccagattgccccagcagctactatctagaactttggagttgctgtggcagaaggaaagagatgtggtagtggtaacttgttcttaaattacagttggaaacaacacaagtcgcttctgtggacatttccttggccagagcagcgtaaataagcaagcctggcttcaaggggatgtgaaagaaaactcgcacactgagggaaccagctcttggtgaacagtaatacaatttaccacagtggtcatcaagggccaacggagatgtctcaggctctgcgagtctctggagtgagactgattcatcattctagggtctgtggataggcttctaggagtctgaaattgtgtgaaagttctgggtgtatgtgcatttttatggggaacctccgtggattcttttatttatttatttatgtatttatattttttgagatggtgtcttgctcttgtcacccaggctggagtgcaatggcacgatctcagctcactgcaacctctgcctcccaggttcaagtgattctcctgcctcagcctcctgagtagctgggacttcttctccaggttcttttttttttttttaattttatttttcatctcaccctcctactctttggattcttaaaggagtcattctgtgacccaaaaaaggttaagcatcacttctttaaagaaaaagtttgggggccagatgcagtgtctcacacctgtaatcccagcactttgggaggcagaagcaggaggattgcttgagcccaagagtttaagaccaacctggacaacatattgagaccttgtttctttaaacaaaacaaagaaaaaccagtaaattaaaaaatttggtgttgaacataactcaatgaaggataagtaagaattcagttgtatgagaatccatgttggctaaaatttgcctgactacatctgttctctgtgggagatgctggtatggatttgggcttggattttcagatgtggagaggccatgccaggggctgtgtgtgcatgcactaataggattttcttcttggggaacataggttgtatctgcagcaaacgctcaatgacactgtgggcaggaagattgtcatggacttcttaggttttaactggaactggattaataagcaacagggaaagcgtggctgggggcagcttacctctaacctgctgctcattggcatggaaggtaagaaatctttcaaaagcagcatggcttggagtcatatgaacctgatttctaatcctgtcttcaccgcttattagctccatgactttgaacaagccacttcactttcttaagcctcagcctactcagctctaaaagaaacataataggggctggatgccgtggctcacgcctgtaatcccagcagtttgggaggccaaggtgggtggatgatgaggtcaggagatggagaccatcccggccaacatcatgaaaccccgtctctactaaaatacaaagaaaacaaatcagctgggcatggtggtgcgtgcctgtagtcccagctactcgggaggctgagagaggggaattgcttgaacccaggcggtggaggttgcagtgagccaagatcacgccactgcactccagcctggcgacagagcaagactctgtctcaaaagaaagaaaaagaaacataatagggccaggcatggtagctcatatttgtaatcccagcactttgggaggccaaggcaggaggattgcttgaagccagaagtttgaggctacagtgaactatgattgcaccactgcactgcagcctgggcaacagagtgagatcctattgcttaaaaaagg

SEQ ID NO: 62496 - DNA, 1089 bp, Homo sapiens
gtggactctcatcacttaagaaagcatctgtcttggcatacccagacagagctggggaagattgtctaaattccatgccctgcaaaagtgtgtgttcaactcatggactgtgcaaaggccaaacaacacacgtggtcctagttagaaaggagtagatggaacatacactagggcacaactaattcaaggtggcatttaaaataatgtgccatatttaaattacacagcactctcttcagtcatctgatattctttcctccaatgaaaatcacttgcaccagtgagccccaatgttgctttaagaagtgttgtcttggctagatgtggtggctcacgcctgtaatgctaacactttgggaggctgaggtggacaggtcacttgagcccagaagttggagaccagcctgggcaacgtggtgaaaccccatctcttaaaaaaacaagtattgcattcgttaggtgtattgaagtgggaggaaaggttgagaatctttgagttccacagagctacccaaaataaatacagagctacataatcatacaacttagaatgactggttaactcctcatgtatatgttgttgataccagtcatttctgttttgctttccttgaattcctgccgtagtcaagaagagtacacggtgtacacagttgattaccctacctgatttttgaggatcattttgatgtgctcttgcttccagtaagggcagcagccttcatttagggaagttgacttagctgatagtggacccttaaccagtgatgtttgctagagttattaccatacaagcttaacacctaattttctgagagttgtaattggaatttccctgattctgcctaaattttgatttggaacttttagctgggagggcaggctgggtttctctttagcactgggtcctgtattccagcttatgcaatagaaccactgctctgcataagaaaatgcctttcttcttacaggaaatgtgacacctgctcactatgatgagcagcagaacttttttgctcagataaaaggttacaaacgatgcatcttattccctccggatcagttcgagtgcctctacccataccctgt

SEQ ID NO: 62497 - DNA, 1105 bp, Homo sapiens
tttgctggttagaatatgtttttgggaaaagtttctgaaggtttaggtggaggataattcctaattcctcatatcctcagctgtggagtaggtcgtctgacctcaggagcactgaagcctaggattctttatcacttaacattcaaatgtggactgtcttatattgttctctctcagggtttaatgtgcattatatcttctgctggatataaattccaaatactttttttaaggcatcgttttttttttgtttgtttgtttgtttttactgccaaactggcatatagtagttttactggtgaagatttggtgattgatattttttttctttctcttgaacctcttaggtggactttgacaatcccgactacgagaggttccctaatttccaaaatgtggttggttacgaaacagtggttggccctggtgatgttctttacatcccaatgtactggtgagaagggggctagggctgggggctttttgggagctttcttttccattccctggaaagccttgtctgtgtcgcttctgagttatggcatgattggttttatgtggtctataggaaggttggcatatccagacatgagcgtactgaacctgtgggggatagtggcgggaatgatagccctgtctctaggacaggatgacggttcttcaagtccaaagagattccggaggcttgagcctagaaaaactgttcttggctctttggtatttcgagactgaacaccagtacctctaacccccaagtgtgtgtttttttcacaggatgagtgtaaagatattgtcttcactattttccgtaactggactccacctagtttttcagcccaaccctgccacccccccgcacttcgcccctccgcccccgccaaaagtatcagtagtaaacaggagcctgtttgttttcttgcaggtggcatcacatagagtcattactaaatggggggattaccatcactgtgaacttctggtataaggtgaatatggtttgctttttttgttttttccagatggaactggctcttgggtgaggtaggtataataaatgattttggatgggatggttgactatccctggaagtgattgtcaggtgtc

SEQ ID NO: 62498 - DNA, 1098 bp, Homo sapiens
gtcaggtgtttggagcgaggcagggcagttggcactccactcctatttggagggacttcatacccttgcctcttgtgccccagcaccttctctctctgccccccgcctaaagtcctgcattcagtgtgtggagtcccagcttttggttgtcatcatgtctgtgtgtatgttagtctgtcaacttcggaatgtgtgcgtgtgtgtgcatgcacacgcatgtatgtatctgttccctgttccttctgggtcaggctgtcacttccggctctcagccctatctcctgcaacctcagtgcctcagcctgagagagagatgagatgctcttggactccccactgcatctgggctgcagggccagagctagtctgaccattaggtcagtctgcctcctgacagtttttgcgtagtcaagctctaggcggtatgggaatggctaccgggactctaatggggtgaaagagaggggaggcttgcctttgagagcctatatagccttcctgtgagagaggattagatagggttccaactgggcctacaagctcaagccatacataaaaggaccttgggacataagaaccaatgattgtgcataagttctaaattagagacacatatagtttctctctttcagcaccagctcttgcccctatgctgggtaccaagggagttctcctagctgtggcttctctaggttctaggggtgcaagcctctgtgtgtttgtttgtgtgtgtctgtgtgtgcgtatccacactaggggtgcaagcctctgggtgtgtgtgtgtgtgtgcgtgcgtgtgtgtgtgtgtgtccgtgtgtgtgtgtgtgtgtgtccacactggccagcctccctacttaccaaggttctccactgcttaccttttccagtgggacagtacagtgtgagcccccgggaagtactgcctgacctatcctaagcttttacacttggattttagccatcatatgttggccaggtctcactgcagcctgcccgaggctaactggctagagcctccaggccctatgatgctccctgcccaggccatatcctttattcctgctgagcttcctggctgaatagatgaaatggggtcaa

SEQ ID NO: 62499 - DNA, 1809 bp, Homo sapiens
ttttgggaaagaggagcacaggagcggaggaaaaacttggccacagtcacacttggaaagatagtagattattttcgttctcctcagcaggtctgctgtattcctcgctcagcgctcaaagatgtgggtgatgtgtcaaggaggcatgcactcagctggtccttgctgagttatttgctgacacaggtctcactaaggtggctgaggggtgggagggagaaggctaatcttggaaccttcacaggattggccttgatccttgggtaacacaagagtgattcctgatttttagacacctaatatgtgcctagtgcttttctctttgttcctcactatcctgcaaggtaggtattctcacttacagatgaataaatgggctcagagagattaggtgattagtgacaatcagttgtaacttagcactgttaggctgcaaaccccttgctccttcctttccaccaaactatgttgattttccttccttacctccctccttgtaccacaggttctgtcctcaagatatcaccccactgggcagtatctgaaggcagacccagcccaagatggtgcagaatatacagctcagggtgaaagttcttctgggctcctgctaacaaagtcttggaaaaactgcctgggaagccatattatgaattagtgctagaagaagctgtggggggaactgagttctgtgtctaattgcattacttatgtgtccttgaataggacccataactcctcccggcatgcttttgcatctatagaactgaagctgtagttctagatggcactaagggtcttggttcatattcagctgctgcttccccccaaggaaaagatgaggtttttccccttcgattaccttttgagggatgtttaggctcaaattctgcttgccacagaggaaacatttctgctgtagttgtttacctccatcctagctggcagtgtgggacacacacatacagcaagtgaaggtgggggtttgggcctgtatagaggtcagctacgctgcaggctcatctattcacaccagcaggtacagagaaaactagtgttttgtaaagtcaaatatttgttgggggttggagttctggggttggaggaggggctgttctgggcatcagttgagcagatgcccaggatgcctgggggagaccagcttcccctacaaatcagagctctaaattacaaggtttttaccaacgtgaacagttgggggaagtcgtctgctctcatttgcgtaatggtttctgtcactggtgattagacacaggatgaaggaaaagaaatttgacaattaggaatgagcgatcattaatctgaatctgttaggagacagagaggggaaggatccttatcagtgggccagcccagtatggggagacactccctccctctgcccccagagactcctgggctacatcctctttcagtattgccacaagtgggcagagcttgtatttcttaacaaagattagggacccagttgccagcctgagatggatataggaacagacatctttgggcatgagccaacaaagatagaaatagatgagtgtcaggtacaagctataaggcaaagaataacagtggaaaagttttgacatgtgtttgccatttgtggaaaatgtttttgtaatagtcaacacccctcatagcccacctgtgacaagtacttgttacattccagcactgtagggcgtgaggaaaatctggtccttatcaaatcccaggagcttctgcttagttggggaagaaattacatgaagcaaccagaggttataaggccacacttgtatatcgtgc

SEQ ID NO: 62500 - DNA, 2066 bp, Homo sapiens
tccctacctctgggtcttccacccttcaaaatctggtacagaatttagcaggggctgcagggaatgaccctcagggaccagtttcacccagatggggtagatgatgaggtatacctagaagtagctcagggctccagagtctggcctttcagctggtgtcttactcccctttgagaccttcagctgcttgtcttccactgcctgcatacttctctgatgtcttctcaaactgttggctctaaagggatgttccagcctccctctccagagctgcctgcagtttcccttattcagctgtctcctgcctagtctctccagcggcctccttaccaagaccctttttcctaaacagttgtccttccctcagaaactccatggctgcaagtgtgaatagacttgtctttaggatccctctctctggtcatccctgatcatcttagggccgtctcccttttctgatttttgacagctctgtttattttgcccatggctagtcctcttgttttgtgtctgctgtgtgttcttgcccttccattgtcagttctgtacatcctggttcagcttgtctcactgtggtagccccttctgcttgtcttcagccatcttggtttaatcctcataggtcatggatgaatggagccttgctgagcactttgagggcatttctgttgggcacaacctcagaaacgggaagtcttgaggcctgggggcgtgtggtcagtgaggcctccagaggtgggttaggggtgggcacctacaagggccagttgaggggagaggtgcagggattgctgaggagactttgtgagaatgatgtcaggcccgggaagctggtgtggaagaactgagctgtcagaaggagataccaatatcccctttgcagggtggtgatgggcatcaaacatgacgtggaacatgtccccttcatggagggtttccatctaaatgcatctgtgtgccttagggatcagtagttcaggggtggtggacttttttgagtgtctcctaatttctctgaggtgtctttggctctgtgtcaccaaatgtgcctgacctctgcatcccagtggttgctgaaagggaaacagtatattgcgtagtcagatgtcaggagtagagatcttaatgagaaaggccctggcagctggagagatgagaggacctagtggtcagcttatacccagactatctctccactcctccaagagtttgagtcccatagctgatgaaagaatttacatatgggctcccccctgctttcccactgaaaatctattctcatattttgggaaggagcatatgtcctttaactttcaatggtaaacaatctaggatagtgtttaaaggcatggattttggagtcacatatagttggtttgaatttctagcttcactacttaccagctgggtttgaccttggttgatttacttaacctctctgagcctcagtttcctcaactataataacatgggtggagggaggcatgttgaaaatatctacctcagggttgttggaataactgaaacaatgtttgtaaagctttagcacagtgcctggcaagcacttaataaatggctgtggtggtggtggttatatttattatgtgatttattcagaaacttggtttcagtgatctctaaacagatttccagtggttctttctctctcaagaaaagcatagggaaaaacgagaaacaccttagataaaccatattgagttgagggtagacagaagagtctagtacctaaactcaccctagaggaagagaaacaggaagtgtcttatgcctcttctgcctgggcagccagactttactgctgtactaccagcccagggccttgggtgagaaggtttcaggtctgagctccccttgcactgtgtgagaggccgtggagccgaatgagtccttattatacctggagaagctgttgtctcctcacaccatgaaatgtaatagcagtcaaatcaggcccctcttgattcaattttagtccatgcctttccatgtatttaaattatataagtgttggccaggtgtggtggctcacacctgtaatcccagca

SEQ ID NO: 62501 - DNA, 1104 bp, Homo sapiens
tgctcttgtctgtgaccaggcactttgcctaggctctgacctcatgtctcagtccttttgaacattctggtcacctgcctagtttgaccgcagcctgactttggtctgtgaggggtcctgggctctctgctttatgcagccaccatatctgatctttgtgatgtggttgtgaatcttctgcttctatctccaccatcactgtccactgcttgggcaatatggttgctcagctgagagattggcagcccagattgctaaaggcttaggagacatgaaaggtgagtttggaagtgtttggattttcaaaagaaggacagaggcagaagccaaccacagtttaagggggcagctagtagagagctttttaggcaagggaggccactgcacatttataggcagagaaggtggcaggacagagaatttaagagaatgaggtctcagaggaggcataggatgatgggatatgaaatagcaaaggcacacccaaggtgatcctgaagctcagaaatattaagtcatgcaggagggggcaccattggaaatataatcccctaaagttatgagtaaacaaatgatggtggggtgtggagggtagaaagaaggcctaagcttgatgtgggggccacagcctgggcaagagaaatttccagcaaagcctctgacaaatttctgacaaagcctctcatgttatctagttgtggcagaagcatctgaaccaaatggctaggaagcttggtgaacagtcagacccagtgagggttgattaatggatccatgtcagcctagactagagggaagtctccagcagtatgccttagggctcagtctgggcctgtgtcctctctgacatttttattgacaactgaccgaagcagcaggctcatcaagtttgcaggtgatagagctaggaggggcagttaatactttgcatgaaagagtcaggattcaaaacgatttcaacaggctggaacactgggctggaaccaacaagattaaacttaacagggataaatgtagagtcctgcacttaggttaaaacaaaatcaatgacataagtaccggttgtaggggttggcccagcttgacagcagttcatgaagaaaa

SEQ ID NO: 62502 - DNA, 1034 bp, Homo sapiens
ctgttctgagaactcaataaaacaatcacatcaaatatgaagaggcataaatcttgtgtctgcacaggtaacctactcaattgcttttattatcgctcaggctgcctccatttattaccgttcatggcctgggcaaaggaggctgcgtggagggtggtctccagtgcaatcctacaccctgagaggcaacaatcagcccatacagccagagatttcgatgggagcccaggaagggcccatctgtctgcatgaaaaccaatcaataactctgtaaccagagcccttgtcacagggaaatggacaacacaacagttcaatagaggggccacagggggaattagccaagtggagatggggccaaacaggagcagcccctagagaagggaaacaggggtgcctggagtaggggagattagggaaggggtggagatgtggcaggggagagcaatagcttcatatgcatgttggtattagatggggagtattgtgcaaaatagacccagggaatgacaggcaatgttggaagttgaggtggtagggaacatgtgttttggacagcatttgggaaatgggcttgttctggtgcacatgggagagtgtgactatgcatgatggcatgtgcttgcggactagaatgttacagcttctacagaaagaggaacaatagtagtaactggtgtggaagattaatcacactccataccccctaaaacccctctgaaaagggggttcctatgagcccacatgggataggggtcctgcttcccagtcttcttagcaggactgatgaaagagccccattgtccgctcccagcttcttaggtgtccaacaatagctactctgcaggttgcctcttaatactcaagtctatcttcaccccctccttgtgtctacctggaattggagtttttatattaagaagagaacaatggtgtaaaagtgacaagcatccagtagaaatcatacttcaagtacccaaacaaccattctgtttctcactttcaatacagtattcaataaattgcatgagata

SEQ ID NO: 62503 - DNA, 1021 bp, Homo sapiens
gtggcatgagcctgtcaggaagacaaaagctcagaacaagctgagacaacaaaaaagggccttggagaaagaaagaaaagaaaggcaggttttggctcagtcctagggaagaggatgtaatattgagagagaaggcagaacttctcaaccttagcttgcttttgtcttctccaaatgaaagaatcttcaaactgagcccagtaggagggcactagtgccctggtcagggaggggccaggcaggtaacctctggccatttcagtgaactttcccaggtccacacaggaccctaaaactgctgttgatgatccctgagatgtcacaaagaaagggtgaggcagtgacaagcccaaggccatcctgcctgtcagaaaagggggaagaggtacacatatgcaaatgacactcaaaatcataaattcaggatcaggctctggaaatcctttaaatgaaattattatacagttaatttatgggcaacagaaaagaaaatggtgatatcccagagcttgcacgcactcacaaaaataagttgtggcatatttactccatatcaacgcttagatcaaatacctccctcataaacacttccctagttgccctgagtggaagcaactgctcctttgtttttttcgttcatcatatgacttcatgccttgatcacggcattcatcacattctgattatataatgatgtgtatgtctacctccctgctagattgtaagtttcttgaggtcaaggactgtgtcctatttacctttgtaaatcagtcctgccatactttgtacatagcaggcactcaatttgctcatcgatgtaaaccagatttttaaaaataatttattaaggaaattatgtggaagtagtgagtgttaacatttaaccaagaatctccttcctagcataatggacaagatgaaaacaagtaaaatgattgatggctgttgggctcagtagttcccaaagcattcattcacttacagcagccaggaggaggtccccattggtgggccatgtggc

SEQ ID NO: 62504 - DNA, 2444 bp, Homo sapiens
ttttgtggtaacattagtatagtttaatttatattttaaacattaataatttagataaatattaaatattttactaacatgcaatttgtatgtgttttaattggctatttagacagacacatgttggattcaccacaaaaatcaaacatcaaatatggaggaagtagattgtctatcactgggacagagcagtttgaaaggaaactatcctcaccaaaagaatctaaacccaaaagggtgccaccagaaaagagccctattatagaagctttcatgaaaggtgttaaagagcaccatgaagatcatggtatacatgagtcacgtcggccttgtctgtcactagcctccaaatatttagccaaaggaacaaatatctatgttccttcttcatatcacttgccaaaggagatgaagtcactaaagaaaaaacatcgatccccagagagaaggaagtcactattcattcatgaaaataatgagaagaatgatagagatcgaggcaaaaccaatgcagactccaaaaagcagaccacagtggcagaagctgacatcttcaataacagctccagaagccttagcagcaggagcagcctgtccaggcaccacccggaagaaagcccactgggagctaaattccagttgtcactagcttcttactgcagagaacgagaactaaagaggttgagaaaggagcaaatggagcagagaatcaactccgagaattctttctcagaagcaagcagtctttccttaaaatctagtatagaaagaaaatataaaccaaggcaggaacaaaggaaacagaatgacatcatacctggaaaaaataatctgtcaaatgtggtatgtgtaagaattattgaattagcattgctactgctatgtcatatttagaatactaaatttaaaaatatttaagagttgttacatcacattgacgtctttcctgaaggaaatacttatgcacagtttgtgtagaagctggtttcattacatttcctccagttgcccttcatcgaactcagtaaagcagtgtttcttatccttagttttttcagactgggaacaaagatcttttttagtcagaaaagtaagcattctttttttttaaggcaagtatagtcttacttatttatgtgtagacagtcttgctctgttgctcatgctggagtgctatggcgtgatcatgtctcattgcagtctcaaactcctgggctcaaatgatgctctcacctcagcttcccaagtagtcgagactccaggtacctgccaccatatttgactaatttttgtatttttttgtagagacaggtctccctatactgcccaggctggccttgaacccctggcctcaagcgatcctcctgcttcctgtactttgggaggcctaggtggaaggattgcttgagctcaggagtttgagaccagccagagccacatatcgagaccttggctctactacaaataaataaataaataaataaccagtcatggtggcatgtgcctgttctcctagctacttaggaggctaaggtgggaggctcgcttgagcccaggagatcaaggttgcagtgagtttgatcacaccattgcactccagcctgggtgacagagcgagaccttgtctcaaaaatacagtgttctaatataatattcttgaattattgatataaacgtaaatcagcattttgaaaactgacttcatttttatgatatttttacatgtttatgatacaaatgcccttaatttttatgacaaaaaccttaagatctttaaatattttattatagacattaggatttacctccaaatatgggtgcttgccttattcaatctagaaatctgtgtttaaatgttaggaagaatgccttcacattctttactgtccccaacacttaattaattttatctcattgtgctcataggaaaatggacatctctcaagaaaaagatcctcttctgattcatgggaacctacttcaggtagaatcaaaattaaatttatggatttctaaataaatttccattttaatggcactgctttttaaaataaatttgtttaaatatgcagttcccttcttggggatgaattaagtgtctcatattaattaagagtttggtaagatcatattaaaaaagactagtccctgaatctagtacttataatttgggtttgtttttgagacagggtcttactctgtcacccaggctgggatgcagtggcatgatcacgactcaactgcaagccttgacctcctggcctcgaatgattctcccacctcagcttcctgagtagctgggactacagatgtgggcaactatgcctggttaatttcttgtatttttgtagagacgaggtttcgccacgttgcccaggctggtctcaaactcctgagctcatgagccaccacacctgacctagtgcatataatttgtaatctgt

SEQ ID NO: 62505 - DNA, 2539 bp, Homo sapiens
aattaaattttagcaggctctaagcagaataaattccctgaaaaaagaaaaaggaactctgtggactcagatctgaaaagcacaagagaatctatgataccaaaagcaagagagtccttccttgagaagcgtcctgatggaccacatcagaaagaaaaatttataaaacatattgcactgaagacacctggtgatgtgttgcgcttagaagatatatccaaggaaccgagtgatgaaactgatggctcttctgcaggcttggcaccttcaaattctggcaattctggccaccattctaccaggaatagtgaccaaatccaagtggcaggtaccaaggagactaagatgcagaaaccccacttacctttatctcaggaaaagtctgcaattaaaaaagctagcaaccttcagaaaaataaaaccgctagctccacgacaaaggagaaggagacaaaactacctttactttcccgtgttccaagtgctggttcctctctagtaccattaaatgctaaaaattgtgctcttccagtttctaaaaaagataaagagcgttcctcatctaaagaatgttctgggcattctacagaatccaccaaacacaaggaacacaaagcaaagactaataaggccgattctaatgtatcttcagggaaaatttctgggggacctttgcgctcagaatatggcactcctacaaagtctccccctgctgctttggaagttgtgccatgtatcccaagccctgcagcaccttcagataaagccccttcagaaggagagagttcaggaaattccaatgcaggtagcagtgcactgaaaagaaaactaaggggtgattttgatagtgatgaagaaagtttaggttacaacctagacagtgatgaggaagaggaaacattaaagtcactggaagaaataatggctttgaacttcaatcagactcctgcagctacaggaaagcctcctgctctttccaaggggcttagatctcagtcatcagactatacagtaagtagttctgtgacgtttatctttacttgaagagggaaagatgattaattagtgaaaggggtggattatcggaacttactttaaaatttagtatttattataactcatatttgtactgaaaatggaataattcttgtttggtaaatgagtttccatatctttagttttattactgtaagtcagtggtctccaaactcttttgatcacacacacttaacaatttttgagcatgtaccccaacatatatgtatacctttagattatatatatgtaccactgtaatactgtgtactttctaaagcatatgcaaaaacagaatttaaaaggaagaagaagagaaaaataagtattttcctgtagaagtgacgtagaagttactatagactaagttctactggagtctctatagaagttccatataaatagaagttctattattttcttcctgcaccccaatggatcaccttgcacaccccctgctttggagaccacatctgtaaatgaaggtagagtgtagaaatgttgttgattgtggtgtgcaattttatttataaagtgcttcattctatcttgggaataagctgaattaaattctaagatgtctgtaaaatttggtggggaaggtgttaatattccatggtaacacctaaaaattagtagtttgattctactaaaatagaatttaaaagtaaagacagggtagccacagagtccttgagtgtttgcagtcacatctcaaagttagcagggttttataagtactgcctttcctaataggtagtaaaatcaaattgtctgcagtgcaaaatactagatttaaagcatgatggtgaaaattatcctttaagaaaggtgttatcctggcccagattattgaaatagaaaatagtctttcgtacccttaattacttaaaacatcccagttcttctactaagacatgtggtaaagtatttctaaatgttcttgttttagggacatgttcatcctggaacttacacaaataccttagaacgtctagtgaaggaaatggaagacacacaaaggtttgttagcataaagattaatttgctaaatttaacattttgcttgtttgtgtggcttacttttaatttaccttttttaaaaaatcatgagaaattagcgtgcattttggactctgttgtcaactgtgttagaataagatatgttggccggacgcagtggctcatgcctgtaatcacaacactttgggagacccaggcaagattacttgagcccaggagttcaaggctgcggtgagtcgtgatggcgccacttcactgcagcctgggtggcagagtgagacccagtctcaaatgaaaaaaagaggccaggtgtgatggctcatgcctgtaatccagtactttaggaggccaaagcaggcaaatctcttgagcccaggagtttgagactagcctgggcaacatggtgaaaccccatctctacaaaaaatacaaaaattagccagtcatggtgccacatacctatggtcccagctactcaaca

SEQ ID NO: 62506 - DNA, 1040 bp, Homo sapiens
ttaattataggaagcagtgtaggatagttgtttgacacatctcatgcctttattaattatgattaagatcagtgtataataacagtgattgtcaaaataatagtggtttaaacaagaagtatatttgaaagaagtataaaagcaggaagtccagggctggagtgccagttttaccatataatctttcttctccaccattcttagcacctagcttcgggtgctgttctagctccagcctttagttcaaattcccagaaattccacacagcattcccacacactaagttagttgaatagaaaacttagtcaatatgaccacacttggccacaagggaagccagagagtgatgtttatttcaggcagccagtgtttgcagctacagatcagggttcagttaccaagaagaaaggcaaaaatagatgctgggatgtgcaactagtaatctccaccacagtgcccaaactgatctaatttctctcagtgcatgatatctcagctctagagagatcacatcagttctgctgccaattttttaaagtacttccccagtctgagacttgataggctctttctcaacactaccagcaaatgtagctttgtctgccagttaaatgtggagcctagccaacagattggatcagctttaggccatcaattaaatttattttatgagtaactcatccatattggtatagagtccacctctatggactgaagacagtttgcttgctcatttctctgattatgtcagatgtgttggtggtgatagtagaagtattttgccatgaagttaatagccatgttgattttactttattttttcagatcgggaaaaacagatcagatttttttgacaacacaaggtttccttacgtctgcttatcactatgtccagtgtcctgtccctgtgttaaagtggctgtttcgggtaagaggaatgtttagagggttatagttgcctcctactatatttctaagtcaaaagcttttaaacataattttatttgcacattactgcagaaaaaattaatgtagcaca

SEQ ID NO: 62507 - DNA, 1118 bp, Homo sapiens
agctctgactttagaattaaattccaccttctccacgtatcatatatattagttgggtagaatatttaatctctctgaacctatttgctcatatgtgtaatgagtactacttcataaggttatcattagtattaaatgcacataaaatgcctttatttttattttatcttattgtattttatttttatttttgtggtacaatcatggctcactgcaacctccacctcctggtctcaaccagtcctccactacaggtgtgcgccaccacacctggctaatttttgtattttttgtagagattgggttttgccgtcttgcacaggctggtctcaaactcctaagctcaaggtatccgcccgccttagcctcacaaagtgctaggattacaggcatgaactgctgcgcctggcctacataaaacaactttatatgtgcctagcaaataatgaatgtttgtgttttctttcttcttaatatcctgtcatttctctgcttttgacagatgatgtcagttcatacagactgtattgtgtcagtgcagattttaagtacattgatggaaataacaattagaaatggtaagtatatcaacttattaagatttaccgtgtgtattattggttgctatttacatggtatctttcacattgctaaatgttagtatatttggaaatatacaatacaaaattatttttctaatcaaaagtcgttttttttggttttttttttgagacagaatcttgctgtcgcccgggctgaagtgcagtgacacaatctcagctcactgcaacttccacctccctggttcaagcaattctcgtgcctcagcctcccaagtagctgggcctacaggcacacaccgctatacccagctaattgttttgtattttagtagagacagggtttcaccttgctgcccaggctggtctggaactcctgagctcgggcaatttacccatcttggcctcccacagtgctaggattacaggcatgagccacctcacccgacctcaaaagtctttaataatgaaatggaacttcagttaaacaacgagtatctgaattttcttacttgcattgagaaaaagaatataagatcttgcaagtggaaaccctca

SEQ ID NO: 62508 - DNA, 1672 bp, Homo sapiens
gcttggccaacatggtgaaaccccatctctactaaaaatacaaaaaaaaaattagtcaggcgtggtggcaggtgcctgttatcccagctactggggaggctgaggcgggagaatcacttgaacccgggaggtggaggttgcagtaagccgagatcacaccactgtactccagcctgggcgacagagtgagactccgtctcaaaaaaaagaagataaaaaaaaaaagagttaatgacagtgtgaaacatttttagttgctgaattgaatcagtgatacagaaccattaagaaaatctcaaaaatggaaaatggagaagaaaatgccacttaattcaactattaacattgagtagttcttgccttcttttctctagacatcggatgtttgttttctttatagttcttttttgcatcttttgtcaaaaagagtttataattaaaactctaaaagtaaaatatacctcctaaaatatttttgtctgtgcatttatgttaaacagtttctaggcttgtgtacatctatacatccagaaggttaccaggatcgtgaaataatgttgctgattttaatgttatttaaaatgagtttggaaaaacagctgaaacagattcctttagtagactttcaaagcctcctgataaacctgatgaaaaacatcagagattggaacacaaaggtaatgttacttaaaacttcattattcattttttatatagcattacaatttgactcatagtgcatatggaattaatactgtttctaaactcaagatctttggcggattaaaaatgaactgaggaagggaatgtttgctggagctgtattatttaaattcgtgataattgaattttttctaaaacttcaactctttatccaacaaaaatgtgtttattggggatttcctatggactaagcattaatgtaggtgctagagattgagctgtgaaagagacaaagcctttgccttcatggggcttttgtcctagtcaaagggttagataaacaagtaaatgttgattatattatcatgtcaggtagtagttaagtactacaaatgaaaataaagcaggacatgagtacagcaagaccagatgctatgctatttcatataaggctggcagggaaaggcctttccaaaataaccttggagcagagacctaaatgaaatgatggagtgagtcatacctacaaccagaatttgagttgaacttctgcaaccatatggaggatgaacatgtataatttttgttaggcctttttaaaaattatatttttcagtcttttttggtggaaaaattaaaatatgcaaaagtaaggcaaagagtataataaattcctaagtatcactttgcttcaataattgagacataatcttgcctaatgtaaaaccgaccctatatttcctttccctgctcatcagattattttgaagcaactgttacgcttttttaaaaattgatacacaatggtaatacatattttgggggtgttaggcttttttttttttttttttctgtaagacagcatctcctgtcacccaggcaggagtgcagtggcgcagtcttgtctcagtgcagcctctgccttccggattcaggcgattctcattcctcaacctcccgagtagatgagactatagatacatgccactccgcccagctaatttctgtg

SEQ ID NO: 62509 - DNA, 1653 bp, Homo sapiens
tttggccaggctggtctcaaactcctggcctcaagtgattcacctccctcggcctcccaaagtgctgggattacaggcttgagccaccacacctggccaggtgttaggcttttaaaaatactggaataggatccctaaagtgcaagaaatcccaaatcaggaacatatatggtcttgtacagctctcatacacatttgtatttagatcagtttatctttccaagaaggactgtttaaatatcaatgggagatatgatgtagtacaaaacgtgaaagccaagtgaaattctgctaaatgtatctgttcagtccatttaagatagtataagtaaaactgaatctgtgtattgtgtacattttagcagattctagactccatgctatttctaaaaatgtgctctgttttgtactagtgcttccattatgtcaagaagggttgtagatgatctgttgggtgttttattctactgttctgtttgaaaagaaatcttacatgttcttttttttcaggtgcctgaactctgtctgggcataaatgaactctccagtcatccccacaacctcctgtggttggtacagctggtccctaattggacatcacgtggaaggtattaaaaagtgaaaattaaacattaagaaattttataattttacattaatgaaatgccttgggttgtttatttccattcatcattctttgaatgttagatcagatatgtttatttcatattcagttgcgagaaaaggcattgatagcctgattctgccttattctaattcttaactcaggtcattatgtaatttttttttttttgagacaagagtctcactctgtcacccaagctgaatatttttttatttttaattttagtttatctgttaccttaatacagatgacatattccacaaaaataaatgaattagcttttttttgctttagtaaaaataaatttcatcagtaaaaaaataggttttctgtcagtaaatcatcagggtcaaagataaggccgttaaatgatttattgagcttcagataactcaagttttatgtacagatattttacatgaaaattttactgttctataacagcttatatgttcctgtacagacttctcttgaaacattgcctatatttccaattagaactagagctcctcttggctcattcatttgcttttcaagcagtattaattaaaatacattctaaatacttttaacttctaattctaggcaactgagacagtgcctcagtctagtgattatttcaaagcttttggatgagaaacacgaagatgttcctaatgccagtaatctgcaggtataaataaatacatttttatttttaataaatgggagaggtaatgagaggtgtaaggaaaattgatgaaccctaagtcaaaggtcctggggtcagagctcagctcttaagcttgatactgttcatgtaatctctagcacacttaactaacaagatccaattttttcatctgtgaaatggagataatattgcaccctccaccacttagggtggttgtggacaatcagatgtgaattaatgtataaagaaactactgggaaaatcataatgtgcaattatatgaatatgatttcatttattgaattagttcagcttttccaagttagcaatttta

SEQ ID NO: 62510 - DNA, 2849 bp, Homo sapiens
caccataggatgggcacagtggctcacgcctgtaatcccagcactttaggaggccggggcaggtggatcacgaagtcaggagatcaagaccatcctagccaacacggtgaaaccccgtctctactaaaaaaaatacaaaaaaattacccgggcatggtggcggacacgtgtagtcccagctactcgggaggctgaggcaggagaatgacatgaacccaggaggtggagcttgcagtgagccgagatcacgccaccgcactccagcctgggcaacagagcgagactctgtctcaaaaaaaagccccatagaacctgatctggatgtccctttgttcttgtttgaattgcaatttggtacaaggtatgccaccagatcctaggaattaaaacaaacaaagatttagattagagactctgcccttgaaaacataatctaatggttgaaacaaaattaaccaactcttatgggttagtgtggtaagaacagtaatcgaagcatgcacgagatgctgtgggatggagagactgatgggcacagctggtttctgctttagtagaattgaggtagatttgattccagatatatggggatcatgctggagctaccaggataattagcagatagttctcattcctttcattgatatttactgccttcaaaagagatccggggataggatttctaccatttctcctaacttttgttgttctgttactttttccttttttgcccatgtaaaatagaataattagctgaataattacatgaataattaaccctcaaactcactaactgatattcaagtaacaatctagttgtgatttttaccacaacttcttgtagttcttctcagaattcaatgacttctaaccacagagtcaactttgttgactttcaaataatttaacagagaaagcattccctgtggcctctatgataatatcgtttggtctcctaagcatttatcctaagttacaagtactaaatctttaacttaaaatccctttttttttttttgagagatgtagtattgctctgtcacccaggctggaatgcagtggcacaatctcggctcactgcaacctccaccccgcatattcaagtgattctcgtgcctcagcctcccgagtagctaggactacaggcatgtgccaccatgcccagctaatttttgtatttttagtagaggcggggtttctccacgttggccaggctggtcttgaacctctaacctcaggtgattcacctcccttggcctctgaaagtgttgggattacaggtgtgagccaccgtgcccgaccacttaaaatccctttttaagcaattcagggttttacataaagggaaaatggatattgttaagtgtaaagaaagctataataaaaggacaaaatgaaagagtacacactggaaaaaaatagcctaagaaagaacaactatattatttagctttgttcaatgtctcctctttcttttgataggtatcagtcctacatcgctatcttgtgcagatgaagccttctgatttgttaaagaaaatggtcttgaagaaaaaggctgaacaaccagatggcattattgatgacagtcttcatttagaacttgaaaagcaggtatccagtgctagaaggtctcaaagagtacatagaagcataactgttatcagcttactaaccatagactgatatgtaggcatttctggatttggacactagacacattctagcaaacataattttaaagcgaataatatttttaatttatcactgtcatgaaattcttccataaatttgagagttgaaaatttaggtaaaaggatgattgttggtaatttgctcccaagagtattttttgtagccctttattagggcagtcgtgaggtcatgaatcatggtaaaaagaatgcacttgagttagaaatgagaaagcctagtttagatgcttcgcttttacttactgaccagctgggttaacttgaccgtatcctttatccttcctgggcaattttcctaatgtgtaaattggaatgacatctatgctagctaattcataggtgttaattttattcatttctctaacaggcatattacctgacctacattcttcttcatttagtcggtgaagttagttgttctcattctttttcttctggacaacgggtaggtagtgtttagtgttgttgctgctgtttttaaataggtgttactgatgatggaatgagtgagcatgctttatataggagaaaactatgtaaacttttcttaatataaaagctaattgattttgctataagaattcccatgtataccagaaagaggggcatgataatggtcttgtaactatatcgtattgaaaagaattgttggccaggcgccatggctcacgcctgtaatcccaacactttgggaggccaaggtgcgtggatcacttgaggtcaggagttcaagaccagcctggccaacatggtgaaaccccatctctactaaaaatacaaaaaaattagccaggcgttgtggcaggtgcctgtaatcccagctgttcgggaggctgaggcaggagaatcgcttgaacccgggaggtggaggttgcagtgagccgagattgcgccactgcactccagcctgggcaacaagagtgaaactccatctcagaaaaaagaagaaaagaattgtcagcaaatgttaattctgtttgttggagtggaacttaaccattatactttggcagcagtataatatattcataagataccaacatcaccaaataccaaatgggctggtgttgtgctggacccatattgactccagtagaaatggcagtcaggtggcagcaggctacacaggagaac

SEQ ID NO: 62511 - DNA, 1662 bp, Homo sapiens
cctagctaatcaggaggctgagactggaggagcacttgagctggggagttcaagggtgcagtgagctataattgtgccactgcactccagcctggcaccagagccagaccccatttctttaaaaaatttttttctttttttttttttaaaaggctagccgttgtctgaatattttgttagcgagtatgttaaaggaaggactctttaaatttctgagtactatattacccagttagagctctggggttaattttcattaatgcgagttaatgcatagcaaaacaacttttgttacagtgtgtattttttaaactagtaatcttattgtcatggaagcagctttcactgatacaactactgttacgttgaatagttaatatcagtcattgctaacaggaataatagatttttaaatgatttagttgttctagctgcataatttctttgttaatttgtaatgcttcagaattgttttcatcccttgcatttgttttgcacagaaacactttgtgctactctgtggggctttggaaaagcatgttaaatgtgatattagggaagatgcaagacttttttacagaactaaggtaagtgtgttctttctttttttctttttttttttcttaatcttggttacgttaatatttaaggatagaagcatacaggcctatattcagaaaaagaacatataaggctaggcatggtggctcatgcctgtaatcccaatactttgggaggctgagacaggaggattgcttgaagccaggagttcaagaccagcctgggcaacatagcaagactccatctctacaaaaatttttgaaaaatagccaggcatggtgtcatgcacctgtagttctggctacttgggaggctgaggcaggaggatcactggagcctaggagtttgaggttgcagtgagctatgaacacacatggcactccagcctgggagatagagtaggactctgtctcgaaaacaaaaagaaacatgtaagattagaaataggactttctcttttaataacagaaatcagctcctgctaaattagtgtagctaaattaaaagtgaaaggaaaaaaaatctcaaagcaaatacacttttcactttactttctgttctgaaactcctgacacccaaggagaaaaatacttctagtactaatgatacatatttttccccattacacaaattaaaaccttcatgcttaagttaccatcaaggattgaagcattatttaaataaatacgtaagttatgaaacagtggctttgaaattttatgatggttgaaaacttgttttattcatagagtacaaatagattagctgttattctttgaatgtttcattgaagaatatgttaaaggaaggagtcttcaatttttttttttttttttttttttttttttttttttttgagatggagtttcactcttgttgcctaggctggagtgcagtggcacaaattcgactcactgcaacccccgccttccaggttcaagcgattctcctgcctcaccctcccaagtaactgggattacaggcgcccgctaccatgcccggcaaatttttttttttttttgtatttttagtagagacggggtttcactgtgttgtccaggctagtctcgaactcctgacctcgtgatctgcctgcctcgg

SEQ ID NO: 62512 - DNA, 1036 bp, Homo sapiens
tatttatgttttgttgtttttgtatttgtttctaaccttaatagattttcttttaatgctggtcatgtactgatgtggtattaaaacagaaaataatttaatagcaaaactatactaatcagcttaacattatttaatctgcttaactaagcccctccatgtgtgcagtggtgagaaaaacatcctgcacttattttttactgttttttgttgtttgactactgaatgtgaaatttgaatctgattaccataaattttcagagaagtcaatataaagattttattacttgtcttatcaaagcccattgtctgatgattagtagttttataaggattaattcataatatgattaaattttgctttaccctcttttttctccttcccttttttaggggcagcttcatgacttctgggtaccagattcttaataggagttgcagcagcaaaaatatgaaccaagagaaattcaataagagcctttcatagaggagtagaaaggattattacagaatccaatgaatgccaagaaaatgtacagcaaatgtgccacttgaatatctagtatgaagctggtaatgaagaaattgccatttctgaagcagatatgaaatatgatctgcttaattgttaaggcaactgacctttcaaaagtgcagagtcttattaaaagaggggaggggtagaagcagaataatagtcatatgtctaacctgccccagttaactcctcttgttaaattataagccagttatcttttttagatagtatttttgtcacttggataatcacaggaaatatataagaaaagagcttggactaacttgagaagttggacatggaaagcaagaccaagttccagttgggtttaattttccctcttggttattttcggacacaaagggaatgcttaaaactgagtttagtaataaaaagcataaatctcttctgtaacttttataaaccacagggaggtttcaatccatgcattttccttcattactcaagattataaatctgtttttaaaatacatctaa

SEQ ID NO: 62513 - DNA, 1918 bp, Homo sapiens
ggggtagtaacaaactcttactagccaactagaaaattattttgttgacgagatgtcccttttaggagggtttgtttcctgaaagaatgccaactttttttgttgttctttcagtattggcttgagtgacctgttctcctgagtgctctagtgtctccagttgtgggggggaaagatgatggaggggaacagaaactggacttgatgtttgcggtttgagaggcaagaaaataaaataactttctacctctaaattgaggcttaggagtaaaaagcattttgtcctaaatttatcatttaaaatagcatcagtaacttttgagctcatgtcaatcaagcattggcagtcagagattttatagggaagactaagtaaatccagtttccaagaacctaaactgattgaggctccaagagtcagaccaacaaaagttttattctgtgttgtttactggtaagaatattattatcttgatactacctctcaagggtattgttacaaaatgccacttatggttaaagagatagatacaaagagttctatttgacagaagcttgaaactctggcatctatctgcccaacgatgggggctttcgttctgtaatttaatcctttgtagatacattatttgtgtgtaattttatacgtgttcatatttttctcattttgcattgtgtaaagtgtacaaaatctcaaagtataaaatactgcttatattgcttgtaatttacagtgtgtaaatattttctaattgtgtacattgatgggggggacaagtgggttattcaggtttttttttaatgacccttttgtattgcagtttcaacagataactgtccatcaaatttaaaaccactttgatacatttttatttaacagttccaataagaaaaaaatctctatttttaattatatttctcctttagaaaaaaaatacttcatggtccctctaaaataaatggccagacctcagtttaggcccttgtatttatgactctggtagaggtcttcagactccaggtcatagtccagtcagtatttgcatttgggttctcatgaaaactttgtgactctcttttagcacaagtagcccatggtttttcttccaaatcaagtattttacttctcccttgagtccccatgctttgtctccctcctgctgctattgcccggtgaatgggatggtagagagggagaaatgttcattgcacagagaatgtcaggccactttggggacttggcaaacgaagcttgcactgagtggtggtgtgtttggcaatattactgtgccaaaaatcaccttgtctaattttatggatatgtatggcaaacttattacccttcttgcaagctgcacattaaggtacttgtaagtgtttatgcttttgtgtgtaactgtttgccttttctaactgcttttcttgttactgaaaatataattctactagttttatcacattaagaggctctccatgcacaaaatgcattgatgtagccgtaaagtaacagcatttgtacattttctatctcctgatggcagtggtgcctttgtcaccttttggaaggtttgcattttgtttctgctttcaagcgcaaatagtagcttgctttcagcttcacaaaaatctcctcaaatgtaaaagatacaaaatggcgtgttatcatccaggcttagttggagtatttgcatttttatttttatcaaaacaaatataattggtggggactggccagtaataatgtgtggcgtctttaagccaagagtaatttttaaattaaaaatgaaaattttaagaggtagcccattaaacaagctactgagttggagaattaggggatgactgtggtggtttgtcgctaaggaggcaacagtagggtccaggcggcggggcacgtagagcagttagcatgatccat

SEQ ID NO: 62514 - DNA, 1029 bp, Homo sapiens
ggagggaggaggccaggatgaggcagaggccaccaagcgcggcaatggctagcacatagagcagtctcacatcaggtgccagctgtgccccaggtgtggcaggggcttttggagctggggcaggagtggctggccggactgtgagactataggaggccagcagggtgcggaggccattttcctcggcatagcagccatagttgccactgtgctcaggctgtgcatctgtaaccagcagcccgtccacgcccacacggtagccaccctgcccatcgctcaggcccatgctcccattgagtagccacaaggcccgggccaggttggatggctggtcacagggcaggaggacatcatcaccccggagcacagagcgggtcttcagtggtggtggtggccctgtggggtttgggggagaggtcagtaccagcccgtcccaggaagggattagagatggcaagccagactgttcactgccaagtccctggcaccaagcacagaacccagaatcacagtgacagctgacccaggctctgtgctcatgcttccacagaaggttcacgttggcccttcccaggaagcaggcagtgccttgggcccttttccattctctctccatgctctcatcctctcctgtggtttcaatttctgccatctgccagtaactcctaatctctacctcagacttctctcctgagtgccagactcggatatctaccatgtgctgggcatctccacatgaggtctcttggacacctcaaaaccaaagcttttctccccaacgacaccaagtcctttccttgaatcgccaccactgtgaatggcaccaccagccacacagttgcttaagtcagaaacctgggagtctcccttctctttcttgctcgcctttttgttttgttttgtttttttgagacggagtctcattctgtcgcctaggctggagtgcagtgacgtgatctcagctcactgcaacctccacctccctggttcacgcgattatcttgcctctggctcctgagtagctgggat

SEQ ID NO: 62515 - DNA, 1028 bp, Homo sapiens
catccgcaagcccttccacaccgacaaccctagcatccagggccagtggcaccccttcaccaacaagccgaccacgttccgcgggctacgcccccgagaggttcaggatcctgccccagcccaggtgcaagcacagtgaagagttgccccaccaactgcagccccaggctttggactgttactccggtaaaggtggttcttcccctttgggattccaagcccaggcaaatggaacccatcaatgggcaagttgacagaggttctgcttgggataatgaagagctgcctgtttctttccagtgcctgcttctgggggcagtgaccttgtgaaccactcatttttatgcaagtggcatccctaaaacctgagatgaggaagacttcaagggttttacagggcccttgttttttaaatccaaattgataataatgatctcaaaacacagtgagaggtctgaaggctggcttctgaagaatccctgatgtcttattggaacaaccactgagctacggagagctctgctgtgatgggctaggcactttatatctgtgtgaatacagatttataaaacaggttaataaacttatccaaggtcacatttcaggtctgtcttcaaaatgtgtgcatatgttaagcacaagcctcagttttcattattttaaaactagacgcagaacatataacaactgtcaggtggttagtatcaaaggccaagtgattaatctaggcctgacccctgaaagggagaggggagtgattctcagaccaagtcctggctgacaagctttctctggtcttagctatacatctccttccccccacgtccctctttgtgcagaaataaaatccatgtcccttgagccagctggtggggggtgctgagaaccttggggaagggcaggaaggctgatattaatgagtattttctaatcttagtttaaaaaggggggatggtggggaaatgagaggcaggaaatgaaaatctagaaacccctgtaagaattcttgaactgttgtcattttcttg

SEQ ID NO: 62516 - DNA, 1051 bp, Homo sapiens
ccgttgtggagaacgctggccaagaagcggctcggagtcccgcgcgccgtcatagctacagcttggaggccgcggagcctaagcagcgaggagaggggggcgggactaaacctcgaggcttccggttccgggacgaccgctcccggagttttgcttccgaggtcaaggcgagtagcatgtgcgggagactcacgttgccggcgaagtgggagagagaaaagtggtaacctggggctgggggccggcgcggcggagctcggagtagtagagcggagtgaagacacgggggaggatagagactggcattcctttgggccgggggattggcgggagtcgtgctgggtgctctcgccgtgttgaggtcccagtgaggggaaggagaagcggaagagggtctctagtcggggcctagggcaaagggactacaaaaaggatgcagatgactatagaaatgaggacgacgaggagatgctgtggaggagcagtagaggtgagaagatgatgcaaagaaactgtgtcagtgaggaactgtatagagggtcatagaggtgaggtggcggagagaaactaactaacggaccatagaggtgggggagccattgtagaaggacgtggacgcgaaagggtcgtgtagatgggcatatgtgtgaagcagcaacgtagaggggctgaagaggagaaattcatggagagaaagaatgcacctagagtgagctctgcagagtgctgcgtgggatatccctagagtttggtctagtgaaggcacgctaaccaggcacctaaggcatttcaagtagtgacttcccacatttggctaggaatgtgggtcctcctccgaagtgggtaccccctccgtatcttgttacccctgcgtggggagtggatgggtcggaggggcctgccccgaaacttggccccaggccctcctcgcagacgttacaggaaggagactctccaagccttggatatgccagtgttgcctgtaactgcaactgaaatccgccagtatttgcgggggcatgggatccccttccaggatggtcacagttgc

SEQ ID NO: 62517 - DNA, 1718 bp, Homo sapiens
ggtgttaccacttccttcagcctcttcattgacaagaccacaggccactttctctgcatgaccagcctagcagaagggagctgggaagacttccaggccagcgtggaggggcgaggggatggggccagggaggggtttctgcttagcaaggcaccagaatttgaggacagcgaggaggtccggaggatctggaaccgagcaatacctctctgggagctgcctgatcaggaggaggttcagctggctgatacaatgtttggccttaccaaggttacagatgacacactcaagcgtttcagtgtgcgatatctgcgacctgctcgcagtcttgtcttcccttggttctcccctgggggctcaggattacgaggcctgaagctcctagaggctaaatgccagggggatggagtgagctacgaggaaaccactattccccgacccagcgcctaccacaatctgtttggattaccactgattagtcgtcgagatgctgaggtggtactgacgagtcgtgagcttgacagcctggccttgaaccagtccacggggctgcctacccttactctaccccgaggaacgacctgcttaccccctgccttactcccttacctggaacagttccggcggattgtattctggttgggggatgaccttcggtcctgggaagccgccaagttgtttgcacgaaaactgaaccccaaacgatgcttcttggtgcgaccaggagaccagcaaccccgtcccctggaggccctgaacggaggcttcaatctttctcgtattcttcgtaccgccctgcctgcctggcacaagtccatcgtatctttccggcagcttcgggaggaggtgctaggagaactgtcaaatgtggagcaagcagctggcctccgctggagccgctttccagacctcaatcgtatcttgaagggacatcgaaagggcgagctgacggtcttcacaggtaaccctttgagaaatcactacttagagtaaaggggcagaagatcaggtgacaaaagcaagtgggtttgggccatgacaatgttgaaaagaaggttggccctttccccccagttttaaagccctgacctatgtcttggtttcaagggtaggacttcctcctcacccaggtctgttccaccccactgcagggccaacaggcagtggaaagacgacattcatcagtgagtatgccctggatttgtgttcccagggggtgaacacactgtggggtagcttcgagatcagcaatgtgagactagcccgggtcatgctgacacagtttgccgaggggcggctggaagatcaactggacaaatatgatcactgggctgaccgctttgaggacctgcccctctatttcatgactttccatggacagcaaagcatcaggtgagactcccagattccagccaccttgctttcccagacatatcccagcactcaggaacctttggttccttttccagctccagtaggaactcccccatctccttaggtttggagtttttcaaagaatgagagggcagggctggacacactggctcacgcctgtaatcccagcactttgggaggctgaggtgggaggatcacttgagcccagggatttgagaccaacctgggcaatatagggagaccacccctctctataaaaaaatttttaaaaattaggctgggcatggtgatggcatatgcctgtggtcccagctactcaagaa

SEQ ID NO: 62518 - DNA, 1035 bp, Homo sapiens
acatgcagtctacgtctatgacatttgtcatgtgatcatcgacaacctgcagttcatgatgggtcacgagcagctgtccacagacaggtgacggtgacatcctctcttgtctagcttgagcccgcttggacatacaacacacacttctcaggcagctggcctctaggcacacatgctgtgctctcctattttctgagatgtgtgcaggcacgtaccacccccatgtgtatcatatggaggtgtggggtatggcagcaggatgtatggacagggatctgagtgtgagtccttgggtagagggaggtagagtgggttgtggtagtttgtggggagatgtgaatggatcaagagtatgtgtatgttcttgtccttctgtgtctgataagctctttgtgttgttgggatggcgtaggatcgcagctcaagactacatcatcggggtctttcggaagtttgcaacagacaataactgccatgtgacactggtcattcacccccggaaagaggatgatgacaaggaactgcagacagcgtccatttttggctcagccaaagtgagtggcctttagcggagctcaagctttggaaaatagagtgggtaggtgtgaccagggacagccctcattcagccttaatcgtcttgactgtccatccgaacaggcaggaggcaatgcctctggggccatgacatgaggaatatatgtgctggaaatacaaaggctgatagttggttcttatgctcttcttgtcccccaggagctcacatcctctcctggggaaacagtaagacagtgattgcaattcagtatgataagagtatgataggcagcacaagtatttggagagcaaagagaaaagatgtctgagtcagcccgggacatctgggagacttccagaggaggtgacaacaaaggttgggttgaggtttggtagacaatgggtattagacaatcagataaatgtgagggccttctgggcatcaggaccagcccaatcctggagcttctagtgttacactgaatgcctattacatac

SEQ ID NO: 62519 - DNA, 1929 bp, Homo sapiens
cgcacttgggacacgcgaacacacatgcactcggaaaggacgcgcccagttggccacccttgcactcccagggacagcgccagccggcccgcgcggacccacagcgggcagggcactctgcggtcgcgtattgggtgcgggaaaggggcagccctgtgactaccgacgggggcgggccgggtgggacgcacccggaggttcctgcttcctggcctcccgcaggtgaagaccaagacgtaaacagacgccgagcacgtgacagctccgcagaccagtggcctgtgcccccaacccaaccacggggcggaaatccaccctagtccggggcgcgtttgcttggtcccaggccggacggcgttccattctccgcctggagcggggataagccctctcccgggaaccggagcacagcgccccctggagccggggcggagcaggagggcccggctgctgggcagggctggggttaactcgggctcctggacgtccttctccccagcacattcttggtgtctgcatccctgaaggtttcggagacaggcccttgatggcagtggacagctgcccccgcctgttaccgccagcccagagagcagctgcctgagcgcctgcgggtccccttcctaccctcacctccactccttgcgggagtcggagtctcctccccccagaaaatgcatgagtgtaaacgctccctcaataccagagtgggcctgcccccctagaaaaaggaggacgagcccctccccccagggaatgagggagtgggcagtagcccgatgcctcctcctcgccccaccccctacccctacacacacgctgagcccagctgccgcctgagctgggcaggctgccagaaagaggaggaggctctcggtgccccaggaggcagggatcagggcaaggccagaggagggggctctgctggggagaggggctcagtctgttcttgtgaggctgagggtctggggtgagtcagggtggctgggctgtgtttccctttccagggaaaaagaaagaaaaacaaccctgtccatggagctaaaaatagagctgagagccggccagggctgtggcctggaagggggggatgctccttcctggggcccgggcgagctccggcaggccttggccctgcgggggagggggtggttaggggagaaaggctgcctttgcccagggatgcaggcatcagctgacctgaccgggtcaccgagacccctaggggaaaggctgtgcggtagaatatttgtgaagcacggcgtgtaagaagttgtctgtgtgagtgactgtgaatagaggctgtcaatgcgtgaaagatggttaggagactaagtgcacttgagactgtgactgggtgcgaaggactgcggattgttgtggaagcctgtgcccaacaggcctgtgacaccgtgtctgtgtgtgaggtggactggaagattatggaaagaaggaacgcggacccacgtgacggctgagactgcggctgcatgtgggaaaggtcttgtgggtgttagggagactgtattgtgtgcgagaaggtgagactacttgaccctgaggaagtggaatattgtctgccgtgaggctggtgtaggtttgggctgtaggcttgcaccggttcgccccagtgattgttggggagccaggggccgctcctctccgataaatgacctctctcttagcaagtgatcccgaggggaggctggggagcacgcggtcgcgccagaggccggcctgggttcgcggggaaaagggcaccgtgccggggagtggggcagggcccgcgtgttgggggcggctgggtgtgttctccgagccggccgccaggtggcgtcgcctccgcgaagcccaggttgccgcctccaacccgccgtggggcaggcgcggatcgagcctcggcctcctactcgggctagggcgcggggt

SEQ ID NO: 62520 - DNA, 2049 bp, Homo sapiens
actcgcaccgggcgggggctggccagggccgggggcgccgcggaggcggaggcggggctgggccgggcagctccgagtggcggcgcgcgggccagggccggggccggggccggggccggagccggagccggggccgggcggcgcgcctgtggagcgctgggggcggcctggggctgagcatggagcagcgcggcggaggtgaggggggccgggtctgggaggcggcctggggagcccccaacttatgcgcggtggaatccagccggggggacggcgttccccagtcgcccccactttctggaaggggggctggactctggagaatgggtcaggggctcctggcttcccgccgcagaatgggaactcgtgatcgcagacttgaccccgcttgactggtccttggagtttgggtgggagggagactttccccaactcttcagatccgtctccggccctgaaccagctccagccctctgctctcctcagcccactaaaaggggggtgctcctgggccagagtgattgctcagggagtgctggggagaatgaggggttcccatctcccacagccacaaacgcatttctcaaaatggagcctccacttgcccctccttctctttcgggctccaagagcgggagccggcctggctgggcctggctttccagactcctggctctggctccctggatgtgtggctctcagggcccggctctgtggcactttggacttatgggccctcggctccgtggggttggggggccctggctcactgggtcccgctggctgtccccttgtcggcctgaccctcgggcctctccgagtctttgtctcttttgggtccctgtctttctctgagcctgtctccttccttcaattttcactttctccgtgctcgctgaagtggggaaatgcaacagaggtgccagcccccttggccccctaagaagtcccttccccactgttcactccacaccctggagtgggcccagagaggggaggggagggggttctctatctgctctgctgggggctggggtgtgtggggtggtctgagccccagccctacagaggggcctgtggtcactccctgctcctggcctacccctcccccagctccccgcagctcctgccccagcgtggacacctcttcctggttcgcagtgtcttttgacttgggtgggaaggagggcggtggatttaatggagggcatgcgagaaagaaggggaacagatcaggcaaaggagttagataatgtcccacctctccccacacgccgaagagagaaggaaacaggctccccccaccaatgggccctcaagccacccaggctcccaccactctcatacctgcgtgcccacgttcacaggctccactgcaccactcaccttcctagtcacacacaaacacaggagctcacacataaactcatgaacttactgacaagtctgtccaggcaccgtctctcccacacaccacaaattcacttgttagatccacatttataactttcacaggctttctaatgacccctgatccacatactcttctaagatatacacatgtgaattcacacatgaactcatatgtatgtgaatgaactgatatatcaaacatgcatagactcacatgatgttttcacacacattttcatacacacgtgttcattttcatgctcctgtgcatgtagtcacacaacaaataactaaatgcacacactcctactcccagtgcaattctctgtccacttcttggccccgctctgcatgatgacttcagcagatgcctaagtcctggtcatcagcggcctcgggactgggactagggagggggttccgggtggaggcttgcagctgcttccaggaaggagcagagcctggggaggtggagccctcttgcctgggctctgtggaagtgaggttttggagcagcctccagaggtgaaggcagggcatctaccttcctcccctcagggttagtttggggaccttctgaagctgtagggtttcagagaggttggcagtggggcagagcctgtggaggctccttca

SEQ ID NO: 62521 - DNA, 1033 bp, Homo sapiens
agtgatgttgaggatgcccgagagcagcgggcacacaatgcccacctccgcggcccaccaccaaagctcatccctgtctctggaaagctggagaaggtgaggaccggctcttccttgtgggcctgggtagaacgggagtcctcgcttgggaaactggaatttagaagcttatatagaggaaagagtgtgggctccagattcaccagacctgggtcctaatcccagctctctctcattctggatgtgtgacctcagggaagtcacttaacctgagcctcagtttctagaactgacatgaaggtcaaataatgtatagcatagtgcctagcacgtagcatgtacgcagtaagtgctagttgcttacgttctggttattctgcaccagttatacgtttgactttgggcaaggcctttaaccttgctgagcctccatttcctcatctgtaatatggggatagtgatcatatttagataatggagataaacttttcaaattgcttgacacaaagctgacactggtggccacctccaccagtggccgcaattgttatgaatatatgggcactggggacccaagacgggagggcagggagtgtcataagggctctgcaagattgggcagctcatctccagtgtcacatggcacctcatttcagaacatggagaagatcctgatccgcccaacagccttcaagccagtgctgcccaaacctcgaggggctccgtccctgcctagcttcatgggtcctcgggccaccgggctgtctgggagccagggcagcctgacgcagctgtttgggggccctgcctcctcctcctcctcttcctcctcctcttcagctgctgacaaacccctggcatttagtggctgggccagtggctgcccatcagggacgctatccgactctggccgaaactcactgtccagcctgcccacctacagcaccggaggtgccgagccaaccaccagctccccaggcgggcacctgccttcccatggctctgggcgaggggcactgcctgggccagcccg

SEQ ID NO: 62522 - DNA, 1090 bp, Homo sapiens
agggtgacatgaggagggagggatgtgactctctcaccccaccctaggctggcttcgagcttgtggcagtggacggagagaatctagagcaggtgacccaccagcgtgcagtagacaccatccgtcgggcttatcgaaacaaggcccgggagcccatggagcttgtggtcagggtccccgggcccagcccacggccctcaccctctgactcatcagcccttactgatgggggccttcctgctgaccacttgcctgcccaccaaccccttgatgctgctccagttcctgcccactggctcccagaacctcccaccaatccccagactcctcccactgatgccaggctcctccagccaactcccagcccagccccctccccagccctccagactcctgattctaagcccgcaccctccccacgcatcccatgaccctccccctaacctcagattcacccactgactccagcatcccgttatccccaggacctctcctaccaacttcttcaggactctccagctcctgcccaccctgcctcctcccagtgccacactggtggctcacatctttccactttcttccctcctcagctgtcattaaggctctgccttagtgtccaaggacaaggtgctagtgggcagcctgtgtcacctgcactcactgctccccaacctcccaagccaggatagggggtgagaaagccaaggtctggagcttgggattggtgggcactttctcacatgctgtcccttatgagtcgcccaagcctccagggacacagactctcagacagggccctgaaggggtcaatgcatccattcctcaaccccaagcagcattctgtgcaaggaaacggatgaaaggcttttctagtccctgaaatcctgagagatcatttcacgttggggtccactaagacctcagacattctactggatttgtccttcctccatcaccttttctccccaagagagctctatgagggggaggagaatagccagcaaatggtgggggggggggggtcaaacaagttcctgtactctttatccagcacattcacattatttttaaacaaaaaaattttttttaa

SEQ ID NO: 62523 - DNA, 1001 bp, Homo sapiens
tgttctggggtctcaaggtgattgtaccatgggagagacaatcccttccaattacggctgcctggcccctctccgtcagtgcatctctcttcccacagttcccaagtccctgccctctgctggttctcctcccacctctctggccactcctctatctccttccaaggctcctctttttccctctgtcccctgaaggtaggtacttctccaagctctgtccctgaggttcttccctccatacatttgcttccaagtgaatttgcataagcagtgctcagactgcaccctgttttgatccaaaaccgtcctgactccccattgcctatgaaggaagtccatagcctgagcattgccttcaagcccctcagggccaggcctcttgcctccctatcccacctacttccagtctgaattctccattccagcttgtcctgagccctcctgaaccccattttcagactgggggccaaggcctgcagctgagcctctttcttcttcatagcagggggcgtgggcccggtacagaagtttgtcacctggagactgagacgtggtaattcatgcatccctttaccaaggcctagtttacagtagagcggcagatgagggtgcatactgggggccagctgagtggctctggactaaattcagtcagggtcaagcatgggggatcaggcagctagaatggtatgtattgggggcagctaaaagaattggactaagctgactaggaaagatagggtggcagacagatattgggatgcattttaggagcttgtgttgggactcccaaagatatatttgggggtgatgagggagcctgtgctgggcctccactgggcaacagactactatgacagtgcatgttcagggggccctgggggcactgggctaagaccccattaagaaacagactggtataggggtccatgttggggctgagggctggggtttgtgctgcattggtgggcaggttgctgtgggctaccatggtggggagc

SEQ ID NO: 62524 - DNA, 1018 bp, Homo sapiens
gcctggtagtggagaagtgcggttcaacaccctccgacaccagctcagaagatggtgtccggcgcatcgtccacctatacacaacctccgacgacttctgcctgggcttcaacatccgtgggggcaaggagtttggcctgggcatctatgtgtccaagtgagggctgaggcaggaagtgtcttcgggtagaactgagaatggggtctggagtggggcctaggctgggatgtggggatggtcagcaagtgaggcctggccaaccacctgtctcagtgagggcctgggagggggcgggaggccccagtaggagggtcaaggaccttgactggtgcagtcttgtgtccaagagaagggggtctggagtggggtaacggagggcaggccaggggcctatcagactgacgcctgtctggcctcagagtggaccatggtgggctggccgaggagaatggcatcaaggtgggggaccaggtcctggcagccaacggtgtcaggtttgacgacatcagccacagccaggccgtggaggtgctgaagggccaaacgcacatcatgctgaccatcaaggtgggcagaacagtgggggtagggagaggtgaggctagagtaggggcttcccagaccaccctagttcttaataatgctctgcaatttatgacgttcccacagccactagaaggtagacaggcattgttctcatccctgttttgaagaagaagaaacaggtttagagaggcacagcaactcacgaacaggtcacttactcagctggtcagtggctgggcttggttccagtcctgctccccacagtgctagagtggtgcccccttcttatgaagggtggaggcctagggttgaaaggaacaaatgtcttgcccagaagggaggggtggtggctgcggtttggacaggacctgggtgatgggcatccccagggcatacagctaggagggctgggctggggccagaggttggatttcacgggaggtggctggattcattattcatgtgggtctc

SEQ ID NO: 62525 - DNA, 1686 bp, Homo sapiens
cttcagacttgctttacttctaacttccaaatcttgagcaaatttccttaggccaactccaacccagaaccatgcagggaagggtattctgggaaaagtagtctcaacttaaccaaggcgacacaatacaaaaccaccacgaggacccagaccctgtagttcaccacttgacatcccctcctcctgctaattcctccactttgtgcctacataagggaggagtcagccttgggaagtggtatttcaggagcagcagaacctggagacccaacaggttcatccaaaggcacatcctcttctgcttaagtaaactgggagggaagggataggagaggaggttgagggtgtggcagaattagacccagatagtaactctctccccagatacctatcaccagccaagagaatgacacatccagagtaatatgagctcagaaagaaaaataatacatccaaataatgtaatccttttaaaagaggaccccgaaaatgaagaacctatatgagaggaagcggaattaatggaccagtgagaacaagaatttaaaataatccttataggctgagcacggtggctcacgcctgtaatcccagcactttgggctaccaaggcgggcagattgcctgagctaaggagtttgagacctgcctgggcaacatggtgaaaacctgtcactacaaaaaaattttaaaaaaattagccgggtgtggtggcacacccctgtagtcctagccacctggggctgaggtgggaggatcacttgagcctgggaagttgaggctgcagtaagctgagattgcaccactgcaatccagcctgagtgacagaccaagcccccatctctgaaaaataaataagtaaataaaataaaataatcaaaataaaattcttctaggaaataatggagaatgttacacattttaaaaaaattattatctaattttttttatacagaaagggtttctctctgtcatacaggcaggaatgcagtggcacagtcatagctcactgaagcctcaaactcctgggcttaaaggatcctcttgcatcagcctcaagtacctgggactacaggcaggtgccaccatgcctggctaaagtatattgtaaatttgaaataggatgagactgtataaaaaagttaacaagtgtaaaaaatataatagctgaaagaaggaaggcaatatacaagttgaatagtgaaatagattcagactaagaatgaattcataaactagaagataaggatggcgaactctcccagaaattatcaggaagagataagaagatgaaagatataaggctaaagttattaaatatggaagatatatagttaaaatgggagttccagaagagaagagggatgagaaacctggaaggaaatgctttaaaaaataatgaaaaaaagaattccgaagaatcctaaaatttcccagaattagagaaaagtgtaagatttcagacagaatatcaacaagatagatttggaaaaatacttaacacattaaagaaaaatttaagagagacaaaaattccaaaagcttctcaagaattaagacatacaagcaagaaaacaaacataaaaagaaatccccatatgccattcattaggaacaagtatcatactgatattagttttttcaatagcaatgcctgatacaagaaaaagaactttagaactagaa

SEQ ID NO: 62526 - DNA, 1093 bp, Homo sapiens
ctcagctcagctcaggtttccctaggagcacgttgacagagtccccacatcacaccaagttttggcaagtccagccccactctgacagactttctgtcacacttccttacagctacttaaactgcactttagcatgtaatggaataccttccatttaggaaggtggagggggtctcccccaggcaggattaaacatgatgacagttcctaaaaggaggggctgggatttaggctaaaaaggtaaggcagtcagaccggagggagacgatcaggagcttcagggccagcctctgccagccttgggggtggggctgctcaggcaagagaggaggaacacagggcttctctgctgggaggaccccggcctccatccctgctctgcagaagggaaaccccacctgaggtcaaggaaggcgaggtgggaggtagctggaccagaaaagaagggagcatccgggctaggaaggcactggcctgggatcctaagcccagaggcggtcaggctggggaaggagagggaaggggaaaggcaggaggtgcctggacagataaccattgggccataggctggataaaggcgtttgtatagtctgaggtgcatctatgtgggttgcaaaattccctgttataaggaggaatcatgggctgcaaggagcaaaaacttagacttgcttaacaaaaagcggggtgcttcctggaaggaaacagggtcttgtcacagtctcgaagttgcagagttagaagtggaccttctaagggcctagatctaggagcttgacagtgataaactggagttgctctcctcaactctctttcaagctttcccagttgcctgccattctcctgtctaccctacccccatactcctgactggcttcatttgcctctgtctgcattgtgcagtagatagttgtcattttgaagtgactcagcatctataccccttcctaacagcacccaatttccgatggaagactattgttaactgtacctgggattctgtttttattcaggtatagtgaggctaacagatcaggagatgattgctgttgaaaagataatttgtgcggggcacagtgactcatgcctgtaa

SEQ ID NO: 62527 - DNA, 1590 bp, Homo sapiens
taggcaggtcctaggacccgtgattcttgccacagtttttcttagtatttgggctacaagtgaggcattggccgccatcttgatatcaaatgccaggcaagccgctactggcgtcgctcggtaaccacggagacacccgtgcccctcccgtttctcatccttagaggctgtaaactacaattcccatcagccgatttcctctgcgtaatggcaacttatctaaatctggcttgtgggcaaccgcaacgctgccgcagtgaactgtgggagttgcggttcacggcgtagcctcagtttttttcctgggggaagttccagaactacaaatcccgtgagccagtgggctttcgcctgcgcacggagaagccgattctccttggcccctcagcctgcgcctgagaggtaagagagggcggggggaaggaagaggaggcgggatccgggcgctgcgttggctgcggcctggcaccaaaggggcggccccggcggagagcggacccagtggcctcggcgattatggacccggccgaggcggtgctgcaagagaaggcactcaagtttatggtgaggagacggtggaggccggggaacggtggaggcgctggcgttggcggcgtcgctggcctgggccgcccgcccactgcgggaccgggcagcgggaccctgggccgaggctggcggcggagcggctggagggatgggatgggagctccagaaaggaggctgggggttgcggagcggacccaggggtgggggcagcggctccgccatcttgtggatgagaggccaagtgacagcgggagcttaatcgaggagggggctccaggcggcgcgcggggccctggagggaaaggggcgtggggactgttactgaaaagcggaggaagctctctggagaaacgccgtgaggccgctggcggggccttcctggtgtcagggttaccggtaaggcccgggagaggaggtgcattcacgactggggaagggagcgcgggatagagtgaagacagatacggtgggtagaggggaacgggcagggctggatgcagatggatttaagggtggaggagggaacgctagggctggtgagaggcttatagttttgtagaatgaggagggaggatagcctttgccttgagggtggaatcccagcttggccaaactactgttgacaaactctggaagggaagaggcctcactaaagaagataaggactgggaatgaggacctagggctataatgacagtccctgggaggggaaaagggtgttgactgtaagctagaattacaaatgtcagggaggggtacataacgctactttgaaaggagaagctaaatactgtaataaggacaaggtgatgaaaagtaagagcagattgtcagggaaacatgggtacaggagattggggcaaaatgagtatctaatagggtaagcaaaacaaaatttaaaggtaaattgtgggacggtaaaatgtggaggccaggtgctttgtatcattttctgggaaaggaaaggccgtggagatgagagttgcaaagacccataagaagtgatgagatcagttgagaaatttaggagataaaaagggt

SEQ ID NO: 62528 - DNA, 1202 bp, Homo sapiens
ctcccattgttgggattacaggcgtgagccaccttgccaagccacgtttatttttaaaaacaggataaatatattcttgtccagccaatcccagaatcaagtacagtagcttgaaatagatgaaataattttagaatgtattgttttatttatagagctgatagataaatgaaacagtataaagggtaaatatttgctgtttaacagacaacctcaaaacttagcttaaaaaaaacaattatttttcccctcaaatctgatggtttttctgcttcacttggtattggctgaggtgtgggaaagaccttcacttctcctctatatgggcctttctctacctggctgcttggatttccttaaagtgtggtggcaaggttctaagaagggacattccaggagacaggaggtagagactgccagtcttctaaatcctagatttggaagtccaagaatgtcactgtgggtcaaagccagtcaaggccaactacagagggaggagaaataatgtctacctattgataggaagggtggcgtgcataaacaaggaagggggaattgctgggggccaccttttgagacttgctaccgtaggtgctatgctagttggatgttaaggctaaaaataaaaatggtatcggccaagtttgtgggtcataatgctaggaatgtttaggaggcatctctttttttgaggttaacttcggaaggcactaacatgatctcctgcgtgacttcccttaatgatgtcactgttgacataatactgggtgaattaatgtgattaagtaaacttgcttacttacttcaggaaacagaggtatctaaacagattacattttaaaataaattgtcagatgtttcactgtaatggaattttctttacatcagtgaaattgattaccaggtagtgggatgaacatctgaaactagttcttagtttaagttgtctgagtttttgtgtatactttacctattcccagtttaaattggctttcaaacagtttgttttctgggtactcttataggtgttggggtatgaaattagtggtaattctttttgcctattttctttttttttgtctgagataccctgagtctcgctctgttgcccagactggagtgcagtggcacaatttcggttcactgcaacctccgcctcctgggttcaaatgattctcctgcctcagcctcctaagtagctg

SEQ ID NO: 62529 - DNA, 1058 bp, Homo sapiens
gtttcaatttgtatttccctaatgcattcctcgattcttgatgcttttattgatggaggatccaacacaaaagataatgcatggtcatgagaacaaaatatttgatatgcctaactttaacattctatgaaagacttcattaatatttttaaaaaggagtttgtactattgaatattcatggtttttcagtgaagtttgaggtactctgaagcctatctacaaagttttaagtaagccatgtgacagtgtggataagagagtgacttcagagcattttttttttttctggtgacctttggtgtgtagaacacttgtggcctttaataaactgaggagataggatgaccaaaattttttttatatgcctgtaatttttttaaagcagaaataagtgagaaacgcttatggacactgtgatcaagatcgtgaacaagatcatgatctacatttactgatttcatgttcctagtagcatagatcaatggtatgattttaataattcttattcagggaagtaatttagatggaggcaaggaaggctttcccttgagtaatatattaatttggccccatctatctcttctcctttgtagatcatcccaagcagcagtctgtattataagaagcaaacttaaatgattgctaattaaatgtttagtgttttttttgagttggttattagcttgaggttaaatttgtttaatgagtaaatatggaagaattatgtttttcacatttggaatgcatacttgctgatcattggtatgttactcccattttatgaagctggaacataatttccttctttttaatgactgtgagttttacagttatttaatctttgttttggtggtgttagtcatgtcagtactttatttgctaccgagttctcagttaggaaataggctcccaattataattttttttttttttttttttttgagacgaagtctcactctgtcacccaggctggagtgcagtggcgcgatcttggtgcactgcaacccctacctcccatgttcaagcgattctcctgcctcagcctcccaagtagctg

SEQ ID NO: 62530 - DNA, 1036 bp, Homo sapiens
atttgcttcccaggctaaatcacagccttgaagcagctatttctttccgaataaaaagtttaatttcacgccctgattagtgccagtacgtgcaggtagatacttatgttatgtagctaaactgatgtgcctttgcaaattacttgccagtcagcagaactatagtttcttatgagtagtttatggtaaattatagttctagttagtaagttctgtgtgtttttttaaagtgtgtatttattagatacgagtaggaatcagtcactaaattttggccagactagcagttgactaacagcttttttcaaaggctcaggtttggactaacagtccagccaattagcagtaggaaagagtgagatcttattttcagttgatttgaaaatatacacaggacctagaaagagtggtttctgatggaaaagacctaaggagagattatttttcttattgagaagtaaaatacattgtagttaaaaattgagacctttgagaggcttaaaagataggaagatcaactgaggacaagacatagaaggttttgaaatcgtgggacactacttaactgaatttttaattgcttaattgaaactatggagttttaaaaacttttaagatgaactggggccaggtttggtggctgtcacctgtaatcccagcactttgggaggctgaggtgggaggattgcttgaggccaggagtttgagaccagcctggtcaacttagcaagacccatgtctctacaaacagaacaaaacagaacaaaattagcgtggcatggtggtgcacacctgtagtcccagctacttgctttgaggctgcagtgggctatgattcctccgctgcattccagcctgggacacagagtgagatcctgtctctaaaaaaaagaaaaaaaaaattagccgggcgtggtggcgggcacctgtagtcccagctactcaggaggctgaggcaggagaatggcgtgaacccgggaggtggagcttgcagtgagccgaaatcgcgccactgcactccagcctaggtgacaga

SEQ ID NO: 62531 - DNA, 1009 bp, Homo sapiens
taatgtaaatatctaataccatggcaattggtaaggcatcacatgcagcattatgattgcctatgaacagatggatttgatgataaatgataaacatcctgtaagtgtgaataaatttattttagctctatctttcaaactttctctgtaatcaaagcttcttaagtgtttttaaaaatgccattatttccttcccaaattccacttgctcatcacagcaagatatttcatcctagtggagtggagacatgttaggaataaacctgatgaaaaccgtggtctttgttcagcagctggctgcttgcacaggtttttgtggtaatggcattggcatctctgtattagagtattgatctgctgcttggtaggtactgtgtaaaataagtcttctagtaaagatgtattaagtggtttaagagcagtttatattacaaataaggtggaagaaggtggagttctgtaagaccggacacatgctataaatatccataaaattaagtattttatctaaaaatgtgtgttgaaaatttctttttttctttttttctttttttgtttttttgagacggactcttgctctgtcgctggagtacagtggcgcgatctcagctcgctgcaagctctgccttccgggttcacaccattctcctgcctcagcctcccgagtagctgggactacaggtgcccgacactgtgcccagataatgttttgtattttttagtagagactgggtttcatcgtgttagccaggatgttctcaatctcctgacctcgtgatctgcctgccttgacctcccaaagtgctgggattataggcatgagcaactgcgcccagctgaaattttcttattttaattcatatttaattgcacatagttgaacattatctgagtgtgagttgcgtacactaataccatcatcctttgccctttagtggaggattttatatttgatgttcctgtgttgtggttgaaaactgtgttgtaaactcgtcagttataagaaata

SEQ ID NO: 62532 - DNA, 1172 bp, Homo sapiens
tctgttaaaatgttttacattaaaatttgatgcactgatttttagattggtgtctaaagtaggcaatatcatcaggttgtgcatttgagatttaccagtttacatcttggcttatgataaattggattggaagatcaggtactttattttcctggaagaaaaaaaaattaggtatattcatcattcccatttcacaatttcttgtcatatctcacttgcttcagaaatactcattttggatccttcttgtgaatatgtaactcttaatactaatgtcctgagagaaaggagaatttcttgtctaacctcagtaataaccataccatcacaaaagaaggcctcacaatgtatcaggcaatcaaatagccaataacctattctcctgctaaattccataaactggatggggagggtagataatgttcatttttgttacttaccagggaacatgacacttggtctttgaaattgttatttatttcatatattgtagctgccaatcagtcagtgatttgcaaatagcaaagtaaatacactgctgaaaatgagtttcttctttgtgctgatctgtgatgtgcgggaaatcagatgtaatatggttgcatttatttatgtaggcatctattctctttcttaatgagcaagtaattttcttttctctacttctacacaaaagttaaattaaggagtacccaagagggctgggaaacttggtttgcagtcattgaaatactgctgagtatcgggatcctttcatgagtggagtttccctctccttaagaagaaagctccagatagctcccttttgaactcattgttagagcaaacacatctgtagaggaagatgatccataagtctaatgctaaggatttgcctcctctccctatcaatgagaagggtttgcctcctctccctgtcaaaggattttactctggcttatttggctgtttttgcctgggaagtgaggggcaagagctctgatctttcctatgacggccagcctggccttaatatgtagattattaacatgataccagcctctgttgagtcatagcaactgctatgaacaaacatgtaaatccatctaggggaagaaaagagtgttgcaaatgcctttcatcaaaatggaagactacttcaacttctatttgctcttcttgttataaccaag

SEQ ID NO: 62533 - DNA, 1041 bp, Homo sapiens
cccgtcattcagggattacattctggcattgtttgttgttcagtgtcttgaaatatatgtttcacatattttgttcagtttcttgatggtaggaagataagtttgataccaattattgccttatggtagaatctaaagtctagtgcttgtttttactttagagtttaattttatttaaacttaatgtactagaagtcctcatattacatatttctaatgtgcataaatttcagttagcacaatttagttaagtgacactagtcacccaataccatggttccaatttcagttaccatagtatattaactatgagtaactatgtaaagtacaaacttcattgctagtactccagtccacacatgactatgtgaaaaacagatacacactagtctatttacttcaaggtctgttggcgattaagtttatatacagacaataaagtgtctagttgtattgtctttcccaatgttaagcccacatgatattttatagaaatagataatcaaaagtggaaattggccaacagatatgaaacaaagtaacaaaaaatgataaccctttcattgaaatttgagagaaatgtaaatgaagttatagaagaaatagttgaccataggaaaattgacactgtcaccatttgatagactctagatatgcagccagaggaacttattgaaggtgaacttattaacataaatgagggaagtggtttttttgtttgtttgttttgggtttgtttttgagatggagtcttgctctgtcgcccaggctagagtgcagtggtgcaatctcggctcactgcaacctctgcctctcactgcaacctctgcctcctgtgttcaggcaattctcctgcctcagcctcctgagtagctgggattataggtgcccaccaccacgcctggctaatttttgttttgttttgtttttttgacagagtctcgctctgttgcccaggctggagtgcagtggtgcaatctcggctcactgcaggctccgcctccagggtttacaccattctcctggctcagcctcccgagt

SEQ ID NO: 62534 - DNA, 1063 bp, Homo sapiens
gaaggttttatttcgagaaaaagccacttccaagcttattgttgttggtggtggtggaattcttttcttcaagggctgttggactgagcctcaattcttagttgtttgttgactgggtcaccgccaggtctgtgccatggggacatctacagtatgactgcttgtttcatcaaagcgtgcaaaccaagaaggcaatagagtctgttagcaagatggaagttgcagtcttaacctaattaggaaaatggcatcacatcacctttaccaagggcatgcataccaagcggtgggaaacatcggggggcatgttagagtttgcctgctaccgttatccattattatcattatttagtttgatattctaattttctcaaatgtagcctgcctcagtctttcactctggcccctgtattattttgacatgtctctgtcattcattgagcacctcaagaagatattccaagctcctcttaaactttcctgtccaagccctcgcattgttctaaggagctctggttccttttagtggagagtgatattttgaatcattaaatgtgtttgttgctattaggttgctcctaggccctctcagttggtagtcagtctgtgtgtgtctgtgggtatatgtgtacatatatatatatatatcatgaatatattatttacctaggaatttctcggtgtaatacattgtaagatttcagcttacaacaacatcctcaattctagttcagcaatgtaatattcattctagttttctttctttctatacttgtaacttgtttttctgattatgagaaacctagctcttattatcctttgtatttgatctgccacctttatttgatcaatcttcctgtataatccatctcctgttgctgacatatctctcgctccatttctcaccccatacttcatatgcatgcctccctcacccttttgggatccgacagcttgcacttggctgccccttccaccctcctcactccactgggtctgaaactcactgctggaccactgcctctccctctcttaatgcatgccttcttctgccgacatgggc

SEQ ID NO: 62535 - DNA, 1040 bp, Homo sapiens
ttggggaagagcttgttccgcaattcattgccaaacaatgaattgttagactgacaaagctaactaacaaagcttgttagtttgttatacagagaatgttatacagatgcagcttgttagtttgttatacatatagtaacaagtgctacaataaaattaaagtctgtgactgagcttttctaaatatttgaaaatttacctaaacttatagtagctgttgtctaatgcaatttagtacattgttaaattttttcttgtagttactatttgttagtagtttatctccttgaaatagagtgtaaactacttgagtctgtggatttgtggagacaaacacatttgagtattatttctgccattgtcatttaggcactataacttcactgaacttgagtgtactctcttgttaaggcaaaagtactaataattctttgacaagaaggtaatgcttaaatgaaataatgtacttaagggatctagtacaatgcctggcagacagtttattcccggtaaactttacttatcctctttttgtactccacctgtgcccactttggtaatgaaaaaataaatggcttcccagaacagtttgaaatgcaagtggcattcacagaagcctattcctggtgatgatgccatttatatttttttcttttgcactttgcagcttttagaatccttattttagccgggtgaggtggctcgtgcctgtaatcccagcactttgggaggccaaggcaggtggatcacctgagttcaggagttcgagaccagcctggctaacatggagaaaccctgcctgtctctaccaaaaatacaaaaattagtcaggcgtggtggtgcatgccggcagtcccagctactcaggaggcttagtcaggaaaatcacttgaacctgggaggcggaggttgcagtgagccgagatcatggcattgcactccaacctgggcaacaaaagtaaaactctgtctcaaagaaaaaaaaagaatccttgttttagttttaccacaaccttgtgcaataaggctgggcagatatg

SEQ ID NO: 62536 - DNA, 1050 bp, Homo sapiens
gcaaagtacccataggtagttttttcaagctttaccccctttgtcctcccaccttttgtattcctcagtgtctgttcccttctttatgtccatgtgtactcaaggttttgttcctatgtataagtgagaaaatgtggcatttggttttctgtttctgcattagttcgcttaggataatggcttctagctgcatccatgttctgcagaggacatgatttcattattttttatggctacttagtattccatggtatatgtgtactgcattttctttatccagtcttccgttgatgggtacctgggttgattctgtgtctttactatcgcattgcagcatttcaattttttttctgattcaggtagtagaaaacatgttcagtcttatttttttctgtgctgtgtatgctttttaaaggctagtgaagtcattcagttggataacaacaattataatacattgttatactcttcaactttctttgattttgcaaaggagagtcaattggggtgacgttaggtgggaactgagctgaagaaactaatatgtgctgtgcagggctggatttgtgtaggatgcagtcattatctgttaactttgtcatagcttttgagactgcatgtaaggagtaggtgatttgcaagttatttaacagttaacagaaggtaaatatttaaacaggagaatgcgtagttgctgcttagtttaaaacctgcttttttttttttttttaattaaaaaaaatgttttttagccaggcgtggtggtgcacgcctgtagtcccagctactgggcaggctgaggcagaaggattgcttaagtccaggaggtcaagggtgcagtgagctgtgatcgtgccactgcactccagcctgggcaagagagtgagactctgtctcaataaaaggaaagaaagggaaaaaaaattaagtatagaaagaaaattttaggaatttaaatataatttgcaaggaaaaacaacaaaaacagtccaaactttaagtagaaaactatgtgcttttcaggtattttaaaggtaaattttaaagggc

SEQ ID NO: 62537 - DNA, 1046 bp, Homo sapiens
cccttcttttgaagcccagtgtccactttatgactgagggatggatggaggcaggaggaagaattctgcactagaaagcaacaggccaagattctagtccctacttccctactttgtaaattcataatcatggataaatacttaatttttcctgggcatcagtcaccttacctataaaatgaggataatgtattaagcgtagtcctatgggtggtaaataaaatgaggataataatctaaaatcaggggatatacatagatctcctttggatttatttgcagcccattatctatctatctttatttagataagagacgggatcttgctgtgctgcccaggctggatttgaactcctgggctcaagcgatccacccatctcagtcttctgagtagcttggaccacaggcacaaacctcttgcatggctctcattgtccatttatcaattttagatggtgtaaacagtgaataccatattttgtttcccaatattactttctacaactatattgttttaaggagaaaaaagtctatgacaatataaaatatttcaaagtctgtaattttaaggtttaatgttacctatattgactactatattttaaaatatgtatccctgtttttatatgtgccatgattaggtatttagttttttagttattattagactgtaatagcactcaagttgatggataaaatttcatcctgggatacttttagagaaacatgaagaatataaaaatagttttgaaaagtatggtttctttcttacaaagctgtagctgcaataatactaatgtcagttacttagagctactagaaatgtgtaatttctaccttttttgactactgaatataccatatgtattatatatatgtacattcttaggtatttttgtttgtttgtttagaaggttttaataccaacagctttctaggtgtcgtcttcttcctcttcctctcccctccccccctcccctccctcccttcctcctcctcctcctcctcctttttcttcttcttctctctctctcctttctctctct

SEQ ID NO: 62538 - DNA, 1459 bp, Homo sapiens
ttcccttctgtttgggttgtttcttcccctcgccttataccccccaccccccacagaccccaatccatctggaaagatgaagaggcagctgctatggtaactgtgcattttggttaatgaatagcagactaacaagatacataaaacatacgcaaactgtgcagagtttgttgctgtcaaagccgtagggatacaatactttttcttttccttctaaaaaaaaaaaaaactctcttaactgtggtgttttgttttctaatttaccattcctaatattgtaatgtttctgtgaactcctcctctttctgcttagtctgcacagtattacaccctgtggtgagtttatgggagctgagttgaggtgcatagaggaaaataattgatcaactggattaagaagtagatttcctttagactgatacatagaagaatagggacaaaatgtttttgactaaatgtttggttttttgaacgataacttctttttttacctcctttccttttggccactactgccccttttgggattctctctggggttaaagccagtaagtagtgtgtttcttaaagatgtttctatcataaaggtcagctgcaactggaatattgcgttcagccaagccttaaaaattcctgtaatctgtgccatcctgtctcatactgtcccatctcatagttgtcctctctctgcagtgctctatgcccaggtctctgtggctgggctgctccagcctggcggacagcatgccttcgctgcgatgcctgtataacccagggactggcgcactcacagctttccaggtactttctctgtctctgtgggttatttgcgggcattagtgtatgtgtctaattcattagtatgtgcctcctcctttcccatactttacttatattcatcttttctccttcatattgcctgtatctcacatcactcagtactcctttaatgattagtttataatgtagacccagactgatccactcttaagacaatgtcatcatgattggttacaaaaattgacatagtacagcttgactgttggctttcagatcaagtagaagtatgatagtagattttaaagtaatctcaataaatagcagttcaatacgtaatatttgctctggacctacataaagccaattagtataatcaatcaattaattacaatcagtttcctgaacattttcttattttttttaaatgattactcaaagtataaagtgccctcttcagagtatctcctggtaattatactactaagtatatattttttataactgttttatttatatcttgattaacatttctaatttctaggtggaaaaacctttgagacctttaggtacagtattcaccttgagacactctagctagtgtttcatgaattaacagattccagttcccctcagcctttcttttttttttttttttttttttttgagacggagtcttgct

SEQ ID NO: 62539 - DNA, 1167 bp, Homo sapiens
ggctctagttgccctcctacctcaaacttccgggtagctgagactacaggcacacgaccacacttggctcatttttctattttttttgtggagatagggtttcaccatgttgtccaggctggtatcgaactccccagctcaagtgatctgcctgcctcagcctcccaaagtgctgggattacagatgtgagccactgcacttggctatatcctatatttttaactacatatcatactgacaaggttctgccattgaagaatccatagtctagtttgttggtttttttgttttgttttgttttttaaccttttcggggttgcagttagtttaggcgatctgcaaagtctgagggaattgtagtgcctaaaaggctgctcctacttcagaaactagtttcatgtttagaggcccccacaaccactcttaggtttgataacttgctagaaaggacttagaattcactgaaaacaattatactcacagtttattacaggaaaaggacacaggttaaaattagccaaaagaagagacacatagggcagaatctcggaaggatccaattgtagaacttcctgtcatcctctccccatggagtcatggatggcattactgcctcccagccgcagtgtgtgacaatactcacagagtattaccaaccatgaaattgacctgagcctttggtgtccaggtattcactggggctctatcacatactgctcacatggctgacttctagtctcttatttcctcctggtgttgaaacttataggtatggtttagtgcccccaacatgaatcacatttgtccagtcgctaaatctctcaggcaagcagagatactctcaccagacaagaagttccaggggcccagagaccgctttccagtagccaagaggaaaggccattcctttctttggtgaagagtaattcttcactacacaggggtcatggatctctttgggaatctgatgagaactattgatcttgggtatttggcaacattgtgttgaatactttacatacatatatagatgtttattatatttctattttgtgaaatgattgagagctattaaatcacataattctgaaagtgtaatctcccaagctgataaattctaggaagggaatgttcaaggagctgtaagaatatataaaagggggacc

SEQ ID NO: 62540 - DNA, 1023 bp, Homo sapiens
ttatcctgtgacagaaatgcttctcattctgtagctgataccctctctattgtatatgaataatttctgtgtagcacaatttctgtataataaatgtagttattttttatgtatatgttaacatttgacttgtatttatcccagctacacccttcaccttaggggtttgcagggaatgacaaatcaaacatgtttttgtttgtttgtgcagaaatgttttgttctcctaataaaatgaattattgtttattatggaatatgtacattatttggtaaatatataaacaagagtatcacccatatgccttccactttaagataattattgctagattaacatgttagtgtcctttgatctgaaatgacttatccatccatgtgtgcctgtgcgtgcacacacacacacgcccaaataatggtttcatttttaagtattttattacatttaattaaattatgagatatacagttaaaacatttaatattcattgtagaaaatagaagtagaaagaaggaaggattttaaatgtcctcccagagattaccgtttcagtgatactagtaatttctgaatttcacctatatcatattgctcaaattctacattcatcatctggtaatactgattttggtcactgtttatctcatagatagctgctcacatgtttttgaattgaacaaagtttgaatttggcttatatctgaccaccacctccctctcatgtaattgttagtcatttcaaattttgcagttccccaaaggtgcagtgtgttcttttatatatctgtgtctttgcatataccgttctgcttacctgaaaaaacccctccacaaacacctattgtcccttacccactctctgcctttgtctacctaatcttcaagattcagctcaagctgagctagaattaaagtcttccctgatctttatctttgctctcttaaactagtcagaggatctgtacccagagcatgcatggaattctgtgccctgtaaaattgacatgaagaaaaggagtatt

SEQ ID NO: 62541 - DNA, 2020 bp, Homo sapiens
tattggctatgaaatattgaactgtcagaatgtgacacttggttttttaagcaacctttcttgtttgaggtgtttgcagttcattcctttctcccccatttgtctgctttcattgatagggttggaagtagttgccttaaatgcatgaaaagggacagtgttaaagagaagtggtgctgatggagccaaacaaacttaacactagaaaataaatgcaggctgtggggcaaaggagataaagttgggttagtgtattattaatagtggaatttatggaacaccctattgtaaggaagaatcaggttaggtcccatttctgtttttgtggaggcaggaagttgggaaggtggtattgggtaaagagatgcagtgacatagtttgttaaactgatagcctactatatggcagtattgccaggccaatcagaattcacccagctattttatttattgctcttattatccagtgtctttaacaagtggtgaaattatagaagactttaaaatttggggaagaaaaatatttttttaatgtggaaaatgtgtatttatagtaagaaagctcattaggtaatatggaagaaacattatgcttatattagtccagcttatgccaaatgaatagaaaatcttccttataaaaccaccatatatttcttggaaaatattttgtagtaataaaatgagttttctattatgttttaaattacatcttttttttcaagctatgagtaggagtttataaattacaatacatcttaaaacaacatatatattttttcttctaaggaagcactattgatgtatgctttcattttcatcccttttggggcattgaatttacaagtaaagttttaactgagaatgaatggccttttgcagttcttctggagtatggaaaagagtttgtattgaaagttcctcaatggctgggcactgtggctcatacctataatctcaatactttgggaagctgaggtgggtggatcacttgagctcagaaattcgagaccagcctgggaaacatggtgaaaccccatctttaccaaaaatacaaaaaattagccagtcatggtggtgccagtctgtggtcccagctactcgggaggctgaggtgggaggatcgcttaagccttggaggtggtggttgcagtgagccgaaatcatatcactacactccagcctgggttgacagagtgagactccatctaaaaaagaaaaaaaaaggcaactatttagcttagccctctcctctgaaaatgtgaaaggcaagagctgttctgcatcagtctagtgaaatgcactggaaaaatggtgttggtaattcctgctttgaggtcatgctagaaagagagaagataatacttgtaaaatataagtcctgctcctttgtagccagatttttgtccttacttaaaaatattgtgctcagaaagtaataccaaaaggagggatattaagaactagttattgttgtttttaagtattgctctgaatttttaaagcataaacattgatgtagatttgcatttaagctatgagaacccactgtcttgactcagtgggggagttttcaaaaatcattcttgtagaaattgatttctcattggctgatttctacaggatgaatgaaaacaaaccattttttgcagtcttagaagaataagaggaatgcaagtgtttaagaaatgagactgaaatatgctttatggagttttctaaatctggtacaaagaaactacaaaatttcttcttatgtattatgcatcaatacagtgaaaatgcctcacagcttatgggctttttacaaccacaccttcacaattaatgattagctttattatttaaactccaggcttgcctcatgagcaaacatcagtgtattcatagaaccatagaatttcagcattggaccagacatcagaggccatctagtcacatacgtctcataatgtagaaatcctttatgaaatgtgtttggaagggagtcatctaatctctccctgatcactaccattat

SEQ ID NO: 62542 - DNA, 1305 bp, Homo sapiens
ggctcatgcctataatcccagcactgtgggaggctgaggcgggcggattgcctgagctcacgaatttgagaccagcctgggtagcatggtgaaacccagtcactactaaaaatccaaaaaattagccaggcgtggtagtacatgcctgtgatcccagctgcttgggaggctaaggcacgcgaatcgcttgaacctgggaggcggagatagcagtcagccgagatcacacccactgcactgcagcctgggtgacagagtgagactgtctcaaaaaaaaaaaaaaaaaaaaagtgtaataagtcagaatacaatgtagacacgtcttgttttgaacacaatttaaataatgtaatttaattactgcctaagattgcatatacttctttgatttgaatgatggaaaaatttctaggaacttagcctgggtttgtttcctcatcttttctttgaagccagaaaagcatagaaaagcatatgtaagcactttgacaaatgacataatgtagcggcatatcagagtggcacaggtattttaaacctagctccagttcctgaagatggtgaacatctgcttagaggtactgtagagctccacaatgcactaattgaattactcttttctggagttgcgactgcactaattgaattagaatctctctctctctctctctctgtctctgtgtgtatgtgtgtgtgtgtgtgtgtgtgtaaatgagataattccaaccttaacgggagagactatgagagacatgactgatggtgtgtactgtgctgctatctaatggcagcctatggaactactacgtggtctccagggaagagaaaatacagcgtgacctcagtctaaccccatccagtttagttcagaaggtcccaggatgtaattttgtaattctaaattgaaaaggaaagaatgtgataaatttctgtattaaaaattaagatatattttattaggcataaagtttttaagtactaagttacaaatattcaactgaattaaaaatttcctttaactggtgaaaaaaaatcgagttggtgggtcatcttttttctcattttgtccttcagtgacataaacgtaaaaaggaattaacgtttttgaaatgtcttagcatcatagaaaggataaatgatacagggcttgttcatatttttaaatacaatttttttcctggttgttagaaataaggtgttaccagattttgcttgtatgtgattatgcttatattaattatagcagtatcaaagtaagttgtacagatctcacttgctcttttttttttttttttttttgagacg

SEQ ID NO: 62543 - DNA, 1351 bp, Homo sapiens
gcaaataaatacactgaggacaactcaacatgaaatatattttgattcagtttaactctaggcattctaacttgtaaaaatggcccttaacagaaaaatacatatgtataatcacttgatttatagaatgtgtatgtgtgcatacaaaaccacttcagtaaaagtgctgttggttaccattctgagcatttaaaacgatcactttccatttgatcatattaaagatatagaaacaagtatatagcatagaaaagttttaatttcttctatgtaatcttcattattaaaatatgtttgaatatgccattattttgtaggctaatttgttcttcattgtgagattgaggtacttagatttcttgtatgaatagctctcactaaaatgactataatttgtactttttatattgtccttagggacattttactgatttagaaaatccttttgacatcaagtagatgtaaggctttacaaataacatggccattcacaactagccacaactccgattcgattcacagagtaccttttatttgccaattactgtacaaagtcttaggcataaattaagattcagaacctatcctcaaggagcttatagttatttgttatacatgtattaagtacttatataccagtcactgtgcatataattactagtgttaaccattagtcatatgtatttttttctgatttattgagctagaggtctggcttagtagcagtcctaaggaaatggtatacttatgttcatatcagatatatctcatctcagcaaaaaagtgataatgtatatttcagactagtctgtgtcttaaatggttttctcttgcctttacataccttctaagggaacagtgatgtttgtgatagctgtacatgtagcttaaaaagagatgataatatttgttacaatgcctcctactggttgatcatagattttcaatccttgttgtcttcagaactggtagttcccactggtgatttgatagtttggggcttctactgaggctataactgagaaagagtctattgcatacaaggtataaagtgcttctttaaacagtctgtttctagaacctaaattgtcctgggaccagctcttgatataaaaattcatagaaacctgtttttcacagagtgtggtaactccttgccatagtgctgtagtgttaaaattcacattggccaggttgttctgtaaattaaacactgacagctaccctcaggggaacagccaatgtatttatgatgatgtgctgattacacaaaatacactgcaagcagaaaacagctgcagagaataaacctcttaaaaagaatacaattacaaatagcaccctcagtatt

SEQ ID NO: 62544 - DNA, 1114 bp, Homo sapiens
tccatcacgaaaaacacaacctacagtggtataagatgcctgctttgcaagcctgtttgggattttaaaatattaacccacattttaataagtagatgtagttttgtaattgcattcgtacattaagcaggataaaaatgtaaaaaaaaaaaactacttgaaagggtaaggtaggaagtgtttttttttgtttgtttttaaattaaggctttagagccaaaaaaaaaaacctgtaaagtttaaatggactattacttctgatgtggagcatattagcataattacaaactcttttatatactcatagtcattgctaagttgatgttcaaacctttgattaagaagtcacaaagctgactgtgttcagacagctgtgtaatatcgctcctattcacaaaacagataactgttttagccccctcccttttttggtccccatatttattgctacaaatttgtctttctcctatagctagacttttaattaatggtgaaacattaaaatgttgtattgtgatattttcggtgacttgaaagttaagagaaagcagcactgctcattcatgcccttgccttgtcactccctggtgcagttcatctcttctatccttcttatcagagtatctcagtgcttagttgagcttgtttatcttaaaagagcaggaggcaggcttttagggaataagctacatgttccagtataacaggcaccaatgctgtttgacttgaaaaacatttgatctcttacattaacagcccatgtcactgtaataggtagtacagccgagttgttcagttttctattattttagctttgaaataactgttagtgctgccccaaaatcttcgtgtataaaattgtatattggctgccccccaggactcgtaagtaaacaaggtgatatgtgtggccagaggggagggtatttgttggctttgttttagataataactgatcctatctaaagatgttttctgtctgatccctgatagtgggtgctgcatgacgttgtgtaaattcgcagacctagcaatattttaaggcagatttctgtttgttattaatatatgtgctcagtaactattaattatgaactttcatttttttctctga

SEQ ID NO: 62545 - DNA, 1024 bp, Homo sapiens
gtcatggggaatattgccccagctatgaacctgctgtgtgctgccatcaaaacatctttacttcttgaattggacagtcaaaaatacaaacagcctcaaagttaggaatgctttggttaagggttgccaaactttgtctgtaaaggggcagataataaacatttgaggctttgtgggagataggatctttcttgtggccacttacctcttccgttgtagtgtgaaagcagccacagacaaatcgtaaatggatgggcatggctatgggccagttaaactttatttgcaaaaatatgtgtcaggccagagcttgtaagtgctgttaactgatcatactggcattataagtagtgggacagtaggactgcagttgggctgccactgaagttcctctgctattaaaaacaaaacaaaacaaaacttttttttaagctagctggacagtctgggtttagggtttcaattattcattgagcatctgttatctgtatacttacgtaatgtgttagtgggtagagggagctacaaagacttttcccagtaatctttcaatcttactggttagtcgaaagtaacagtgcagacatttatctaattaagtgcctgttgtgtggatcaagattaaaatttagttagggaatttccagtagagtaaggtggagtagttttatggtttcttggagaagatgacagttaaacctcattttaagaatgtgtaagacttgaatagatgagataatcttgtgtttataattgttgagtgaactagactggagttaagaatccttccaggccagactctgtggctcatgcctgtaatcccagcactttgggaaacggaggtgggaggattgcttgaggctgtgagtttgagaccagctgggtaatatagtgagaacccctgtatctacaaaaaaacagaaaaattagcctggtgtagtggcgtatacctgtagtcttagctagtagggagcctgaggcaggaggattacttgagcccaggagttggaggttacaaggagct

SEQ ID NO: 62546 - DNA, 1030 bp, Homo sapiens
aggtacaaactagtaactttatggaatgaaatactcatttttgggttagcctgatgttttcttataagtagatttaagttttgtggttttgacaaggatacctcacaagtgatgtgctgttttcagtacatcatattaaaaggcacataatcttaaggtggcatctgctggatttctccactatgaggttactcttttttcattgtaactatcaagtatcttatagaaaaaatattttgagattatgtgaccatcctgttaacttgtcaaactttcactcacttattgtagttttaaattttacttaggtttttgagatggtgtcttgctgtgatgcccagactgctctcaaactcctggactcaggcagtccctctgcctccacctcctgagcagctgggattacacgcatatgccaaagtactaggctcacttgctaattttagcacccaatgatgattcttccttatattaatcacttatccttaaatagaatttattggatataatttagcctgatgatctaggaaaattatgcacatagcttattgggaatcctcatagataaagatgcaaggaataactgtgttgctgagctttcctgggtgatgttggacaggctttgagaactgttgaggtgactacttaggtatacatggctatttcatcattaccccttaccctcaagactgtagacctagtaatctcattcactggcattctgcttctactctttagtattaggagggttcctaatccttgttcctgatatcatgactgtttaatgtccctacctctatttttttgtaacaacattataagttggattttttgtttgatttgatttctcatgatggatggcccagagtaaaagtgttgggttaatctgtattaaaagaacataccaatgtttatgggtttcccccattttttgtttaagagttatttttaacaataccatttaaatattctttgccctagtgggatagaaaggggaaaggaactcctaagaagctctgtgttctatgtt

SEQ ID NO: 62547 - DNA, 1067 bp, Homo sapiens
agctggaattacaggtgcctgccaccatgcctggctaatttttgtattttggggtttttttttttttgagacacagtcttgctctatcgcccaggctggagtgcagtggtgtgatcttggctcaccacaacctccacctccagggttcaagcgactcttctgcctcagcctcctgcgtaactgggactacaggtgcccactaccacaccgggctaatttttgtatttttagtagaaacggggtttcaccatgttggccaggctggtcgcaaactcttgaccttgtgatctgcccacctaagcctcccaaagtgctgggattacaggcatgagccactgttcccgacctaatttttgtatttttagtagagacagggtttcaccatgttggccaggctgttctcagacccctgacctcaggtgatctgcccagcttggcctcccaaagtgctgggattacagacatgagccaccacacctggccctgtattcatttttaatataaaattggatacaatgagcctgagcagcagtaaaaataattctaatttacttggatttatagcattgttctaggaaataggagatctaatatttgttgagcacccaccgtgaacatgatgcttatttgatttaaccctcacaataaccctgtaaagtttttagatatgatgtgacttccaatttatagatgaagaaaatggagggttagagaggttagatgacttgtctagctaattagtgatttgatactcagatctcagtgtttccaaagcgtttctacttgtgccttctgacttcagtttatatatagtgtttagagggaaagtacttgaaactgtgacacattcattttttaatttactatatgttaaatgttttttggatgaacacttcttttttttataaaaataattgtttagtaaatagaattgaatcatccaggaagctttaaaaaaaaaaacaaacaaaaatccacaaatgatcagtaattgatgttgagacagttacaattttaactgtttggagaatcaacacctgatctgttcatctaaaccaataggacaa

SEQ ID NO: 62548 - DNA, 1015 bp, Homo sapiens
agggcagctgtccaggactgccctgaacttgattaccccattgctgattttttttaaggtaggacatagtatataagctgtttaaactccctcttttctctattgcatatgacaataatgaagtgccatttgctattttgtttttttgtttttgttttgttttgtttttcctgtagtcaacttctgtagacaaaaagatgtcaaggccgccttatacctagtattgatacaagtaggatttgcatctcattaacttgagattcttttgcagatatttctaatgggatttcagaaactcactattgattataaaaagttcagttatcttctagcaatttaacattgtttttaactaatattatagttgacatatattattcaaaaatagcgttttgccattgttgataggacataactactgcatgttaatttggagagctatttaaatattggaggagcaaacaactttataccaaaaatttggcaagttgaacaaattccttgaaaaatacaacttaccaaaactcttaacacagggtgaagcaaaatttgaatagcctgatgtctattaaataaatttaattaatcatcagaagggacatgtggttttactggtgaattcaacaaatatttaaggaagaaatgatacgaattttatgccagaccctttcacagaatagagaaggaaagaacactccttgacttaaaaatccaccataacagtaattccaaaacccgacaaagatattaccagaacaagaaataatgaaggtggaaattaagagacactgttccctgtgtctgtcaccaagtcattttgtatacctgctttttcgtttcatttccagcatctgaagatggaagagtttggggtagggagaggaagtagagcagtgtatccttgtaaagaaagttaattttcttagtttcagaataatctcatttcttggcattaaatatgaacttttatttaaaggatgtacaaaatagctacaatttttgttttactcctaaa

SEQ ID NO: 62549 - DNA, 1054 bp, Homo sapiens
aaatcacatcttttccttacagaagaattccagttaatgtggaaggaaagacaaaaataataaattcactattagaatacacagtaaaaattaccataggcatgattagcacccaatggatgctaaaattagcaagctgagatgcaagtagaaacagaatatttgcatagtctccaagtattttgccatatatatatatatatatatatatatatatattcagtaattcctaaggggaaaataatgtttatactggagaatcttggcagacatgtccttagctgtataatcaaggctaacatcaccagaaataccagcataccttctgatttgatgcagtgagaggggcacatcacctctaaagtatctttccccaaaataacctcaatctgatcatgagaaaatatcagacaaacccaacttgaggcacagtctgtagattaactgatcagtgctgtttagcagtgtcagtcatgaaagacaaggaaagactgagggattgttgaaaataagaggagccctaagagacatgacaaataaatgccatgtgggatcctagattagatgctgaacagaaaaaggacattagtggaaaaactggtgaaacctgagtaagttctgtactttatatagtaccaagttaatttcttagtttcgataaatgttctgtaattatgtaagatattaacatatggagaagctgggtgacaagtatataggaaatctttactttttctttctttctttttttaaagagatgatgtcttgatttgttgcccaggctggagtgcaatggcataatcatagctccctgcagtcttcaactccagggctcagtcagtcctcctgagtagccaggactacaggcctgtgctgccacgcccagttaatttttttttttttttaaatagaaatgtgggcttgtatggaactcccggtttcaagtagccctcctgcctctacctcccaaagtgctgggattataggcatgagccactgtgcttgaactttactatttttgtacttgttctataaatctaaaattatctcaaaa

SEQ ID NO: 62550 - DNA, 2014 bp, Homo sapiens
ggccaaggaacaaggctgtgccttttcagcagacagctggcagggagagaggcatgttgttaggaaagagagaggcaaggcaaataaaattactgctaacgctcagagatcggcaggagtcctacttgcctaatcttaccggtgggagcaagcggctgttgtaatccaattatagcagcataagcaatttgttagacactccgcataatgtaacaatttcccaataaactctgacttgtaataacgtcggcaagagtccgcataaatctgcccgaatggtgggggctggagcattcggctgggggcttgtaattggcgccatcagcacgttttgcggagtgcagtatggtgcagtcttttagtgcaggaattttaaggagaaaagcgtggcacatttctcagggaaaaaaaaaaaagtggccattaaaaggggaacagcaagaagggcatactcttgccgtcacattacctaggaatcttagtgtagaaagaaaacaggaggaagccatgtttcctcctaatactaaagaggggaggtggggaaaagagtgtgtgaattagttaaatttctttatttaaaaggcatcggtttctattatttataccttcatctccagccccctaaaatgctgttcaggcagggtttagctaacatttttataaaatggtcatactcaagacaagcctagaaatgccaagttaaaatctgttttcttctggagttagcattttctttacaacatgaaatatatattctttatgaccaggacaaatcttttgaagatattatctcactgaatatcagacctttctgtggtgttctgacttctgctttaagaaactgtcacttactgaagggtttaaatctcagcttgtttgcttagctgcactgcttcttttctcattctgaaacatattgtgaatatctatgatactaggattagtaatcaatcttattgaaacattacattttataagaacatatcatttaaatttatacttgtgtgatcattatagaaataattttgattcctaagtaataaaatttctgttttggaaaaaatatttgttgttatatgggacaaaataaaatcacccttattaattgattagcatttgtagtcacagaatagggtttcttgttatataaggtataggaggtgaagcgtgcttatggatttgagttaatagattttcatgctactcaatgtttattaaatgttacctactttcttatgccaacccatttcttcattgctatataatttgtgtcaaaaccaactatatgaagaacaggatttttcagaatatcctgttgctgtgggtattaccacaataaatacttacttgcagacttaaacatttccttttgctgaaacaaatgcagccttctttgactggagctacatcaataaactgcagtgcctctaataaagccactcagtgtctgggtttaactaatggctgattttcatggctttgacagtgagctgtgtgcgttattttctcctgatattgtaaaaataatgagagcaaattagaacaatcagtttacacagatagctcctgattggaggcgatgggcaatatggcagcaggtaatccatctttggactcctgtcacattaacttcaacagtgtgaaaagatcaggtggggtaagcagggatcctacccagtcggaacactgaaattaatgagaagaacagtgttctgtgatcaaccttttaattagcaagagtggaaacagagggaatgatgaagggagcaccacagctgcacaatgccaggctcagtttctgaaaaggaaagcaaaaaaatctgtgttttatgttactttttttcttgctgtgtacaggcattatctttccattctagagctggttgcaggcttaagaaatactgcctactttccaaagtaatgccacaaatatggttgatatattaataatctatagactgtaattctatcaggagtcatttgattttgattaccagcatactttctttggcat

SEQ ID NO: 62551 - DNA, 1056 bp, Homo sapiens
aaagattttttggtaggaagtgtttggtaacatgttgctttgttggtggaacataatgttgccacaaaccatgaataaatattctgaattatctaatattatagcagttataaccatttttaagcctcctttctaagtagatatttctctcctggcttcctgtgctgtgaactttgcaaaactggcataggcagcctattaattattcatatcatagcaacaattaaagcaaattaaaaataaaaatcaccgtattgcatttaaccgtgggcagcaccaaactgtgtcagctctgtaagggcctgtggtgtttccttagttaaaagtgctagagggagctctaaccttgttcagagtggtggcatatgggaacaattgtctgtatgtggccataggtttgcaagtgaagatatagtctcaggctcttctgtggcaaaaatttaaatcttttttattagaagtccctgtttcctttatatctgaaaataagggctaggacagtctatctatagccaaacagaactgtgttcatccttattgccctttctgtgaatacaatcatagtgaattttcacgaagtgaacatacctgtgtgattaccatcagattttatttttatttttaaaaaattccagattaagttcacatccacccagattttaataggaaaagagaaatgaaaagaccattaccggagcccactactaccctctttaagtcactaccctttcaagggtaaacattatcctcacttctaacaccatacattagttctgcctggttttgagcctcatataaatggaatcatatagtatttttttttttttactgtctgaattatttcactgtttttgagagtcatttatattgttatgtatgtatagttataatttgttattgatatgtaatatttcattatacatatatgccataatttatccattttactataagtgaacattgggtttctttcagattttcataactacaaaaaattattttacatatattttcctgaatatatacaatgagtgtatttgaatgggtatattaacc

SEQ ID NO: 62552 - DNA, 1044 bp, Homo sapiens
aaaataataatagcaggccagccgtggtggttcacgcctgtattcccagcactttgggaagccaaggcaggcagatgaccgaaggtcaggagttcgagaccagcctgaccaacatggtgaaaccccgtctctactaaaaatacaaaaaaagtagctgggtgtagtggtgcgcgcctgtaatcccagctactcaggaggctgaggcaggagaatcacttaaacccaggaggcggaggttgcagtgagctgagatcatgccattgcactccagcctgggcaacaagagcgagactctgtctcaaaaaaaaaacagaaaaaaataataataatagccacctttagtaaccatgtacatgctagatcctgttccaagtatttcatatacataatctgttatttcatatgacaattgtaggaagtaggtggtattagttttgtttacagggggaaaaagtgaagcttaaagaaggcaactaacttgttcaggtctatatagcttgtacatggcagacacttggcctgtacctgggcttgtctgacactatgcagtactaccttttttttgagacaggagtctcgttctgtcgggctggagtgcagtggtgcgatctgggctcactgcaacctccgccttctgggctcaagcaattctcgtgagtagccgggattataggcatgcaccaccatgcccagctaaatttttttgtatttttagtagaggtggggtttcaccatgttgcccaggctgctgtcaaactcctggcctcaaagtgatctgcccacctcggcctcccaaagtgctaggattacaggtatgagccaccatgcttggccactatgcagtactaccttttaaataattatgtatcttaccacctccataaataaagccctgggtccttcatattatatttaagaatataccctccaaaatgtcttgattctgtctttgtcacacccctaacccccattctcactgctgctctcctagttcatgtctattctgatatcagcccactcttccatccttactatgtaggccta

SEQ ID NO: 62553 - DNA, 1063 bp, Homo sapiens
ctaatttttctatttttagtagagacggggtttcaccatgttggtcaggctgatctcgaactcccaacctcaggtgatccgccgcctcagcctcccaaagtgctggggttacaggcgtgagccacctgtagttttcgcgcctggctagttttccaaatttttttacctttcaaaatgggtggccctttgaactgaagcatgaagccatcagctcattggcactattgtagcacatggtgaatgttaaatacagttgctcaagttaggcttcaactctaagtcctataagacctttcctgcctttctctgtcctcccaaaatttagctcatgtttttttgtaatatttcaatattagagtgttcagtctgatagacttggcaatttttatacagatttgttttcagccctgttatcagtcttgggggtggggaggacaggcattgatgagcagcagttctattatataccttgtttattgtccttggtagtgttggttataaaaagtgtaacagtcatgctgtaccaagccaagatgccaactctgccatagttaaatgttaaaattccaagctcagattcaaaattgactgaaaggaaatctttcagcagactatttcaatctcagttgactaaccctaggtatgcaaggtggatggcaaggctagatgaagtgctctaaacaactgaagtttacttatttcctagctatagtgtactcattgtttcacaaagggttaaattatgtagttagtgaatgcttttctagctgcaggggtttttgaaaagagatctaggaattctgcagttaattgaattcttcaggcatggactcagggtctctgaaaaaatttgagtgagcaaaattctcttgctttgctcctagatatagttcataccatgtcttaggaatccagaattattttttgaaggattttatgcctatatatgctgactgaacatttaataagataaccacgacattttaaaagattttatacaatgtacttgtttccttgcattgcccttctccctgttttttcttctcttacttccccaagtctg

SEQ ID NO: 62554 - DNA, 1039 bp, Homo sapiens
ctccggaggctgaggcaggagaatggcgtgaacccaggagttggagcttgcagtgagccgagatcgcgccactgcactccaacctgagcgacagattgagactccatcttaaaaaaaaacaaaaaaaaaagtcgttgttagatgtttatttaattaaaacctgacaacagcctctagagagtataatatagacttttaaaaaatctcttcctttccccctcaaaatccttgtaagttttgccttgtttctcctggccgcaggagcaagaacactgttgtatccccatccagattaatgtaccagactaaatatctaaaggatcagccttaatgaggtagtaaagtattatactaaaataaatgtatattatgacccagacttacaattctcaacaggggatttctcctcctttggtttctcctccttcatcctctgtcatgagagttaaaatacctttcttttaaacatttcctaatctgcctaatctaatcctagccatagtcacattttgcctggattattttatcagccttctaattgatctttcttcctctgcttttgcaacttgctcttattatcccctccccacctttccagcccctgctccattctctgtgtggcagctagtataaatatttgtaaggcacaaatcagacaatgccatatgtgactatttcaaaacctccaggggctctcctttacacttcagatgaaatctaaactctgtaggatggcctagaaggccttatgtgatcttagccccagccaccttaattcccaccatttttccttaattcccaccattttcttattcattctgcccagccacattggccttctgtctttcacttgaacataccattgcactagctcttccttctatctagaaggatcttccccaagatcttcacaagactgacatgtcattcaaatctcagctcaggtgtcacttcctttagaggcatttcttgaccactccagttaaagtaggctgcactctttacttcttttctttttcttttctttttaaacatgatc

SEQ ID NO: 62555 - DNA, 1036 bp, Homo sapiens
ttgattttttaataattgaactttttcattgtgtccttgtagattttcagaagttctcaaattggaattttgctgaatttactttagataattgtagaaaaatctgtattggagaatggtagaagaaaggggcatgacaacaaagacctttagatttctctacaaacataataccttagttacaaataaaattcatattacagtggatttatcagtaggaatactgtactcttagaagtttttttaaaataactttattaaaatataatttacatacaataaaatacacccattttaagtatatagttcaatgaatgttggcaactggcgtaacaatcaagttagagaacattttcattgtcccaaaaacatcccttgtacccttccccagtcagtcccatctctacatccagcctcaggcaaccactgatctgtttttctaacaattagaattactgttcctagagtttcatacgagtagaatcataatggactcatttgtacctggcttctttgattcagcatgtttttgaggttcatctttaccattttgtgtgtctgtggtttattctttttgttgctgagtactattccattctacagcagcatcacagtttgtttaccagttaatcttttgatggacatttggattattaccattttggatttttattaatatggaagcaaaaaacattaaagtaccagtctttgtgttgaactgtgtttcgttttaaggaggtaagtacctaaagtggaattgctgggttgtttggtaagtatatgtttaactttacaaaaaactgtcaacttgttttccaaagtagttgtaccattaaacgtgactgccaacaatgtgtgagagacccagttgttcctcattcttgtccacacttagtattgtcagtcttttaaattttagccattctaataagtgtgtcataatgtcttgatattttaatttgcatttccctaatgactaataatgttgaacatcttttcatatgcttattggcatctgtggatctttttttgtgaa

SEQ ID NO: 62556 - DNA, 1126 bp, Homo sapiens
gatcgcttgagcccaggagctggaggctgcagtgagctatgatctcaccactgcactccagcctgggtgacagagtgagaccttgtctcaaaaaaaagttgtgagcaagtaattgtataaatgtccaacaactgttgtatacaagaaaaagcaaattagatttttggcttgctagtaataacatgctttcagcttttggtttttatttgtgtatcttcaaatattaagaatgtcttctgcaaacttttggaaatggatgcttagtcttctagtattatagctgatttaccaactttctatggtatttctgtggttttccacgtaattgctaatagaataacagagtgggctcaatcatgtagacataatatagcatgccataccagaaaatcatatatatttccctcattttcaatactaatcattttatgtttcttttaacccccttctacagacaaaacttgccaatggcacttccagtatgattgtgcccaagcaacggaaactctcagcaagctatgaaaaggaaaaggaactgtgtgtcaaatactttgagcagtggtcagagtcagatcaagtggaatttgtggaacatcttatatcccaaatgtgtcattaccaacatgggcacataaactcgtatcttaaacctatgttgcagagagatttcataactgctctgccaggtatgtctacaagtgtttgtaaaccattaatttgctatgatgataagagaactagatctccagctatatatctctctttaaaagtctttattggcttgatttttacaaattaagttccttaactgtacctttttgatataaagcttttttttttttttttttttttttttttttttttttgagatggagtcttgccctgtcgcccaggctggaatgcagtggtgtgatctcagctcactgcaacactgcaagctccacctcccggcttaacgccattctcctgcctcagccttctgagtagctgggactacaggcgcccgccaccacactgggctaattttttgtatttttagtagagatggggtttcaccatgttagccaggatggtctggatctcctgacctcgtggtccacctgcctcggcctcccaaagtgctggg

SEQ ID NO: 62557 - DNA, 1012 bp, Homo sapiens
gagacctcagtacagatttgggtggtggagaactttaattgggaagcccttctggtttacactccccaagatctgttctccactgttttcctctgcacctcctacaaaatattctctgaaatgctaaccaagttatcttttggtctggaattttttttcatttttgcccaactgtcatttaggttttatagcagcagctactctcaaatatagtttttttaaatctgaaattaaacccattcttgaacttaaacatacatctctgtctttctcttgggatatttccatgccattctgtatttccttcttctctcctttctgcatgcccaaaattctataacccagcacattctgacttagtgcctctcccctagtacatttaaaggacatttcttttaccgaacagctttggaactacagcagtaatagaaacagaatgagaaatggacctaatatagagatttgggggggtctgaatcatagagtttgagatgccatccatagaacatcccctagtgctgaaatccatatagatagatgtgaattgttttctggaatcctttttatttttaatgtcttggggggtttgctggttgttagctttaacttccttatctaaaggaagatggaaaatactgttcatttctgtaaccttatggaaaaattattgacactcattttacccaagcctctgtttgaaaaagaaactggaccacactagggacaatgatgtgccttcatagcagaacaaatgctgttctgttttaaaggaccttttgtaaaaaatcattcgccaccttctgtgttctttttctttgcctcctccccctactgaaagctcggggattggatcatattgctgagaacattctgtcatacctggatgccaaatcactatgtgctgctgaacttgtgtgcaaggaatggtaccgagtgacctctgatggcatgctgtggaagaagcttatcgagagaatggtcaggacagattctctgtggagaggcctggcag

SEQ ID NO: 62558 - DNA, 1810 bp, Homo sapiens
tcatgccactgcactccagcctgggcaacagagcaagaccctgtctctttctctgtctctctctctctctctctctctctctctcacatacacacacacacacacacacacacaaaagaatattattactacttctcaaatatgttttttaattcttatttcgctacatagaaaaatagaaatctttcataacctacttcatactttggaaataaactctttaatagtacaacaaagcaaataaaaatggagttatatggtattcggggtccatcattttgctaagagtgctgggaccagccttggggatacagcaggcagttgcttacatgagaaaattttagggcagctgagaagatttctgtatccctcagaaaaaaagaatctcgtctccaaataactcctgaaatttcagttaaggagattcattcctttagctataaaggttctgttacctgttaaaatacattgtgttcccatttggactgtaaatgacagtaaaccttcatcataaattgggagtttactgagtccttttttgaaggcagaaagatcaagaagtaagtgggcagttcttggcagatggatgtgaaaatgccaaaggtaaaaggctccacagttttgcttgggattggcactaaatggcaagatcttttatgttagttacaaagaaaaaacaatcattgagaagatggcttttgagcctttctaaagggtaggtgaagtaatccaggatccagcactaattaccacttttttcccctatctctttatccacagaaacccattcccgctcttttgagtatccttcagagttctgactatatccccttgtctttgggcatgtttatcctcttaatcccatgataaacccatgaaattccaaatacttatacatcccgtgtcaacttcctccattattccctcgactttcttgttgctgcttctgtttttacatgttgactttattcctgtgtcagttttcttcccttttttaaaaaaaaatttactccatcagtttctcattttcttctttcaagttgtcttaccaagcctaatacgtcaataaagtctttctgtgttatacttttccccatatgctagctttgaaaggttcttccatttctactaaccaaaaatagtaagtaaatacagttttctaataaagcttttatctctaagttttaacttggtatttgatgttgtattttatatctagatggatttgacagtcttcccctgggacatgaactctgtagttttctctcttgaataatactgaatatgctgtctgctcagtaatggtaactcttaaaagtataataaaagaccacttgggaaaagtcaattttcttaatcagcagatcacattttatgataacattctgaatttaatatttaacgtttatcatgtactcacattcttgtaggtactaggcatttcacatagaagtagtccctgttttcaaagatcttccatcataaaaggttttgacttaaaacataaagacagaagccagttttcagtacctagccacctctttctgtaacactttgatttgaagaaattcagatactttaccaagacatggtaaatgcagtgaggtggaaaacaagatcagaagcttatgtgagttctctttccttagaatgtagatagtatcattgcataggaagaaagtcttggagtgctagagattaaaagaagacaggaatctcaggaatggtgggcattgagaaacaataaagtagttaagaatgtgggtgggctcaggagtcagacttaaaatcttcacattcaaaatctatt

SEQ ID NO: 62559 - DNA, 1012 bp, Homo sapiens
ccctccacaacttgcccatatttcaagcagtatgtcttaaggacacactggcagcatcccatccccttccttctcccactctcccagtctggccctctctctaaatataaggggtggaagggcgcatgatggtcaaatataggtaacagattgtagcttgagtaccatctaaatctcatctatcacttccagagtgtgggatgtaaatacaggtgaaatgctaaacacgttgattcaccattgtgaagcagttctgcacttgcgtttcaataatggcatgatggtgacctgctccaaagatcgttccattgctgtatgggatatggcctccccaactgacattaccctccggagggtgctggtcggacaccgagctgctgtcaatgttgtagactttgatgacaagtacattgtttctgcatctggggatagaactataaaggtaataaggcatttttcagtaagtttccaacttagaatgggggaattcatatgaaaatttgatcaagggcaatttcatatttaaacgttgctacagaaaaatgtaatatttaattcagagactagtctacaagtgaaaaggtgtaataagtgagacgttgtgtgacaatttatcctagatattttattcctataaatagtggtgagtgtgagaagagactaaccctagaagagtaaatcaatctgaggaattctcatgtggtaacagccaactgcaaattagcctctgttaccatgaatttaaattgtcctttgttttatttgtttgagaagacttccctctaatggttcagtcctgttttctgcttctctaagactccatttgccatagattttaccaataaaagcaccaaatcaactgctcaatgccattttctttttcaggtatggaacacaagtacttgtgaatttgtaaggaccttaaatggacacaaacgaggcattgcctgtttgcagtacagggacaggctggtagtgagtggctcatctgacaacactatcaggtgagcag

SEQ ID NO: 62560 - DNA, 1028 bp, Homo sapiens
aagaagtgtctgccgtggcagagggggaggtgctttgtgagaacaggacatcactgataatctgtatctctttcagtttggtgacttcaggaaactgctttcttagcttggtcatttccttctcaggcaactgcgtgcattgaattcgtttttatgcctggaagaacctgtttacagaattatgtaaagccctgtgctttgaaaatacattttacatttgaacttaaacctacatatttctgtgtgagttatatagcagaaaggaaataaattacattgaaagcagtacatatctgtgtgggtggtgattgattttattttatgaatttttagaaggcatatgaggtgtattgttataacattccaggcttagaaaagaatacgtgaaaattcacctgacttaattttctcttccagattatgggacatagaatgtggtgcatgtttacgagtgttagaaggccatgaggaattggtgcgttgtattcgatttgataacaagaggatagtcagtggggcctatgatgggtgagtgtgctaacagagtgtaaaaaagagaaaatctacgtcttaatccttccttatgtttatggtgttaaacataaccattccttgtttctaaaagcttatagattttacacaaaatatctgataccatatttctttaatccgtgtatttacctctccttggtttagtgtcctgaaatattcttcccattcattttattatacttgtttgcacatggttgtcattcatattttggttatttggttatgtatttgactgttttgccctgtaaagcaaagaacaagaaaaacccagtgttaacaggctacccatgtaaaagggtaacctgttaacaaaacagaaacactagagggcagtatttggggacttagtgtggtaagatcttgaattttgatttcttgggttttttatctctttgagtaatttttaagagtacagttctcttgtcatcacttgtcatcctagcatttcatttatgagtttagtcatctttattttc

SEQ ID NO: 62561 - DNA, 1823 bp, Homo sapiens
caatattttcttattgtcctggctttgatctgtacccacctgtcttggaatttgtctgctatgtaccttgaggaaacatggcctattaaaagatttttggaagagctacacttatcttatttaaatcaaaagatgagggcttgcttatataaactccattgctcttacatggaccccagtccctcagtacatgtgacctgggccactcttagaagtgcccaggaagaggatgcttcacagttgtagatttctaggtctgtgtaatatcattaaaaggtctaatgtacaagatctcctcttgatcccaaagtatggtataactttactgttaactgtcttcagtttggttaaagctagcctgtttctcatttgtaggttaatcacgtacatttgaactatactcaccatccatatttattgccatgaatttctgctattcttccctgccttctcttacatttgcttttaactaacatttttgtcccctttttgatctttagaaaaattaaagtgtgggatcttgtggctgctttggacccccgtgctcctgcagggacactctgtctacggacccttgtggtaagagccttgctgtttagagagcattggagagcaggtgggggaagaaattaaacgttgatgtgctgtggaatatggatttgaatttaatagttacaacctcacaaaacctacaactaagtggtaaggcaaccagtacatgacaataaaatatgtttatataattcctttcatccaaaaatgctttagagactatatatggagagaaatgtggcagctgtttaacagctgcacagcaactctacacaacagtttagtgcagggagtgaataagaattctgtatccaccagaaacagcagggggtactaagggagagagaatataattattcaaattggaacctgtccaaaatctgaggacctgtacacctgtgccttcaaaaagtgccctgggggccgggtgcggtggctcatgcctattatcccagcactttgggaggtcaaggcagatggatcacctgagatcaggagttcaagaccagcttgaccaacacggtgaaaccccatctctgctaaaaataaaaaaaaaattagccaagcatggtggcaggtgcctgtaatcctagctactcaggaggctgaggcaggagaatcacttgaacctgagaggcggaggttgcagtgaaccaagatcatgcttgcactccagcctgggcaacaagagcgaaactctgtcttaaaaaaaaaaaaaaactgccctgggaatctgcatgaatccccctggtcaaccccttagttctgcagcctattcatgaggtagtgcctccagcaacttgagcccatcttttttgttccccatatacccccttttgacatttggggaaaaaagtgattcaaaaggaggaatgcactaaattatttatcatgttgttagccaagggcccagattgataaatgctgcttccattagaaaattagttggagcaacagggtggacagacaccactcggagaaaagatgagagcaagcatttgaagcccagtgttctaaatcctgactgtcatcatttaggcattcttggctctggagaagagaaagaggttacatttcttgtcttccttgttggatttatgtgtgtatgtataagacagggtcttcctctgtcacccaggctatagtgaagtggcactacatgttgctgatgtatatcaatatttcatttcttttgaaaatttgctgagtagtattctattgtatggttatacccattcactgattgtttctcgtttttggctattaacaaa

SEQ ID NO: 62562 - DNA, 1016 bp, Homo sapiens
agtgcaacaacttttgggtggctgaggtgtgaggatcatatgagtccaggagattgaggctgcagtaagccacagatatgccactgcactccagcttgggtgagaatgagaccctgtctcaaaaaaaaaaaaagaaaaaaagctagattgacagtgtctttcagcactttaatgatgtcattccattttcttctggcttggtttctgactagaagttggaagtcactcatctccattctgtatctttttcctctgggtgcttttaagattttctctttatcattagttttcagcaatttgcttatgatgtgtcttggtgtggttttgtttgtatttttcctacttcacattaaaaaaatagaaattgtcagagcaatttgaagaagaaggctaaacttatgttgtctacaagaaagctactttaactataaagacacatacaccttaaaagtaaatggttagcgaaagatataacacatgttataggctgaattgtgttcccctaaaatttatatgatgtcttaaccaccagtacctcagaatgtgactgtatttggagttataggagctttcaagaggtaaataaggttaaatgaagtcattggagtaggccctaatccaatatgactggtgtccttaaaacaagaggagattgggacacacagagaccatgtgaagataaagggagaagatgaccatctacaagtcaaaggaagaagcatcagaatgaaaccaaccctgccaacactttgatcttagaattctagtctccagactgtagggaaattaatttctattttttgagccccctagtgtatgccatactttgttatggcacccctagccctgatggaccattctaacactagtcagaagaaagttggggtagctgtattaattagagagagagcaaacctcagagcaaagaatattatcagggataaagagaagtgttgtataaggataaaggggccagttctccaagaagacctaacaatccttaatgtgtacacacc

SEQ ID NO: 62563 - DNA, 1035 bp, Homo sapiens
gtttgaggttacagtgagctatgatcacactaccgcattctagcctaggtgacaaaacaagactctgtctctaaaaaaaatgatgatgatgacacctgtaatcccagcactttgggaggccgaggcgggtggatcacgaggtcaggagatcaagaccatcctggctaacacgatgaaaccccgtctctactaaaaatacaaaaaattagccaggtgtggtggcaggcgcctgtagtcccagctactcgggaggctgaggcaggagaacggcgtgaacccgggaggcagagcttgcggtgagctgagatggcaccactgcactccagcaggggcgaaagagcgagactctgtctcaaaaaaaaaaaaaaaaaaaaaaagatgatgatgataaaattggagtggaggtaacattgtttagtaaggggtgtgagattgttttccagtatgctgggaacattctacatcttcatcagggtggtaactgccagtggtgtgctagaacaggctcatactcacttatgagagccaactattagatattcatgaattttgccagctggttgactatgactagcttataattggccatgataggagtttttaatgccgtggaaatctaccgatggttttacaaagtagcaaagtttggttgataaacatttatcagcatactgcttcttattgctcaccaatccttgacctctgattgtagaaggaacttagaagataaaaaccagggaggtagtaaggaatgctctcatccaccctacgccaaaaagggttggccatgagaaactattaatagcatgctatttagcatgtcttggccaaagagtattgctttgtttacagctgcctagtatttgacttttccatgctgcctttagccaaagtaaattttctctatttttttaatttatttatttttattttattttttttttagacagagtctcactctgttgcccaggctggagtgcagtggagtgatctcggctcactgcaacctccacctcccaggttcaagcaattctt

SEQ ID NO: 62564 - DNA, 1069 bp, Homo sapiens
aatcagtttgaaaactaagtactgtaatgacccaaaggcctgtgatgtttaagttcccagatcaaacaatacctacaatagagacctttcaagccaagtaaacagtctgatgtctaatgtgtgaatggaaacatctcttggtgaaagttcacactgacatataaataaaagggcagattttaaaaggaatataaaaagtagcttttatatccctatccctattcctcaaccctccaaaaagaggacctgtcttttgacctctgacctccacatgtcctcccactcaagtctccaacctctctctcaggcaggggaagatcctaaaatacccaggtggtccatacatattgtggtatattcagatcatacctgctgttctaaccagttcgaatacactaggttgttaccagtttgagaaggctgccctagctgctgaggagcgttgctgtcaggatttgccacgtgtgcctcagttctcgtggcggaagtacatgttcgctacacgtttctgcatctctctttgcagtgttccgctgaggacagtgattcacgcccagctgggctgtcctcagcttctctttctctcacagaggacacggttcgtcgttcctcagccaggtcgcacaggctgtgtgcccttagacaagtaacttcccagaccctgaatctcttgatgagtaacgtgaggggcagcactcacctcacggaaccctgtgaaggctgtgtggagatactgcatggaaaattcctagtgcttagcacagtggcgaatacataatatgccctcaggaaaaactggtcatgagtattaatattgcaatctccatatacctaccccctcctttgcccaaaattttctcttccttagacttccgtgttactttgccatttttaatattcttcctgactctctgattatttgtgcttctttccccctcactcccaagagtctgtttctggcttttcttattatttttattttattttattttatttcattttattttattttattttatttcttgaaacagggcttcactcctgtcacccaagctggagtgcagtggca

SEQ ID NO: 62565 - DNA, 1062 bp, Homo sapiens
tcaaatttctgtctccagtccaagcctctgccttaatctccaggccacatttccagctgccatccacacagctgtccttgaagatagcaagagcacttctagtgctcacatcctcaactgcactgtcccctcctttacactgctggtaccctgcagccacacagccaggccagctttccttgattcccccacttctgttactggcaccgccatgctcatggccactcaaaaggcagggcccacagaccatcccccacccctgccctgccattctacagggcaagtgaaagctatgccaaccgtgggcactctcagcctcaagacatcagagtcactctgcttgaacaccacagccctgagcatgtcagcaagccctgcctttagtataacttcccccatcaggccaggtcacctttgacagaagctcctgcatggcataggcagagagcaggcattaggaaggacccctaagccttttccccattggcagctaagtgaatgttcttttgtcttcaagcaagtaagaaatatcaaaaaaggggctaatgactatttgctctgttttcacacaggacccattaaagttgcggtatttaacgtatctgccaataccaggatgagcaacaacagtaacaatcaaactactgcccagtttccctggactagccgaggagcagggctttgagactcctgttgggacacagttggtctgcagtcggcccaggacggtctactcagcacaactgactgcttcagtgctgctatcagaagatgtcttctatcttttgtgaatgattggaacttttaaacctcccctcctctcctcctttcacctctgcacctagttttttcccattggttccagacaaaggtgacttataaatatatttagtgttttgccagaatctctcttgctttgccattaagcagaagaactagtttccctgtatagcctgctgggagagacccacttctagggtatgggggatgcagcttcaagcccagtgcccagtgtctccctgttaactgcaggaatgccaagcacctggccagagcagccca

SEQ ID NO: 62566 - DNA, 1028 bp, Homo sapiens
caaggtggggcctggccgagtgctgcccactcccactgagaaggatgtcttcaggctcttaggcctcccctaccgagaacctgctgagcgggactggtgacccatggctgggggtgctgaggagagccgagttggactggctacccctcctggccacccagtactccctccagcctcagctggctgaacctcgccgctccaaccaccagcttcctcagcgagcagggcccagggctctgggcctgaagcaagagccagcccggctcccagtgtctgcccggctcccagtgtctgcccagccctctcccagacaggagcaggctgccaccccttctacctcaccactgcccctcgaagaattttgcaaatggccccttgccccattttaagcaggagcaggtggctggtttgaagccccaggtatcccccttccctgctatgggaaaggccaagctgctgggtggggacagaagctgcaggggagagggaagcagccgtgctgtcaacatcatccggcaccctctggggtaggagaacagccattccacatgtgttccctctatccgtcctgcttcctgggcagctggtggtgctgggaatggggtgccccagccttggtgaggacagtgttgggaggcccaggggcccagtaaagtgcatttgacattgaacctgcctggtgtctgagctgctgcagcctctggctaccttgttccacccaggcagggacgacagagatgggaactgaaaagaggagcccagaaaggctgtgttaactgccctccagacaggactggcctgagtcagctcctaaactcacagcaaggacagcagtggctgtgaccagggagaatgttggagccaggcacccagagctcctatctagtcatcagcatcttctgcaggccctaccttagaccaggctatcaggggacatgagcaaaagtgacaagactcaggaaaccattaggaacaactaaatggtgaccgtgtacacagggatgggcggccagggaaggcttcccgga

SEQ ID NO: 62567 - DNA, 1053 bp, Homo sapiens
tcttaagcaaatgctccaggggtagaggaattgggctaggagactcccttagtttcttcttcttctttttttttagacagagtctcactctgttgcccaggctggagtgcagtggcacaatctcagctcactgaaacctccgcctcccgggttcaagcaattctcctgcctcagactcctgagtagctgggactacaggcacctaccaccatgcccagctaacttttttgtatttttagtagagatggggtttcaccatgttggccaggctggtcttgaactcctggcctcccttagtttcttctgttctttcaacggatagtgcatcagtgtttattcatcctttcaatcagtatttagttgagctcctagtatatgccaggagccacacttggtctttaggaaaccatagcatggggataaaacccctcctatctagtagaagagataggcagtaatcaaagagtcacataaaaagatgtaaaatcataaccaaattaagtgccatgaagaaaatacatggggacttaacattgtgttactgtgtgataggaatggcctggagatatgcagaagaaggcagggcactggcatggctagagggagtgcttggtcaggaaacccaattcaatgtcctgaacacatagagagataaatacgatgtcattcatgggaagacaaatgcttttaaaagtatcatggtatgtagtaaatgctccactatggatacgagtaaaacattagggaggcacacatgaggatgtgattaatcctaccaaagtggctggaggtgatagtggaggaagacttcccagtggaagtgacatttgagctggattttgaagggcaaagaagagttccacagataggaaaaaatatggagctgttgctggtagaggaaacagcagggcaaagatgttcaaggaaagcttcagaaagggagagagtctcaggacacgttttaaagtaatggtgggtggtggttggcaaggagtttggggaggtcctggctgggttcctcagtactcccaaggctggcactgtttcccaggt

SEQ ID NO: 62568 - DNA, 1044 bp, Homo sapiens
tgaagtaggagacccagcgcccctaggagcagggaacctggggcctgaactcatcaaggaaagcaatgccaatgtacgtccatctgtccaggtgtcttgcacggactgaggtgggggtgggctgtgggctgctggctcttgagggcagggaccatgtcttgttcacctcctcgcctccagtgtgccacctggacacagcactctataaatgtttgtttgaatgaatacagacattttggcttgatcgtcccagggcgggggctcagggcctggagtgctgtagcaatagcagcgtcagaggggagcagtggagaagagctgagggtcttgttgtgccccggggtagcgctctgatgagggtggagccttcccttccccaggaacagtcctcgagttggatttgccttctgcagcctatcttcatgcgcaaggacaccaagatgagtttccagtggcggattcgaaacctcccctatcctaaggatgtctatagtgtctctgtggaccagaaggagcgctgcatcattgtcagaacaaccaacaagaagtgagtagcgtggaaggcaccctgtgtgcttgtgtatgagcggggtgtagggtggggtttgatctggcgttaggatcattattcaggccggtcctgcagagaggaagcccttctgcttacaggtattggaagggcttcctctctgcaggaccggcctgaataatgtaatcagctccatcggggaagagaaacttgaatgagtatctagtatagtacctggcatagataggggctcagtaaatatttgttgaatgaatgagatgatgagggaaatcacaggaccattaacttgtggtctcaggtggttctgctgaaaggttattatgaccttggtctcctgactggagccaggccttggtaagggtggcctggtgacatcactgtcagagctggcagggagccatagcttggaaggcacccctgtctgaagtgggagtgacagtcctttaaagcagtacttgacagcagtttaaagcagactgggcagcagtaaacct

SEQ ID NO: 62569 - DNA, 1030 bp, Homo sapiens
cacccagaccagggtggccattctggcaggtggggaagtgtggcctctggccagaagccaaaaactcaatggctactcccttccacagtgtttagctttttaaggatatagtacatttaaaatctgttttctgatcatcattctgtcaggaggtggacaggatccatacttttattcttgtgttatagatgattatataaatgtatatataaagtcagcatgatgaaccagcttgctgaaagttagtgactgtctctcctgatactcagacatctgcacttcagaaatgcacatcatggcatttctctctgatttgacctcttccttcacctggaggttccataacctgccccagttctaatattctggaatgtggttactaaccaaagccagagtttctttacccatacttgccttgtctctgaagagctgggttggtgactttacttgaaggaattgattgcagtgtatcatgtccttggcctcacatattagtgagggatgaatcagggaaggaaaaaagtgcttttccaggatcccagtgttggaccatctattcctgataacgtttgtgcagaaagagggctcctagcctcagcctggaagttggccgctgtaggtggaatgagccagggtgcaggagtgagaagttgttgggttaaatctggcctctgccactgttagctgtagaatttaggcaaggtttcctcatctatcagagaagactcacagctacttcacagattttggggaatttgatgaaatcatatatgtacaggccagcacaacggctggcctgaagcaggtcctcaacagttctttggaaattggaatctgaggagagcttggctgatttgacatcggtgatagtaacactgtgggaggtgttaataggcttcactagaaaaaaggattctgtggttaaataaatttaagaaactctggattaaacaggcttctctttggtggggccgagagcctttagtatgtgtgtgtgattgtgactgtctagcagggggcgactgtgggt

SEQ ID NO: 62570 - DNA, 1034 bp, Homo sapiens
ggagagctcctcaatcattccttaaggcctcactaatggagggggcagggcccccaaatctggaagagggaggagaactgtggagccaaacagcccctacccagcatgcacccagtatacctgtgaaagagagagaatgactcccctacagggctctggcctgcccagggtggctgaatcttggctggtggcccatctgggaaggcagggcttctctgggagccaaggttagcagtctctaagggatgctgatctggggagaaggccttctgcctgatccctctcaggagccccccaacagacagaggcttgccatcttctccccgcaggcccagctctgggctactgagaggaagaccagaacttccctgaggaggctggtagcaggggtgctgccttggggattaattcccccctggcagcagcagtgctcctggccagggcccactgcccagggctcaaaggggaaaggtggaaggggcagaaaggaacccccagtctcctcctttgattccttcggccttcgggaagatggcagctctgttggggagaagggaggttgtgggtcagggtctcagtgaggtggaaggacgagagctgacatctgcattcagacatgtggctggctgccttgtctgcctcaagccctttgctgacatgctacttgggccaaaagggctggtgagccatgaagtcccctcactccatgccagggcctcttacctggacatccctgtgaagtgtccacggccttgtttctcctgtcatggcatggggaaagcccagcgtctcacgggtaaaggaagctaaggcatcaggcctggagggcgccccttttccttcatttcccccagtcattctgtggaaactccatacttgcacccatcccctggctgcagggattagcgggtgcacttgatgttgaggggtagttgctagggacaggaggcccccctacatagttgctaggggtctggcatcagggcaaagggtctgcccactgccgcggtcacggagggaattacacagtcaca

SEQ ID NO: 62571 - DNA, 1038 bp, Homo sapiens
ggctggaggtgaccctgggtaactcttggggcaagtcctgaggatgttgaggggccagtgatggagtggctgcattgtctgtgaaggtggggagtgccaccaccctgaagcatatagatctaagatttactaggtgcgtgacccctgcgccttcattttctcatctgtaaaatggggttaagaaacttacctccaaagcctgttgtgaggattaaatgggctgatacgagtaaaacactcagcacgttgcctggtacacagtatggactcaggatatgtgagctgttgctgcggtggctactctgccaccaggtaacctaagcagccgtctcatctggctccagcagacacaaagagaacaacaggcccttcagcttacttccctctgttcccgtcatcctgaaagctgctaccagacgggatttccaggagctctgcctttatcatggattcaggctctgcctttccttgctatacgacattgtcactttttgtctgtgactcttggtttccttatctacaatcggggcctggactaggacaatcactgtttgttcaaaagcctcatggctgtctgccactcacggagtttgtgccaggtgagggatgtgcaccctaaggcccactgtggcctggaggccagaccctgccagcacactcccaagcctccaaccaaaccagattgccagctgccgccaaaacagcctggttgccctagtgctgcacctttgttgttgctgctcctgccacctgggccatctccctatcttgtcattgcctatgacagccctgtctgtcagtgaagaatcagtcaacacccccagccagaaatgcttgcttttcttagctgcccccttgtagaactttccgttgttctctgtggtacctaccaactcacattttgatttgttagttggatatatgttgcagacttctttctctccctggattgaatactccttgaaggcagggacaaagtcttcttgatcaagtcacagcttacatctccctgtagtttccattaagcacaatgctttg

SEQ ID NO: 62572 - DNA, 1049 bp, Homo sapiens
tcatcttgtgttctctatgtttgagcaggacccttccttggctaggccccagggaaggtgccttgtgttgactgtctggggcccagctcctggcagctggaaggcccaagtgggtctgactggcctgacatcacaaatacccccttcctccatgggcttcctcttgctgtgggttttttttttctgccaaggggcatttgagatggacctagcactggtgccctgagcacagggcacagctgggcccctgatagcctgtgggcaggtgggcttcaggatggagagccctttaatcccagacctgaaggtgtcatagtaggtccagccacagtcacagccctaagccccactgggattgtggggtggggaaaggggtggggaggtggttggtgacctggctgctcctagggtattgagtccttggccaggtcctgtgctgccctgtgtgtgtggcaagccctgcacacatcccattgattccccttcccctttgggccagggtcatccctggtcccatgttacacctccacttccacctcaaagctcccaagttccccttttctcaacaaaggcaggggcagaataggcttctcacccatcctaacagatgccctagatttttctcctctgagcctgtgctcaagccaaccccatgcccagaataccccctctgtgcctaatgaaaccctgctcgctcttcaatataaacagcacctccaccacgaagctctccttgatcctgacccctgtggctggagttggtggccctttccactgaacacagtgttggaacactgataagggccacctggtcagccatggctgtggcctggtagaactctccctctgagctgggaactgaccttggtatcctgaactgagcacaggatatgagtgagtatcagggcatctaatgacatttggaataaatggtaagggacatttggctggagccccttctgtctggagaaggaagccgtgtcctgcacacaggctgggccactctgagagcactgttagtgcccatcctgcccaggtgtggctttgtc

SEQ ID NO: 62573 - DNA, 1053 bp, Homo sapiens
ttaacccacaatcccctagggaatgagcacggcatttcccattgttagccatttccaccacaggttctgacaagccagatctgactttgttctccttttgtttggcagctcttttgtgacagggacggcttgttgcgggcacttctcacccctgagaatctgggacctcaacaggtaagagattcatgagcccatgctggcttccagtccaggaggtgagggaaagcttgctgagccagcctctgcctcagttggctgagtggtccaggagaaggctgggaagtggtctagtaggaggcctctgctgtggtgccttctcacatggaatcattcagggttagctggaggagactgctgaagtaatttataataggtaaatagtttcatgtagaatttatgataacaacaacaatttggatttatgatactctttctctgaggaatgcctatgtggctatataaaatcccatctatccccagagatgattttgctaaaataaagaaattttgaaggtggcctacggacctataaaaagaattatacagaacagtgaaaatacatgcaggttttattcacaattctctgccttggcaggcttgacatattcccatctgattatctgccattctggttttttttttttttttaactttctaattttgaaataattatagattcacaggaagttacaaaaataagatggaaaggtgtttgtgtaacatcttacataatatgtaataatcaaaccaggaaatagaccctggtaccatccatggacctttattcagattgcactctgtgtgtgtgtgtgtgtgtgtgtgtgtgtctgtctgtgtctatgtgtgtctagtcctttgcaattgtatcacgtgtagattcagataaccatcaccacaattgaggtacagaactgtttgttccatcagcacaaaaattcctcatttaccccttggtagtcacacccatccttctcccctcctcctcttcccattgtccctgattcctggcaacttcttatgtgttctccatctctataattttgtcattttgca

SEQ ID NO: 62574 - DNA, 1019 bp, Homo sapiens
actgtggccagggagggaaagtcatgtaagaacatggtggatctctcaggaatcacatatatggagggagaatgtgggcacacagaacaataggtgtctactagttggataaaggccaaatgactccatgatgtccagtcccaaagtgtctatgtgaatggtgactgagctcagagaccttggctaccaactcttaaacaaagtgaagagtctgataggaactgttgtacagcctttgacctcctccccctcacattattactagtcagcaaataaggattcctcctttgtaagctgttgatggtgtccttagcaaaacccgccatattctaatgtgacatgcacagagaaagaacctggttgcagacacctgaggttgtatgaatgagcagtggcctagcaccctccctgaggggcagagagagactggaaccaagtcctgggatggcacaggtctggcctgcccaggcttcctccaaaggaaaatgattagcaagctgcatgatttgggattaaactgcagggagttgacacgtgcaccagggcttgctgctggcactcctctacaaatggagcactcctttcttgtgagggataggctttacctattgtgtacatagatacagtagctcttattgtcatggatcctacttctgtagtcctactgtgtataattcatgacgcatagcatctctttacaaacagagtggttatgaagcagaagtttgggggaaagcactgtcagagctgccggaaaactggaattctcataggcagctgttcccaggctttcaccactcagaaagccatcgaggtaaagggtctctgtcaagtcccggatggagccaagatatcatgtggtttgtgcaataatcagaatcacatttaattcagtgtgctactaatatgcaacacatctttcaggtaacttcaaaatgagtattttgattaccattcttttaatttcttaatttctgttttgttgttttatacataagtgatacataaatatgttctaa

SEQ ID NO: 62575 - DNA, 1054 bp, Homo sapiens
atctccctccctgcagattccgagcaagttatcatcagggtctaagctctttggcttttccacagagggatagcagaatattgggggtgggatgggaagttggttttctctagtaactggacttgcaggtacctcaagtcagcagctagcagttgtctagcacctggcacaggtactgtggagaaatgaaagcctgaagtaagatgggtcacccagccattaaatcaggaatatataccactgtcaagtgtatttgcaaatttgtgacctttcttatcattcttctgaaaggtttgtatcccatcccaagtggcttagtgggaaagaaaggaagcttccaatgaaatgactttttggtcattttttggtgtcctactatttttccaaagagaaaaatcttcatggttttacagtttgggatttcagaaatgcaagacaaaaacatgccattgggggaaaaaaaatcgattccaaagcaagtgttggtgtggtgtgagtgggtggaactacacttgaggttggatgggatgggcaggcagctgcctagggaagggattcccaggctttagcaactccttaagtgcctatgtgtaaaactctcctacttcaaagaactacccagcaagtagttcctcccctcatctctctaaggtggtagtcacccaaggaaggtacagggtcagcactctgaggcctggtggaaaagagctgatgggggcagaacgacctgtgggtgagagatccattccctagaactaatgagaggaacagataaattaaggtcaccattggaatctcctcacattgtaggcatccctgcccaggcctgggacccagaaaacatgattcttgagaataagtgggttctggcagcctccattgggaaagccagacatacacatgactagcagtactgcatgggtgtgtgaagacttggggaacttgaggtcctagagttttgtggtatcgctgactgaagccatgcttgcaccccattcctaaccaccaccacccaccccgccaggcgatagaaaacctccctccagcctcttga

SEQ ID NO: 62576 - DNA, 1014 bp, Homo sapiens
gggaaggaccaggtggcatgtgcagtgtgttccaggcctgtacaatccctgggggacagagctgggggctcagagactggtgtgctcctgtttctcgaaggaatgtgcagaggcgcatgcattaatggtccccacacaatgcttgcattttttttccaggcagaggcatcttccccgtgaaaaggctgccgaactcagggcccaggcgggagatttgccggcatagtggcgttatttcccaccctgcgcttagtcacttggagctaacatgggagaccaacaggccgcgtctctcgagagcccgatctttgtatccgatgtgtgctccccctctgccctgtcagttttgtgtgttcacggagtgttgattttaatgcgggcctgtgttgggctgggaggccaggctggggggcctcaagtctttgtcttgcagggctttttcttcttggagggtcttcggccctagaggctggtggcagatttgagaggtaggatgagatgccaactctggctggcaaaggattcccccatccatgtgtctgtcacagaccactgtggggtgcctagaaaacaagagcaccttgggatgctcgagcacacacttgcttggcaccccaccaccccttgaggggggcggttagttctaccccatagggctgccagcttgaagtgagttaaaccccccttgtgactgggtctggcaggagcacagattgtgagcctcagggagccaaagcagggccttgcttgcagggctctgagggaggtgggggcaggcaggaggggtgctagagcacaggtcagctgcagagactactctgcaatcattaagggacaggagagaatagagaccagacagaaaagaggcagagtgtctggggaagcttcaggaaatcacaaatgctcatctcaggcagttgaaggggaatgtccctaggaactagggcctaagtggaggcattttccccagtgaggagaactggacatggtcacaggtagagccaccaaggacca

SEQ ID NO: 62577 - DNA, 1044 bp, Homo sapiens
ggtcagcaactgagctagagatggtaagtgacaaagtgagggaatatcgtggatcccagttgttcctccatgtgtactggtatccagggcgaagcaagagagactgatttagaatcaagaaaaaagctactgaccacggatgttgccatttggagtggtttagcatcagagccataggagctgctcaggttcagggcttgcttgggcagctatggctgtctgaaaacttttttttttttaaagagatataactaaaaactttcaagtcctcggattttgggggtagtaattccacagggcttgtcatttgtgtttgaagctggtggtgaggagggcggagtgaggagaagcgagggggtggagatgggaagcaaagaaggaatcagagagagaaattttattgagggagagtttgctgggtttatgggagggaatctctcccctcctccccattcggatttgaaagggccggtgaatctttgattaggtgcaggtcaaaagaatttacacattgtgaccttaataactagaggtgattggcaggcgggctgcagggagagggccgcggccccctttcatctcacttagcacagaggagagacaatgggccagccgattttccttgttgtcccttgtttgaaaaggtctggtgtctctactaggtacctgtgacatgggggtcttgattggggtctcataaaggcccctgtcagtatgtccaaaggccaagagtacaaaagcaagcagtgggtgggggtctcagctgaccactgaagaagggaggggagggcccgggaggcagtggagggagaagcaacccccgatgggagcccttatagagggagggaaggaggggggcagagaagggccatttttgtccctaactcatcaagcacatctgcagaattgtccaagctgctgcctcctggtttcaaaagaaaaaaatgattgtttgataaaccgtccctgattcaccactttctcacaacggtgggagacccagccctgacctctgtatgatttcacgtcaggaccaggctttct

SEQ ID NO: 62578 - DNA, 1012 bp, Homo sapiens
ttaacatttaaattaagggtttgtttttcagtctgttttataggcagggacctttcatggcctgtcacatgcagcacccaccccccctcccaacccaacttcccaagcaagtgtgtaattgtagccactgctgtatcctaatctgtgttgcagtcggaggttcaaagggaattcctggagctggagttttggaggtacaagatgtaatagtcaggatgtcggtgttactcctcaaatgaaggtgctgtgtaggagctctttctcctcttatctgacctgtgctttctcagctcttcaagggacacacacttcaatctgactccgacccctcccgcccttccttcctttgggccatggggcaggtaggaaagggtgcagtccattcaagtgatttctccttatattacaagttagggccggggacagactattctaagatacagatttccatgcttatcttcctccttttgattattattattatattttagcctcacaaatacttccacctaccccactgactcttggagaagtaataaaataaatgggattaccatctgagaatttgtaattacagtagggtcctttggtcctaaaaagtgtattctaacatggatatgtgtatgcataccatacatactagctctgcatgtaccttgttggaaatagcttactgattgaatttgataaagctattctcccagatctatgtattcagaagaaactctactacaacctcaggtttctgagcttcctttcacacagaaatatttggcagcatttggggaggttttgaaaagacatccctgctctggtctccttcccatcagcaccctgttgatctgtagatgacaagaatgtgtactagacacacatgaagcatctcattgcttcataacctctgagggcttagttttcccactgctggtctctaggtagctttcttctctggacagtgaagagaggagcattgggacctttctctctttctgttcagaggctgagagtttcc

SEQ ID NO: 62579 - DNA, 1090 bp, Homo sapiens
ttaggcccttcagcttctttctcctcaccccatggagcctgcacccctcctcctactcccttccacaactccctttcaattttttttctttctaagaattagagccgattagccacgtcattaattcttcaatttgacggctgatatagcaggacctgaaacacattgctgaccccggagaatggagaccccattccttagcatattgacgatgagagaagttaattaaaattccacagagcagaggtgtcggctaacctataaacctgtcgctgttcaaaacaaatcattctagcaatcgtaggaaagagggaaggaaagaccagcagggagtggagaggctaagtgtgtgggagcggagagtggaaaatggagccattgagctttgtctcctcctcagtttcttcctaatgctgcccttttaaaagccagttagccagacctgggtatccgtgggctgaatagaaggaaagtgctatggccagtgagaaatgacaagtgtgctggtgactttgccttaatggttgcttgtggacttctgctggttttgggagactggagtggaggtggtggtagagagaagctctcagggccggagatggtctgtgcgcttccttcatatggattgaagccaaagaacacaaacaggctctgccctgcatccctacccaacatttctctattccagcctcctcctctggaatgtgttaggctacctcttaacagaatagggcacaacaactattgaagatggtgtcaataaaagaggttgaggacagagtctgccctcatcattaagaagcatttaagattacagtaaactgattttgggttttttggccacaacttggagactgactttggggaagggcctagctttctggcattattactgctactacatgactgccactactactagcagctaacatttagtagtcatctgctctgtgccagaccctctgctaaggtctcgatgtgtctcatctttggtgaagacctaggccttatgttttcttcccattcatcttcagggtcttcctgtcctcttcttggccctgggatgattttttgagaggggtctcacagt

SEQ ID NO: 62580 - DNA, 1052 bp, Homo sapiens
aattggtggcatgcttcctcagccgctcctggagaccaagaaccttgttctgtggtttgcagaatctaggaatcaaccttccctttccgtggaggacattagtgaattcaggcctaggccttccccatagattttgtaatcagagtccttagtgtttcctcaccccctaagaaagaatctgcctcccagggagtttgtgtcagggaaaaggcaaagctgtctttttagctgggctgcctaaaagagtacattggaaatgtatctagttattgccaaagaggactgactatggagtccaaagagtaggccagaatcatggcactcaggaaaagttgtggtgtttacctttgttttctgcccctcctcatttaggatcctcttagtatgtttattttcttttcactgtgttgggaaaagtaactcacacaatcatcccatcccccacccccatcatacacacaaactctaaaaaacactttctccttttatagggaagagttatcatgtgactcttaagaaggcaggaccacccctactccatcacctaccctttaaactcaaggaatgtttcctttaaagttcttccatctaaggtcctgcctgagttttgtgtgttccccttatagcactgctgggaccttaagaggtcactgatccatctggctgcctctggatccctctgttgctgctgtcttgggatagtcctgtacgtctgagatttcctttctgtttggttaggggcttatgtccctgtgtgtgtcatctagggtagggtgaagtgaggggggagccctgtgcttaatgggagatgtctaaatgcactgactgctgagagggctctgtgagtgttgattagagttaagcccagagtggctgctaatgtacattcctgactgatagagaccagataatgtgctccaagcaatatttttaacctgtaggagatatggaagcttaaaagagttaagcttttctgctacttttggtgacactaggtgttaaattccctgctgacgtgaatagtattggatcctgggcattatcaacaaaca

SEQ ID NO: 62581 - DNA, 1049 bp, Homo sapiens
gtaatcccagcactttgggaggctgaggtgggtggatcacgaggtcaggagatcgagaccatcctggctaacacggtgaaaccccgtctctactaaaaacagtaaaaaaaattagctgggtgtggtggtgggcacctgtaatcccagcttcttaggagactgaggcaggagagtgatgtgaacccgagaggcggagcttgcagtgagccgagatcgtgccactgcactccagcctgggtgacagagcgagactccgtctcaaaaaacaaacaaacaaaaaagaaattagtgtatctctccctggccagcaaatttccaggcagacatggcagttatcactcttgtcccaagcagtgtaccttgtatgggcagtggagcaagctaaggagacacaggagatatatgggaacctaaagtggaattttcaaattcttgctcatgatttcaaaattctcttcaaaggcgtactctgtaaggggcttagagctcttctccctattgcctattaacccatccccaaacagtgccattcctgtagcttgtgtgctctcttctcttattgctgttaactcagctcacccagaaagtactattgacactcgccctccaatgttttgaagaatttaaaactcagaaaagttgaatgaattgtaccatgaacactcatatatgcaccacctaggttctacaattaatatttggctgtatttgctttatcatgcattttaaaataagttacagatatcagtacatttatccctaaaggcttcagtgtgcatacatatcattgactagagtatattagtttatgggtttttttttttaagaaaaaaatatatacagtgaatttatatttgagtaaactgcacaaatcttgtgtatcatttgatgtatttcttttctctttttttttttttagagagggagtcttattctgttgcctaggctggagtgcagtggtggaatcactgctcactgtaacctcgaattcctgggctcaagtgatcctcccatcttggcctcccaaagtgttgagattacagttgtga

SEQ ID NO: 62582 - DNA, 1040 bp, Homo sapiens
cttgtcgcccaggctggagtgcaatggtgtaatctcggctcactgcaacctccacctgtcaggttcaagcaattctcttgccttagcctcccgagtagctgggattgcagacgcccactacaacgcctggctaatttttgtatttttagtagagacagggtttcaccatgttggccaggctggtctcaaactcctgacctcaggtggtccaccctccttggcctcccaaagtgctgggatcacagttgtgagccaccaagcccagcctagacctgttatttatggagacataattttatgtagtgtctccccacctctacctttataaatttaacttagttttaaaaataccattacttgctatagttgttgccaaaatgttttgcaatcctcacatttgtcatttctagtggcagtatattccattgcattagtatactattctcctccacagacagaccttcgggctatttccagattttagctctaatatatagctgcagctataaatatctttgtaaaaattttttcttttgaattatttcttcatgatacagtgctcaaagtagaaatgctagatcataagctgtcatttaatgacttttgtcttaacagaattcctttctgaaagactgtacctgctgaatgtgctataagcaacatgtaaccaaatccacactcttatatcaaattaaagctagtgtcagttttttctacttaatagatgtgaggtgtactttaaaaattgttttaatgtacatgcctgtaaactattcttgggggatgtttcctccaatgttttatattgtgaacactgtgactgtccttatcctctgttggacatggatgatatggtattggagacagggtgttatcttgatagatttttatcagctccctaaaagttttagagagaaaacttatatctacagtgttagttaaaatttttcccctactctgttgcttttaatcttttttcccttcctgtagcatttcaaatttaatagcattaaactcaaatactttataattgatacatt

SEQ ID NO: 62583 - DNA, 1261 bp, Homo sapiens
gaccccctttgactggcagtgacacgttcccacagggatggagggatacctgttttcagagaaaggagatatattaaaaatttctttggatttttcaggtgctgaagccaataaaaatatagatatgatttggccaacagctagggaaactgtaaccatccaagatggttagacaaaagatatgaaaaagctgagttgttaaattgtttttaacaaagtagagctttttcaagtcaaagccaaattgaactttttttttttttcaaagtctaaatttgaaggactacagccaagtgttttgattatgatattcttcttgggagaggatgcctgcacctgctgtttggtagcagcttctaaagttcaactttgaaagtttcttggtgctatgatcaaaccctcaggggagtattttgacccctagtaaagtgtcacatggcagttaagtgaccagggaggtgagagaagtgctgtctttattccaattcaggaaatatatccattcttttactttcgttttcttcctgctatgatccagagtactccctttttagtttcatcaccactcattaattttagacctaattcaagagaagagatataactgtaaacagtttcttcctttatatctgggagggatttgcagatacgaggagcagacagggaagtctattttttttttcatttagatttcagttcctttggcccatcctgttaagtatcttttactgtcctcagcagtagtctggtagtgtaggtggctctatagtgatttaaaaccagggactacattcacccaacagaataattcagtaaaagattttagccttaacatgtgtatagccaagtcctaattgttcagcctgaaaaataacaaatgtttgatattggaggaacaatttctaatagttataactaaactaattagaagaaaaacgaatgattattagagtcacattagtgacaacaccattaatggatattatctactacctatacttatgtaaagataattaactttttttgtagtgatttataacatgtattgtacttcgttttaggtgtcattttaaaaaacaattgtgtgaaatattatccttattttataggtgaagaaatggataattggagaagttagttacctgggttgtataattagtaagcggtagaattgggatatagatcccagtttcctaagtctgccttctgtgctttttcagttttatttaatctgctctttagttaaaggtaaataggaaga

SEQ ID NO: 62584 - DNA, 1044 bp, Homo sapiens
gctaagggagaacttcatcccttatcttggatgcagtttgactttatcataatggcctagaagctggagatgtaaaaacttgctgggtgacgtctggttcatattctcctcatcccttcattcaggctggaaggtcaccagggattttgaagtctggtcacttgggttgagaacctgttttgatgattaatatagaacacagtttcatgattaaaaacaataaaaaacaaccctgggaagcagagcagtgtaattatttctcacatttcagatgaggagtctagggaaaagtcattttgaaggtatgagaacaaagtctacctcttagtctgctagtgcctaattcatgactcacttagaggaaggcctgttcaccgctccctgccccccaaaaatccgcatctttcttgccattgttcatttttagaaagtactagatcagcctttccaaaagttgtattgtgggattcttgaaaaactaattctgtaatcaaatgagtggggaaaatgctgtgcgccacattccctctcttggggatcacaatgtccattggggattaaaggcactgacaagtcctgtgatagagggacctgtttacttttgtttcagccagcatcatgcaaaatgttttgaccataaaattctttttttcactgctaaatatctctttaacatcttgcagaacacacatactggtcaagtgccgtgcaaatacagaacctaaccaatgccaggaggaaaaggatgtgaacacagccaagttctgaatcttaagctcatgcacataaaggacccagggttatgcttagtgcttctgaaactgtttagacatttttgacatgtgggtgccatgttaagatactttatctgctcagatttcttcccttgagcctctctagaataagaatttagaggctttggttgaattcttgaagatgtggtatgttacacattttaaggaagggcctttggagctacgggtgttgttcaaagtgtgacttgccaaagggaggaccatgtttttggaaactcttgcttgagca

SEQ ID NO: 62585 - DNA, 1101 bp, Homo sapiens
attgccaaatgatatggctttattatttattagacatgtgtgttttgatttctcgcccatgtcctagggtaaggtgtcctggccttctagggaagttattttgccatagcacttgataaagagcagggtcactgctcgggttttctggattgagggaagaagttatgcgtgttacagcaggtggagagaatgtttaccagtgtggtccgtttctggacagctgcagagacttaataagccactgagagaggtggttgtcatccctggagggagaaggcatgcaccccagtccacttagggagtcagcgaacccgggcccaaagtacagcaagagtatggctgcttggatagtggcagggctgtcgttcattgctttgggctaattaactgcagactagataagtgagatgagtttttatcagcattacacaaaacttgatttgaccagaagccacataacctcactggccctaggttttattacctataaagaatgggaataaccttgcctggtaaaatgaggcttaagtgtagaatgctggctagtacagcattaagcacatagtaagcacacaataaattgtaaaacggaactttttaattgtttgggttctcctctagttagtctgtatatagcaaaagtggggatggtttgacttagaggtgctgactaaagacaaagggaagaacacgcacacacacgcactgtgcttcgtttctctcacctgtcctgaatgtttttggaaacatgacagcagaacctgtggacttatggcctgcactccgggacgaagagcctcttgattctcagaaacacaaactgctaaggtttactgaccttccggcccagggcaagtcccattcagtttggctgttcctaactgatcatagctttgttgagtaagatgaactgctttggttccttgtgatttgctaatggtcttatacttgtgcttgaaggcattctggccactttaaaaccacaaacaaataatttgcttccctttaggcctcttgcccgaacagtgaacactaatagatatcctaagcttacttttcttttttttttaaagggacacaaagatagttggagtcagtcat

SEQ ID NO: 62586 - DNA, 1011 bp, Homo sapiens
tacaagctgagcagtgatgactgacttgctgacctcgatgccccaaacccctgccatgggtttcagggacagaggaggtgccatatgtcaatgcaggctaagtccaagaactgctttctcagggaggggagaggctgggctctgcggcagggacggcaggagagccagcgccttctgtcccttcctaaacagtgaagtcaccctcactactttcttgaggacagcctataagagatgattgcacagagaggtgaacaggacaggcttctgtggcaagttggctgtctaaggggaggggaatgggaaaggaggcatagaattcagccctgcctcctggcctccagtctaagaggccagcaggcaggattctccctcctcctcacccacagaagctatttggtcactgggctgagaagcccagctgtgatgaggctgaaagagaaaagacaattgagttgttgatttctagacactgggctggggaccctggtgactgggaagccacagggaagaggcaggatcctcctggcaggtgtctgaggttctgggaaagcagcctgctttgggctgtgtgtttagggagagctgtccccatccctagcaccttctcagcagagcagagcctggtgatgttgaggggctgggggtggccaaagctgtgagttagaacccaaagtggcagaaacaggagacaatgctttcatctttggccttgggactggaggtcaccccttcacccaagtgtttgtaatgacctgtgagacacgcacacataatatttggagttggaaggatcctcggagatcttttgattagctatggaactctgattcaattaaattttacttagatcctcaatctaagagacatcactgtctggtttaaaaagagggtggaaggaatggcacttcagccttttcaatttgatagtcccaagacctctcttgagaacccagtttgaaaaccataatcccgtccactgccctctgtaaacccaggggtggggcccga

SEQ ID NO: 62587 - DNA, 3817 bp, Homo sapiens
ttttttttagtagagacagggtttcactgtgtcagccaggatggtcttgatctctggcccaagcttttaaaagtgaaaacggtggccaggcacggcagcacacacttgtaattctagcacttcaggaggccgagatagaaggatcactcgagcccaggaattcgagaccagccctgacgatataaatagggaaagagagagagagagagagagagcgcgtgcacgcgagggagaatgcctgcccctctccagcctggccaacagaaggagatcctgtctcaaagaaagtgaaaatgcttcagctagaattataggataatcctgtgtgagataatttacatagtgactggaagagttattaaatattgctttcttgttgctaagttctgtagttgggttagatatctaatgcgtaactattgtgaaagtcaagagattctaatttttccagaaaataatgttgagtttccatgaagaacaggaagtactgccagaaactttccttgctaatttcccttctctgataaagatggacattcacaaaaaagtaactgacccaagtgtggccaaaagcatgatggcttgcctcctgtcttcactgaaggctaatggtgagtacatatttgtggagttggtggtatttgggcaagatagggaaagaactatatatttttggatataaaaggaaagaagtgaattgtaaatttatactgcttttcccaccttttatgatttggtttctgaattaattagtggtgaagaatcgcatgtgtattaataattgagaaatgctggttgggcttagtggctcatgcttgtaatcctagcacttcgggaggccgaagtgggaggatcacttgagtccaggagtttgagaccagcctgagcaatatggctgagaccccatctctacctaatttaaaaaaaaaaaaaaaaaaggccgggcacggtggctcacgcagcactttgggaggccgaagtgggcggatcatgaggtcaagagatcgagaccagcctggccaacatggtgaaaccctgtctctactaagagtggtggcaggcgcctgtaatcccagctactcgggaggctgaggcaggagacttgcttgaagccgggaggcggaggttgcagtgagccgtgatcttgccactggactccaacagagcaagattctgtctcgggtgcgggggaagctgggtgcagtggctcacgccactcattattgaattttttgaatatgaatttttttaattgtgtgaaatgtaggagctggtgtagacagacaagccctgtttatattaaccatctcgaagattatagttttatatctataattatactaattaagtgacttatttatgttttgaatatttgttttatttctaggctcccggggagctttctgtgaagtgagaccagatgataaaagaattctggaattttacagcaagttaggatgttttgaaattgcaaaaatggaaggatttccaaaggatgtggttatacttggtcggagcctgtgacatttgttgacactgtgaactgtccaaaagtctcttaactgcaccttgtgaatggtagttgaggtcttcatacagttcagcctctagaatggtaacaaatcagccaattggattcgaaacaaagaagactatgtaaaactcacccatcacactttgagactactcactggttggaagaatatagtattgcagcaaatcctgtatgaaagagagatgtgggcttcctttttgagtcttgtgttaggtgctgagaccttttacatgggcttatacagggagagagtcttcaataaatgtagtcagcactattttctgcatccagtgtggttgcgtttctcacctgagagtaatcaagataacatctgtcatcttccttggtttattgagtgaaatgcctctcagtcttaggggacatggcagagatgaaagaaagaaagagtgggtttcagaagtgtcagggtggagtgattccaagtgggatggttgtggcattagtttaagctgaataaataatttcaatttggggcagttattctgctttttgtaaagccgtggccaattgtctcctgtaatgactgttggttcaggcatgttgtactttgtagggacaaatgtgcatttgtttgtggcaaaagcctacaattgacaaacttgtaaatttctttgtatataaactagctgtaacctgactatcctttgtgtttactgtttttgtaaatttttttcctctataaatgaaagggtgttggttcagaatggcactttgaataatgtaaaccagtgaaaagtggattttctttacttttgtctttgggtttggggttgtttttgttctttttgaagttttattatttttaaagtgcctcccacctaggcgtaggccatgaccatttggggtacgagagcctaattttgtaggacttaatctgttgaaaagtgcagttacttctggaaattaacctcaatattaggtcagcatgtgaaatgttggatttgacatgtcaggtagggttcagggactgattggtcccatttgccctcaggtcagttgtttaatctcaagacctgttactactgattttattaaatcagagtctttaattcttgcatgtttgtatctaatttctgaatgaatgagcacactttaaccagttatttacagttacctttttcctttaaccggattgtgaaagcttcatgtattttaatttagattctgtgtttttaagggttctgagcatgaagctggcagatagtcggcaggactcattttttcatcatggctggctgatttctccatagattgataacagtattttgttatcttgcttctctgtagttttgcatcagctgtttaactttgagctgagtgaggggagaggggtaaagagaaagaaacttaagttttctttcacagaactccaccattgtgggctttgagagagccctaaagcattgtacctagtggtacctagtgacttccaaccaaagcctttgagtatgcactaaataggtgagaagaaaggagagaaggtttttaggttagaaacctttaaccgatagaaggatatggtatgttgtaaagctggaaccaagtttgcatttttgagggcttgagatgaagggaagactcttaccagatagtaagacagctgagttttcctcagttttctcgtcttaacactagtggacaattctagcattttgtttggaggatttcagagttaacctcatggaattcaggattttttagcaagtttgcttttggttttatcttggcttttagtaatcatgttggctggtctggtcacaggtgactgtgaaacagatgccctggtcttgctttcatcactctaggatcatgaagtgctatgctatttcctggttatgaatattaaggttggaattacatttttattgattgtttggatcagagctcagttcctgtagaaaacgaactgtaaaagaccatgcaagaggcaaaataaaacttgaagtgaatgcttgtcgtgttgtattgtgtgaatctatttcctgtctgccccctcccttttctcctctttcatgcctcacctacaagcaggtattctctcctctccacagctgttccaagttagagattggatcttgaaggcagccctcccctacctccatcaccagtaagacttccagattttcattaagacaagagctaagaaaagtagactagtttttagccaagccaccccaccctcttgccacagttataacctggatgtgaaatagggcctctagtttgagttttgccatctat

SEQ ID NO: 62588 - DNA, 3628 bp, Homo sapiens
gtgaaaccccatttctactaaaaatacaaaaattagctgggcgtggtggcatgtgcttgtagtcccagctgcttgggaggctgaggcagaagaatcacttgaacccaggaggtggaggttgcagtgagccgagattgtgtcactgcactccagcctgggtgacagagcgagacttcatcttgtggggctggggggaggctctgtatagctcctgtacatgggagacatctacccttaggctcaagagacctcaatattggttgctggatgacaacatttgccttccaggtttctgctcaggttcttataattcattcttatagggatttaaacttaagtttctaaggcccttaggaattttgaacctgaaatctggattattgagcttgaaatgtattacagaaaacatttgatattcagtttttaatttaagaattattaaaagttaaattcttaatgatacacagtattgtttctttctcttctcagggtttatctctgcactgagcatttatggtggtagctttccaaaattatatagatacctcttacacaatctcaagctcttacagcaagcttgtccagcctgtggctcaacacaagtttgtaaactttcttaaaacattgtgagtttttttattttttattttttttaagctcatcaactatcattagtgtattttatgtgtggcccaagacagttcttccagtgtggcccagggaagccaaaagattggacaccccttgtaacatcttagaagttttaaataattatcttcatatccacatagctttacaaaagctcacgacagggagagtattttcttggttctgtagtaatttcagggggtttactgattggaacccttccttttcctcctctctccagtccagctggcattcagtcctttaaacaatgtggctatgcagtacttttgattactaatgacttctattatcttcttccccattgtgtacagatgggagaatcctcagcacaagtgtctactactattggatggacagcggcagatgttcacagcgcgtcatgattaattagtttaaattgcaaggttctatctgtgaggtagctcaggtagatttaagggcggtagacatgaactgaagtcacgtttgcgcagcgactgaggcattaaccatgttttcatttacacagctcttcgtacatgcagctttttattgtaatagttggaagtgctagttatgttgtagtctcaaagtagggggtaggggaaattggctgatcttaaagtttgagaggtatagtttttttcctgcagtgtaaattacactgagttacggaatgggacaggttctcgtatagtctaaattttgaccctgtttcatatttattttacaaatactacattttatgttttttaaaagtacccctacccttgaaaaatgacaaaccagatacaaactcttaatgggcctgaattgttaacaaaaaattggtttgctttgggactgtctgactagcacactatatttgtactgatgagactgttaacttgaacaggaggtagaatgctgtcttccaatggaaaagaactatattgcgctgctttatcttgtcagaagactaggcaagtgattttgatttggcctccaaacatttgcctttatgtcttactgttagctagcgttattgcctattaagttagttaactggtgaccttaaatagagacttctgtattccatgtgtatgttcagtgtattgcaaagattattataatggctggtcagaggaaccagatactgtcatacttttaagaaaagtatatttagctctgggcaaaataacatcaattggctctccttagttctcagaatctgtcagactggtattattagccaagtctgattttgaattgtttttgtccaaaaaaatttttctcattatgtttcattttgtcaacttaatttcttgtattttattctactgaccttagttttctgacaagattaatccttctcccccgcccttttcccttacctgtacccttcctcaaaatgtaaaatgtgacttcagacaggttgaattccttcatgggctgtgataataaagtgtctaattatcagtcattttagttaatagttactataattttatgacagagcaagcagctagcttgatttgtataatatctagggaatatataaagttgactcagacaaacttgggacttactttccttccagtaattaaagagtagaactgataatactgattattcattaattggaggaaggaacattagtattgaaatgccgttaacattttaaaaaataataattattatcatagccttgccctgaaaccctgattattgttagagagttatttccacgaagtgtttgtcagtttgttggacatttgagaccccaggaaatcccctttctcgtaacgttctccgcttggatctgatctcaacagggtgtcgtagtcattcttcagcacaattcttaattggagaccaagaaccctgggcctttagaggtggtctagcaggagagttccaggtatcaatatgaattcacaactgaattgacattttctttgttttatgagaaaccttatgttgcgcatcagatggctggaaggattggtctgccgaaggctttctagtcccaaattcaatttagttacatagctggatttttaaatcaaattttcctcctctttcacagtaatttctgaaggagatgctgccaatcccccccgcgcctgcgaagcgcagcggctctaggtatacacttcacattgtttctttgcaggtcgcacagcattttaatctgcgcccgcaatgcacaatgcgcgcatgcttgtctgccagtggaagctccatgaacaaaagatagtaattatgccaataaatggtgaaagagcttttggatatttatccaattattttataaatataatgtgcttgaaagaattgtccattgctgaaaatatgaacaaaataggaagtttttttgctgctggaatttgttcatggactttctaggtgctctacttttctccccccaacaggtgctctgctgcgcacagcaaactgaagcgcattgctttggggataaagcgtctcctggacagataaccctcttcagaccaaacctctcctcctgacattctgttctgccatcttatcgtagggagatggtctatctaagataggttttaaaaaaaaatagatttgtcataattggaataggtttgtttttgtttttgtttttgtttttactgtaaatttaaatccccattaatatgccactaaagctgtaactcagagtgggtaatttctattcagaagcactcccctcccccagcaaagaggtatttctattagtaaagcatagtacacccctcttctttaggtctgcctgcagtagccagttaatataagttggtaatctgcagtgcacacccatttaaaaaaatggataccttccccaaactaatccatctccttttttttcttcccacagcgtttgctgccaattgatggggcaaatgatctcttttttcagccacctccactgactcctacctccaaagtttatactatcagaccttattttcctaaggatgaggtaatt

SEQ ID NO: 62589 - DNA, 1980 bp, Homo sapiens
ctccagcctgggtgacgagagggaaactgtctcaaaaaaaaaaaaaaaaaaaaagtatgttctttacagtggatgtggactctactaaatctggtaccttcagtttcatagtttgcccttctagttaagaatgaggaaaggtcattattttaggaatatttgtcagtttggggagacacaaaatgatactttaatggttaagataaattgccagtacctgacaacataagcagcttaatgtgtaactgtgtctcagattattttgttaagcttacagttttttgagtctttttattgatcttcaatagattgaagaatggcggtcacgagcagccaagtttgaagagatgtgtggactagtgatgggaatgttcactcggctctccaattgtgccaacaggacaattctttatgacatgtactcctatgtttgggatatcaagagtataatgtctatggtgaagtcttttgtacagtggttaggtaggtgcaccaggaataatctcttctcctcaaatatattgtccctttaaaaaaaattatcccacagggagaaaaacatttagggaattggcacatttccaagtctcttcaattcgttgcctaggtttctttcaaaaataggcattattgaagacttgagatgcaagtcttagtaaatacatcaagcacattaatttttctcccttgggctaattcagcataagtatcttaaaagtatgttagaaagtactgactttaacttgctctgactgaatgctttctggatggaaccctgtataccacttttatctgatttggagatgagacactatgaaatgtgactccacaagctttctgctgcttgctgtgtcttgataacattaatgctatgtttaacagaacaattgctgaaatgacctaaagggcctggcaagaggaagccatcctcccagccctgtgcgcatgcgagctttagtgtaaggctattctggtgctattcagtattatttcacgtggctttttctttatccttctaccaagtattggttttaccaggggatagaaattgtaatcccctaaacatctctgctacattaaatggacttttgtatgtctcctttgaacactgattttttttttttaaattgtcaaacttggtaaaaagcaccagcatggccaagtttctctagggacttcatttcattttcaggttttcaatccagctataaggaatatgtaatggacttatatacagcacacagcaggcagcaaggctgactgacatgtcatagttttcatagtagtcacaaatactatgatgggtttcatggtcttggttgtgaaatagatatctgaaacaccgtgagcttagaataaaaagtagtagtgagattttccactttctgcctgtatacctttgagctcttaaatatttaaaaaaaaaaaaaaaaagtttccctgtgatacaactaattagctactaaaagtagagtctcagattgttaatttgaaaatagataactttttttggattgctgtaataacaggtagaagagagtattttgacctcatgttaaaaggctctgtatagcttcgggcgcggttgctcacccctgtaatcccagcgctcttggtggctgaggtgggtggatcacttgagatcaggagttcgagaccagcctggtgaaaaccagcatgagaccagcatggtgaaaccctatctctactaaaaaaatacaaaaattagccaggcgtggtggcgcatgcctgtaatcccagctacttgagaggctgaggcaggagaattgcttgaactcaggaggcagaggttgcagtgagctgagatcacaccattgcactccagcctgggcgatagagggagactccatctcaaaataaataaataaataaaggaaatactgaccgtgcgcagcggctcaaacctgtagtcccagcacttagggaggcctaggcgggcagaccacaaggtcaggagtt

SEQ ID NO: 62590 - DNA, 1053 bp, Homo sapiens
ttacagtcggttgtagtggctcacgcttgtaatctcagcactttgggaggcccaggtgggcagatcacaaggtcgagttcgagaccagtctggccaacatggtgaaaccccatcttcacgaataatagaaaaattagctgggcatggtggcatgcgcctgtagtcccagctactggggaggctcaggtgggagaattgcttgaacctgtgaggcggaggttgtagtgagccaagatcctgccactgcactccagcctgggtgatggggtgagactccatctcaaaaaaaaaaaaaaaaaaaaagaagttacaaggccctgaaggctatgcaatgttttcttcatacgaaaagcatggtacttttgaccttgacttcccaacaattagtactcagtagacggttaagattgactcttccactgatactaaaatttatatttcttatttcaattgagattttacatttaacattacgtttaggttactatcctatatgaagtggtttggtgaagggtcttgcttttatttgaatttttatgtttaaggtttgttctcattctgttctttgtttctgtggttatactgtgaaaactagttgcatttattcttctcacttgtcagaaggcttttgtaatcaaaactatttttgtgcttttttattttattttttgcagctgacagtgaagatagtactgtgtccatccagataaaattagaaaatgaaggcagtgatgaagatattgaaactgatgtactctatagtccacagatggctctaaagctagcattaacagaatggttgcaagagtttggtgtgcctcatcaatacagcagtgagtttggccattctttgttaagggggttagatcacatagttgagtcacaaagtaaagaacactgtctcccgggtgtggtggctcacacctgtaatctcagcactttgggaggccgaggcaggcggatcacctgaggtcaggagttcgagaccagcctggccaacatagtgaaaccttgtccctactaaaaatacaaagattagccgggcgtggtggc

SEQ ID NO: 62591 - DNA, 1113 bp, Homo sapiens
agtatcgtaagaattgatctgtactactgttggaggaaaaataccagattttatgaatttcttaaatgaactgcccactttagttccttgtaggaggccttttatcatttagatgaaaataatttagaattggcagacattttttccacattcaaaaacccatgggccttttgggaggccaaggcgggcggattgcctgagctcaggagtttgcgaccaacctgggcagcatggtgaaaccccatctctactaaaatacaaaaaaaaattagccgggcgtggcggcgtgcgcctgtagtcccagctgcttgggaggctgaggcaggagaattgcttgagcccaggaggcagaggttgcagtgagccgagatcgtgccactgcactctagcctgggcatcaagagtgagactccgtctcaaagaaaacaaacaaacaaagagaaaacccatgagcattttaattctgacttttttacttttctccctacatttagaatactgtggcactttctgttatccaaatgtgtctcagtctccatatttaaggactgtgggtgaaaagcttctacctggaattgaagtgctttggacaggtaagtcttttaagatttatacagtcaaagttgaattaagtaggacttgcagaaattgcttgttcttgttaattgaatacttttttttttgagacggagtctcactctgtcgcccaggatggagtccagtggcatgatctcggctcactgcacgctccgcctcccaggttcacaccattctcctgcctcagcctcccgagtagctgggactacaggcacccgccaccacgcctggctaattttttgtatttttagtagagacagggtttcaccatgttagccaggatggtctcgatctcctgacctcgtgatccacccgccttggcctcccaaagtgctgggattacaggcgtgagccaccacgcctggccttttttttttttttttttgagacagagcattgctcttgttgcccaggctggagtgcagtggcacaatctcagctccctgcaaactctgcctcccgggttcaagcaattctcctgactcagcctcccaagtagctgggattacaggcaca

SEQ ID NO: 62592 - DNA, 1327 bp, Homo sapiens
tgttcagagatggcaaaacaaaaaaaaaaagcaagatccagtaccatggctcatgcctgcaatcccaacactgtaagaggctaaggcaggcggatcacttgaggccaggagttcgagaccagcctgggcaatatggcaaaaccctcatctctactaaacaaaaattagccgggtatgcctgtaatcccacctactcaggaggtggaggttgcagtgagtcaggatcgtgccactgcactccagccttgggcaacagagcaaggctctcaaaataaaaaagcagcggctgcattttatgcctttcaaatgctgcaggaaatagaaatggcttaagttcagtaagagaattgacaattcagtgtttttgagaagtggcaatgaaagggaggaaaatgtttattgattttagcctgtttccccaaaaggataagaaactatttggaagtgaaaaagaagggcctcttattttctgttggttcagatttcaaaggtgtgaaaactattctttttcccttactgtgacattaaatcacttcaggcttgtaccattttgtatggcctgttgttaagttggacatgacaatttgtaaaatgtgaggatcttttcctttcttgtaagttagaagaaataacctcttcagttaaaccttcagtgaaggttcttttagttttctgttctgctttctaaaaacatagactctgttctttagagcaacttatgactctcatctctgctgcacgagaatatgagatagagttcatctatgcgatctcacctggattggatatcactttttctaaccccaaggaagtatccacattgaaacgtaaattggaccaggtaactccttactttttattcatttttcctgactatgtacttgaaactagaagtttactcagttgcttttacgatgttaaaaggaaatcaaattcctatttctttgttttctttttttgtttgtttgttttgttttttgagacagagtcttgctctgtcgcccagactggagtgcagtggcacaatctcggctcactgcaacctcctccgcctcccgggttcaagtgattctcctgcctcagcttcccgagtagctgggactataggtgcgtgccatcatgcctggctaatttttgtatttttagtagagacagggccttcaccatgccagccaggctggtctcgaactgctcacctcatgatcttcccaaagtgctgggattacaggtgtgagtcaccatgcctggttttttatttctttgtttctataagaattttttttactttgaatgctttttttttctttttttttttttttgagacaga

SEQ ID NO: 62593 - DNA, 1056 bp, Homo sapiens
gcggatcacgaggtcaggagatcgatactagcctggccaacatggcgaaaccctgtctctactaaaaatagaaaaaattagccgggcgtggtggcgggctcctgtaatcccaactactcgggaggctgagacaggagaatcgcttgaacccgggagttggaggcgtagattgcattgagccgagatagtgccactgcactccagcctgggcgacagagtgagattccgcctgagaaaaaaaaaaaagaatattttgtatcacttgtgagaggctaacattagattgtccagatgaaagtgctacagttatacattggtatgtaatgaattttaatttggtctgtcattgtcctttttgtggtgcagaggagtcattctgcctagagattggagctaaaatacattgcagaaatttgttttagactagtctcttatgtagattgtgtgggtttatgtagaacattttgtgttcagaatgcttttattaaccttcttcatggtactcttgagaggctgtccttatctcttactgatgattagactgagacaagtggaaagtaaaggttagacaagatgtaaagtgtgtggtttgagctgtgatgagcacactagggagttccagataccagtttgatgcttattcaaccatttaggttatcggtctgcgagtttgttttctgcagtgtgtgcataactagtgttttgtcctcttagaggatactctggggacattcttgagttttctttgtttattcctttccgtttaaggaccagaagtaatattcttgaattttcatttgttcagatctttgctctgtaattaagattgcgtgagagtttgttgtttgggccagttaggctgttgaatttcttgggaatgtggtttcaggcattttttggtccctttgattatatcattgtatgtggaactttttttgagagagagagttttgctctgtcacctaggctggaatgcaatggcgcggatcttggctcaccgcagcctccgcctcctggattcaagcagttctcctgccctagcctcccaagtaactg

SEQ ID NO: 62594 - DNA, 2247 bp, Homo sapiens
taaacaggaagcgggcggtggaggcagcagcagagggagagctcggggcttggaggggaaacagcggaagacctaagattatcgggagggcagcagaggcagagaacgaggacaggacccttggccgtcttcttccagggaacgagaggtcacagcctcgctctccgcttaggcttctggcgccccagcttaaagccgaggctgcggctgacaaagggctcgcgccggtgccgccgcccttctcatccgggcattcgggtccctgcggagagggagggggaagggcagagggggaggggaaggagccggaggggcgcacacttggagctgaagccctctccagggctccgggccggtgccccaacggacagaggtcgaggaggacccgcagaggtggcagcggccgggggcaggaggatggtgcagaaggagagtcaagcgacgttggaggagcgggagagcgagctcagctccaaccctgccgcctctgcgggggcatcgctggagccgccggcagctccggcacccggagaagacaaccccgccggggctgggggagcggcggtggccggggctgcaggaggggctcggcggttcctctgcggtgtggtggaaggtgagcgccctccttccctccccgttttggcactaacacgttctgtcctcgggaggagggtggtggcggggattttggagactctaaaaggccggaaagcctctgggtctgaaatgtggccctcctaaagcgaggggagagacgagatgttgggcgaatctccttgcacgtcttaagacggcgtcgaattcccccctggccactcacaagtctgaccccacccgtcttgggcttggagccaggccacctcctaaggaggcggtggttaagagcctggtgttctgttagcctctgagttctacttctttgtaccttgggatcttattccctagggttgtctggttccagtgaaaaaatatgtgtagtgcttctgtcaccaccctttgtggaaaatcggcccacactgacgtgcttgtacttctggagtgaagagaagcacgtttggcctatagtatttcaagttccacttggcttagaatatttttgttgcttccccccacccccgcaaagattcatttgcaacttagaaaattgccctctttcccagctactgtactttgctctcgagggatgaaactttggctttaatcacagattctcgaagtatctgagatgcgtaattggaatttagtgaccgcagaagcggctttaaaaatgcccttctcgccttttttcccatttacagtcgaaaagaacgatggactttttggtagtgagggaaaattaccagatgcttgtttcagtttctggatgagaatggacagatagtccaccttgcagctctgtagaggcacgaatcggttacattattagtctttccgcagttacagcatgtatttgaattttctgaagtattttggccgattcagagtttcctagatgtctgttttatatctctctcgtatgtaatggcgtggataagggtaaaaaatatatatatttaaaaaaccaaaaaggtatggaaaaaggattgctctcgacgttgagaacatcagcttttctgttttttttcaccatataaattagagtattctttcgaaaaatgggtggtggttatggtacagaccataacaggctactttgctgctacagtaaggcatgaaagagttcagcgaagttaactgtcttgcagaatttgggggattacagaatggaaaactgctatatagtattcatcaaaaatgattgcattgtgtgacttatatcgttgtatttattggcttgagtgcagggagattttagaaaaagaatctggtttttgttatcaaagatcttggagtggggatgagagagtgctgggaaatttcggagctagactggaatgagtctaaggaaacttgccagtccattataccttcagttataaaaggagaaaactcatttggtttaaattcgtttgtttagaatagcattaaaaggcgattcttcctatttaaagaacagagttgtctgccattctctcgtttattcctcctccctcccgtgcccttgtatattttcttagtgactgagcacctgagccagcactgattttttgtgtgttttgttgtttttgttttgggagacggagtctcgctctgtcgcccaggctggagtgcagtggcgtgatcgcggctcactgcaacctccgc

SEQ ID NO: 62595 - DNA, 1179 bp, Homo sapiens
ggattcagtagtccagatctctggagctgaaggggccagagagtgggcagagtgcatctcggggggtgttcccaactcccaccagctctcacccccttcctgcctgacacccagtgttgagagtgcccctcctgtaggaattgagcggttccccacctcctacccctactctagaaacacactagacagatgtctcctgctatggtgcttcccccatccctgacctcataaacatttcccctaagactcccctctcagagagaatgctccattcttggcactggctggcttctcagaccagccattgagagccctgtgggagggggacaagaatgtatagggagaaatcttgggcctgagtcaatggataggtcctaggaggtggctggggttgagaatagaagggcctggacagattatgattgctcaggcataccaggttatagctccaagttccacaggtctgctaccacaggccatcaaaatataagtttccaggctttgcagaagaccttgtctccttagaaatgccccagaaattttccacaccctcctcggtatccatggagagcctggggccagatatctggctcatctctggcattgcttcctctccttccttcctgcatgtgttggtggtggttgtggtgggggaatgtggatgggggatgtcctggctgatgcctgccaaaatttcatcccaccctccttgcttatcgtccctgttttgagggctatgacttgagtttttgtttcccatgttctctatagacttgggaccttcctgaacttggggcctatcactccccacagtggatgccttagaagggagagggaaggagggaggcaggcatagcatctgaacccagtgtgggggcattcactagaatcttcaatcaacctgggctctccccaccccaccccagataacctcctcagttccctagggtctcttcttgcttgactcaatctacccagagatgccccttagcacacctagagggcagggaccataggacccaggttccaaccccattgtcagcaccccagccatgcggccaccccttagcacacctgctcgtcccatttagcttaccctcccagttggccagaatctgaggggagagcccccagagagcccccttccccatcagaagactgttgactgctttgcatttt

SEQ ID NO: 62596 - DNA, 1022 bp, Homo sapiens
cactgctccctccctctggcccatatcttggccaaaagttcccaaggaggtgccagtccaaaggctgaggtggccctgcgaagaggaagaggcggcggctgtggttgggaggcttgtggggcagaggcggggtgatgggggagaggaaggagatcctgggagggagagtgggagggaggctgcaggcagtcctactcaggctggggagtctgagggggaggtggtgtgaggcggtgaaccggcgtatctgaacctgggccctgtaggggccatgccccaggcccaccatgaacctggaagggctggagatggttgctgtgctcgtggtcctcgctctgtttgtcaaggtcctggagcagtttggcctctttgagcctgtctccttggaaggtaatccaggtgtcctggcatgtctgagctgctggctggtggggcagctgccccacagcactagggagggtgtttgtctgtcttcatgactggggcagggatgagcaggtgagtgatggcacagggatctgggaggtgagtaggggtgcttgggggatacaacatctgggaggggtgaagaggaggcctcaaggagtagatatggagggaggagggaatctgggggaccaaggtgtcaggaggtgatgaggggtgcagtgtgggaggactggggtgtggagatgaggaggtgaggggattctgggcgataccaggaggggtctggagatagggaaggagtgtctagagtagaggagggaggttctagggatcctgagataacaacggatttctggggggtcctttttggagtcaggggcccaccacggtgcctgtgcatcctctccacacctccatctgtgcagtgtagcttatggggtgtgtgggcatagtgtgtgagagacacagggtgtgactttgtgttcctgtatgtgagagagtacaaagtgtgtaactgtgagcctgtgtatgggacagggatatgactgtatgtgtgagagtgacagggcatgtggctttgtgagaaggtggat

SEQ ID NO: 62597 - DNA, 2510 bp, Homo sapiens
ttatgagagcaaggaatttggagccaggagacagaaggcagtggggcacaactctgctgcctcttctttgccaccccaatacactggcctctttctccttcctcctggctttcttccattggcccaggaagtgtggggagttgccatgacaactctgtcctcttaccccttcggctctttatgccaaaatggtgggggcggggtgcagggtgcggggaggagtgcgacaggcggagaaaggggggctgaaagggggcaataaaagatacggttcattccccatccagctcttttctcaaaacccacatgtgcctgcctggcctccccgccagaacccagaaaaatgctccctgagaaggctgagtccgcgccgcccctccccgccaccccccccccccgtccaggaactttgggggcggctgcttcacatgatggggccagggtgagctcctctcgtgcggccaggagaacatgggaaggctccagggtttcgatcctatgcctgccgggccggccctcccgcgccgcccacgcgggcctacccgggtgagggcggagaccggaccgccccggggcctgggggtggagcttagacgccgagctcgccgccaaaccatgaaccgatgcccccgcaggtgccggagcccgctggggcaggcagcgcgatccctctaccagctggtgactgggtcgctgtccccaggtatgatgaggaagggaagggaggggcaggatccttcaaaaagtgagcgaagtgggttaggagctccgcagaggtagggagggaagggcccctcaaatagatggagggagcaacatccctccaaggaaagggcttccaagacgagatcctggacagaagcggagcaggggatgggcctccttactgagcaggaggaagacagcgctcttcaaagaggaaaggagaggggcatcaaggtccctcacaatggtggagggggcggggcttctcaccgaaggcagaggagggggccttaactgaggggcagggcgcctcccagggatgaaaggaggaggcctgcagcagagcagggaaaaagttcagtcctttcctgcatttcttggctgaaggggtcttaagatgaagggttcagtgtccagaaggaaaaaaccctgagatgggcctagaccaacatgaactcagctagcaagttcatacatgacatgggactgatagacttgtgtggcttaaggattgtatgtctctgttttctctctctctgggagtgtgtattaatgggattgtgcattactaagttgtgcatcactgggctatgtatggctgagtctgtgtctccctggggttgtgatcactgggattctgtgacactgagactgtgtgtacctggagttctgtactttaggactgggttgagggttcctgagcctctaagttggttgtgtagccttcgtgaggttgtaccttggtgtgaaatttgtggagtgtatgaggtgtggattgttgagtatcccacggcactgctgaggtgtatgcacatctccacttgcatttccttatgactgcttgggcagggcccatagaacgcaacgtctcctctgtacctgacctcaaacagaccaaaacaacctggtcctgtggcattctgagatctgtcattttctggctctctccatgggtatccacttgagcccctggagtatagatagggcctgtggcctctccttgccatctgtcccccaaaaggagggtagatggatggtcctgagccagaaccatacctggaaatcttctggggagcatacaacctccaagccccctgcttgggcctgtctccagtgacagatggctggagccaggcagggccagctctcagtcattgcaggcatgacttccaggacccaaaatagccccaacgtctagggaggtcattaatcactcgatgcagctgggggctgcagtgtctttggcctagctgggaatggtgtgggtctgggggactgagagaagggctttgaggtcttcactggctgggttaacagtggcggtggggggtgggacaaagctaaactggggaaggtgggacagttgcatagagtgggttcccccacaaggcagtgttactcacatttgaactgggggagataaataaataaatgataggaatatctctgtggtaagatttgagggatctggggaaggcccacctcatgcctcgagatggttttcccttgagttcccactctgccaaattgcttccacagagattttactttgagtgaagagctaaattcgtggcacagggatgcttggggaggatggatctggcaagtttctcactgaacccgaggacttgagaagtctctgagtggggagaagggacagcctggaaaaataactcatcctttcactcctgacagactctgccacaggatgcctggctgatttaggaccatgagtcctggcaaggctgggtcaaggtctctgagagttgagagtgggagttaggaaaaggaggggccagggccag

SEQ ID NO: 62598 - DNA, 1123 bp, Homo sapiens
atcaactctcagatatagctggagctacatcctgcttcctttgggcctggggctgtgcttggcttgaaatctgtgtcccctgcctgcactggcactttgtccagtcatcgggacctttggctcagatttagggtaagataggaatagggtacctttttccttttttttctgagacggagtctcactctgtcgcccaggctggaatgcagtggcgtgatctcggctttactgcagcctccgcttcctgggttcaagcgattctcctgcctcagcctcccgagtagctgggactacaggagcgtgtgccacgcccggctaattttttgtatttttagtagagatggggtttcaccatgttacccaggatggtctcaatatcctgagttcatgatccacccaccttggcctcccaaagtgctgggattacaggcgtgagccaccacacccagccagttttcctattttctgaattcagaattgacttctctgggaaaactggagatgagaatctgcccagtgctctgctgtccagtcaccgccttttgaattttagttttggcaccaggagtaccgttagctttccccttcttctggcccatttgactcatcagcacaatagggtcaccaccttaacttttaatttctaatctgctttactgtctttagggtgtgtatgaaataaacattgacaggctttctggagccctcaaggtgcctactttgctggttccctttccagcagctcccccacctcccttagccccccctcctctggcagcctctcctgcctctgctgagctcccctccacgtgttccacccccttaccctgctgttgtttacatccaacctgcctgagaatttcctctggggaggaatctattcctgtcatggtctagtgcctgggagggagagaactttctgggggtagggtgccctccatctgaaacaggccaggtgagcatcatgcataaggcctccattctgtccgctcagattctgggtggggccacaggcaaatctcctgacttatggggagttggcttgtggttcctcccttggatagcctccatggaaccactataggctttcccaacagctgcctctgaaatagctgctgcttcg

SEQ ID NO: 62599 - DNA, 1045 bp, Homo sapiens
aaattagccaggagtggtggcaggcacctgtaatcccagctacttgggaggctgaggcaggagaatcacttgaacccaggaggtggaggttgcagtgagctgagatcacgccactgcactccaggctgggcaataagagcgaaactccatctcaaaaaaaaaaaaaaaaaaaaaaagaatagacagtgttgtttcctcttcaccagaatctgccataggctgaatgaagatgtatgaggccctagcccctggcttatcattagaactatcttgagatagccagaactccaaatactccttgtcaccagaaagactttcattataaaattagtaaccattattgactattgattatgtgccaggcattgtacaatcgttaatctcatgttatcctcacatcagccttataagatgtagatggtgttgtcttcattttatagatactgaaaactgaggctcaaagacattaagaaacttgtataaatttattttgctaattagtggttgactgggaactaaaacttaggtctctgacctcaatcctatgttcttgatggctttgctgtcctctcaggccccttacctccagaggcttcaggggcagatgtttaggccttcccaaacattgcccactttgttttcccctcgcctaagttgaggcaaagtgttttaaggcaaagaagagggcatgagatacttgaaactgaggccatttgtgtattccttgtcttccacttgaacccagaagttgttcctttgtggtgaagaatcacttacgcacatagaatctttgggacagtttgaaataggtaggtacttcctggactgtgaaagtagttacttttgagtcataggagctgtctaggtagctgtgtagccattgggatgacagtgtttccatcaattgtatgttacttaaaacttttattcaggaacttaaaaacttttattcccatgtcattttaggaaggtgagttcaagttccattttatagaaaaaagggctgagactcacagaggctaggtgaattgtctgaagtcccata

SEQ ID NO: 62600 - DNA, 1037 bp, Homo sapiens
ttgtatattttgagagtagagtgacatcctctcccattcgtttcatcttttgctcatcttttgtacaggatttatttatttcagtgtcagggctgagccttgaagaatctgcctttcaggtgattgccctgatggagtctaggctgtcagtgtcagtcacagatatgtccaagctaatggttggtccttcctgcagctgctgtctcaggggccctgctacacttgtgtagaattttgcactcacaattagctactacagtaatgtaaagaggaagaggtggtaaacaaaagagaaaaaaccttgggttccttattttcccagtcttagaaggtgtgacactatctcaatctagctgcccattcactggtcagttaagcagctgactccaaaccatacttagtgttactggctcaaccttctatgtccttacatctgtgggtgtgcctgttgatggtggtttatcttgattcctcagtttgcatgttagctccgtaaaggcaagacttggctctgagggcttttgaagcctgtcaaagaatgctgagaacagtgcagaaggtacatcagggtctaactctaatcttaccacgtgaccttgatgagagattactttcttttttggttgggcctgtgttactaaattagtcagcaaacatgttgactgtttgttgtttcttaggactctgttagacattatgaaaatccataatgtcacactgagcctccttcagagtgctaagcatctagctatgagagatttcagtgaggaaatcagtcgtaatggcatgttgtttctctaggagagggcctgccactctgcctgcgtccacctgctaatgcacgaaccctaaagcagtatattctttcctccacaggaaatccctcattgggaaacctgtagaatgcaaatgtcttccagaaagggtggggacagatgagaggaatttttttatttatggatggggttgaaagggaagctgtggaaataggtcacttctcccaatttcaggccctaaaaaatagttattcatagggt

SEQ ID NO: 62601 - DNA, 1059 bp, Homo sapiens
gtttagttttagctcttatgtttagatatttaatccattttgagttaatttttatatacagcattaggtaagggcattttgacctctttttgtatttaacatacctttatgaataaagattacggagaagatacaacttgcttttctaagagctatgaaactactcatagtttattccttactggatttggcttgtttctgggacacctttcaaaattgtccttcaggccccttgtcccctcttcaactgagatttagttcctttctctctccagtgtggctttttagtaagcatgcatccctacctggtagaatcatttgatatgtccaggaaaattgatcagccaaggaataaggattcccaaaaagatgaaactaaggggtcagactggaagatttagaatgcataccagcttaagtggtttctgacattaggaactttgagtctactttgattctctccatttctaaggctactttctctctgcttccagttgtgttcatctcctctagctctcttctcttttaaagaggaccgcaaataatgcaacctgagcacatcagtcacccttgtaagccttccgaaattctggtcttcagcttgtccctcgctagtggcctgcaccctaattttctttttgtttgcttggcgggtgtgtgtgtgtgtgtgtgtgtgtgtgagatctccctctgttgcccagaatggagtgcagtggcatgatcataatttactacagcctcgacctcctgggttcaagtgatccttccatcttatcctgctgaataactaggaccacaagtgcatgccaccatgcctggctaattttttaaattttttgtagagatggagtctcactatattttccaggctagtctcgaactcctgggctcaggcaatccacccacctttgcctcccaaagtgctggggttataggcatgagcaccaggctgcactctgattttcattcccctgggaggatagttgtcatacaacttgtgttgcatagataaaccccatgaccattttgtctgtactaaataaatgtagatggcaggta

SEQ ID NO: 62602 - DNA, 1298 bp, Homo sapiens
tgtatattattaatcttataagccaaaagagaaccaaggacactcttataacaggcagctgcaaagccaagccatttagtgtcgtcagtgtggtttggtggagatcagagactggaggcttcagtgtggctttaagtggaacagctgcatcaccagctggagactgacagccgcagagggcgggcacggcacagctgagatccatctactcccatgggagcctgaaagacctgcctccaacttagaaaactgctttgtgtttacagttagtttaggggagaagaggtagagaacctgccctggcctgtctccatgagcatctttgagtcagtactgagcaaacaggtgtaaacaggaccccaacaggcagaggtcttgtggctttcacaaaagttgtcctgcttccccttagatggaaaatatttaaaatgagacactgggaaaggaagctataacttttatctttagtttactggaaaaatttgactatttgttgaaggcatgaacctaatttttaactagtaaggtttcttttgtttgatttagtaaaagttcggtatcagtctccttccctgtaagaaaatgtgcccacacattctcacctttccttgcctaattataaactaattcatattttgagactctgctcaagcaccctgtccttcagaatgtcctttctaagcctgcaggttgggctaagcacccctcctctgtgcttccatgataccttttgtctactctttgtctgccttagcctttaccacatcataatgaaattatctgtctgtcgtgtgtgtcttttccatttatgaactccttgatctctgggatttattttattcacaaccttcattgcctagcgtagtgcctgcacatgataggtattcatatgtttgtcaaacaaactgaattatcaagagtcactggcagtgctggcaaacctttagcttcagatactgtagaacttccttctagggacagagattccttgactatatgagaaagcagtcaatttgcagagtaagagaggagaaaatatagaagttctgtttctaaaacagtgcttatagcataaacaaagttctttaattactttaaaactaaatttctccttttggtagcgtcacctttcaggaggaagaaaacttactgctctttctggtatattgaagagatggcagctaataacctctttgtgagcataaaacaattataccagcctcctgtggagacaatctgccagagccaaccgcctcaccctccgcatgggcttcattttcttactctggaatctcatc

SEQ ID NO: 62603 - DNA, 1353 bp, Homo sapiens
agccatctatgtcaaatggtttcttattttcttatccttatttatcatggttacgaatacttgcagagtgtagaaagtaacaaaaagctgtaattaaccttgtaaaaataagttttaatagggaaataaattataagaattataagatggcattataagtttgctttttttttttttttttttttgagatggattttcactgtcacctaggctggagtgtaatagctgtgatcttggctcactgcaacctccacctcgcaggttcaagcgattctcctgcctcagcctcccaagtagctgggattacaggagcctgccaccatgcccagctcatttttgtatttttagtagagacggggtttcaccatgttggccaggctggtctcgaactcctgatctaaggtgatccacctgcctcggcctcccaaagtgctgggattataggcataagccaccgcacccagcccattttaagtttttgactgagtaaacaggtgataataaaatgctgtgagataacggtttatgttagcagggtatcgtatcttttttttttttttttgagacagagtctcgctctgtggcccaggctggagcacagtggtgtgatcttggctcactgcaacctctgcctcctgagttcaaacaattctcctgcctcagcctcccgagtagctgggattacaggtacccgccaccatgcccggctaactttttgtatttttagtagagacggagtttcactatgttggccaggctggtcttgaactcctgacctcatgatcctcctgccttggcctcccaaagtgctgggattacaggtgtgagccaccacgcccagctcgggtatcatatcttaatcctgtgtttttatgccccttcagcccaatttactgactattcataatagatacacagcacttcatccagccgggaaatgaaggttcatcttggccaacacttaattagtcattaattatttattgttcatttcctgtgtacccaaccctgtgtccttagtttctgacctacattggtagtactaccacatggcaagatttcatagggtagaatgccattgcaattaagactttggaggaacagctgaaggccagggtacaatcctgctgtacccgagttagaatgtgaccagaatagctatacttccattatagctcttttgaaaagctccaggagatgacagaccactgcttaccacccattatttgcacctgggaagtttctgaagtgttccctcccttttgtgcagtcatggcagctccgggaaggaggggaccactttacgcaccaaaccaaacaggtctgctgaggacatttgctcactaaagtctg

SEQ ID NO: 62604 - DNA, 1080 bp, Homo sapiens
ccaagattgcaccactgcactccagcctgggccacagagcaagactctgtctaaaaaaacaaacaaacaaacaaacaaaaaaccccatgatatactggagattcttggctcaattgaaaattgattattaagaacacagagaagaagctgttgatgcaaaatgaactgcaaaacgactgtaaacctaaatgccagtgtgggggctggggtggttgggaaagattgttatttcctgggatgctgcagggtgctgatgaggaacaggcatatttagcatttgtattaatgaactagggctgaaagtaaacaaagtattaatgaagtttgtaagtcatactgatttggaggtgtttcctatacccgggagggcagagaaatgatattgatggaccagaaagagaagcatcacagaaaataacccagctattcccttgggaaattgcatatctgctaaatagaaatagcataaatagagtcaggcagatattttccaaagtagaccttccagcagtccactcctaaatgtttacccaagtgaaataaaaacttggattggacaaatgtttatagtggctttatttatacactgtcaaaactgtggacaacccaagtgtctctcaacggcggaacagataaactatggtacatctatataatgaaatactattctacagtaaaaaggaatgaactactgatacatgcaacaacctggattaattcagttgcattatgcagtatgaaactatccagatccaaaaggttacatgctgtatgattccatttatatgacattctggaaatggcaaaactatagggacagggtataggtcagttgttttcagaggctggggttggaaggagaggttgattacaaatgggcacaggggaacttttgaggtgatgaaactgttctgtatcttgactgtggtggtgattatctggatgtatgcatttttcaaaacttgcagaactgtatacttgtatcagggtttttcagaaaacagaccaataaaatatacatagttatacaagaggaaataggctatgggaattagttcacatgattatggaggccaagtt

SEQ ID NO: 62605 - DNA, 1445 bp, Homo sapiens
tgggcctgatctaggattagctgggagtaatggtacttcagttattgggctgatggagggagccaacaagggcaattcagagacagaagctcagagaaacactgaacaaaaatgccaggcggactctccagaagagaaattgactgaagggccaggcagaggataagaatctacgttaagccagtggtacagcccagaaatactagagtaaaaggtttgaaggaaaaaggtaagggttaaaatctagaagaaatgctctgggataaataggatatctgcaacagcatttcttaaatagtgagcagagacaaggtggagtgtgaaaagcacaactctcccggtacagtttagtaagtattgaatgtttcgtaggatccagcattggagatcaagcaggtcagtaaagaacaaaccactgtgccgcagccaccagaagcctggaactttgccatgtgcttcagcctacaggggtctgctaagaagagaagcaaagccctctaagaacagcacagagagaaataaagtcagcgagagatgggactattaagggaaaggcttataaagtgctgtgagcttcgttggcaaagaaagggctgttcatctagtctcgaatgtagccaagcagagagggagctgggaagaaggagatatgaagatagccttagctaatgtgtgtcactctgcctttgaatgaccattcaaaacatcagcctgttggtgttcttcaaactggtgaggctgttgggggctcaaggaaaatgggtcattgtttaagacaaaaagaaaggaagggacggagagaaggagagaagaaagggagggaaggagggaacaaaggaatttctttgagttaaatctcactgcgttgatatgccccctccccctttttgcttgttctgaagaccaaaagctctgttttcttctgctgagggtcctccctttggggttttggtaatatctgtgatctataattgttactcttaatactaaatattttcacaagtcatttaattatctatagatttgactaaactgacctagatttagatttaggttaagccttccatgcctaatgccacatacctgtgccccacaaacctgagctctttgagtgctgcaggactataacttgatttgaaaagctggatgttctttttcatcagaaatcagtgttctactaagcctgtcaattcattgtctcctagacaattttgaattgggataacaaattagagttagggatacattacaaatgataaatgtgacttccttaaagggaaatccatttgttttgcttagtgtttctgtgattaattacttgccagattaaattgctccataaaaatgcatagtattttattcgattgctcttcatggtgattaatcaggccatactgttgcttcgtatgttaattatgctgacattttattctgttctctagttt

SEQ ID NO: 62606 - DNA, 1499 bp, Homo sapiens
tacaccactacacccagcttcctttgatccattttgagtgaatttttatatatgatataaagtaagcatccaacttcatttttgggcacgtggatatccagtttccctaatgcccactgctttttttttttgtgacagttttgttcttgttgcccaggctggagtgcaatggtgcagtcttagctcactgcaacctccacctcttgggttcaagcgattctcctgcctcagcctcccgagtagccaggattatcggtgcccaccaccacactggcctaatttttttgtatttttagtagagacagggtttcaccatgttggccaggctggtcttgaactactgaccctcagatgtgagcctcggcctcccaaagtgttgggattacaggcgtgagccatcgcacccggcccccactgcttttctgagataactacagctcagatttcttaacttgagtcaggctgaatttggaacttaactgtgattagagatagaaatggagcctctcccgttttttcctacatatttccattcctttttgtttcttaggtttgctcattcctctgctgtttaagagatagcataatgtagtggttaagagtggggactctagagtcaggttgtctgagtttgagtccttgctgtaccattactttggacaagttatttaaccattctttccttgagttttctcagctataaagtgaggataacaatggacctatgtcattattgagattactaaatgacaatatatataaagcatgtagaatagtgcctggcacatattcagtgctatatacatgtttattattattatttttaaaaatttgttgtcctgattgtgcaagtctgggaatcttatcagccccttccatacccaactttgttcagtcctttttctgtactcatctgggcttagtagggaccagagacacaaaataatatttatttacaagctgacatcaggggcaatactggaacttaggctgtcagcctgagcctttgcatcattgatgggaaaatagtttgggtgggaagagtttgtgttttctatcactttcagtcctttgaggagatgtctgaccatgcaaccttggctatatcattgtggtaaaagaatgtctccaaaatgaatacacgtatacctgagaggctattaaccaacatgttcttatctctggttggcaggattataggtggttttataggttggtgcaaaagtaatggcaaaactgctattacttttgcaccaacctaataagttttctttcttgtattttaatttattaaaacatttagctgtgaactttttttgtagatactctttatcaggttgaagaaagtcctttctgttcttagtttgttggctgtttttatcatcaaagggtgttggattttgtcaaatgctttttttgcttctattgagatgattttgtggtttctatttcttattctattgataaaacgtactacattaattgattttcagatgtta

SEQ ID NO: 62607 - DNA, 1001 bp, Homo sapiens
gttccagtgccaaagtggtcccctcacccacccttcttacttgcttatgtagctgttttctttcaccctaaaaaacactcttcccctcatacatgggtgcgcacatgtgcacgcgcatagacacacacacacatggttaagtgtacactgctggggaggctgaggaacaagaatagctttcagcagcctctgagataatggggttattgagtataacatcctttggaataggctgtgtacagaattctgaatgtcacaggaaataagccttcaagcagtaatcactgtcgatagcaaagttagggttaggaagggatgtgaggtctccccaacttcctttgcccactcacctgtttgggctgaaatctttgctgcattgctataattcacttaacaaaatggttaccaatgagagagaagcagtttcatgtccaggcacttcagctgaaggatgcaacttagtctagtgaaaagtaaatgtggactaaattgattaatgatagaagcagagccattgggctgttgactcttgactagcagggagtacatgaacataaccttctattctgcagttgtctgctctgaggtggcaggtaggctcatattatcttcactgagttagaatttatcaatcatgacctttttttttctgttaatcagaccctgctgatctcccattagagaaaatgaaaagcattatgcagattaaaacaaagcaccaaaatgaagctggtataatattgtttacccaatgactgggagcattacatatcattgtaatggttgctgtaccctaatctcttaagactacagctagaattaaaaaaccaaatactgaatcccatgtggttaatcatctgttttaccttagtttggtttatgctgcaaaatgaagttttacaataggtcatagctggacttggtgaactgcagtgaggtaaagaagtcttagtttaggagattcagacattcataattaaatattaagatttttagctgga

SEQ ID NO: 62608 - DNA, 1043 bp, Homo sapiens
acaccattatatgatgtttgcaccacacagatataatagttataaatctccagagcataggttagtaaaaggtagaaaataattaggaagtgataagtttttaatatttattactttcattttaatataatttatttaattataagtttatatgagtgaaatttttaataatggctgtgtttaacaactggcttacaaaattcctgaaaattttacagtcaactcttgcaagacagtaagagctggctacagcataccactgataatttttagtcttcatagcctgatgcctatatatgggcctttccttcttttttagattgtgaacctatttaatatgtttatcacatatggcgacacatttctgccaacccccagcagctatgatgaactttactatgagattatccgcatgcaccagagctttgacaacctctactccatgggtaagctgccttttctttttactcctctctccaccatttgtctagcttttggcatataagaggaaaagactacgaaagattctcctctagttgtttggtgccctgtgtggcacagaaatatagtagtctcctcttctcaggcaataggaaggtacatgtgggcctttttgcctttaggaattcagatttcatctcagtgtaaagctggttagcagccctttgttgatgttgctgagagagagagagagaatagggaggcttgtggattcattgaatgccagagagaaggaggtgaaagagtgggtgggaattgacagcagcaaataaaagaacttggatcccagaacattgtgtaatttgcggatgtccaggattttaaggaatcttagtgtacctatgtatttttagcataacttacaagtggaagtgggcattagataaaaatcttttttttgcaaatcttttggtgattggctcactgaaaatgtactctcaagctacagcaagtataacttatttctgaaagaattcatgtgtccctataagtttggaataggggcctagttaattctacctgtagtataaaggttaaggaaa

SEQ ID NO: 62609 - DNA, 1031 bp, Homo sapiens
atgggcagagaagcaggactcatttcatggacaaaatgtgctaggtgaatgagtataaggtaactgataacttcttttatgcttaatatttatttgcaaaaatgtctgaagctgcactgctaaactagggacttggcagtcagtctctttattgaggttgcttgggttttaggaatctctcccctcgctaagaattgccaggcagaaagagatttcaataaatgttgtcactgtaacgagaggtcagcgcaagcttcactttgtttgaatagttagagcagttaagggctttttttctctttatgagctctcctcatctagaggagtacatacagtatagctgctatatctggtgaccagttagaatggatacattttcctcttagcaatgatgtctgaaacagatacatgtctaaagcttgatgacaatagaagctagcagctgagggtggaagggggaccctcattttcacctgtaaattgagcaaatttgatggggaaatcaccatgtgggagtaaatttgaaacaccaagatgtcagttttatagtcagatttctgagcttaattgctatttaagaagtggcaaaaagaagtagctatttcaaaaccttccatgaacagataagcagacacgtgcttgggaaggtgagtgctttcctcaaatatacctaccttacctgctttttaaaagaccttggtggctgagacttactcactctaaccttctggattttttttagagctagtctgtttttatttaactttattaatcatggtttgaatagcttgttgatgtctttttttttttttttaaagccttgataaatttgctgaagttccttatgtcaaatgagactgtacttttggccaaacacaacatttttacattagcccttatggtgagtatcaaaacaaatacttctttttctgaagccatatgctaaggcagaaatgcactggtttgaaacaggagctggtggtctggggactaagccatagagggaaccagacctatatatattttttgga

SEQ ID NO: 62610 - DNA, 1052 bp, Homo sapiens
gttgggacacaggttgcccgtgccagagttgctctcttcctcctctaatatttctcactttgtcatcctggattctgaatcccagagatcaagactagctgtagtccagcagaggagcaataaatcattgctcccacatcctttcctccaggtttcctgccctttaattaccacatagccactgctgaggctgcatctctgtgctgtgtgtcctggggacaaaagcccttgttgatgggatgtgtgcaaaagctgctttgtctctagccattacgttttgcagagtgccaagcgtgctgcccatccctttctctcgcctctatgattttatagagtccgattgtcaggtagtatatcattaacagggcttgtctaaactctggggattaggtggtggggtgggcagcccccacgtagctcactcagcaaggtgatcttctttaaggagggaagtttgggttagtcatttttatgtgaattttagctagccccattattcctgtgctcctggtaggagctaagcaggttgtgtgatcctgaatgggctcccttggagcctttttgtccccccagtccaacagatacttgatcacttaacagacaccattaaaagggccagctgcctatcatttgccttttcattatgaaaccccagagaactcaagttggggccggggtaaagagtttataaatgaagatgcctatctccttcatgcctggcaaggcttttttttactatttgaggggaagattcaggctttagaaacagaatgtgggtgaagccagcctcttgtactttccttgcctgctgtttctttactgtacctgtgcttttaaaggattgagagtgaggggtgttgtgtggtaggcagcaagagtctggagagtctcactcctactcatcattccctgctgttccaaatcaaagctcacatctctactttaagagtagtaaacttcacacaaaactctgacagcatgggagaatgaacttctttgctggcaaagaagcagatatggtcctagaaaaagagaggtcaagccttttcttg

SEQ ID NO: 62611 - DNA, 1080 bp, Homo sapiens
tcctatccagaaaaatgtcaactctcataggcccatgagcattttgtcaagtaaaagggaccagggaaggattagctgtgcttttggttactctgcctatattagtttcaaagggacatgtcatgtggtttcataaggtatcatccttctctggatctcgagggagcaagacaagtctgttattggtcctacctcattttggcaaaaagtaaagttattggttctgtgtcagatggctccactgagacatggtctcattgacttttagatttcttaaagggtgattttggctatcactcctttaggaaacggtggggggaaaggagcaggtggtatagggccctagaagaaggcagtggctcctgagcatgcttggttagaggcagctgcacagggaccctacatttcccaaagtctaggatctgggaactttcatgtggaaactcattttcatgaaaaagaagaggctgggtgctaattgtgaggtttgcattgtctgcaagaaaatggggaatggaagatggttgagaaccttatttattttttttttttagcagatacacattgactgcaaggaaaatggtaaggatggaagcagatttccgtttaaagaaaggatttgttctatttctgactcatttagaggaatgtggagcctttagtcagtgcaggctgttgacatactgacttgtgtgctgtgttcacctggagaggctgatagcatacagccagagccatttcattttcttgtttgattctttggcctctgtgtcagtgaagtgcttaggcttgcatccagacagatgcctgtattctgaaaagccacctagagttgttccccgccccctgctccccccacgactgagtcttgctctgtagcccaggctggagtgccgtggcgcgatcccagctcaccgtaacctctgcctccctggttcaagcaattctcctgcctcagcctcccgagtagctgggaatacaggcgcacaccaccatgcctggctaatttttgtatttttagtagagacgggcttttaccatgttggccgggctggtcttgaactcctgaccttgtgatcc

SEQ ID NO: 62612 - DNA, 1036 bp, Homo sapiens
gtatttttttttttagagatggggtttcatcatgttgcccaggctggtcttgaagtcctggactcaagtgatctgcctgctttggcctcccaaattgttgggattataggcatgtgccacagcacccggcctacttagctttttaataggaactcagataacatttggatgaacaaataaatggatgaatggatatgtaagattttcattaatgatggatcaacattctccaaaagcagcacaatgttgtgtttgagccgaataataataataatagaacccagtaggatgttgttaatgtttctgttgagctgacatcatcacctttgatagggccagccatccaccttagtttatttgatttgttgatgtgagagagagtagttagtaatttcttttgtttttctcattcttccttacccacaggtgcatggattgcttttaaccaagtaaaaatggaaactttgatggtttctaagccattaagcaaagattgagcaggatgtgcagagagaagtgtgtagttgttggagagagaaatacttgaacagagcttcatggagtcagcttattttacttccactgcaggaagaaggggcattggagaggcaggctgcatttaaatagtatgactttccatcgtctgaaaacatgggttgttttaaaggcagatttatactgacattttatattcaacatttatctatggatcacagttgttaccctctcactctgccacatcccggtgataagtcgttatttttatccccatttgttggggaagggagtagagatatagaagggttaagtgacttgctaaggatcatggaaccagacgctaaacagagtcatgattagaacttagagttcctgactcctatgctcagacacagatcactaagcaacatttgcttgcctgcaggaagaaaggccccctaagcccccagaacaatctgttcagcttcactgtgctaagtaacatccaaagcattcacagctttgtgaaaaagaaattgtacatggcctgaccttttag

SEQ ID NO: 62613 - DNA, 1033 bp, Homo sapiens
tatgctgtttgactgtattagctctttgttattattggggaggtagccagaggtctccagattcccataatgaatttacaggtgtgatcttatggacaaggaggagtcagctgtattagttgggggttcaatcttgcctgataagcttttcctagttggttttacagatacgagccctgatctactccctgctgccactgtctgtttctatgatgcatgtcaccatgatatctgagtatgtatgaaaatatatttaggctaattttaactagaatatggaaaggaaaaagttctattgctctgcattgctctgttttcagcaatcactgtttttcaccacatatagaaagtttgaaagctcttctctgatgtctaggcaacccagatctcccagtctgagtaaaagattagatcttaaaactctccactgatagaggtagaaaactgggttttgggataagatcatactgaaatagttctttacttttgagaatagaatgaaagctacagtcatctttgtattcagaaaaaatgtccatttgcacatatatattttgcatatagtttcacagagtttctggatcctctgaagccccttgtgtcaaaaacctctgtcttaattttaagttccacagcctcccaattaatcctgttctcacagaaatcttagtatctaggtaaattattttattttattttattttatttttttgagaaagagtctcactctgttgcctaagctggagagcagtggtgtgattgcgggttcaaacaatcctcccacctcagctcctgccccaagtagctgggacttaaaggcacacaccattatgcctggctaacttttgtaaagatggagttttaccatgttggccaagctggcctcaaatttctgaccttaggtgatctgccctcctctgtctcccaaagtgctgggattacaggtgtgagccactgcgcccggccagtattttttctttatttactagtcacactgcgctcctactgggaactttaggttagcaatctcctt

SEQ ID NO: 62614 - DNA, 1004 bp, Homo sapiens
ttaggagaggagagtatgattgtgtgagaggttgagattgaaagaatgtcaggagagttaaagagagatcaaaagagatggaaatgaccaacagtagaatttcttaggtagcaacacctccttttaatataaaggactattattgctgcctatggatagttgtatgattgttaggctctaaaagcataggattaaagagaaaacacaataatgatgcagatcttcagatgttggtatagttgttggatttataataagtacacatggtttatgtctataacttgaatgaaattacacattgtagtactaaacaaggtggtagtagtagttgtttccgcctgcatcttctgattcccttctggttttactttctctttcattctattttctttcctttttgtcctagctattctatctctggcctctgtgatctctgtggcttttctctcattctcgtgatctgttgtcctcttcctcattatcctgttccattgtcttgtccacattgccttctattcttcgttctggtctgtctcctgagactcagggcttcctgttattctcctcctatccccattttgtatcctctgctctcttgatgaatcgacacttttattggtatgaagtgttctttgtgttattatagtcatgcattttactttttacatgtgtcataaactctagaatacattgccctcatttttgcttaaacaagcgattatcttttttctttttttttttttttttttgagacggagtctcgctctgtcgcccagcctggagcagtggcatgatctcggttcactgcaagctccgcctcccgggttcacaccattctcctgcctcaccctcctgagtagctgggactacaggcacccaccaccaggcctggctaattttttttggatttttagtagagacggagtttcaccgtgttaggcaggatggtctcgaactcctgaccttgtgatccgcccacctcggcctcccaaagtgctaggatt

SEQ ID NO: 62615 - DNA, 1061 bp, Homo sapiens
gcgtgagccactgtgcccaaccttccggcttcttagattgcttataaactatatagtcttgctttcgtaggtctgaaataatgatacaaattttacttttaggtaagtaggttgcagtttgcatttttccataccttttgggtgtttagaagtaagtctgatcctttatttcaattcaaagaccatgaacagttgctttttataacacttaacagatgagtgttcagcttattttagctggggtccctgaacttcattatcttagggttcagatttgtttttgctatggactttatttctggcttattttatatcctagttttaggatgtgctatttactttgtaacacgtattactgtagtttcaattttttcattttaaaagaaaggaaactgaggctcaggagattaattactttgcccagggttattctgttagtaagcatcattgcctagatttgaacccaaattttcttactataaattctgaactgttacattcccaggtgtattagttatctactgctgtgtaacaaactaccctagacgtagtggtttaaaacaaacatttatcacctcacagtttctgtggttcaggaatccaggagaaacttaactggatagttttggcatagggcctctcaaaaggatgctttttaaggaataaaggtaatatgcatacttgaggatcacattaacgtggcacagcttttcttaaagagtgttaaagagaagaatgcagaagtggcaaagaattaaaaaaaaccttaaggcttaaactttattaaaataagatgatgaccaggttagttggggcagcaagtatctgagattctactggggctcaaaaatctgctttcaggctcacctaatggttgttggtaagcctcagttcttcaccacgtgggtctctccgtagggttggtaggcatggcagctgtctttccccaaagcagttaatctaagagagaaaaggggagcgagagcccaggatggaagccatagtatcatgtataacctaatctcaagtaacatatcatttctaatggtcacacagaccaa

SEQ ID NO: 62616 - DNA, 1036 bp, Homo sapiens
cacaggcatggcagaacttgagtgagtttagagctaaatttatagcttcaacctccccctttactattccccactctgctcttttctctcttaagaaaaatggtgaagatattccacatgaagtagagatctctctcagtctctctctcttcatgttctctgtggaaagatgacctccttttcacaagattaggggtggctggttatggaagagctgcttattagcagtgggcctggtataattgcttttcaaaaatctttctaagaaaatctttaaaggagttgtttttcacaaattgtaacagttccttgtaattggagtctgtaggcttgtcagatcttcagaaaaggtattgggaaagggccaagggatgtttattactaatccatggtaagaggtttttgattttctgtcagtcttcaggaaagcccggaatagacagggtcttgcctgcttccacgctgcctgtgtagcagtttgcttctgttgggctgaacccattcccagcagagcacagatttttcttcttgctcctaaaccctcatgtggagcctgcacatgaatcctgcagcctctgtgaaaaccttaaactatcacaaacagagccagctccttgggcagatgggacggaagagggaataggaaaacagattactctcattcctctcagcatctgccttaagtccctgcgtcttaatttttattgtttttgcttggaaatttttgaccagttagagatacactgggaaattacactaaagaaaaatctcatggcttaagtagggtttgacataaggctctaggctcatcctattagctgtccagctgatccttgaaagtagttctcaaagtccaaggatttgtacgaagtgtgatagattacagtttcttaaatatagctctcgcttcttactttttctctatatttttattaggatcaatatgccaatgcatttttgcatgatgacaacatgaattttcgagtaaacttacatagaatggtaggtgtttcttttgcttcttgttttttcttag

SEQ ID NO: 62617 - DNA, 1047 bp, Homo sapiens
ctatgagcagtcatgaaatctttctagattttgtggtaggtggtgcttagagctggcagatgagagggtgggtggaaaaggaaatggacctgactattcaagttctatcagcaaagggctgatgtgagagtactggccactatttgagccatgacagtaggaaccattgtgagttagatggctttcaggaaggtggttagccatttaacagactaccaggatattaaaaaaataaatcttctgggggaattcttttgcctaggagggaagcaagaattactatagtagtaccttgattttcatttatggattttgtgggaagagaaagtgtgaatgtttccttttatgatatacgtccttgttctgtattgaaacagatgatgtaaatctggatgatttacagagaagagtttcttttttctttacagatgaacacaggcttcacagtggcaaactctgtctgattatccttacatgtattgcagaggtaggtctcacgagccttctgctattaggcagtcttttacaaagtgctatctttccctgcctcccctcaccccattactgtctcatgacatttagggtcctaaagtttaggagagaaaatcttccccctttgtattatctgtcttctcccactagagtgtagtcttcgatgaagccatggatagacagggtcttgtctgcttccacgctgtttagcactgtgtttttaaactgtggagcagtttgtttgtttgtttgttttgagacggagtatcgctctgttgcccaggctggagtgcagtggcatgatcttggctcactgcaacctccacctcccaggttcaagcgatcctcgtgcctcggcccctctagtagctgggattacaggcagtgccaccttgcccggctaatttttgtaattttagtagagatggggttttgccatgttggccaggctggtgtcaaactcctgacctcaggtgatccacccacctcggcctcccaaagtgctgggattacaggcgtgagccaccatgctcggcagtggagcagtttaaaaaa

SEQ ID NO: 62618 - DNA, 1123 bp, Homo sapiens
taagaaaggttagggacagaagagtcatctgttttggtccctactgggtgtctcaccatgtctttgcctcccaatgaaggcacacacacttttgtttgttgtggaacaggaaggccgccatctgaatagctcttttgctttttttttttttttttttttttggagatggtgtctcgctctgtcacccaggctggagtgcagtggcacgatctctgctcactgcaagctctgcctcccgggttcacgccattctcctgcctcagcctcccgagtagctgggactacaggtgcctgccaccacacctggctaatttttttttttttttttttttttttttagtagagacagagtttcactgtgttagccaggatggtcttgatcccctgacctcgtggtccatctgcctcggcctcccaaaagtgctgggattactggtgtgagccaccgcacccggctgaatagctctttttatagtacctggtatccccttgactcatctacatctgctagtcaattatttggttatcagaacagcctattgatgtgttttaggttgatctgatgagatcccaggtctggatgggattgcaaatgttctctgctctcttgtagaataatcctgtatatttgttgaccccagtttttttttttttttttaaatgtctgtggtgccacagaaaaacttatgtaatgggaacctagttgcttaagataaattagcacacagagcttattagagattagcaagcatcagtcgtaatcaagtactcatgagaacgaaatacagaagtagtcccttctcagctttttttttctttttttttttttttttttgagatagagtcttgctgtgtcaccaggctggagtgcagtggcgtgatatcacctcactgcaacctccgcctcctgggttcaagtgattctcctgcctcagccttccaagtagttgggactacaggcatgcaccaccatgcctggctaattttttgtattttagtagagacggggtttcaccgtgttggccaggatggtctcgatctcctgaccttgtgatctgcccaggcctccctaagtgctgggattatgggtgtgatccactgtgcccagcctcagtgagctttc

SEQ ID NO: 62619 - DNA, 1042 bp, Homo sapiens
cttattcacttgctctgactaggacacaaactaaagattttgttatctgaaaaatggagagtggatctcatatagacagctttggtctgaaacctgaatattgttcccaaagatagctttatgttggttgaagtcagcctgcttcctgtgaagtttttcctaagttagtttctgacttcaaataagcaacttctaggaaagatacagagtgatgaagatgtgtaggttaactgtcagagggactaaacttacacactgaaaaggagagttggacaaaagtactaggctttttctttaaagcgaggtgatttagtaggcaagatgatttactaggcaagatgatttagtaggattctcattatttcatttattacttatgagtcttttaagattttcaaagtgggctggttttggtgtgtgtgacttatggcctagagttccaagttctccccaggtggaagcagcttgttttcttcactgataaaaggcttcctaggcataaagctcctctcatatcctcctgctataagtttgcaattccccttttcttccacaggtgggcagcatgttcatagcagatgcccatgagaaaatctcagtacagtaagtgcctgacattcttgtgcagtgacttggactttagtgtgggctgtcctgctggatatgagagtgtgcagtgttacctcttgctaatcttttacagaatcatacttttttggtgattttcaaatgtttcatgggttttgaacattaatggacccttagaaatttctgcttttcatatgtattgagcgacaataagctgaacaactgttgccagactatctctgcaatgaaacaaaagagggatgggtgtctgagccagttgaggacttaactgggttgaggtggaaaaacagagggaagataatgaagtagatgagaactggtcctaaggaattaaagtgaaggccctgactcctgcctatacacttttgcatacgcccaaatggcaagtaaaggggaactttagaaatgcaaaggaattgataatgaggcgctg

SEQ ID NO: 62620 - DNA, 1055 bp, Homo sapiens
gaaatttttcctcacatcccataggtgtaaggagaggtcattggttctcatcccccttgtaggagatgatccagttgctttatgagtttaaatatatgaccatttatgctgcccaactgagattgggtctggaaaaacccaagaactcttccagtgctctaagtgatgggacaatcattaaattccagtgtcctgaccagattgttgtttgggtaattacatcctttttttcagttctccctgcagtgttatttgggtatcagatctccataaatgacctctctggctgttaagcagctgccactttccaccccaaggtggctttgctttacgggtgggtgaatcagtccttgcatgtagtttgtgaaatggttagggagcctttgggatgaaaatataagttagcaacttataaatatgtgccttatggcaagaagcttttatgttccccaaaagacagctatctgtatggacttagtaaattattggtagggtaggacaaaatgagtgttgtggagcactcacttactttttagatgcaagtaagagggaaagatcgtagaagtgatggacataaggcctgcactgatttagcctaatggtagaacagaactgaggtgtgtatgtgtatttgtgtgtacacttgatgaatgcccagacacactgaaaaattaactggaaatgggaggagtcagcaggcaatatggattgggactgtgtatcaggagcatcactgtagagagagggccttatggaagcatttttgttaacactttaaagatagctaacgggctttcttaactaggtcagacttacctggagtctcttctcttatttaacagtctgtgaatccttatattgtgaagctgtctatcgtggatgatgaggccacactcaatgtgagtatctggatccttgtgtattgtcttacttatttgcattcaatggtattactttcagtgaaagtacatttagaacagagagcagagagctattctgtcaatttcatccggttatagagagggaattaatatttctttttagtgcgtcagtgc

SEQ ID NO: 62621 - DNA, 1092 bp, Homo sapiens
taatgaaaaattgaagacagtgccttattcatatgagttctggagttctttttgcccctgaattaatcaaggtgcagatttataggtttttgagatgaagagcagaacccagagatttatacttgggttggcacatatatttgattcccttcaaaaggcagaatacacagaaaaggaaggggaccactcaaggaagaccgggggcttcattggagattgcttttgaggagtaggaagcatttggcactgagtcctggtaactaggagtacattactgaacccaaaagtcaggagctgcactgaggcaacctgactttcttcacttaataaatagcagtactgtgagaactgggccagctggagagagaattttcttttttgagcttctggatcttcacctagtgatttttgatatgagtcctagttgggctttatttggccgggttgaaagtgatgggtaacacaaaatctggagcttattcttataagaagagatatggaagaaggggaggccgtgagaaaggaatacttaaagagggactagaatatgcagagcaatgtgaatgtgttataaattccaggatctgattgttttcattgtcttggaggaactgatgaatggtgggtagagctcctaataaatatgaaatttattcccaacacctattttactgatgatctggaggggctggcatggtagccattttgatctctgtcatgtgtaatagcctctggggcctcattacaacagcaagaaaaatagctgtggaaaaatgctgaggatagttaaagagaggtgagggttatatgtgataggaacacactatcatcagtaatgaatatttttggagcattctactggatgcagtccactctgaggcaatggcttggcttcatgattgtgatccgaatcctggctcagctcagtagggctctctgaaatgtcagtctgaaatattggacatggccaaggaactggagagaatcatatttctggaatgaagtatgcatctctagtctttcagaagcccccagaagaattaatgtagtgggcaagggcgagctggtgggcctaatttatctgggctttgc

SEQ ID NO: 62622 - DNA, 1050 bp, Homo sapiens
gtgaaaccctgtctctactgaaaatacaaaaaattagccgggcgaggtggtgggcgcctgtagtcccagctactcaggaggctgaggcgggggaatggcgtgaaccctggggggcggagcctgcagtgagccgagatcacgccactgtactccagcctgggcgacagcgagattccatctcaaaaaaaaaaaaagaaaactaaggttgactatgtatagtattcttaatgcttttggtgttagctgggaaggctgaatgtgcttatattctggtttcagacagaggaccccagtaagtgcagtcctcggttttgggaggagctctttctcatgaaggtaagagttggtggcatctgtggaatttcctggtaactaaaattgccttctcatatattctaggcgctaagctaaaaatgcactctgccccttatttgtttccttggcaggtgaatttagagtacctagaaggcaagctggaatctcttgatggtgaggagttaatgaagatcaaggacaatattaattgcttattccaacactgcatccaggctctgggagaggagcatccaattcgggttgtcaatgcattgcaggtacaaggctgggagactggggaagtcttgtttaacaggagaaaggaattgtaacacatctgtttgaactgaggaacctagagttgctctgaggtatgaggttttcttttttatttctgtaagttaccaaatatttatgccacgtttgtttagccatctttctatttatacaaattgacacttaggagtaatcgtatccatttgtataatttgatctaatgctaaagtagattcttagacagaattcttgtttttgcttgagaaagggaagaagtagagaggaaactgaggcaagaatgattagtctttatcaaaaatcagaagactgctgggcacggtggttcacgcctgtaatcctagcactttgggaggctgaggtgggcagatcacttgaggtcaggagttcgagaccagcctgaccaacatggtgaaacccacctctactaaaaatacaaaa

SEQ ID NO: 62623 - DNA, 1006 bp, Homo sapiens
ttcactattctaaaatgtgactttctgttcacagattctctaaccatggcacaggtagagaaacgtggaggtttgctccggaaatcttcagcctccaaaaaaccactgaaggaaaaagtggtgctgatgtatgatgagatcttcatggtaaggcctgcggccttgttgtgtacagcttgagtctttagtttcttagtccaagatgagaaatacccttacctctgcctgctaccttcaggttccttgggggatgtgggacaggggagagaaagagggtttgagggcaaaaatgaaagctgtcagagtagagattataatcatgtattaattaatataggttgttattgtgttgtccttataggttgttgccatgagccaggtaaaacaattgaaaggagggaggaaggctggggaagctccttttctgaatattttaaagaaagacttgctctccttatgctctaacttagggctatcttatcctagatgtctcatgaagtttcttttggacctagaattctataattcagatacttttaaaggatacattattatattccatctcaagttgttggtgaaggaaataattacttaggactatctcattctccaactataggggataactgaggaattattagtaattgggtgggggatttctttgggtcttcagaactgattggtccaagcctatattgtaaaatataccctatcaggggctgggcgcggtggctcccgcctgtaatcccagcactttgggagggtgaggtgggtggatcacaaggtcaagagttcgagaccagcctgaccaacatggtgaaaccccgtttctactaaaaatacaaaacttagccgggcatggtggtgcgctcctgtaatctcagctattcgggaggctgaggcacaagaatcacttgaacccgggaggcagaggttgcagtgagccgagattgtgccactacactccagcctgggcaacagagtaagaccctatctcaaaaaaaaa

SEQ ID NO: 62624 - DNA, 1021 bp, Homo sapiens
gggcgacacagtgagacactgtctcaaaatgaaacaaaacaaaaacgtgttgcctcctttgtatattgggtgaatggctcatggtcagataatggtaatattttctttgacttagccacaactcttggacagatagctacataagattttcatctccatcactaagtattgtggatactatagtcagtgtgtcttgtagtgatcttctttcacatatggggaaatgggctacagtcccaaaggaagtgtgatttaatgtggggagaatgatatgtgataaggtgagtgttgcttcaacgccctttttagagactgcagaggtttcatttattctctcagtatcatctgtctagatactccttccttttccaagtctggtttaaggctgggatgagtacttctcaaactttaatggtcatcagaattacttggggcagggctttttaacctctttgatattgacatgttgggctggataattctttgttgtgggaggctgcctcgagtattgtatgatgtttaacagcatccctggcctctacctagtaggtgccagtagtacctcctctcccagttgtgacaatcaaaaatgtctccagacattgacaaatgtcccctgggaggcaaaattgcaccagttgagaatcactgatctggagtgattgttaaaaatgtagacccaagctaggcactgtggcttatgcctgtaatcccagcactttgggaggccaagtgggcagatcacttgagctcaggagttttgagaccagcctgggcaacatggcgaaatctcgtttctacaaaaaaatgcaaaaattagccaggtgtggtggtgtgtgcctgtagtcccagctacttgggaggctgaggtggaaggatcacttgagcctgggatgcggaggttgccgtgagccgagatcatgccactgcaccccagcctgggtgacagagtgagaggttgtctctcaaaaaaaaaaaaaaaagtttggttcaatagaatggtaggaaggcttaagaattt

SEQ ID NO: 62625 - DNA, 1013 bp, Homo sapiens
tctctacaaaaaatacaaaaatgagccgggtgtggcagtgtgagcctgtagtgccagctactaaggaggctgaggtgggagggtcgtgtaagcccaggaggttgaggctgcagtgagctgtgattgtgccactgcattccagcttgggcaacagagggagactgtctttcggtggggcgggggagtgggggaagaagatgattatgggactttatcttataattttcattttatatttaggtggtgttcatgaggcttgtataattgagcaggggaagaaatgagaagatatgagtgacagtgtgccgtttgaataagttcagggctggagcaggagaaagtattaatttacaggaatctcctgctcattgagaagatcttaccatgaattttcattctgggatgtgtcagaaaatgtggtttctaatcagaatttcctgaaatactgtcaatttggagctggttcccccttcggaaggaggaatgccttccttcttgtgtaggataatttgaaagggaaccaaaggtggtcatgtttatttaaatgaacgagagctcatcttcattgatcatttgtaacattaggcaaactgagtagatgctgatgggaccagattaaattgtcttttgtgaagctagttgacctgtagtaggtacagactggctgatacctgggaatagtcctggttttgccatttgcttcttagtcttgggaaagtctctgagttacttccattttcaggtataggctgaacacccattctgaggggagcattgtctagagcacacaagctatggaccctgccttgtagtggtttgtgtgcttccttaatcagtctggttctgtcctagcttctagaaaatagagatgatgcttgtcaggtgatgtcctgagttgactgacttctttctttttctttttcttttttttttttttccgaaatggagtctccctctgttgcccaggctgtagtgcagtggcccagtcttggctcactgcaacttccgcctct

SEQ ID NO: 62626 - DNA, 4042 bp, Homo sapiens
ccaggctcaagtgatcctcctgcctcagcctcccaagtagctggaaccacaggcatgcaccaccacacccggccaacttttcaattatttttagagacgaggtctcgctatgttgcctaggctggtccctgcagcctcgacctcctgtgctcaatcaatcttcttgccttggactcccaaagtgctagattacagatgtgagccaccgcgcccagctatgactcctttctttctcgtctaggttgttcctcaaagtcattcaagctgtactcgccgaaggagcccccgaacggcaacgcctttccccccttccatcccggcaccatgctggatagggatgtggggtaagtgagtctcttggccacttcctaacccttctccaggtgggatcctgcctggaaaggggagggagtagccccctgcccccaataattcctatcttcaacccccattctcatagcctcttcctttacacagcccaactcccatgtatccgcctacatacctggagccagggattgggtaagtggagtccagtggggaagaaggtgctttccactgggtgaaggccgaggtagggggtggagggggcaggctccgctcctactgacctctctccttcacttcctccaggaggcacacaccatatggcaaccaaactgactacagaatatttgagcttaacaaacggcttcagaactggacagaggtatggccaagggaaaaggggctgggagcaggagggccatctgggcaccctatgggatatcttatgacacatgaacacccgttaccatgctccctaggagtgtgacaatctctggtgggatgcattcacgactgagttctttgaggatgatgccatgttgaccatcactttctgcctggaggatggaccaaagagatatagtaagtggcctctggggtcttgctatgagggtgtatacctcctatgtcgttctaaggtctagaagtgggtctgggagtgccaggggatatctagattggtaggggaggcatctgcctggccccttttgcggtccctttgtcctgaagagtttgtcccatctctacagccattggccggaccctgatcccacgctacttccgcagcatctttgaggggggtgctacggagctgtactatgttcttaagcaccccaaggaggcattccacagcaactttgtgtccctcgactgtgaccagggcagcatggtgacccagcatggcaagcccatgttcacccaggtcagcaacccagctggatgtggaacaccatggcacctgggtttgattcccatcctctctcccagtgtatactcacagctgttccccagggaggcataatgtgaactggcaaaataagaagggcgggtaggcatgttgcaaccgtcagcaaacatgtattgtgtttgtatgggatagttttctgggccccaaggctacacgagtgaacaagagtctgccctcatatagcttagagcaggtgggtgtatcactagccacatggggagaggacaaggatctgttaagcttttctactgtgtgtctgtgtgtgtaagggccaggtatatgggtggggggtactgtgacatttatgcacccagatttaatgtgcaggtgacaaaagtgtatgcaatgggagagttgtaagcaaatgggagactgtaatagacataccttcaggtatggtatgtggggagggggcagggttctgacaagcctgtccccaggtgtgtgtggagggccggttgtacctggagttcatgtttgacgacatgatgcggataaagacgtggcacttcagcatccggcagcaccgagagctcatcccccgcagcatccttgccatgcatgtgagtcgtgggcaggacccaggatgcaagagtgaaggcaggcgggggaagggtggaacaaggtctgccatttcccgactgactacttagacagagggttagggtttcttcatctgaacagcaggtttaataagagactatcctctctcaggagtgtcacaatgctcagatgatagggcaggtgagcagaggcaacccaggtgtcagtgttctttcttgtcttttctcccactctaggcccaagacccccagatgttggatcagctctccaaaaacatcactcggtgtgggctgtccaattccactctcaactacctccgagtgagtctccgaccacccagtttctgccccagtccatttagtctcggctccatgtctgtcccctgacaagccacctccttgtctacccctagctctgtgtgatactcgagcccatgcaagagctcatgtcacgccacaagacctacagcctcagcccccgcgactgcctcaagacctgccttttccagaagtggcagcgcatggtagcaccccctggtgagtgccttgcacctgctcttaccaggatctcacaccgctccccaaagctgtatctttatttccttttgaagttttccccaccccttccttgttcccgggtctacaaaattgggatcagggcaggctcatgctccttgggagccacaatggagaataggggacctggggccctctcccatctgagtctccgtttaccggcacagcggagcccacacgtcagcagcccagcaaacggcggaaacggaagatgtcagggggcagcaccatgagctctggtggtggcaacaccaacaacagcaacagcaagaagaagagcccagctagcaccttcgccctctccagccaggtacctgtaagcatctcggctttcttctctcttctgggctgccccaccactcacccctgacccctttccaagcctgagctcactagcaggcgtagaagcaaagacagtttttctcatgtactctgccagcatgggctaactgcttttactggtgagagagttcttgtcaggcacttgcatgggtgtgatcacacagactcagccataggaagctagggcataaagggacagagacacccatgaggacatacggatattcaggacagacagcttggggctcacagaccatccagcacacacactcacactgatagacatgcagactggagtgtttgcagatccagaatacatacccttgcacatgcacacactgccctccctcatgtttttgatatgctccctttcttacatgtggacagaagttgaggagtcccctaaaattttggggagatgggctagggagctaggggagtagagtgacttctagaatgtaatggatatgggctaaaggctttgatgctctggtgttcttcagtaggaaggattccaggagctgagggtgtcaggagttggggttttaaattcgggtatgaggagggggtggggactcttgagcttccagggtgggtactggggctctgggggtatctgccgccctgggccgggcgagcccttgccccgattatgtttggggacctccgccactctcaggatgtgatggtggtgggggagcccaccctgatgggcggggagttcggggacgaggacgagaggctcatcacccggctggagaacacccagtttgacgcagccaacggcattgacgacgaggacagctttaacaactcccctgcactgggcgccaacagcccctggaacagcaagcctccgtccagccaagaaagcaaatcggagaaccccacgtcacaggcctcccagtaaaaggccctgctgtggccacccagtgctctgcctacctgccccacccctcacagccccagggagcagaagacagaatgaagagactgagcatctaaaatgggcagcctccatccacccgcttcagggaggaactggactctctgggggcaggtgccaagatttgcccccccagtggccctgggctgggcctggcctctacagagccttttagggggagggggtactcatgtggatgcctacttggaacctgggcctctgagacatgtcctgaccaccccccagggcatttgcctccatcttcaccccagattgtgggtttcccatccccctgactttacccctttcaagcctggggtt

SEQ ID NO: 62627 - DNA, 1113 bp, Homo sapiens
ccccagcccagagccgccggggcgctcaggcctgctgacctgtggccagtccctaaagggaggaggcctgccctcgagtcagcctggttaccatggcaatacccagctggaggtgcccccctcagccccgggatgcagcttccaccctgagaaaactttactagttctgggctcttctctcccccttcctaaaggcttccaatttgctagaggtgggaggggggctatggctgactccagggctggatgacacatctcctccgtccccccaccttgctgcctctactcctgctgctggggacaggcagcaacagggacagatggtctgggtgatgtccctccccttctctactcactcccaagcccttgtgctggagccactgggagttgtggctctggagagatgctgagtttgtgtccattcactggaggtgtaaatagaggcccagagctttgggctctagctcctcagagctatttacccaggcctagacaatgcctgttcattctctagagagagaaatggaggctctgagagtttttttttttttttttttacaaaattggagagaaacccaggcgtcctgcctcctgtctcttcaggttcttgagctaacacatttcaagtggcccggaaactgaggaggcaggggtggttaagctatgggagaaaggatggcctagttgggggatgagggccaggtctgagaatctactcttgggtttattgcccaggcctggcctctggtgggctgtgtgagtttgggcttcctgtgtggccttagtctgcctgtctgtggattggggagacttggtggctgggtggggactgtctttctggagacacaggctcagtccagactggcatgtgaaggctgtgtgtgctgttcttggagcatatggatgtggcccgtgagagctcgtgcatggggtgagggcctgttgcgggcatctgaatctgcctggggctgctgggttccagcccttgataggcatgttagggcgagctgagggtgaaagcctgctaggcaggatgaggcacacgtgtgtgcaggcacacacaggctctgacttggcatcttcagagactgtgcagtctgggaccctcctttt

SEQ ID NO: 62628 - DNA, 2679 bp, Homo sapiens
ggacctgttctgcccctgtgcaactgggtaaatctggtcagagcagagaaaggagcagacttgctagagaataactagaaggcctgttttgaatggtttgccagtcgatacatcttggcatttaggggcccctccaccccacagcgagactggagggcccttgtagtccctcctgtctgaggagacagggtgggtgtggggttctgagctctgggctggaggcaaaagccagagcacatttccccctccccatgaggacagtgatttgaggcctggagggggaagggagtaggaatggctgcagggcttggcttgtatctggtgggtttagaagtgcagggttcaacccccccaccccccagcccaccctggtcatcctgtctcagtgggttctgttaggatctcactgttaggatatttggccctatgtgctatgaggatctcttgaggtactgcctgtgaatgcactttggaaagtttaaaggcagtgggggagaagtgggactaccccagagttaagctgtaaatttgggagtcagtgggagtgtcttaagtcctggtgataggctgtatgttgcagggtctggctgaatgttatagatttcagtatgtttgtgaaagctggggtttattctatggccaggctgtgatgaggaatggtacgcaggcttcagagagggtgatttataggttaagtccttgcataataaatgatcggggtgtgtatgtgataggctgtcacaggtttaggggttataacacagttttggtgtgtgtattgaggtcaggatgcgtgtcataggtcccagtgtgtatgacttagactgtgtgtgtgtgtatatatccaggatttgggtatatttaggatttgagatatatcacaggttgatggccagacgcggtggctcacatctgtaatactagcactttgggaggccaaggtgggtggatcacctgaggtcaggcgttcgagaccagcctggccaacatagtgaaacctgtctctactaaaaatacaaaaattagctgggtgtggtggcatgcacctgtaatctcagctactcaggaggctgaggcaggagaatcgcttgaacccaggagctggaggttgcagtgagccgagatcgcgccactgcactccagcctaagcaacagagcgagactccgtcttggaaaaaagatatatcacaggttgaaatgtgtatcaggtagtgatttatgtgaaagtgagatgtgttatttatgtggaagatgttcacagagccaggtgcaatattactgcacagttaactagtgagtatgtcataagaaatcctgtccttggagttatgtgtgaatatagttgggggtaggagacaggaagtagagaaacagacactcaaattgcaaagaaggaaatagaaggttcgtgctcccccttcccgtgtgtgtgtgtgtgtttgtgtgtgtgtgtgtgtactatgtattttccttttcctatttgtccacgagtaaggtctggcccactacccaagttttagaaatattccctcctgctacaacaaaattaccttaggaaaaaaaatagaaatatctgctcccttgggatgccctgctggatgggagaacaggtcctatccactaaccacacgtttttttttctggggtggtggggaggattcagcagcaaactaagctccttctggggacccttggatggccaagttggctttccctagctctgacaatgcctctttccctggcacccacttgtcttcagtggtggtggggaagggggcttcctgttaagggggatctaagtcaaggcttggaatttagctgggttgggggcagggaagcctggagtgtcccccttcctccaatcagtgtttacagtctgatgtcagaatgtgtgtctgtcaaaaataaccccctggagcctctccccccagctgctccaggatttcaccaggggagcccaggctggcagtccgggccagccttcaacctgagcgatcacaggggcgagaaagatttgggggaggtttgggaggtgctttgaagatcttggagtctgcagagaggagcccgccctcctccatctctgccagtggctttggcccacctgctcactcctgagcaccgtgcctggggctcgggggaggcgggctgcatttcgttcctggcccccacaggcctctcctccatccaggtctctcctggcccaatctgatccgtcccctgtctctcccagtctctgtctctcttttgtttttctcagcagtccctccgtcccagcctccctccctcccttgctcttcctctttcctctcagggagggggcggggccggtgggggcagctccaccctccgcccgccctggggcctcattctgagagaggctcggagagagcgagcggggagggagggaggcagggagagaaagggagaaaggcaggcagccggcgggcgctgcgtgtgtgtttgagtgtgcgagtgtgagtgagtgtgagtgccgggtcctgcctctcctggtgcccccagcagaggggcccggtggcctggggagggcgggcgggctgctcggaggcagaggcagcaagaggcggcggcggggagagccgagaaggaggaggaggagagaggaaagagcggagcagccattgttgagggaaaccttgcaaacaaagaaggctccgg

SEQ ID NO: 62629 - DNA, 1087 bp, Homo sapiens
ggggtcgaaggctgagacctccatgtaaggatgcccagtgaggctccccgagcccggcgccgcagttcccttttcggagccacgtggggttgggggagcaattttcccgggagaacttgtctgcctcccctccccctctaggcggcccgggcatccacgtgggtcgggctcctggtggaggggggcgcaggcagcgggtccacgtgggggcggggaaggaacgtccacgtggctcccgtcccaggctgtcgggcatctagtatcggccttggagcctggctgacgcgaactgggtgtgtctccacgggtcccgccatctcctgccggggctggaggcccgggccgggaaggaaggtaagggctgctagagtcaactttgttcagagccttggaggttttttttttccctgctgcttgggtccgcaacgtctctccactgcggatggtgaaggactctccagatgttgcgggagtttgttccctgcggatggctgagtgtgatggggagggtagagggctgaggctgaagggttgtggaggagtgagtttgtggcgcttccgtctgaccggcttggggtgggttgtgagtcacgggcattggcgttttggttgccttgcagtcttgccttattagtgattcaaggggtatggggagtgtcaacatacacctgggacaaggttaagaaagggaaagggaatcctctcctcactttttcctccagcatctcttttgggaaggcatgctcctgtaatctgacacgcagaaactggggtggtccgtacttaaggctcttcggattttttgctggggatgggaaaagttggaggcggtttgagaactgttcaacatgttcaacagttgaacatacactggatgaggaggattctgttagatatttttttcttggccttcaaaaagtgttattgttctactctacagtggagggcttcttaaaagtttccacccagggtagaaggggcaggaattagtttgaactgttacctctcttaaacaattaagctgagtccttgacagcattttttgtgtgttactaggtgggagttgggctgcaggctgcctggtaat

SEQ ID NO: 62630 - DNA, 1050 bp, Homo sapiens
gtttcaccatattggtcaggctggtcttgaactcctgacctcaagtgatccacccacctcagcctcccaaagtgctgggattacaggcgtgagccaccacacccggcctgtaagctatattaaagagtttaaacctaatgctaagagcagtaaaatgccattgaagggatttagggagggtctcaggcagtgatcagatacatatttaaaaagtttctgactgtttttgaaccctggagggagcaggtttggtgggtgaaagctacttgggaggtttttgaagttagaggtgctgatggctggcttactttcagcctgggcttagcactcggatgatcttggtactctgggagctgtgctgtttgggaattgagtgatgggtgaggtcaggtgtgagggtgtgtctctgactggacacctgatggaggtgaagatgagtggttcatagagagctgggcattgtcttgagattccagcttagtcgctggggctctggtaggtaggtggtggcagagcaaatggagttgcagcctcttggctcaccctggagtgtttgcagagccaggtgctattcagctgctggtttgtaattataggattgtgaaggcctgggaggagttagtgcctaaaacctaccactttttgcttattctctgggcctggcctcctaacgcgtccttaaccagcctttccttttcctgggcgttggtactcagctctgttaggagggtatatattgccggggtgtggggggtgggggtgtggaagacacctgttgcttttttcttttggaagtggtgcggaatttcactttgttgcagaagaggaaagggaaggtctggcctgtctgtatgtgatcctgttctcaggcctttttacttcatgtttcctatgcggtagtttccccttatccacagtttctgttaacctgctgtcaactggggtctaaaaatacatgagtacagtacagtgagatattctgagagccagagagcccacattcgcataacttttattatagtatattgttttaatctattttattattaa

SEQ ID NO: 62631 - DNA, 4522 bp, Homo sapiens
gtgcttctctctgctctgctagcccagaagtttggcgacagtgttgctgctgctgagtttggccccagcagtggagggtacctgatttatggagcatattatcagctgctgccagagagctcatacccttctcaccttcttctctgctccaggtgctgctgcatgaggaggcgggtgattctggctttgtcagtctctctcggctgggcccatctctgagggacaaggacctggaaatggaggagctaatgctgcaggatgagacactgctggggaccatgcagagctacatggatgcctcccttatctccctcattgaggattttgggagccttggagaggtgagctggggctggactctgaaatcttcaagcaggaggtttacatgggaggttctagctcaaattcttggcatggctctgctctcccaggaccttagcttcttcctgggtgcccaacctgaatccttgaagtgtattttttgtctctaagtgggaattaggctgcaggctgccagattatgtcccatgtaagaattcctttcctagcttagactatagtccaaggcctttcccactgtctgggcccctgaactacatgtccagaggattctgatctctgtttttcagctcatttctagcctagccgatggttgtctgctgagcatcccacatcttatctgagggtaggggaatgtgtgaaacccaagcttgagtcaagtctgacaggtctctgttgacaccaagagctggtggatggtagctgagattggaatccatgccttctggtattcagatccttctcgctgccccattagctgagttgaacctgggagactgattctctcgatatccagtccttagtggcatagtaggtcattagggatgttggtaggaccttctggttgtttttctggagcagagcaggttatctctggaggaccagaatgaagtgtcgctgctcacggctctgacggagatcttggacaatgcagattctgagaacctttctccatttgacagcattcctgattcggagctgcttgtgtcaccccgggagggctcctctgtgagtgtgggaccaggggaaggggattagtacaaagtttagacccatgcctgtggacctactcatatagctctgaagcatagactgatctcaggtctttctttccctcttagctgcacaagctgcttactctctctcggacacccccagaacgtgacctcatcaccccagttgacccactggggcccagtacaggcagcagtagagggagtggggtaagcctgacctagagggtttcagaaactcccaggtgggaggaggagtgtgtggggacaggtctggaaaatactttcccaaagaaaactcctcctgagacctctcttctctcctgcaggttgaaatgtctcttccagatccctcttgggacttctccccaccctctttcttagagacctcttcccccaagcttcctagctggagacccccaagatcaagaccacgctggggccaatccccacctccccagcagcgcagtgatggagaagaagaggaggaggtggccagcttcagtggccagattcttgccggggagcttgacaactgtgtgagcagtatcccggacttccccatgcatttggcctgccctgaggaggaagataaagcaacagcagcagagatggcagtgccagcagctggtgatgagagcatctcctccctgagtgagctggtgcgggccatgcacccatactgcctgcccaacctcacccacctggcatcacttgaggatgagcttcaggagcagccagatgatttgacactgcctgagggctgcgtagtgctggagattgtggggcaggcagccacagctggcgatgacctggagatcccagttgtggtgcgacaggtctctcctggaccccggcctgtgctcctggatgactcgctagagactagttctgccttgcagctgcttatgcctacactggagtcagagacagaggctgctgtgcccaaggtaaccctctgctctgagaaagaggggttgtcattgaactcagaggagaagctggactcagcctgcttattgaagcccagggaggtcgtggagccggtggtgcccaaggagcctcagaacccacctgccaatgcagcaccaggttcccagagagctcgaaagggcaggaagaagaagagcaaggagcagccagcagcctgtgtggaaggctatgccaggaggctgaggtcatcttctcgcgggcagtctactgtaggtacagaagtgacctctcaggtagacaacttgcagaaacagcctcaggaagaacttcaaaaagagtctgggcctctccagggtaaggggaagccccgggcttgggctcgggcctgggcagctgccttggagaattctagccctaagaacttggagagaagtgctggacaaagtagtcctgctaaagaaggccctctagacctctacccaaagctggctgacactatccaaaccaatcctataccaacccatctctcattggtcgactctgcccaagccagccccatgccagttgactctgttgaagctgatcccactgcagttggccctgttctagctggccctgtacctgttgaccctgggttggttgaccttgcttcaaccagctcagaactggttgagcctctcccggctgagccagtgctgatcaacccagtcctggctgactcagcagcagttgaccctgcagtggttcccatctcagataacttgccaccagttgatgctgtcccgtctggcccagcaccagttgatctagcactggttgaccctgttcctaatgacctgactccagttgacccagtgctagttaagtccagaccaactgatcccagacgtggtgcagtgtcatcagccctggggggttcagcaccccagctcctcgtggagtcagagtccttggacccaccaaagaccatcatccctgaagtcaaagaggttgtggattctctgaaaattgaaagtggtaccagtgctacaacccatgaagccagacctcggcctctcagcttatctgagtaccggcgacgaaggcagcaacgccaagcagaaacagaagagagaagtccacagcccccaactgggaagtggcctagccttccagagactcccacagggctggcagacatcccttgtcttgtcatcccaccagccccagccaagaagacagctctgcagagaagccctgaaacaccccttgagatttgccttgtgcctgtaggtcccagccctgcttctcctagtcctgagccacctgtaagcaaacctgtggcctcatctcccactgagcaggtgccatcccaggagatgccactgttggcgagaccttcccctcctgtgcagtctgtgtcccctgctgtgcccacacctccctcgatgtctgctgccctgcctttccctgcaggtgggcttggcatgccccccagtctgcccccacctcccttgcagcctcctagtcttccattgtctatggggccagtactacctgatccgtttactcactatgcccccttgccatcctggccttgttatcctcatgtgtccccttctggctatccttgcctgccccccccaccaacggtgcccctagtgtctggtactcctggtgcctatgccgtgcctcccacttgcagtgtgccttgggcaccccctcctgccccagtctcaccttacagttccacatgtacctatgggcccttgggatggggcccagggcctcaacatgctccattctggtctactgttcccccacctcctttgcctccagcctccattgggagagctgttccccaacctaaaatggagtctaggggcactccagctggccctcctgaaaatgtacttcccttgtcgatggctcctcccctcagtcttgggctacctggccatggagctcctcagacagagcctaccaaggtggaggtcaagccagtgcctgcatctccccatccgaaacacaaggtgtctgccctggtgcaaagtccccagatgaaggctctagcatgtgtgtctgctgaaggtgtgactgttgaggagcctgcatcagagaggctaaagcctgagacccaagagaccaggcccagggagaagccccccttgcctgctaccaaggctgttcccacaccaaggcagagcactgtccccaagctgcctgctgtccacccagcccgtctaaggaagctgtccttcctgcctaccccacgtactcagggttctgaagatgtggtacaggctttcatcagtgagattggtgagtgacacacagttcccccatgtagtccccaagttggctgggggactctagaataggataagccaccctgatgaggctggcctttgttggatttctttggaggagtttttttgtttttattttgagatggagtcttgctctgtctccaggctggagtgcagtggtgcaatctcggctcactgcctcccaggttcaagcaattctcctgcctc

SEQ ID NO: 62632 - DNA, 2118 bp, Homo sapiens
ctcagcctccccagtagctgggattacaggcactcacacccacgcccggctttttgtatttttagcagagatgaggtttcaccatgttggccaggttggtctcaatctcctgacctcgtgatccgcctgcctcagcctcccaaagtgctgggattacaggtgtaagccaccgcccttggcctgtttttgtttttaagagatgaggtctcactgtgttgcccaggctggacttgaactcctgggctcaagtggtcctcccacctcagccttccaagtagctgggatttataggcacaggtgtgtgccaccgtgcctggctgtggagggttcttcagaggcagagccctgggttggtttgaatccttcatgctttgtgctgctaccttggttcacttagtacagagggcagggggagtggaaagggagaagtgagatgatttgggggcttcctgggacctgtgtactaagttgataggggctcgttttcaatcctgtgttgtgtgcctccacaggaattgaggcatcggacctgtccagtctgctggagcagtttgagaaatcagaaggtgagggaacatgggtagttttgctccaactctttttttggtgatacttttttgggcccagccctgtagttgcttaaactagggtgagaggggacagccttagccactggagcagacccctaattggaagagagagacaagattgaactgtgacggtaatccaagccagggacggcagtgatacagtaaggaaggtattaaagagtagactgggaatccaggccaggcgtggtggctcatgcctgtaatcccagcactctgggaagctgaggcgggtggatcatgaggtcaggagtttgagaccagcctggccaacatggtgaaaccccgtatctactaaaaatacaaaaattagctgggcgaggtggcgggcacctgtaatcccagttactcgggaggctgaggcaggagaattgtttgaacccagcaggcagagattgcagtgagccgagatcgtgccattgcactctagcctgggccacagggtgagactctgtctcaaaaaaaaaaaaaaaaaaaaaggaatccaagcaggttggggttgtttagggacatttttctagagggaagtagctttcaggctgggcattgaaagacaggtaggaattcacagagagaatatgtgtggcaactaaaggcagagggtaggtataggaagaatggcatatggcacatttgaaaggcaatggatagctggctttcttagtataaggcgtggatgtaggtgctatggaggacactatcttcttctcaaggagcttatggtctaactggggagaagaatctacagaaatgattcctgagttggtaacaaggcaaaatagaaaatgtgatttgtagaacaagagtaggctgtgaggccaggaagctagttaggcagatcatagatcaccttgaacgctaggcttatacatttggactttatctcagattcagtggaggaatgtgggtgtttctgagcagaaaagagacatgattaaaaatagtacttgggcatccactggaggagactagatctctttggggagatcccaacagggaatatgtaggcaaagtggattttcctcctttgggtctcaaagcaagcccttctgtgccgcctcagtctagaacatctggttgggcttttaactagtatggtttctttgcagccaaaaaggagtgtcctcctccggctcctgctgacagcttggctgtaggaaactcagggtaagtatggagacatgagcgagttaccctacagctgttagtcagcagccggctgacactccaggactgtcaactggatgcctctgttgcagggacgctgtagtcagctctagagtctttccctgtttccccaccccttactctgcctatcactaccgggcagtgtcttgggtggtgaggtgagaacggggcatgttcactgccctccagctgattccagtcgggctccaaatgtcctagaggtgccttttatctcctggcaagtcatacctttggggatttctttctttcatttaataacacttcaagtttgctcagtgctggtaatggtgtaacttaaagt

SEQ ID NO: 62633 - DNA, 1112 bp, Homo sapiens
gagatcgtgccactgcactccagcctgggggacagagcaagactatctaaaaaaaaaaaaaaatgtcgggcgcggtggcccacgcctgtaatcccagcacttggggaggccgaggcaggtggatcacgaggtcaggagatcgagaccatcctggctaacatggtgaaaccccatctctactaaaaatacaaaaaaattagccgggcgtgatggcgggtgcctgtagtcccagctacttgggaggctgaggcaggagaatagcgtgaacccaggaggttgagcttgcagtgagctgagattgcgccactgccctccagcctaggcgacagggcaagactctgtctttaaaaaaaacaaacaacaaaaaaaaacaaccatggattacagtgagatgtgaagagggacagtcagggaagggttatatagaaactaatcccctaagctgaggcttgagaaactctatcaggtggtagatttagggaacagggcattctaggaagacagagcatcttgaatgaactgaagaaacaaaaccaactgggtatgttttggggaattgtgagaggcttggtttggctggagtgtagtagctgatcagggcagtgggcagaggtaaagcgagagataaaactggagtggtaaatagaaggtcagattattgggacctcgaatgccatattaagctctttggactttatcctgtgcattgaagaaactttgccagattggtttttgggtgctccatctagcaggaatgtagaagacaggtggactctgaagctgcaagtggggagacgatagatgatgactgcatgagtgcaggaaagatgcagcctagaagtcaggcagtactcgggggaaggggcggatctgagaatggagagcttagactctaggacctggctactaggtttgggtagtgagaggatgagggcttcaggaagaccctagctggctggatttctcttgctggtccccaagttggggaacatggggaaggggcagttgaagcagtgggaaaagttgggctgcttaccttgcttggtgtactttgtgagatgaggtgggggtctctggaggctatatacacggtatttggaagcgtagaatcg

SEQ ID NO: 62634 - DNA, 1978 bp, Homo sapiens
ctccatcctccctccccaccacagggctcacccctccagctacccctccccaccagttatggaagcccctggctgctgtctcactgctggccaaagccaaatctcctaagtccaccgcccaggagggaaccctgaagcctgaaggagttacggaggccaaacatccagctgcagttcgcctccaagaaggggtccatggccctagtcgagtccatgtgggctctggggaccatgactattgtgtccggagcaggacccccccaaaaaagatgcctgccctagtcattccagaggtgggctcccgatggaatgtcaagcgccatcaggacatcaccatcaaacctgtcttgtccttgggcccagctgcccctccgcccccatgcatagctgcctcccgggagccgcttgatcacaggactagcagtgagcaggcagatccctcagcaccctgccttgccccatccagcttgctgtcccctgaggcctcaccctgccggaatgacatgaacactaggactccccctgaaccctcagccaagcagcggtcaatgcgctgttaccgaaaagcctgcaggtcagccagcccctcaagccagggctggcagggccgccgaggccgcaacagccgttctgtcagctctgggtccaaccggactagcgaagcatcttcctcatcctcatcatcgtcttcctcatcccgatctcggtccaggtccctctcccccccacacaagaggtggcgaaggtgagctttgatggccctgtaggtcctctccatttaggaagttcacgtacttctgtggtttactttgaaagcttttacccgttgactttggtactttcaggcgctaaggcttctatttctgactttggcttttgtgttttcccttttcctggattgttgaaggaggcaagctgtgagacaattgcttctgtcccctgttggagcttggggtgtcaggtctcctgcttctttgagacctgccttggggagacttttagggtttgattttgaccatgttgatttttttcacatactgtatcagccttcatttttggtattctgggcgctatgtgaggtagtgggttacttgttaatagaaaatagttcttcccttaatcatctgctgaggaaggtgtctggggcagttcctttgggtgtcactatggcctcatctatttcctggcagtatctttttttctcagtaaccaagttttcccacttaatgaagaattcttgggttttggagatgatatatgtcttcagaactggcccatactacaagtctagcagttaacctctctcatggtcacagtatttcagtgagacctggtaggggagcaatagtaacccaaaagacccaggcttggccccagcaccacagatagctgggtgtgagacctagggctcacccctctccctgagtctccatttattgttcttcctctttctgatttgttaaatatttttcaatttttaagtgcacaattgaaaatgtgatctcttccaaaacacttcacaacattccaggtacacctaaagttccatgaagggcctcagtttgttcatctctgaatgaaaattgttcttctagacctcttctactctgctttgtctttggtcctgagcttcctaaaagaaaggcaggactggggcctgggtgagataagcagagtatacctgaaccactcccagcattcctgcatgccctcttatccttcaggtccagctgtagttcctctggacgttctcgaagatgctcttcctcttcttcgtcatcatcttcctcttcgtcttcctcatcctcatcatccagttctcgaagccgctcacgatccccatccccccgccggagaagtgacaggaggcggcggtgagcatgtgttcagggagcgccatgcacctgggatgcaggtgcctaagagttgagtcttgaattgtcttatgtttggggggctgatgacaccctcttttgtc

SEQ ID NO: 62635 - DNA, 1305 bp, Homo sapiens
catacaaagaacccaagggggctgggcatggtggctcacgcctgtaatcccagcactttgggaggctgaggcaggcaaatcacgaggtcaggagttcgagaccagcctggccaacatgatgaaaccccatctctaccaaaaatagaaaaaattagctagaggtggtggcacgcacctgtaatcccagctactcgggaagctgaggcaggagaattgcttgaacccaggaggcggaggttgcagtgagctgacatcacaacactgcactccagcctgggctacagaacgagactgtctcaaaaaaaaaaaaaaaaaagacccaaggggtgggacgagaggagaaatggggactggggactctcctatctctttgacttaaaattagagcagttttcactccatccgtttttgggatgggagatagctagccatttgcagaccctgtggttgggaagtgtggtcagagaccttgaagtttgtctttacctttatagactccaaccgggaagactttgacccagcacctgtaaagagcaaatttgattctcttgactttgacacattgttgaaacaggcccagaagaacctcaggaggtaaccttgggcccttccctgctatcctttttctcctttggaggtgcccaacctcctccacccccttcccctactctaggggagagagctgctagtgagatgactgttttataaagaaatggaaaaaagtgaaataaaaaatatgttgaatcagattttttaaaaggggtatttgtttttttataacaggtattgaaacaagttaacttgcattcctatgtaagataggaggggctgaggggatccccagtgtttggaacataagtcactatgcagactaataaacatcaactagagagaactcccaactgctgttgtgcgtctttatatggtgctaatgccaaatgtattcacttttcctatctgaacatggtccagggacatgcctctccctggtcaggtgcaaaaatcccactggatttgaaccttggttcctcagatgtattgtctaaaatgagtcatttaggacagtgcttctcaactttaaagggaatttgaatcatctagcgatctttttagaatgtagattctgacaatgggatgatgatactggtccaggaagggattttgataacaaggacctagagaagctcacacttgttccaaagaaaggttttctaaactgcgacaggtgtatacattcatcatgtcagttatgttcatcattttataatagcttgagcacactgcatggcacagcaggtgctcaaa

SEQ ID NO: 62636 - DNA, 1004 bp, Homo sapiens
gaagaaacctaaaatcttggcctctagcttgtaaccaaggggtgatggcggcaatacaataggtgattatgaggaagaaaatctggggattttcagggagctgataaaagtatgaggtctggaagggatgtgtgaggttgaggtcaggctccgaatctagaggaaattaaacccattctgcttgaggagtttgggttcttctgggacactattcagggctccaagaataagagagagtgttttcctgggagctttggcaggataaggcaggaacagggccagtgtatcaagtggctgaactttgttgttttttgccctttccgtatcctgtccttagctttcttttgctcttactgctccattaggcccctaaaaataaaaggaacctaggatgccctttgggtacccggaagcttttgctgatttctctccttgtgtcttttctaacagaagggagttaagccccaagccaaggcagccaaagctcctcctaagaaggccaagagctctgattctgattctgactcaagctccgaggatgagccaccaaagaaccagaagccaaagataacacctgtgacagttaaagctcagactaaagcccctcccaaaccaggtactgtttctgttcccaagaggctgggctggggaccagattgctctggggactggagttaaaattgccgatttggcacaggggtgaaatggtactgtttgttgaactggaggtgttgattactggtcttttaattttaaaggttttactaataaataacaagatttcataggagctagtaaatagagaaagttattgcagcaagaaaaaatgtgtattttttttaatggtatccatttggtattttgtgacatttcatagacattttatgttttcacacatcccattccactgtaatcacttaaatatctatttgttgtgcttttcactgccatttttactcttgtatgttcattctatgagacaaatgagaatttttctttttttc

SEQ ID NO: 62637 - DNA, 2570 bp, Homo sapiens
aaaggcggcagtggtagtttccaaatcaggtctgtacccaatgaacatgccctctgggttttgtccccccaaatcaggatgggatatactctttgagagtagggtagtgagaggaggcccaccactgggcttccagttgtggaaactgggaggaagaacaggaaactggttacctttttttttttttattagagtctcactgtgtcacccagaccagggtgcaatggcatgatcacggcttgtgcagccttaacctcatggactcaggtgatctttccaccccagcctcctgagtagccgggactacaagcatgcaccaccatgtctggctcatttttttaactttttatagagacagaatctcactatattgcccaggctgatctgaatttcctgggctcaagcgatcctcctaccttggactcccaaaatgctggggttacagttgtgagccactgtactcggcctgagtctggctttttgttttgtaggttcattaaagaagcggaagcagaatgaggctgccaaggaggcagagactcctcaggccaagaagataaagcttcagacccctaacacatttccaaaaaggaagaaagtaagttgtctcactttcttctcaggagccagctctttaaaagtagaaaaatctaggatcatcttgacagctctgcctggcgtgacctggtacatgtgcccatgtgtatcactcaggagaactgttacatgaccactctgtctttaatttcctacttcattcttctgtagggagaaaaaagggcatcatccccattccgaagggtcagggaggaggaaattgaggtggattcacgagttgcggacaactcctttgatgccaaggtgagagagagatctgtgccattcttgggagggaggatgggtagtgtcagagaggacaattcttggttcaggttggtgggaatcttctctgggttcaggtttccttgagcagggagtagaaagaataaagtgacagggctccagcatggtcctcctctgtgttaatctccctctctacttaccagcgaggtgcagccggagactggggagagcgagccaatcaggttttgaagttcaccaaaggcaagtcctttcggcatgagaaaaccaagaagaagcggggcagctaccggggaggctcaatctctgtccaggtcaattctattaagtttgacagcgagtgacctgaggccatcttcggtgaagcaagggtgatgatcggagactacttactttctccagtggacctgggaaccctcaggtctctaggtgagggtcttgatgaggacagaagtttagagtaggtcctaagactttacagtgtaacatcctctctggtccttttctgtgttcctagttttgtacagacttgtttttgagtgttgagtagcagggacaaaataagggaatgttattttttaagaaaattcattttcattgttgtctccttccttttctgtgaaagtcctcatactgagaaatttgtatattttatattaaatcacttactattgatttttgttgtgattttcaaaggtggattcccacagataaaatcttggctattgcccaaaacatagtaaagggtcacgtgtgactttttataataggaagaaaattctgcctttgtgagtgcacatgtccacatttcatccctccttccctcaaaaccctagagaggggcattaaagaattgttgatgtatatgcaatgtctgttaagcatgcactatgtatttcatcctcatttattgggtctgggactgaagtttttagccagcatggacctaacctactttttgggataaaattctctgttttgttacaggcaaaattctggtatggcgtgaatgccatgggtcattctgaatatatttttttctgtaattttatcattacacgatgtttgcaatacgtgctttgttttttaatttgaaagcaaacttttctactgttgaaagacattttttgacaacttgacccttcctagtattgagttctaagttgaggactgcatcttctcgttttttacagtatagagaacaaaatgacatgagtttgaaaaatacatatcacttggtattgctgtcttggttgcagtggtgatacagaattggtttcattaattcctacatggttgagaatcactgatcaagaaagtggggggaaaaaaaacaaacgttaaaacctcaatcctcagtaggaaggtagattacattaggtgaaattataggtaatctatgtatgtgctaatggggttggaaagaaccttacagagcatattacctgataaactggagtgggtttgggagaacaaactaataggattattgtgtctcctagttggtacctgggagcaattgacatgcccccttcagaaccttaactgttagtagcagtggctgtaacaacacaaaccagtgaccagagataacagcttttaggccaagctggcctgacggtatggctgcaggaagtgactgagcagtagcggtactcagccagaccaagacggagagggaagagtccacagctttctggaagctaagg

SEQ ID NO: 62638 - DNA, 1024 bp, Homo sapiens
ggtaaccttatataatatattcatatgtttagaattttcaaagccattttcacatttattaccttattgaacttttatacaaccctgtgagggaggcatggcagctattgtcccctttttgtgaaagaagttaaagcccagaggagtttaaagtgatttagctgaggtcacactaatcctaagaggtggagtcaaaactagaattcaggcctctgttgcctggtttagggctctttgctctatattgcttctgtacatgtgattagaagagaatgtacacattaagtaccttatatttgtgtgtgtgtgtgtgtgtgtgtttattttatgtatatatatacacacacacacacacatatacactggcaggaaaggaggaaagtgtcaaaaccaaggggatgtagatacagactgaaagggacagcctcagagctatgttcctttgttgaccacaaagggctcctgcagtgtataaccctggaatgcttttggctagtgacatatgtcagactgtaattggatagtgtttaggcttctgcaaattaaacaaacaataagaaaatttcttcttttcattagaaatatgggagaagatctggagaaaaaatctattttactttcctaaacatgggctaaagttatctaagagttccctacatattttctttctttctttcttttttttttttttttttgaaacagtgtgtctctctgttgcctaggctggagtgcagtggtgtgatctcggctcactgcaactgcaacttccgtctcccagattcaagcgattttcgtgcctcagcctcccaagtagctgggattacagacgtgcaccaccacacccgactaatttttgtatttttactagagacggagtttcaccatgttggccaggctagtctcagactcctgacctcagatgatccacttgccttggcctcctaaagtgctaggattacagacgtgagccaccgtgctcagcccatattttctttttgtgcagtggcgtgatctcagctcactg

SEQ ID NO: 62639 - DNA, 2276 bp, Homo sapiens
tttctaggctttctgctggcttgattggtaagactatcactgttggaaatgggtggttcattggacattgtcagtaaaccaaaatgatttttttttctctttttgtagaaagaatctttaaaatgtataagtactacctacactactcctccaggaatattatctcattattgtgaaggaaataagtccttttctccagtaaggttggctaagtccatactagtttttctcacagatgtatgtcattggaccacatttacagtcagtatttgcctaaactgtatgatgactacaaggtctatagcatttagagtaataagatattctaataataccaaatttgaaaagagggttgctcttggaagaaaaagggtgtccaagagcaaagtttgcatactgttactttggataaagctttagcttaccaccagtgagagagacttgactgctgtccctcatttggtcttgaagtcctctcaggactccttttagattattctgaaggagttaaaacagatgtgtggttaccaggggctgggagggggtatggagagtgactgctaatggctacagggttcctttttggggtaatgaaaatgttctagaattagatagtagcgatggttgcacaactttgtgagtatacaagaaaccactgaattgtatacttgaaaaggataattttatagtatgtgaatcatatctcagtttataaaggaggcaaatgtaggctgcagaagtgatggatttgccagttttttctcaggtctcagaactgtggagggaagtctctgtagtcactgctgtgctttggacccattacccagcaaaggcagcataaggctctgttcagcttctggcccagtttgtccttttatgtctctctcattaactcaaggaagcacatggcttttatatttaaatttattcaaactgtaatctttgacatttgagttagcttttagtacagttttgcatttatagtaatatatattatgtattttctctatccccaaagaatccgttttaatcttttccggatgcaaatttcaggctgtcttgtcccatcttccctctcttgctctctttcccctccccccacggagtgtgtttgatcaggtgtggcaggaatatccactgtcaagctgcgccctttatattagtcaatattatccttctcccccctccctgtctgtctgcccctttgggctttcccagttgatttataattttggaattctcattggagtctgtaatacagtttgttcattatttaaccaaaacctgtttaatgagcagagagaggcaatgtaaatgttaggcatgttgcagtgatgtacctttgtgcttctcagagcgggtgggtagttaactctgtgctgcctgcagggctggggtgtcctggccttaggggcagaagggccactgcctctctcttacatctgcccaagccctgccatgggtttagattccaaagacacatttccttttattcttctaagaatcttttggggctcttgcatatgggagttatcttcagtctcgcagctagaccttgtggtaggatctgtggcatgggatggggcatggaagggaaagtgaaatatcaggatacttgatattgctcttggttttagatctgacaagagtagacagtttatgggaatgcttctagccaatatggtctgtggtctttgatctctttgttcccagactagataaattcttgcaagccttagttcccttcatccagtatagctttatggaaagggctatagtcagttgtgagttgtggtgtttggttgtagtcatttgcctccagatatagtctgtctttgtccttggtctttaaacttagatcattacaaagagattcttttccagaaaatttttggtttaaaacaggagaggaacagtctaaaagtatcacaaccaggctaggtgcagtgacccacatctgtaatctagcactttgggtggccaagacagcaggattacttgaggctgggagttcgagaccagcatgggcaacataccaagattccccccatctctacaaaaataaaaataaaaaaaattagttgggtatggtggcgtacaactgtagttccagctacttaggctgaggcgagaggatcacttgagcccaggagttcgaggttacagtgacccatgattgcgccactgtactctagcctgagtgacaagagtgagaccctttcaatgaatgaatgaatgaatgaatgaatgaaagaaagtatcacaaccaaaatctt

SEQ ID NO: 62640 - DNA, 1391 bp, Homo sapiens
caccttagaatctctgtaacttgagtggccacagacttgtagacatttcagcacagttagagtgaataaaggtactgtgattctttttttccccagggactattcatattaaaagggtagctccaagaggcctatattttgatgacttgattttgccatttctttttactggggccttccccagatgatttatgaatgctcttcatttgacacttttaaaccaagaagttcttccaaacatttgtttgtactcaaggttaggaaatgaagactcttgagaagaaacagctctgcataatctgtcctctcatgggttcagctctctctttttctcttcctcatacccaggcacacttagccatcagaactagtttcctggctgttgagggggcacattttctactgcatgtatcagaaaaggaattgtgtaaaaagagggaaaagcattcttaatagtttagctctcaaaaacagagaaacctaatttctttgtagcaaaggttagggggcagtgtaacagtgtggtttgtggtgggtatcaaagttgctggtgtttttattgcatttgtcctctttagcacagctacctcttgaggcctgaaacttctgagtatatgcccaacttaccatgacagcagtcagatgagtaaaaagaaagccagctgctgtttttttttcaaacaaggaggcaggcagagtcccttcctgcttttccacccattcaaactcaggacaagtgccaaaagggtttcagaagaagccaaatgcttgaaattcaatgtgttgttttgattaggagagatagtgaagagtttgtctcagccttgcccccctctgactatctctctatgttcatagatacttagttgataacccagtttctgaagtgatagtggatatgtttatggaaagggtgagtacatttgtcttttctctcctggcatctgttagaagatggagttggctatagagcaaaatggagataagatcatttcagctcagatcacttcattaagaaagggtaatagatggagagcaatgactactttaggctctcagttttactctaggaaaccaggagataatttgcacctcaccagtttaggggcctttattcctttcctttattctttgaagatcctaaagaacttagatggacaagcacttctggctgtctgttggctgggttctcatggcatgtctcttctgtaacatcagcattctgttaccactgttaccactgtaggtcgagttgtgaagggctgccacatgtgcacagatcacaactgacctttccttgttccacgcttattgagcaattacttgcccgtttgtggaactcacattattgtcttgcatttctggcccagtgtgaagtgggggcatccagg

SEQ ID NO: 62641 - DNA, 1099 bp, Homo sapiens
agacttcagtgtagactaagttcttttaagcatgtttgcacttttttttctgtctttttttttttttttcctttatgtggagaacgggacctcgctatattgcccaactcctgggctcaagttatcctcccatctctgcctccctaagagctgggattacaggcgtgagccaccatgcctggccataagcttgtttaatccagtcaaatttcagtaccaaataactatattcattgtcataaataggaatctgaagggggtagcaagggaagcctttcttttaatgtttccatcttcacatttgttttcctggatgaagtttaactcttatggacagaaatacagagttcacttgagcatgaaataccagacaaagagacaggtgtaaattggccctgttcttctgaaccctgcctgcctactttctaggaaggctagccttcccctcttttccccagcataagtccaaccccttccctcattatggtttgtcataagaactctctcttatactggtgcaagtggaaaaaagagagtattattccttttctttttttcacaaaatacttcttcctaccctggatttgctaacctctggcttaaatacgcaccaagcaaagatgtatatatagtcttcctcccttcctctctctccccttagtctgaaggaaagcagcaggtgatggaatgcataaaggatcggggcagggctagagtcttttctcacacactatggacgttgctcaacagaatgggtgtgaaatttagtcagagccacagcatgtgtttcagttttccagggaatttcctcttcctaactgtaggtttaaccctttcttctgtgtagggaatgccaggggctacccaagaaatatgaaatgagttatttgtaagaaggaaaaaatgccaggcttttaccaggctcctttgggatctaggatctccaacttacttcttgctaaatgattgtggaaaaagacatagactttggagttggatagacctggcttcatatcccatctctaccattgggtggtcttgggcagtcattggtggcagttacttgatcttttttttttatttgagacggagtttcgct

SEQ ID NO: 62642 - DNA, 1157 bp, Homo sapiens
cagaacctttaagacagctgaatctggaggagcaatcctcaaagggttggaaaacaatttcacaaaacatgggacagaagctgggcccagccaacacctgtttccccaacactgtctgtctgtctgtctcttgttttatcccaactgcacacttaatacaaaagctccattattctggtaaagttgcattccagcccagagtgcagagttaatgttttttacagccacatgccttcttgtgacggatgaccactttataataaaatactttatgctcaatcaacttacaaataatgggtattccattacatggcatttaaaacacaaccaaattcagaaaaatccagaaagaaataagaatagaaacaagaatgattcctagaaagagaggagggccgccagagaatcctctgtaagtccttcactcccaaagaatttatccattctcttattgaaggatatttgagttgtttccagttatttactattactgctgtatacattcctataaaagtctctttgtaaatgtgtttgtttctcttgactaaatacctaagagcgaaagtgctcagccacagggtagatgtgcatttaactttaaaagaaacagttcttcaatgttgctgcacacccctcccctctccaccagctctatattttcctcccctaagggcctaggttctttaagttgaggatttggcaggagagaagaagccacatcatgaggatccctgctgccagagcacagtggcctgaatcggacacttaaaaagctgaaacaggtgtttgaaaccctactccagcctccctgtttggtgccagccccctgagaggctaaggcttggccaggagaattcggctcatctaatggatgccgattagagacttttacaagacatagctacataatagtgtatatgctgtgacgtggtacatttaaagcaggtaagtgaacatcttaatcttaaggaggggggcctctggtggtccaaatgctcttgagcaaagggtagtcaggctacgtgccagatgaaagcccttcaccaacctctaccttttctccttatatatccacacaattgactaccactcagaaaagcaaaacagaaaaaaactactgatatatgcaacatggataaattccaaaaacatgctaa

SEQ ID NO: 62643 - DNA, 1028 bp, Homo sapiens
tattcatcatgctagctgactcacgttgtacagggtgggaagggcaagagaagaagttttccttggcactctggcttctctatgctttggaaagagttaagggtatggtaccttactcttggaagtttggttaggtttgtttgtttgtttgtttgtttgtttagttagagatggagtctcactctgtcgcccaggctggagtgcagtggtgtgatctcggctcactgcaagctccacctcccgggttcatgccagtctcctgcctcagcctcccgaggagctgggactacaggcgcccaccaccacgcccagctaattttttgtatttttagtaaagacggggtttcaccatgttagccaggatggtttcgatctcctgacctcatgatctgcccgccttggcctcccaaagtgctgggattacaggtgtgagccactgtgcctggcctggttaggtttatttttaaagttattttttcaaacataatgcatgcacattataagaagacagacaatagagatgttcaaaagaaaagttaattgtccttcctgtactttctcaatgttcctcctccttctttaggcaaatagtgtgaacagcctagtttgaatctttatgtttttctatgtctttataaatgaagtaccattcctttttaaaatgaaataaggccgggtgcggtggctcacgcctgtaagcctagcactttgggtggccaaggcgggtggatcacgaggtcaggagtttgagaccagcctggccaacatggtgaaaccccgtatctactaaaaatacaaatattagccaggcgtggtggcgggcttctgtaaccccagctactggggaggctgaggcaggtgaatcgcttgaacccgggaggcggagtttgcagagagcagagatcgcgccactgtactctaacctgagcaacagagcgagactctgtctcaaaaaaaaaaaaaaaagaatagaataaaatgaaataaaaataggattatgtgctacatattttcttttttcatttaat

SEQ ID NO: 62644 - DNA, 1040 bp, Homo sapiens
cgtccatctcttgggctcatgggctagggctagaatcagttctgaaatatgtcagggtcataaaaagtgaagaaacaattccaaggacaagcttcttggagacctctctaccaagctgaggtgaggtcagcattcttgctaacccctctctcttacccttgagtacctctcagtaccttgtttatcacagtaattcctttttcttcctgataggttctacggactctgctgctaaccccagtgggtgcccacctaaccaatgaatctgtgtgtgagattatgcagtcttgcttccggatctgctttgaaatgaggctcagtggtaggtgcttggatattagccccttcaccattcctggggccagtgtctgagtatgaatacaggaggctgtcttcccagagagatggaaaattcaggacttctccatcatctatctcatgcgatcataggggtctagaagaaatgtctgtacttggctattgtgaagctagaatagagacctcagcccattatgccagggcaggagttgggatggatcccagattgacttagcccaggcaccaaatcaccctctcttggggtttctgggattgacaccaacctgcaaccccctagaacacatctatacctccccttttttccctgactcagtagtgccacctagtgggccagtgaagttctggctgccaggctgagctggagctggttttaataagtttggcataatccttggtaaacaaggtttggaggggagtctgctctgagaaccctcttgataatagcacagcaagtaatgacacctgtgttatttgtttttgcctgtgcagagttattgagaaaatccgcagagcacactctcgtagacatggtgcagctgctcttcacaaggtaaacctgctgctgtttgcttcagcccggctgcccaggcctcttgagtctgcctgcttccacacagccacgtcagggacctggccaaccccacagccgcatcagaggccactgggattatggatggggggtagttctctgggcccagggt

SEQ ID NO: 62645 - DNA, 1088 bp, Homo sapiens
gccagttcttcatggaaactgcatggtacccatcagtcttggctaaaaatgtctgttgacaaagatgaaagtcctgccatcccctcaagacttagccttatccgcaggtagaaggcctagagaggctatgtcccaaatcctacctcaatgctgaattagactgggctcttgcttgtgctagtctgtattgaagagattagtcaagttaagaaccaaagggttcttaaactgctaggagaagaatagtggtcaaaagaatggcttctttctatcttgaactgaagccctggacttcacgggcctctgatgaggattccgcttgcagccctaagagggtctacctatggagatgacccttagctgtgtgatgcatgcacctgaccttctcctctcccctgtcatccatccccattcctgccctgttccctgttggtatgtgtctgagtttatttcactgttaaatcgtgcgtttgcctgtctttcgcagatatctccatgtctcctcaacaaactggagctaagtagtggggagcagaccaaagccctgaaccagttagagagggtactactctttaagaacctcaaggtctctctccctctctttcccttcccctttttatttctttcaatgtttattttttatatataacacctgggtcccatttccattgtgtagagcacaacttactcctccctagtaacacagcacggctttggaagagttgcacgtgattgtagctttgcagtgttgggaattctcctggggcatctggttgcctggatacaggagaaggaagacttgaacatcacatagttagcctagaaagcctggggtctgctgttaccttgtggggaggcttaagatctaccatttctagggaaaccgtgagggaccttcaagcaagacccttcccccttctaccttatccttgtctcagagctggcatagagagcttaagcacagtcctcagctctatctggattacctggactgggtttggagggaaagggtagtccatctagttgggatcttttttttttttttttttcttggttaccattaaagaggtcattccaaggattagaac

SEQ ID NO: 62646 - DNA, 1001 bp, Homo sapiens
aattccatgaatacctactgcccaccccacaccttcagaccttaggagagggagaatagctataccttttaagggctgaggcattcgtgagaactggcagcctcttggcccctactccagccagcaggctgagaacactaattgaaatgatcaggttggagcaagctttgcagaagatagagaaggaaacgtgaaaaactgatcctcgtatgggaaggaatctcaatgactgactggcttctcagtggaagtaggactgcctggagtccctgaaatgggggagcctcctggagagaaaggctacctcataaaagtagatccagttcttagtacttttgggagctcaatgataactgccagtagagccaggaggtctctcattgatctcttggcctcttgcccttttgcatgtttggcggactcttctcccataacattttttactatgaacttgatccagttgagctccagtggttcctggggagagaatccttttgcttcctccttagctatagcggtcagtacgcctgaagctcagttctaagcatatgactgcaggcattttggagatggatcatctagaagtataaatccagtatgaggctgttgctatgttactaagagctgggggaaggaagggctcagctgttcagcctcatctttattggaaggagctatgggtaggaatggaagaattgtgtggtttctaagcaaggaatcaaagattacccaggttctgagagcttgggggagcttgaggaagggagtcaatccctcactatcaaaaggaattgaacaggccatggacaataggatatattcagcctttaggaagaggcagagagaaaaagtgcttctgctctctttagagtcattctaatggtttctggaagagtgttgccattgcccaatccaggaatggtccaatccaagaatggtctatcagtctaggaatagtttagaatgactttgtagagggactgagttcaaacccaactgag

SEQ ID NO: 62647 - DNA, 1705 bp, Homo sapiens
aggtcaggagatcgagaccatcctggctagcacggtgaaaccccgtctctactaaaaatacaaaaagaattagccaggcttggtggcgggcgcctgtagtcccagctactcaggagactgaggcaggagaatggcgtgaacccaggaggcggagcttgcagtgagccaagatcacgccactgcactccagcctgggtggcacagtgagactctgtctcaaaaaaaaaaaaaaaaaaaatggggcctaaacaaagtaactttgaacttagaatggaggaaatacataaaaacacagatcctagggaatagttaacaaacaggtgatagagattgtcccttgccactaaaagtaagctataggaagaacagaaatacagcaagaggggagtgcaacagagcaaggagtcaaggaatcagtggccttaccatctgacaacataaaactgcatctggaaagaccaatagtgagagggccagagggacaggtagtctcattgatataacaaattgggagcagcagagagcacagcagcagcgtgacatgaccttctatcctgaactccacaaagaaactgggaggccactccttccttaactccaaggaatgagcttttgaccaatctgatacagaaattccagagagtaagagatatgttagctgggtgcagtggctcacacctgtaatcccagcactttgggaggctggggcaggcagatcacctaaggtcaggagttagagactagcctggccaacatagtgaaaccctgtctctactaaaaatacaaaaattatccaggcgtggtggtccacacctgtaatcccatttactcaggaggctgaggcaggagaatcacttgaacccaggaggcagaggttgcagtgagctgagatcgtgccactgcactccagcctgggtggcaaagctagactccatctcaaaaaaaaaaaaaaaaatatgtttatggcttaggcccagctcacataccagtaagaaaaccaggacaggaaggaataggctcttatagttggataaaactacaagtaggaggctgctctacaagctagttgaggaggaaagccgagagaccatgcacctgtagaactgagtgtcagggcaaaggaaaccctgcccttacactttctgcaagagggtcatgcatcatccatagggctcgggatttcctgcttaatgtaacactcaggacccagagaagcagagtgataagtgtgaggactggccctaccaatgaccagcccagaaacagaatgtcaccttctacatggaggctgccatgccaacctgtgaagtggtaaatgtagaagccaagttagaagagtaggaatgtgaactgatggtctagagtcttactttagcaaagatatggggtatagcttgttttctagagatcagtaggactaaatgaagggagattaatagggatagagtcttagtttgaataccattgctaatggggtatgatatttccagctgaaaatgagagccggaggcatgagtgattcatccaaatggaagaaacagaagagatcccctcggcccccacgccatatgaccaaagtcacaccaggttcagagctgcccactcccaatggaaccaccttatcatctaacctcactggtgagtgccctggactacttcctctgattagacaaaagaagagctcctttctctcttagggattttg

SEQ ID NO: 62648 - DNA, 1050 bp, Homo sapiens
cttgaaaacccacagcatgactcactgtgagagatagctcatgagatttatcaagttatgcatataggtagtacttgacaaaagggaaggagctggccattgctttttctggaaggtaatgatccaaatcctaagcctgtgagaggctctgtgtctctaaggttctagtcattgtaggtcagtgaagcctcaggagatgtttttctgagtccttcatcatactcctacctgagccatcttgcggtgattcataaaccactgagttggccctacatctgtagcccattagagacagcttggaagacagctacttcaggggagtaagttccaagttgctcttgcctcatccctcttcccatatctccctgctactggtcatagcaggaagggacccatgtggaaaagtcccagtcagcatctgtggagtccatccctgaagtgttagaggagtgcacgtcccctgccgaccactctgactctgcctctgtccatgacatggattacgtcaatccccggggcgtgcgctttacacagtcctcccagaaagaaggtgggtattctggtaggctctgccaattcacctcccccatcctacctactaagctgcctgagcctagaccgtcttaaaccaagatattggactactgcctgttgctccaagttctaggctattttctagtcaggaaatggagtcaagccatagactgttggcatggagggagcccttccctaacttatactacagggaggaagtttgatgggcaataggaagcaagaaggaagggaaaaaagcttaggacttttaacagaaaggtaggatcatcaattctgatttcctccagaagtagactagtcccctcatgtccccaggaaaaaaaaaaaaatccttttcctttttttttttttttcctgtcgcccaggctggattgctgcagtggcacaatcacagctcactatatcctcgacttcctgggttcaagcaatcctcccacctcagcctcccaagtatttgagactataggcatgcaccactgcacttggctactttta

SEQ ID NO: 62649 - DNA, 1574 bp, Homo sapiens
ggctggtctcaaactcctggcctcaaacagtcctcccaccttagcctcccaaagcactaggattacaggcatgagccatcacgcccagcccttttcttcaaagagaatcacttacctaaaattgccttgtgtaatgcagagcaggctaggcaaagccagcagactagttgttttatagcagtctcactctcctcctggccttccccaggcacagctttggtcccctatggtcttccctgcatccgcgagctcttccgcttcctcatctccctcaccaatccacacgaccgccataactcagaggttatgattcacatgggactgcatttgctgacagtggcccttgagtcagcccctgtagcccagtgccagaccctcttgggcctcatcaaggatgagatgtgccgtcacttattccaggtaagacaagattgctagagggtctcagagcctctttcaagggccaggggaacacagggaggtctggctgattacgcaaagagtataggacctaggaaagcatctccctcccagttggctagtagttttagtaagagggttccagtagttccccagggactctggcagccagagagaaatataggaatggctagatgtagagttccctggaagcaatggacctcagtgacaccttcactcagtttgcctcttctgcctctcttggttgagccatagtcagcttcagaaacctcacagccgggctgggtgcagtggctcacgcctgtaatcccagcactttgggaggccaaggcgggcggatcacgaggtcaggagattgagaccagcctgaccaatgtggtgaaacccagtctctactaaaaatatcaaattagctgggcatggtgacgtgcgcctgtaatcccagcttcttgggaggctgaggaaggagaatatcttaaacccaggaggcagaggttgcagtgagctgagattgcgccactgcactccagcgtgggcaacagagtgaaactccgcctcaaaaaaaaaaaaaaaaaactcatggcctaccctgctctcatctccagctactcagcatagagcgactaaacctttatgctgcttccctgcgagtatgcttcctactgtttgagagcatgcgagagcacctcaagttccaaatggaggtgagtttcttgatgtggaaagaaaagggggaaaaaaaatagggagatatatggcatcttcagtggggccagctctatcatgctacaggggtaggatttagggacttcctataggagagtccttttagcctccagagttcggttcaatcaactggcctcttttgtggaaaagttaaaaggagaccaaaggaaactggctgaccccaaatatgagaactgccaggtaaccttaccatgaatagggacagctcttctgcccagcagttactctgcaacacaggtaggtaagtcaagccagcattgtcactaaattgctaaaaggaactctaaataggaccaggtcatgttcacatagcacaaaagggcaagaggcaacttgtctgggaccaggtatgtggtagagagccaggccttatcccccaacatgga

SEQ ID NO: 62650 - DNA, 1797 bp, Homo sapiens
gatggtacctctcctctgtactagcactgaccagtgggttggtagtgagggtttaattggccagagaagggcattgacacaggcgggatctttgctttttcagaattgtaatggctccccatttgccaatagcgatgcctgcttttccctggcctatgctgtcatcatgcttaatactgaccagcacaaccacaatgttcgtaaacagaatgcacccatgaccctggaggtaagcttgggtcccagtcaaggcaaagaagacccagcacagcttgggaggtagcaggaaggacataggatttccagtgggcatgatggatggggttctgtccaagggaatcaggaagggctggccaacctagaaaagggactggggtggggaagtgggttttttcgcttaccttttcctaagtcctatttactgaaaacccaggagttccttaggtggggcttcagtgttgacacaaggggaaaaaacttactggcctgtctctaggagtttcgcaaaaatctgaaaggtgtgaatggaggcaaggactttgagcaagacatcctggaggacatgtaccatgccatcaagtgagtatacatagagaatagtgcagtatctctgttaagaagaagcacattgcttcctttcccagtttttagagtcatgtcagactgcagtgactcacatgccctggatttagcctcaggacttagttgggcagccccctctctgccaactgtttcttccttaaagaagcccaaatgatattgggactctagtactctaagccagggtccaaagtgctgctcttaagtaggatatcatggccccattttctgaacttaaaacaggtacattttcctgtatagattacaagatgctggctggtagagaacccaagatgggcactggagtgtgaggcccaggttacaggtcagaaatgggccacttagttttttactgtaaatcagaaaaggtagaattgttcattttatcacacctagtaagaatgtgtgatcttactatagaactaaaggcctcacttacagatagggctttgagattatgggacacttcctttctttctgtctgctcccactggtgggtggaaagcagaccactgagctgcagttctgatgacctctcatcagtggagagtgctagtatggatgaactcctagtcttggtttggaactagtcaggttcaaagcagtgcaactgctccttcccttacctcctgacaggaatgaggaaattgtaatgcctgaggagcagacaggcttggttcgggagaactatgtgtggaatgtgctgcttcatcgaggtgccacccctgagggcatattcctgcgtgtgcctactgccagctatgatcttgacctcttcaccatgacctggggccccactattgctgctctctcttatgtctttgacaaaagccttgaggagacaatcatccagaaagccatctcaggcttcaggtagcccagctttggccttggtcttcacctcccactagctctgtgagctaacatggttttctccatgcctctctgactcctactgttacttcattagaatggggttccccctgagtttttggagggaggctgaagcttgggtaggctcagtcttaaacagaaacaaaattaaaaggtttcttcctgggactgactggggaagagccccatgcaagctcagggacttggaagggctgcttggccttccagtgactctgtttctgggatggggggtaacattacaggaagtgcgccatgatctccgcccactatggcctcagcgat

SEQ ID NO: 62651 - DNA, 1011 bp, Homo sapiens
gggacagtattatttctgtcagggcagggccagtggttggcttcttttccatgcctactttcctgctgctgttccccttcaggctctggtctcagtgacaccagatgaagagacatatgatgaggaagatgctgctttctgcctagagatgctgctaaggattgtgttggagaacaggtaagatgagcgtagtctttaggcagaccccatgctgggcttgtgccaaagggatggaagccatcttgctgagtgggctctggggaactgtaggcagcaggggagaagcttactcatcatacctgtctacttagggtataataccaatgagtcctgaaaggcctaggggacctgttgcccagtggcccctctggctgagactatcttcattcctttatgtctacacagggatcgtgtgggctgtgtgtggcagactgttcgagaccatctataccacctctgtgttcaggcacaagatttctgcttccttgtggagcgggcagtggtggggttgctacgcctggccattcggcttctccggagagaagagatcagtgctcaggtaagcagaatgcatcttggagagtgggcaggtatgcaagggattaaggccacagttgtcaattatgaatatggcctgagacagagagtacatttagtgccccatagcatgagtccagtgaccaaccacagggctggtgcagtctagcgggtggtactgggagtgagcctggaatggcctcaggcatggagcttgtgtttggcacctcagcctcctatgaatctgctttgtaggactggcctgctactgccttataatagtctcagccctatacctggtttcctgtcatgcttatgaccctcttgagatctctttgcttaactacaaaaaacaacaagcatagaactaataagtggattcaacaaggtcacaggatgtgagatcaatacacaaaaagtaattatatctctacatgctaacaatgaacaatatggaaactgaaatttaaaata

SEQ ID NO: 62652 - DNA, 1041 bp, Homo sapiens
acgggaagatcgcttgagcctgggagttcaagaccagcctgggcaacatagcgagaccccatctttccaaaaaagaaaaaaaaaattagccaggtgtggtcacatgcacctgtagtcccagctactccagagactgaggcaggaggatcacttgagcccaggagtttcaggttgcagtgagctgtgattgtgctactgtgctccagcctgggagacagaccaagaccctgtctcaaataatataattaatatatttctatttgaaaaaaaaaaaaaagaccagagcagtatcctaaattgggtcctagccaaactgtcttcactggcctaaggagactggtgggaaagaaaactagacaggaagctgtgtgcccacacagctccccgcttccccgctccctgccctaaccccactccaggtgctgctctccctgcgcattttgctactgatgaagcccagtgtgctatcccgagtcagccaccaggttgcgtatgggctccatgaactcctgaagaccaatgcagccaacatccactcaggtgatgactgggccacactcttcacactgctggagtgcatcggctcaggtgtgaagcctccagctgctctgcaggccacagccagggcagatgcacctgatgccggtaagccctttcccagggagactcaggctggcagataaacagttacaccccaggagttgggacaggaaaacaaaacacaggttactgtgttcagcagattaaacagccctggctcctgccatcacttccagagcttccagtgcccgctggctagtacccataagttaaatagcatgagggcaaataagcaatgcagacggctgtgaagccaggcttcctactgtcctgaggactgatttgtcctgaggactgtttcccagtttctgtttctgagctgtcccgaggactgttttcccagaattctgggaaaatagaattctgtgagcagactttatatcactaaatcgatacatcactaaatcccagaaactgggaaaacagtcctcaggacagtgg

SEQ ID NO: 62653 - DNA, 1060 bp, Homo sapiens
cctgactctgcccttctccctgcctaccataggggcccagtcagatagtgagctcccatcctaccatcagaatgacgtgagcctggatcgagggtacacttccgactcagaggtctacactgaccatggcaggccgggcaagatacaccgatcagccacagatgccgatgtggtcaacagtggttggttagtggtgagtgacaatatgggcagcaattgagtctctcctgcttgacctgtgggaagaattcctggtcctctgcaaggacattcacacaggggccaagcctgtgtccccagctcctctgtgtactttacaggttgggaaggatgacgttgataactccaagccagggcccagccgcccaggcccttcacccctgatcaatcaatacagcctaacagtgggactggatttggggccacacgacactaagtctctgcttaagtgtgtggaatcgctgtccttcattgtgcgtgatgctgcccacatcacacctgacaactttgagctctgcgtcaagactctccggatctttgtggaggccagtctgaatggcggtgggtcagctgatgagggggcagctggggagtagccatgcaattatgcaggggagaggctgagaggggagaaaaggcagggtatctatgcctatatagacacagaaatgtgacctgagtctggctctgctcaggatgcaagtcccaggagaaacgtggcaagagtcacaaatatgacagcaaagggaaccgcttcaagaagaaatccaaagagggatcaatgcttcgccggcctcgaacctccagccaacatgcctctcggggcgggcagagtgatgatgatgaggacgaaggcgtgcctgccagctaccatacggtgtctttacaggtcagtcaggacgtaagtatggcaccctttacttcctctcctcccctgcacctgatactgggagcctggggcggccagggaaagccagggctgaggggaagggcccatgtgtgccagcccaggccctggaccaccatcttcacaatattcccttacccaaaaccttacctg

SEQ ID NO: 62654 - DNA, 1050 bp, Homo sapiens
gagcaagggagtgacaagatagaatccgaaattttgtatctgactgagcctgtagaccaggatgtatggggttggggtgggggcggcactaggaaactacttcttccatctgctaccatttagcccacaaaccgtgagcaaagcctggggctggatgtggttgagccagcggaggcaggcccggggctgtcctggtggagaagggtgtgagggctgcaggtgtgcagcaatggagaggatagtgctggccctacttgctgggaggaagggacagtggtggctctaggctggggagctctgagggaggtgccctgctctgaggaggcacagctacacattgtggaggcctgatctgagacgggagacatggcaggaccctcaggttgagccccccaagccacaaacactgggggagcttttccagggcgagcagaggccagaactgaagcgggggccgcggctccatggccagccccctctgaggtgatcacacctgcagagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagagtatgtggccgagttgcggggggcgggcgtctaggggatggatgggagtgggcctgttccagggccccctgacctgtcttctctccccgcagcacctcggggcaagcggggctggaagagcttccacgggatcctcaagggcatgatcctctacctgcagaaggtgcggggtcaggccagggggctggggctgggactgagttggctggtgggtgtggggtgatgggtgggaataggaggggctgggccaggctgcatttggggccaggacaagatggacacccctgcaggaggagtacaagcctgggaaggccctttcagagacggagctcaagaatgccatcagcatccaccatgccc

SEQ ID NO: 62655 - DNA, 1035 bp, Homo sapiens
tggaaagacagcaggagggctgactaggatttgctgagaggccttacctctcatcctgtccctgtcacctttgttgggcagatgggaaaccatagctctgagggagggggttatactctctggccttaaagataaaggtctagctcatagaccccatgaagctgagggctggagtctcaggataggtgggggtgctggaggcatccagtgtcctacccagggcttgtcctgttcccttcctgcagtggcttggatgaggtcatcttctcctatgtgcttggggtcctggaggacctgggcccctcgggcccatcagaggagaacttcgatatggaggctttcactgagatgatggaggcctatgtgcctggcttcgcccacatccccaggtaggttctggctagggccaggaggaggaaggggctggctgattatggggtgggcagagtcatcctctcactgccctcatcttttcaggggcacaataggggacatgatgcagaagctctcagggcagctgagcgatgccaggaacaaaggtgagtctggggctctgggcacctgagtgattcataatcccgctcccccaactgcctgctccccagagccttggcaaacctgatgctctctttgcctctttaagagaacctgcaaccgcagagctctggtgtccaaggtcaggtgcccatctccccagagcccctgcagcggcccgaaatgctcaaagaagagactaggtcttcggctgctgctgctgcagacacccaagatgaggtactggtagaggagggtaccgatgagggacccagggggctggaaaggggggagtattgcctcttgttaacgtttgtacccttaggcaactggcgctgaggaggagcttctgccaggggtggatgtactcctggaggtgttccctacctgttcggtggagcaggcccagtgggtgctggccaaagctcggggggacttggaagaagctgtgcagatgctggtagagggaaaggaagaggggcctgcagcctgggagggccc

SEQ ID NO: 62656 - DNA, 1675 bp, Homo sapiens
ggacatgcatttactgagaatggccttggaggagtaaagcacttgagagaacattagtttgggacacgctaactgtgagatgcctgtaaaacatacacgtggcagtgttagagaggtagatgtccaagcctgtagctcagaggagactggactagaggactggacatttgggaattgatgacatggcattggtacataaagatgtgggcccagatgagatcttccagagagagagagagcgctgcagtgagaaggagaggcagccttgcatgtgaggaactcccacatttagaggggagcagagaaggggacagagaaagggccttcgaagaaatggccagagaggtagaaggaaaccaggaaagaatggcatctcagaaaccaaagttggagctgctgaaagggcaaatagaaggtgaaatcatgagaaattcccccctttttttttgtagatcaaaaccagacaaaattggcaagctcatatggttcaacctaattagactaaaacctggaaaaagtaactgatgacctcagtctaagaaattttgaggccgggcacggtgactcatggctgtaatcccagcactttgggaggctgaggtgggcgaactgctttgagcccaggagttcgagaccagcctgggtctcgaaccctggactcaaaacatggcaaaactgcatctctactaaaacaaacaaacaaacaacaacaacaaaaaactagtaggtggtgtgtgcctgtagtccagctactccggaggctaaggcaggaggatggcttgagctggggagatggaggttgcagtgagccgagatcataccactgcactccagcctgggtgacagagccagaccctgcctaaaaaaaagaaaaagaagaaattttggtggagattttggagcagaagccagactcaggatagggagaagtggatacaatgcagataagaaggaaagaaggaaatagaattgacagacttggtgattgactggtaggggtgaaagagggcaaaatcaagggtaatccccaggtttcagctttggcagctgagtgagtggtgtcagctgatgaagcagatgtgtgtttggagggggatgtgcgcagatcagtagtctatgatgagtgtgaggtgcgtggaactggtggtgcctcggagccttctgagtgggatgatgagctggcatttggacctatgggtctggagccattcattaccacccatatgctcctgactcccaaacagacttttgggagtcaaaagcatgtagatgggaatggagcatgtcaacaggtatgtattcagcacctagccagtatgggcatttttctaggtgctagggttacactcatgaataagacagagtgtccccctcatccccaccttgctttggagcttccattttatgggggcagacagacaataggcaaataagcacaaaataatgttaatggtagtaagtgctatgtagggttaaggggcatggagaagacttacttgccataggttagtcagggaagggctctctgaggaggtaacatttgagcggagccctgaggagtgactggacgagccatggatgtcccgcaggacacagacaggaggaagctcagcaagtctgagggacagaaggtggggtgggagcaagctagggaggagggactggggaggctgga

SEQ ID NO: 62657 - DNA, 1023 bp, Homo sapiens
agggagctgcatgatgggatctagtatgcctgggctgagccattctgctcttcctcagggcccatgagggctctggcgcaggtggtatgaattcccctggtaggctggggcttctcagtcctgctttccaaagtgacccctgtgctatgagcaactctgttaccactcgggaccaggcaactgtaagcatagaaggtagccctgtcccaacccacttgaaagtcttgatatcctcccttccccagagtagcccctagaatagatgctgaactaggtgacctggatttaaatctgactaccgcagtcaagccaggtgactctgggcaagtcattaaacacactgaacttcatttcttcataggtaaattggggttcaactgtttattgagtgcccacttcatgagagatgctgagtatacactggtgaatgtcagcccggtgtttagtccctgcttcatgagacaactggaagaaacattaaacattgtccaaataataattatggctgtgaaaggtgctgctagtcagaaaacttgcagcctgcatagagagtgtaatatggcagggcccaaatgagttctaggtcaggggtgatgtcccttgaggaagaagggaattattttatttttatttgaaaatatttttcttttcttttttttttttttttgagacaaagtctcactctgtcgtccaggctggagtgcagtggtgcaatctcggctcactgcaacctccgcctcccaggttcatgtcattctcctgcctcagcctcctgagtagctgggactacaggcgcgtgccaccacacccagctaatttttgtatttttagtagagacggggtttcactgtgttagccaagatggtcttgatctcctgacctcgtgatccaaccccctgggtctcccaaagtgctgggattacaggcatgagcctccgtgcctggcctaaaaatatttttctacaaaaagagagatggggtcttgatatgttgccgaggctggtcttaaactcctgagctcaa

SEQ ID NO: 62658 - DNA, 1071 bp, Homo sapiens
gcctgcgttatgggtccagggcctcaggaaccgggcttcacaggggctgggagaagcagtgaagaccttccatgctagaccccttgctgcctccctgagaagttcgctaggactcctttcacactagctcccaggattcctcctcccacatggcctgctctccctccactttaagcacctccccaccccaagggagcagcatagtacttcttaccccactctcacttaaatttgtccacagtgtctctatctagcatctggagggtccaggcctgtgctgcccttgggaagctcccaggctagctgggagcagtgaaggtggggcagttagggttggctgcagaaagggagtcctgcagaatgagatttggagaggcagagggacagatgctctgggctgggagagtggtgtgagcaaagattctgaaatagacaatatagccagccaggcaggagaggagattcagaatataggatggggccacacaatttgcatcgtgagaggtgatgtagtgtggtggttaacagtgagggttctggatccagacagcctgggtgtaaatctgccattaacttgccttgtgaccttgggcaagttacttaacctcatagtgccttcatttcctttcaggtaaaatgtggataatacggccgggcgcggtggttcatgcctgtaatcccagcactttgggagaccgaggcgggtggattgcctgaggtcaggagttcgagaccagtctggccaacatggtgaaaccccgtctctactaaaaaatacaaaataaatttgccaggcatggtggcatgcgactgtaatcccagctactcaggaggctgaggcaggggaattgcttgaaccagggaggtggaggttgcagtgagctgagatcgcaccactgcactccagcctggatggcagagcgagactccgtctcaaaaatacataaataaataaaataaataaaataaaatggggagaataacagtatctacattttagagttattgtaaggattaggtaagttaatacatgtaaaagtgcttaggacaatgcctcgtaagcagaggcaa

SEQ ID NO: 62659 - DNA, 2221 bp, Homo sapiens
cctgaggtgaagctgtcgcctcttctgggacctgtgggggagggagagggagaaggtccccatctcaacaagttgaaagctcatttccagccggaggaggaggatgggcccccaccccccaaccctggtgctagaccctgctgtggggagactgggcaggaagacaagaccccgagagtgaaacaggaaacacagcagacaattcaggggtcagctgcctgttgagaaaagggcacatattatacctttcatgttcatttgttcatttggtattcctgaggataggcagagaatggaattgttttctctgcttcacagatgtaggaatagactcagatagtaagttaaagataatgttcacacctgacccagggctcctgactccaaattatgcctcttcttagcttttacctctgcactaatgtctcttgtacagtctgatacctctcactccaggggcccagttcggcattcttggtttccgccactaaattcatcaacctcccccacccaccataggttggttcagaaatcagggagatgttgctgcttccatccctttctagtctttacctaccaggggcctggtagggtgaaggggaagagttttgacacctgctagagggcttcttccaaacagatctgtcacttccccacccccagcgccccacctgttgtcctcagcatagaatcttgcacaaggtttacaaaacccttcctgatgtggcccctttctcccgcgctgctctgagctctcttcccagattgtttctgtgtctcttagcacagtgctgtgcacccggcgaaagcttaataaatgttcctctgttatgatcactattcttctttgtacctgctgccttgctttagtgtcttactcagagaggcacatcaagcctcccaggctgccccttctctctgactcccacagttaagcagaacacagagctaggaggggcacagtggggtctgaagatgacagttttcctatgactgctgctgctgttccctagggctgaggatgttgttgatattgaccttttaggggccaatcgacccagcagggattgactgagcaagctgagggagcctggtggaggcaaagggcagggatcaagggcgggactaacccagccctgctttttttttttttttttttaagagacggagtctcactctgtcctccaggctggagtgcagtggcgcgatttcggctcactgcaagctcctcctcccgggttcacgctattctgcctcagcctcccgagtaagctggtactacaggcgtgcccgccaccacgcctggctaatttttgtatttttagtagagaggaggtttcatcgtgttagccaggatgatctcgatctcctgacctcgtgattcgcccgcgtcggcctccccaagtgctgggattacaggcgtgagccaccgcgcccggtatcagccctgcttttaagaagcctgtgggctggaggaggggaagggaggcatttggatgcctgataagggggaaaacgggagagaacacgtgattgggtgtgcttgggaaagccgtgacactggatgagcaggatttgataagatgggggcagggtgtgggggggatgatgaagtgagaacgctgttgttttagtcaaaacctgttttgaatcttgactccagcacctactagctttgtaacttgggcctgttatttaatcttcagagccttggtttcttcatgtacagaacgtgaatgcagatagtaacagagctgtaaggggtctgatgatggatataaaagccaagcataccctgtatggctgaggaatagtatatagttatcctagggtatcttaggtgacaggaacagcatgaacaaaagtgtggaggtggcatttagaaaggaatttgatggatggcagacaagaggggctaggatattccaggtggcaaaaggcataaagcttgggtgctggaaagacaatttcaatcatggatttggcagaaaggtcaatgatttttatttttgattgatgttgccccagctggtctctaacttctggccccaagtaatccttctgtcttggccttcccaagtcctaaaattacaggcatgagccacaacgccccacctagtgactgatctttaaagatcatgaaaccacacggtggctctcgcctgtgagccagcacttcaggaggccaaggcgggcggattgcttgaggtcaggagttcaa

SEQ ID NO: 62660 - DNA, 1008 bp, Homo sapiens
tgtttgggttggagaggtggccttggacgtacacttgcctggctcggcaggggaagagatctaccctggcttggcttggttggcccctctggactgtggactgcaaacaccctctgctgcttctggaagattcctttgccccatccctgcttgagcccgtcatcacccccaaccttgagaagtgggcatcccataccctttggccatcagcccaacaggctaataagggggtggaaattggggcagaggaggagagtgtacccactggtgagttgtgcttcctaagttgcagactggggacttaggggacagtggcaccaccctgttgtgagtcccacaccctgggcctccatccctcccctggggcctgggcaaggggaacttcagcctgccaagtctgacacggcatctcccaacaactctcctttccccggcaggtcaggcgccgggctctcctcaagggctgtggtgctggcccgggtgcaggccctgggctggcatgggccgctgctggcgctgtcgttcctggcgttctgggtgccctgggccccagctggcctgcagttcttgctgtgcctgtgcctctatgatggcttcctgacgctcgtggacctgcaccaccatgccttgctggccgacctggccctctcagcccacgaccgcacccacctcaacttctactgctccctcttcagcgcggccggctccctctctgtctttgcatcctatgccttttggaacaaggaggatttctcctccttccgcgctttctgcgtgacactggctgtcagctctgggctgggctttctgggggccacacagctgctgaggcggcgggttgaggcggcccgaaaggacccagggtgctcaggcctggttgtggatagcgggtgagtggccagccccggctcttcaggtcctcaccagcaaccttctaagtctgatttcggtgctgggtccccggctgatgggggctgccctgggatgtgttgggggataactctggcc

SEQ ID NO: 62661 - DNA, 1019 bp, Homo sapiens
atccgtaaagtggggatgataatagtactcaccttaaggggctgtgaagatgaactaagacagtgaagctcttagcacagagcccagtgcatcgctagtgtacaggaatgcagtcggctgtgaagctgatggcgctcactggcactgcagcagtgcccttgacaaggtggctccccgtcttcctccccaggcctctcctatgtcgctccccatctcaacaacctctacttcctgtccctgtgccggcgctggggcgtctacgcggtggtgcgggggctcttcctgctcaagctgggacttagcctgctcatgttgttggccggcccggaccacctcagcctgctgtgcctcttcattgccaggtatgcccctgcccacgctccccgcaacacctccatcccatgccttcattcctgcctgctctctccctctactgcagcaaccgcgtcttcactgagggcacctgtaagctgctgaccttggtggtcactgacctggtagacgaggacctggtgctgaaccaccgcaagcaggcagcctcggcactcctctttggcatggttgccttggtgaccaagccaggccagacctttgccccgctgctgggcacctggctgctctgtttctacacaggtgagggcctggtagcaggcaagggctcttaaggctccagggggcacagcttacctggcacagtggctggcaagcctgggctctgggtccagtgacggaaggtggcaactggcgtcccctcaacatggctagagtcactgggtcaccgattccgccatgctttcttagttcattcatttattcattcattcaacaaatatgtacggaatcccttctctgcaggtcctgctgtgggtgccagggagctaaccatgaataagatagacaaagtctttgccaccacggagcttgtattctagtcaggggtgggctggggttggcaataaacatccaaacaagacattatcaggcagtaatagtgttatggtgaaattaaggtgatgtga

SEQ ID NO: 62662 - DNA, 2591 bp, Homo sapiens
ctggaaaatgccagagcgagaaggaaatataggagcctcccctcactagtttccaggaggcctatctttgttcctttaagcccttgacatgtagagtctgtcttgagcctggccttcatagccacccagttactaagtgacgtgcagaggggcgtcttccattcccactcccaaagggaccttggtcccagctccgacctcttcagctggccctcctacctgcagattggtccttcccgattccgggcccctgagttgctcttcaggccagatttgattggagaggagagtgaaggcatccacgaggtcctggtgttcgccattcagaagtcagacatggacctgcggcgcacgcttttctctaacattgtcctctcaggaggctctaccctgttcaaaggtttgtctcttctcttggagcccttcccctggaagtgttcagctcctgctggctccaggcaccctgagaattgacttgaagttctcctctttgcccattcaggttttggtgacaggctcctgagtgaagtgaagaaactagctccaaaagatgtgaagatcagggtaggagcatggtggggcctggcctgggtggaactaggcttccatggacagagtgccacctggcgtagcttccctctagctttgcccaagctcttcaagcagccatggctctacaagcagcgccaggttcccagcctgtacactgaccctgaggtctaggtcagccacagggaggctgagttctcattctccctcttcacaccaaaggcaggcagttctaatacccagatgaggcagggtactaggtagagggccccctgcgtgatctttcagggaaactataatcttaagaggagactgacttactgttgctgtgccccctgcccaggtggctcccctgtcacacagtctgacaccttagtgataggtgaaggaggttggctgtctgaggagagcggggatcctaaaggaaggagtacagttcttgccatggagtctgcttctccctgccccccccaatagtcccagcttccctgggacctgtggggactggaaacctgcttccccagatgagtggcaggctggccacagtgccctccagagaggccagagcttcaggcttgtgtaaaatgtatcccctgccatgggcagaaagaggagcattgtagggaaagggagcgggagggctggaagtctcagattcctctttcccccacctttgcagatatctgcacctcaggagagactgtattccacgtggattgggtgagtagctcttccaggagtaagaacagaacaggaagtgatggcactgataacccctcagcaccctctaaagaaaagcctgatttggtttggccccaggggactggtaggctccacacacagccacttctctctcacacagttcctctgggtttcctccctccaggggctccatccttgcctccctggacacctttaagaagatgtgggtctccaaaaaggaatatgaggaagacggtgcccgatccatccacagaaaaaccttctaatgtcgggacatcatcttcacctctctctgaagttaactccactttaaaactcgctttcttgagtcggagtgtttgcgaggaactgcctgtgtgtgagtgcgtgtgtggatatgagtgtgtgtgcacatgcgagtgccgtgtggccctgggaccctgggcccagaaaggacgatgaactacctgcagtggtgatggcctgaggcctggggttgaccactaactggctcctgacagggaagagcgctggcagaggctgtgctccctcctcaggtggcctctggctggctgtgggggactccgtttactaccacagggagacagagggaggtaagccatcccccgggagaccttgctgctgaccatcctaggctgggctggccccaccctcacccccacccccagggtgccctgaggccccaggcagctgctgcctccactatcgatgcctcctgactgcacactgaggactgggactggggttgagttctgtctggttttgttgccattttggtttgggaggctggaaaagcaccccaagagctattacagagactggagtcaggagagagcaggaggccctcatgttcaccagggaacaggaccacaccggccactggaggagggcaggagcagtcctcactctgaatggctgcagagttaatgttcccagcccagtcccctttcgggggccttgggagagtttaaggcacctgctggttccaggacctcgctttccatctgttcttgttgcaatgccatcttcaaaccgttttatttattgaagtgtttgttcagttaggggctggagagagggagcttgctgcctcctgccttgctacactaatgtttacagcacctaagcttagcctccagggccccacctctcccagctgatggtgagctgacagtgtccacaggttccaggaccatttgagattggaagctacactcaaagacactcccaccaggctctttctcccttttcctcttgctcactgccctggaatcaacaggctggttgctggttagattttctgaaacaggaggtaaaat

SEQ ID NO: 62663 - DNA, 1017 bp, Homo sapiens
acactcccaacacagggaggggaggcggggcctattgtcaagtcacaccttccctgcctgtgactggcacagacattagccaatgggtgcttggatagggtgcgccggcgccccgccccccttagcgccccgccgccccgaggcaccctctggcagactcggcggcggcgacagcctgggcggacagtgcgccgtgcgcaggcgcggagctagacctcgctgcagcccccatcgcctcggggagtctcacccaccgagtccgcccgctggcccgtcagtgctctccccgtcgtttgccctctccagttcccccagtgcctgccctacgcaccccgatggcggagctgcggcctagcggcgcccccggccccaccgcgcccccggcccctggcccgactgcccccccggccttcgcttcgctctttcccccgggactgcacgccatctacggagagtgccgccgcctttaccctgaccagccgaacccgctccaggttaccgctatcgtcaagtactggtatgctctgggccgcggggagacggacaggcgcgggctggaaagggttaaagcgccgagggcgaagtaatttgtgggaggtgggaggaggggtagagaatggttaaagcactcagaaggagggcttcttgctgcgagggaaggagttaaggctcaagttgggaatggggacaaaggggttaacggagcccgtgggtactgaggggttaaccgggattaggagaatagagtgaggactgggggtgtgtgtaggagcagaggggggaacggcaggagcgagggaactgtaaacgtggtgaaaagagggggcgcctgtagggggtcattagtgggcgaggggaagccaagcgggggcggccgaagtgggatgggagaggcgaggcggggcctggggagcatttgagagggctttggaggagcgaagccgaagaagctcagagggcacgagactgcatagaatggggggttcggggggcccagggctctcctgtggtgggtag

SEQ ID NO: 62664 - DNA, 1007 bp, Homo sapiens
agggcacaatatagtctttcaggaattagctgtctaagaggctggagtggagcagagcctctgcttccaggaacaatgcccattggggatgcttgggatggtctttcaacagaggccaattgattgactgatgtacctcttgccttgaagcttggcatgtatacaggcaccacagaagagagacaatccctgccaatctcatttgggatcggtaatttgaaacaggagaaagcaaaatgggtaaccatccagtctgttttatttctaaaagaggcccagtctttcaggggtaggagaagggagcctcttgggcttgcagagttgggcagccttagctgtccatcccttagtctcattctggagagatgtggcctctgtttagttacctttcacccaggttcctccaggatgggtcctttaggtttacaaagtagagcgccttagcttgacattgtctgatttccaggcttacactaacacccctgtgttttgttttttgcaggttgggtggcccagaccccttggactatgttagcatgtacaggaatgtggggagcccttctgctaacatccccgagcactggcactacatcagcttcggcctgagtgatctctatggtgacaacagagtccatgagtgagtatatgccacctgttctttatccagagccttattcctgaggtcttcctgagcaggggtgacaatgtcatagtgctgtgagcatggtacttctccgtggaacctctgcatttctgccctctgactatatctactcatgccaaggtggtcctcgttaacacctgattcctgcttatctagtgcaggaaagtcttgatgagcaggattcccaaatcaggtttttctaagcttgccctggagtttgggctcataggacaggaaggtagcatggttatgactcagaacttgggctgatgcctctgtgtctacttccttttattcccctagcttattatgaaacattttaaacataaagcaaagttggaag

SEQ ID NO: 62665 - DNA, 1027 bp, Homo sapiens
ccagacgttaatctgctccgtagattgtcatcgttgggacacagttctgggcatgaggcttgtagtaacaagcaacataaacctggtcctggtcctcattgggctgaagggtccttgagctagaagacattgtggggaggtgggcctgatacagtttcacagccttaggttatcacctggtgcctctttgtctcctcttcagcagtccatggcttgaggcctagtggagggctcttggcaagcaggagtcctgaggctcagaaatgatgtgaccaggcctgagtttgaggctgagacagttgtccatttgtcagcgagatcatagcttcacagcagcttctcagagaggtatggttcactggactccaggcccctagcatgttagtaaaagatagtggccctcacagatccctttccttcctactcctatgttactcagtctcttggagtccctggtcatagaatcagcttagccacaggaaggccaatcaaagagatgtcttgtttttctagtactaaccctcatgtgatacctggggcctcttggagccctgcctccgaccaccagtttctcttactctgacctcaggcctttcaacatgatgtcaggctgcccacggccatggctgtagggaagagtaactgctagagaatgggacttggcccaggctaccagtcccaggggggtcgagctggctggctgtgcttttggcctgtgatggatttgactcttcaaggcttctgacaaagcttggttggttagaggaaaaatgtagtgaaaacctacaggcaacaccatggcttgccctaaccctctcgtcttcctgttctagcttttcccatatatcaggttgcagacatgctgaattcccaccctcctggagccaagctgccaatttctcattcctgtaaccagtggttttgtgtagataaaaggcccagaaggaagatggtcgctgagcagggagccttcggagttagaccttctttagccagggccagtggacactcatctcatgaatcatgc

SEQ ID NO: 62666 - DNA, 1075 bp, Homo sapiens
ccagcctgggcaacatggggagaccctgtctcttaaaaaaatgaaagtaaagcagggcgccaagtgtggtgactcatgcctctaatcccagcactttgggaggccacgggggggtggatcacttgagccaggagttcgagagcagcctgggcaatgtggtgaaaccccatctctacaaaaaatacaaaaattagtcaggcatggtggtgcgtgcctgtagtcccagctacttgggaggctgaggtgggaggatcgcttgagcccaggaggcagaggctgcagtgagccaagatcgtgccactgcactccagcctaggtgacagagtgagaccctgtcttaaaaaaataaataaaattaaaaaagcagggatggtactctggagcttacatgggtagaagtagtggttgaggtgggtggggaggatgctgttagcagtaatcagtgatggcttccttgaagatttgaactgagacctcaaagaccggtggcagccagggctgtcacattgtacaactctagggccaccgttcacattattctgtgcaattgctgccccctggagttgtacaatgctgggagtcctgatgaaggtcctaggcagtgaaacagctagtataaaggccctgagggcagcacggacctcgaagtgtttaaggaaaagaaagaaggccagtgcatctgaggcttggtaagagagaacagtggaacaagatgaggttgcagagtttgaagacaatgtaaagaatgtgacattcaataaattataattattattattgtttttttttttttttttttttgagatggagtctcgctctgtcgcccaggctggagtgcagtggcagtggtgcgatctcagctcactgcaagctccgccttctggtgtcatgccattctcctgcctcagcctcccaagtagctgggaccacaggcacccaccaccacgcctggctaactttttgtatttttagtagagacagggtttcaccgtgttagccaggatggtctcgatctcctgaccttgtgatccgcccaccttggcctcccagagtgctgggattacaggcgtgagcc

SEQ ID NO: 62667 - DNA, 1024 bp, Homo sapiens
tcggcctcccaaagtgctgggattacaggtttgagctagtgcgcctggcccataactgcctttcttatgggcttctcttgaagcaggagccacagacagctaataatgttacctgcctggtgtctggctccttctactcccctgaccaaatgcaggtcattgccatctctaaacctgccatgcttctgtaaaatatctggtaggccacaggcagttgccgggagttccatgtgttagagcaagagaaaggtggcagatggacatgtagccagcagcccctgagttcttcactgtagacttgtgagttcttgggcataaatcctcttcattcacagatgatgctcctctgttttcctagtgcctttaacactgaacatttcaaactgctgccaggatcctctgttctctctgctttaaacttggtttccttgtatcttctgcatatgcaagaaccaggaaccaggaaggctatctttccctaagcccttgttctgtagccacactgggatccagcatggggcactgtgggccgttgtttggcccctgtcataagtgccaagtactaagaaagaacctggtcctttgcactagtagggtaaacagctgtccttccatgccaagggctgttcttcctagtctgcaggatcccctgagagcagcccacaggacccggagcacctagtggtctttgaaagcaagccagggtcccacaggaacaaaggacagctttctttcctggtggctctgtgcaccaagtgtgaactcctctgtattcactgtgcctttctggggcctgcttgctatcagtctctttagagctggcatatattcctgtgattcaagctctacactaaccagctgtgtgcccaaataagtccctcgccttctgggtcttaactttttctttttacttataaagtaaatagcccagacaagttgagccaagaattgtctgtctgcaactctttacctaagtgagggaccccagggcagccagtgcagaggaaaaagctcagactatccc

SEQ ID NO: 62668 - DNA, 1039 bp, Homo sapiens
aggtgccggggttgtctccccttcctgaaggtttagtgcccagtaaggtctctaaagcaccaggacctgtagtctgaggggaatagaatgtttcctctgaggctgtcagtattggttaccaatttgttagcaattggttgagaaatggtttctcctcctcctttgccaagaacattctccaacacacccctcaagcctgtcagactcaagtttcctgttatctcaggatcgatgatgatggactcagttcagatcagtgagcgtgacggtaatatctgtgctgcccactctgggacctgaccccatttcacatacaccacatggattgcaactgagaaagctgacccaaaatgtgctggcaccagtgtttgctcctctccctgttggggggcagccagcgtgggccatattttgtctgcgggtctgatttccccttagtcaggacttctgggccagggagctcttatgcatgggtcttcgcgggtttgtctgtggtctaaggaagatacagagctaaatcagaggctcagagcagctgatcaagcctgggcaatagcagccgggtgccggcctacttgggggtgtcaagcacttgctcttttcacacttcagcagcagctaaaaccttattagtgctcattctgtgctaggtaatgtgccagctactatgtgctgccattcatttatcttatcctcatagccatcctgtggtcgataatcttacatattcccctttaatggatgaggtacagagaggctaataagtatcttttccaaggttggaaaggggtagagcttagttacagccatctatcagccattaaaatggatgtaatcttccttaccccattctcagggaccccatgggggacacatcagactgtgtctctgagaaaataatgacctttactggtagaattcatctaactagttgcagcatgaatcaggacctctcacatggcaccaaggacaaggccaaagcctcatattagaagcttattgggcttatttaactaaactctaggggagttaaataact

SEQ ID NO: 62669 - DNA, 1050 bp, Homo sapiens
aaaatactgcattttgtcatttggttattggtgtttactattcaccttttgtggccttttactcctatattgtccttataagaaaatttgtcagaataaccaggttatacagccttgtgcttaataagaacttcagaggtgagctggtcccctctccctcgatcccacagccacacccttttccagttctgccttaaagggagacctgcaggtggttctttctctggaaagttcagagctttcgtcagcaatcagaaagcaaaaggaagaatctcccaggcaaggggcagaagccagaggttgggctgggctcagcaggccaaatccacttcacttgtgaatagttgccaagcttgatgccctggttcctgttcctgggcatccccaaggagaaggccccaagtcgtgtgtccactgcagacgtcatgactcacaggactgggattgtggctaaaaggagtctcaatggttcagctcctctcctttccacccatgctgccactgactgaatgggaccaatgccctttaggcgaatgtgaaaaattaagacttttccgttcagagagaccagggtggaggggaagcatggttgagactctgttggtctgttatgtgtaggtagggtgatcaaggcatgtactatgaactgtacactgctagaaatcaggaatctaccttgacactggaaggagagggtatattaggatctataaaaagtcaccttatgcagtgagaaatacaagtatagaatgtgttatatagacaggtggttaaagatgaaatagatcagtttagatcaattgcacctctaagccatcccataaaccaccccttggtgtggtgctctcaatatagaaggaatcctgggctggtcctcgcggctgagtgggcagtttttattgcgcatcaccttgtgccaggccttgcgtcgtgggatgcccttgttcctgtcttgtgacttagaacactgagacttagccaggttgtagaacttatctagcatcagactgcagggattaagtgtcagccaggatttgaacctgagtggtg

SEQ ID NO: 62670 - DNA, 1598 bp, Homo sapiens
ctcacagaacagtgacagggaagaagaacttgcacacttggggactccccactgtccccagcacctgggagtgagtttgaagggtaactagccttggccagccaccctgggcagcagacagagagcaaatggccagaatgaacaggacctggaggggcccactgccatcccacagccacatcctccccagccacttctctggcccaggcccagggcctttcaactggtgaagggttaattggaggcagcctgagaaggcagagggcaggttccacttcctttgctgatgagtggctctgcccattagctgcccctgcctgcccctcccccaggtgtatttccagactagggattaacagtaacttctgtggctccctgagtgaccccacttggcttcagcttgcttgcttgctttttttttaaagatgtgctgtggcctttgggccagccacttgaatgttatgggaaagcccaggagcaggtggaagattctgccctggacactgaagggtcccactgcggaggcactatcccatcgtcccagggaaacttgtctagacgctacttcacctccgtcccctaaggggggatgtgacccccctcttacctctgggcatgaccttcagcacattgctaccttccctctctgccctcaattttcctaagggaggtgagctccaggatctctgcagggcttttgaactcagtgttttctgctagctttgagcactttggaaggatgatgttagagaacttgtgagaggagcttctctttgaaggtgttgaaatgagcgtgtttggatacagtcccctgttgatgggcaggtgggcagccaggagggcatgttacctggcccgcggaccatagtccccactgtcccagagccttggccaggcctgctgtgcttggaactgtttccaagcccagctcctcactgtctccatgttcccatctccaggggcaggctcctgcatggacggcactttacatataaaagtatcacaggtgacatggccatcacgtttgtctccacgggagtggaaggcgcctttgccactgaggagcatccttacgcggctcatggaccctggttacaagtgagaaggccctttttcttctccctccttcctttcatagacttccttgcccacccctcctcttctcccttggcagctcttgatggcaccccttcctggggggctggtcatgaatgcctcatggattcagggcctggggcctgtgtgtaggtatggagtgtggatgctgctacccactccagcagcttaggagcacttcctgaccttctccccctgtcacctgagacacaagtgttaactctccaggccctggctcttggtaattctggttccccgtggaaatccaggttggagggatataagactttctgcaccttgggtaaaccaaggtacaagaactcaaggatgaagcaagatgggaggatgtgtggaggccactctccaatggctacatggaaatcccaccagaattcagacagtggcatgtgtgcctggaccagggctgggcaggcctcagtgggaagagcctccccttcttagcctacccccatctgacagcc

SEQ ID NO: 62671 - DNA, 1052 bp, Homo sapiens
ttggatgtaccttccagggcacttccagattccagatagggcttgtattccaaatccaaacagtttccttttgtccttctacggtgaggggcagagggggacactagagcctgactgggcagcagctttaatttaattttttttccttttaatttttcttttctgttcctttttcttcctgagattcctttttaccggccccaccagtgttcatctcccttctgggagcagcattcccagctctcccagtgtcctccctcccctccccattgtcccctgacccctttccttctatgcctcagtctgatattgcagggaggtgagggtgtggggggaatgacagctggggacaggcctcaaacacttccctgtgtcccttgaacagatcacagtgagctcatctctcctccatggtcagaagagaggtataacgcttggtggttggcaaaaagatcatacatttaaaaataataataaaagcctgccttgtgccttcacagattctgttgaccgaagagtttgtagagaaaatgttggaggatttagaagatttgacttctccagaggaagtaagcttgtttgacttttcctgacaacaggtcccgtctctgggaccatgtgtgtgcgtgcgtgtgcacgtctgtgcatgcatgtgtgcgtgtgtacctgtggtgcgtgtgtgcttgcatgtatctgtgtggctgcatctgtgggctcctccccaaggtgcagggataggctggagaggagactgtagatttctcttctgtttctatgcaccctcaccatcccctgccctacccccagcccttgtaaggacacccagcaaatcgtctgaattgccagctcctgagagcctcattgaagaggaagccagggccttcaggctagtacgagttctccccagcccctgctgttccctggcagattctgaacagaacgcccatgtctgttgccagagaacattccgctggggagttctggtgggcagcaagggactcctgctctcgcctcgggccacccaggagccactctcccttcttcgtcctcca

SEQ ID NO: 62672 - DNA, 2257 bp, Homo sapiens
cgccgccgcggagcccaagatggctgggcgctgagggtggcggctcggcctggccccgccgccgcaggctggctccgaccgcagccccgagccttccaggccccagcagaggccgagaagaaaagaaagtggggaggagggggccgggggggcgaagggggagggccgggggaggggaggggagggccgggagccgagcctcctgttcattagcagttgagaaaaattcctttctagtttgatcaatccttgttttcctcggcagagcccgggcgcccgcccagcgcggagacgggcgcgcggggtctctccgcggcgggggcgccgggcctcgggggagcgcagaagtagccgcccgggggtcaggccggagcgccgccggggcttctccctccctccctcgccggttgcctttttttccacttctctccctcccccttccgtttctatttgtgaagggaggaggaaggcagaggcgggctggtgtctctggccggggactggaatttcatctgaatgactgcccctgcgcgcacgcagcgccccggagtcggcccgcccgcgccccgcagcccgcgcccggccagccagccgggggacgcctgcaccgtggcccggggaccgccggcctgcccctcccgccccgtccggatctagcagccctcggcgcggccgccctcgcctcctggccccgcagaccccgggctccggcccctgcgagggaggtgcggcgccgacgagccaggcaggagccgccgctgccgccgccgccggaagaagtgtgctgctcccaagctccgtctgccgcggggcgcgccccaatgtcagccgcggggacgagcgcaggccgcgggccgccactgccctagccgcgccgacggggaggcggcctcttatatggaatttggaccccggcgctcccctccaaggctggagtcccggccgcggccctggcgcagtccgccgcctcccgctaggcgctcgggaggaggaggagacgcagcccgctgcgcgcgcggcgtgaggaccgcggctccctcctccggggggcgggcacgcggaaggcgctgctgactgagcgaccgtcggggccggctggggccggagctcggggctcggtgggcctacagcggctccggacggacccccggggctggggagtcggggaggcctgccccggccccctgcccgcggccgccatggcggagaattggaagaactgcttcgaggaggagctcatctgccctatctgcctgcacgttttcgtggagccagtgcagctgccgtgcaaacacaacttctgccggggctgcatcggcgaggcgtgggccaaggacagcggcctcgtacgctgcccagagtgcaaccaggcctacaaccagaagccgggcctggagaagaacctgaagctcaccaacatcgtggagaagttcaatgccctgcacgtggagaagccgccggcggcgctgcactgcgtgttctgccgccgcggccccccgctgcccgcgcagaaggtctgcctgcgctgcgaggcgccctgctgccagtcccacgtgcagacgcacctgcagcagccctccaccgcccgcgggcacctcctggtggaggcggacgacgtgcgggcctggagctgcccgcagcacaacgcctaccgcctctaccactgcgaggccgagcaggtggccgtgtgccagtactgctgctactacagcggcgcgcatcagggacactcggtgtgcgacgtggagatccgaaggaatgaaatccgggcaagtaccctacgcgcgcgcgcgcacacacacacacacagacacacagtcccttcctctctcccgccccgggaccacccatcccgacaggctgactcttgtgacatcaggccagtggcccctggccaaactcttctctgaaagtttggggacagggtcctgggaagaagggccccgggtcgctacttggtacattctcgcacctgtgcgcacagggtccgtcttctgagtgctttatgggattggggtgtgggaccgtcaggggtagagtctgggtgttgcttttctgtggtgcgcagctccctcccccagtcttgttgctgtaggccctacgggaagtcaccgaggcagtgaccccggtcctgcctctccagctgctgtttatgtaatgagtgtcccggtgccgctgctgtggctgacatgatccatgatgctggcataccaatgaggaagtaaacaaaagcagccatgttagttttcagcgctat

SEQ ID NO: 62673 - DNA, 1002 bp, Homo sapiens
ccttggggcctggggcctgggtgtgatatctgggggctaggctgcactctggtgggactgggagtgtctctgggtggggatccctggaggttagtggaggccagtgcggaggctggctatgaggaagctctgttcagggcatgattggagatggggctgtttcctgtgtggggggaccagtcagaatgagtcactgtttagcaattaaaaaacatacacatacaaccaacaaaaggcaggagggccaccacaggctggggcgggggcagcaaatacgatttgctgtataattagtttccaatcggatggactagccctgggtttgtgtgccaggataggcctctggtttcttaaaggaagtgtgtcctccaccccctgtgtcctccatccccgttcagggcaggcacagcccacactttccccagtattgggaagctgctgctattaataaagatggaagggctgggggaggaggccgggaaaagtgcagaggcaggagaaaggagggctgtccagttctgtcctgggattggcagtggaaaatgagaggaggggaaaggagatgtggctgaaaggaacaggggaggggcagcaacctgggcgatgggcggatgcctgcccgcacccacagtgctgctgtagctggtctgagttctagggatgtctttaattggggtgggggagaaaacgtcattatacctgacttggtgtaggaggatagctttaggtgtctgtgtttttgaatgtctttgagactgtgtgcttcgccctccaatgcacctgtctcctgtctctacagttcagggcacaggcaggggtgggtgggtggcatgtgcatgcagagtattccctggggtgccccccagcaggcccctcatttccagactcgtggattggatggaagcaggcactgaactttgtcggcaactccgcagggtgtgtgtgtgcgtgtgtgcgtgtgtgtgcgtgcgcgtgcatgcgcgtgctttcttgtgcctggtg

SEQ ID NO: 62674 - DNA, 1031 bp, Homo sapiens
agcaggccagaccagtgcagccccccggactcctccctggctggcaccccctggccagcctccttcctcttcctgctctcactccaacccctgcagcagagacaggagcccagtggcctcagcagcaggagggggaaatgaaaccctcccacctgctagggactgtgtggcctgggctggtgtcccacccagattgcctgggacagacagaagcttgggaagaccctgccggctcccagggtagaagtgctgtcaggggaggctgaggaaagcccggaagaagagggaaggggctgagccccacccccccaggactggacaggaaggccctccctctgctgtgccctgaggggtcactccctgggcatcagcaagggatggggcaaaggggcacccaccagcctgcggggtgggtgtggacagctcagttcctgtccccaaggaagctgcgctgggaccttggagctgcctctttcctacccctcccctgggactcacctgaatcctccctgaaccagctcctggtgggtttggtcgtggagaagcagccatgcagtaagcctgtggtgtgagatgtgtggggccagcagggcctttcagatgtcctgggcactggatggagggatcagcctggactctgaagagcacctggggggccctgtcctcctgagggtgggcttggggcaaccagcaggcaagaatttgagggccaattgttccaggggaggtcagtgggcctgatgttcccagagtgtcctggccacctcgccatcgtgccaggcctcttgccattgtctggggcctccaggaggtccagccttccctgtgagggggttgggtcaagtgcctttgcacctctggctgtgcccgccagcatacctgaggcgggctcggggctcaggtggcaaggtattcccatgtgcgtgcgcagctttgtgccaggtgcccctgcgcctgcccactcatgctgtgtgtgctgtcgggctctgacccttgggctggcagcagattcctgtgcctcttggtgcttc

SEQ ID NO: 62675 - DNA, 1036 bp, Homo sapiens
tatcaggccaggcgtggtggctcacgcctgtaatcccagcactttgggaggctgaggcaggcggatcacctgaggtcaggagttcgagaccagcctggccaacatggtgaaacctcgttgctactaaaaaaaatacaaaaaattagccaggcgtggtggtgggcatctgtaatcccagctactcgggaggctgaggcaggagaatcgcttgaacccaggaggtggaggttgcagtgagccaaggttgtgccatcgcattccagcctgggcaagaagagcgaaactccatctcaaaaaaaaaaaaaaaattaaaattctgtggcatattagggacaagtcccccaaatcaaggaaaaagaagcaaaaccaagaaatgggcgagtgagcatttagtgttcctctggaggctgactcaggcacggatcacagctcggcgctcggactgctcatggccccttttgtggacacaaggcaactgaaagcctatgtgacctgctcatggctcctgtctccaggaggaggagaggaacgtggggcagacatcacaagaaaaggtgagcatgagggggtggcctggagagcagcacccagggcacgatctgctggcttaaggttatgggaggaggcaagtctccgtggtgaccatggctagaggtcaggttaaaacttcggatctctgctttgagaggaaattcaaagccagtatcattttaattacacataccacacacacatgcacactcagagtattttagagagaaaatgtcttcaaatgcctggaactgtaacagcagaaagagctgtggtttggggttcaagttcaggtctgtgggtggaggagggatggatttctcgatacctttctctggctctaagccagatcctttgttcactattttctagacacccaaggagggaaaaaaaagactgagagtcccagtgcagaatgtttcatcctaggaggggccctggcaacctgggcctgacctcgagggcgcagagtgacacttcctccatgttgataatggagtctggc

SEQ ID NO: 62676 - DNA, 1364 bp, Homo sapiens
gctcgcctggaccagggagtggagaaagcctgcccacgtggctggcgggagcctcccggcctgggattggtcgaaaaggaggggcgtggggcgggcgtgggggcagttccccagcccaggtcctcctctcacccgggccagttttcaaggcgggctgtaactggtggcatttgtcccgggaccaggtaaggggccttgggacaatggcgctcgccctgtctacctccaatccccacatctcgggtgggtgctgagattgctgtcctgactgcccaggcggggctgcagcgcgggctggacttccacctgcagaagccacgtggcgcgaagtgcgccctggggctgcagatgggcccctctgctctgacccccattgcctaggagtgccaggccgagcggctggggcgttacgagctgtccgggatgggggagtaccgatggggggaggccgtctgtcggagggcaagaagcagcctgggggctggccctgagccctgaggtgagctgaaagcacaggtgaaaggcgttttggggatcggcccggtttttgttttgacacagggtgtcgctctgtcgcccgggccggagtgcggtggcgcgatctcggctcactgcagcctttgcctcacaggcttaagcgattctcccgcctcagactctcgagtagctgggattgcaggcgggcgccaccacgcctggataattttttgtattttgtttttgtagagacggagtttcgccatgttgcccaggctgggctcgaactcctggggtcaagccatccgcccgcctaggcctcccaaagtgctgagactacaggtgttccaaagtggtgagccactgtgcccagcctctggccggttttgctaagctgctttggacaggaccgcgtaccatctgtagtcctggaggaggcaaaaatgagcctgcatttttagccaaggaagagcaagtgggacactggggtgggttgggaagtgctacctcccatccctttcccgatgcagaggactataagaagagtttacacaaacgtgctaggccctgttctagacgctggagacacagcagtggacaaaatcagcccgtatggaaattacatccttcctaatgaaatacatttcataccaaatttcattttcacaacccctagaaattggtaattgcggccaggcgcagtggctcatgcctataatcccagcactttgagaggtggaaggggaggaaggcttgagcccaggagttggagaccagcccgggcaacacagtaggaccctgcctctacaaaaaaaaattttttttaattagccaggttccgtggcgcacttgtagtcctagctactcgggaggttgaggctggagga

SEQ ID NO: 62677 - DNA, 1080 bp, Homo sapiens
tttatctattctggatattttatataaacgggatcctacaatatgtggtctttgtgcctggctcctttcacttagcgtaatgtttataaggcccatccacatcgtagcatgtactagtacttcattcctgttcatgaccaagtaacattctgttatctgtaaaccacaatttatttatgcattgaagtgtctaatttttcctcaggatatgtttgtgtatactagaaataccatgtgaaaggaatgtagctcattttctagcccagtgtattcccttttcgagggttgggacccttctgttttagcctttgttggggttgtttttccagtggaaatcataaactggcagaagaaatatattttttttgtttactagaaatgttatagccctcaggaccagtaaagttaagtataggtattgacaacaaaatatagaatatagtaaatacagaatttacttttcctttgcacatgtctgtttctgtaagtatctcgaaaaggctgtccccagtaaccaataaataacatcggtagaggtttggtttaggaatgtcagagcctttggagatgggctggtcaaagataggaactagatccactttttcagcaacggggatgatggaaagtggaggttcctaccaggtcgtggagcctgggaggtgttgtgaacatgtggaaggggattgttaatgttatattctaattgcagtttgcaaaccacaggctgctttcttatatctgtggcacttctaatacttaattttggggacaggtgtcttttgtactttgttccatttggatgaatgctatcactgaccaacagctgttacacggttacaattcctgcagagaagggaaagttttcgtaatgagcagtggccctcttcctaaccagcccccacataccctcactcctgacgctccctatacaattccatcccccaccttatactcctgtctctttctgtctgggagtactagatatctatagtgagatttctgttttgaattttaaccttcggaatgcaagttactatataattattaactctgaatccaccgcaatttagtcagtgtatt

SEQ ID NO: 62678 - DNA, 1025 bp, Homo sapiens
cctgcgaggttggaggctacagtgagccatgatcgcaccactgcagtccagcttgggtgacagagcaagatcctgtctcaaaaacaaaaagccggcctggccaacatggtgaaaccatgtctctattgaaaatacaaaaattagctgggcatggtggcacgagcctgtagtcctagctacttgggaggctgagcaggagaattgcttgaactcaggaggcggaggttgcagtgagccgagattgcgcctctgcactccagcctgagcgacagagcgagactctgtctcaaaaaaaaaaaaagcaaaaaacaaatttcatctgagtgtgtttcatgtagttggtgtgatctacatccctccttttgttcttattccgatctttggtttggagagcaattgtgaggaggcatgaaatgtatctggagatagctatgagctgcagcctgctgattttcatgtaattcttggctacttgccagtatggttggggttaaactgtttccagggtaggaaaaacacgaacctagcattttgatatgaaaacaaacaaggctactttgtacttgatgaagctcaagttgcagatccagtgagagcccattaactattggtgaaggcccactgacagtgttgagtttcagagacccctgcacattctggagatggcagcgaattgttgtgcagcctacgaaagtaataaatatttctgcagtgattgtcaacaacaaaatgattttcttgtttggggggtggggaggcaagaggcagaaaccttaggaagctgttgcaaaccagtttcagcttctgctacttttatttctttccatttaaagctgggtgcagtggcacatgcctgtagtcccagttactcaggagcctgaggtgggaggctcacttgaacccaggattttgaggctgcagtgtattatgatggcccctgtaagtagccactgcaccccagccagggcaacataatgagaccctgtctctcaaaaaaaataaaagactgaggctgcaccaatgac

SEQ ID NO: 62679 - DNA, 1106 bp, Homo sapiens
gcgtgtgcctgtagtgccagctttttgggaggatgaggcaggaggatcacttgagcctagggtgacagaacaaaaccctatctcttaaaaaaacaaaacaaaaaaaaaaaaggaaggaagaaaaatatggaacacttcatagcccattagagcaaggtttattgtgtgttttggtcatagtggcatccccagtgcctaaaacaatgcctggcacactgtaggcattcagtgagcgtggagtgagtgaatgaatggtacacttatgccatggcactctttctggagaatttcaggtgccagtctgtcttgttagatcagtgcagattacattgcccatgaggggatgaggatgctgtttccatcagtttgattgccaaagttagtgctgcgtatgttttgtggttctcagtggttgccagggaaccgaggaagtgaaaggaaggggttgaaagcagcctcattgctgttccctgggcggctgtgccttgatgtccagccttgtctgtatggcagtttggcctggttgtgagagtggtgacaaggcctgggatagactgaccatgtcttgagaatatgtatgtgctgaagaatggcttcccagtccccaaacaccggcagcagcaggagccacttcttttacacatcagccaccttttcctctagcaatgaagctgtgatccattctttcagtgagtctcaaggaaatggttcagccagtttggcacattcattttcttgtcaggaaagtcaatgtgaccttgaccatcattggggacctgcggtaaacacgttgtgtgtctggctggattctaatgatcaaacagtgcttttggcacctcactgtgctgtacgtgtcatgtgctcctaatttattgtcctaggttgggggttataggtactaatttgcaagaatcatttctgacttacatggatcatgcccagcacagtgccactaccatggaggccttggataagtatcatgaaagaaaattgttgcagaaaatgaaaggaaagatgaaatatacttgctttgagtcctggacagtgtaattaatttgtagctgaggaagttattgaaaagtaactttttgtaatcccagcacttt

SEQ ID NO: 62680 - DNA, 1052 bp, Homo sapiens
tagcaagcatagatctgctttttccacacgcaccaggcttcagaggagaagttgactagatagccagtgtctcattttgtttgtggtgggcatgggatggtgaaaacggaaggaggaagaagtacaggggacaagatatttagatggtccacaacttgcgatggttcaacttaatggtttttcagctatgatggtgtgaatggcatacatggccagtagaaatcattctgtttttcacttttagtacaggattaagtagatggtatgagaaatccaacttgatagccagtgtctcattttgcttatggtggacatgggagggtggtggtggggcggcgggggaaggagcacatagaaggaactctgcgtgcaatgttgtgagggcctcattgtcagggtttatgaatttctcgtttccttctttctaaactgtcatatcagaatgtaaagtttttaagaccaagaaacacctaaagatttatggtggaaacgtgcactaagccggggaactggttttcagtcctgtgctttctcttgtcctctccgtgtggcttcaggtgccagtcctgtttctgcccagcctctagccctgtagacagtcactggagtgcctggtgtatacccttggccaagtagacagtgtagtaaagcatggcccagagaggaggagccgaccatgtgacttcagtttccactggcagctgtccgccggatgtgcactgtgggcagggccagcctgagttgccgcaaatactgtggctttagtttatttgctgagcagggcttttttccttcttaactctgagcttcttggggataaggacaatgtcttattcatctttgtatcccttgaacccaacacaatgcttggcacaaagacagcgtccagtaagtgactgtgttattgtttagaatgaagaaatgttgaaggccacatatagcagatgccttacaggtttcgtcatctgcatagtggccccaagtacattttgggctgaggttaacgttggtctgggaggtattttatatcttacatgtgaaactttttttta

SEQ ID NO: 62681 - DNA, 1117 bp, Homo sapiens
aaaccatattttttcccctaaactctgttgttgttgtgtaaatcttttaaagttttttttgtttgtttgtcttttttattttttatttttgagatggagtctcgctctgtcgcccaggctggagtgcagtggcgtgatcttggctcactgcaatctctgcctctcttgttcaagcgattttcctgcctcaacctcctgagtagctgggattacaggcgcgcaccaccacgcctggctaatttttatatttttagtagagacgggatttcatcatgttggtcaggctggtctcgaactcctgacctcgcgatctgcctgcctcggcctcccaaagtgctggcaatacaggtgtgagccaccgcgcctggccaaagttgattttcttaatggaataaacattgatacaaactgttttgggggctggtgaatagacaaccaggaggacaatgatgagaaggaaagtgttcaaaagctgtcatttaatatgctaacatgcttttttaattttttaggataaggaagcctgtgtgggtaccaacaatcaaagctacatctgtgacacaggacactgctgtggacagtctcagtgctgcaactactactatgaactctggtgtaagtccttgcttgggtgcctctcagtatcccagggtcccagttactgcctctgcttagtgggaaactctgggcattagcccttttcggattctcttggggacagtgttggtgagtggaatctgtttatgggttccagaagtgcttcctttgtagaggaagagagttctggtgctctttggactttgttagctgaagactagagaatatggtcttagccaggtctgctgcagaagctcttgcctgaggttctcctggctgccctctccattgtgtgctgagcagctgacaacaacttagatgcttccttgggccctcccagaagcccaggtttgcctttctttttttttttgacggagtctcgctctgtcaccaggctggagtgcaggcgcaacctcagctcattgcagcctctgcctcccgagttcaactgattctcctccctcagcctcctgagtagctggtactacaggtgtgcaccaccatgcccaactaatttttg

SEQ ID NO: 62682 - DNA, 1028 bp, Homo sapiens
gtgcagtggcgcaatcttggctcactacaacctctatctcctggttttaagtgattctcgtgcctcagcctcctgagtagctgggattacaggcgcctgccaccatacctggctgatttttgtatttttagtagagatgggggtttcaccatgttggccaggctggtctcgaactcctgacctcaagtgatccacccatcttggcctgggattacaggcatgagccaccacgcccggcctgttgtcatcattcttacattcctgcccacttctatcccatgtgtctttcactctggcacaagcatttatggaaattgatcacatggcttcaatgtaaattaactgggtgaggcccagccatgccagcttcaaccacgtgggcaccgtccagggacctccctgttccgcaagctgcccctctggctggtactcactgtgtgcctctctgtcttgccttgcccaccccccagggttctggctggtgtggaccatcatcatcatcctgagctgctgctgtgtttgccaccaccgccgagccaagcaccgccttcaggcccagcagcggcaacatgaaatcaacctgatcgcttaccgagaagcccacaattactcagcgctgccattttatttcagtacgtacacccaagcccccatacccaccctcaggagctcaggtgcacagacccagggctcacactgaatattggtggccaggctcctgtaggcatagggggtttgtcctctccctgcccctccgtagagcaaggtcttgaaagtacaggaacaaggggacactccttcagcacagaggagcatgtgctaggggtgcagttccctgaagccactgggccattccaaagctcacagtggctgggttctggctggatctctgcttctttagcacctgcgtacatacctacctacctaacttcctcccttcctccctcccttccttcctccctccctctttctctctttctttctttctttctttccctgcctgcctgcctttccatccctccctccct

SEQ ID NO: 62683 - DNA, 1804 bp, Homo sapiens
tactacctccttatgaggaagtggtgaaccgacctccaactcctcccccaccatacagtgccttccagctacagcagcagcagctgctgcctccacagtgtggccctgcaggtggcagtcccccgggcatcgatcccaccaggggatcccagggggcacagagcagccccttgtctgagcccagcagaagcagcacaagacccccaagcatcgctgaccctgatccctctgacctaccagttgaccgagcagccaccaaagccccagggatggagcccagtggctctgtggctggcctgggggagctggacccgggggccttcctggacaaagatgcagaatgtagggaggagctgctgaaagatgacagctctgaacacggcgcacccgacagcaaagagaagacgcctgggagacatcgccgcttcacaggtgactcgggcattgaagtgtgtgtgtgcaaccggggccaccatgacgatgacctcaaagagttcaacacactcatcgatgatgctctggatgggcccctggacttctgcgacagctgccatgtgcggccccctggtgatgaggaggaaggcctctgtcagtcctctgaggagcaggctcgagagcctgggcacccgcacctgccacggccgcccgcatgcctgctgctgaacaccatcaacgagcaggactctcccaactcccagagcagcagctcccccagctagagcaggtcctgccagcacccagcaacttggcaaagcaaccagggtaggggagaaccacgagagaagcattaagtgactttcaaagactttcagagtacagccacttggttcctttttgtttgttttccttctcctctcctgcattttcctccatctccaggtacagttcggggtgtggatgcctcttcctccacaagggcacagtgttgtggagggctaagttggttctgtgactcattcctcataccctaactccatctcctttctttaaagtcaaatctcacctacctgtttgggtcagagagatgtgttttaaaagcccccaaggaaggaggctgggactgtgccctgacatgattcttggtgatggaataggtttgtgctctgattctagtttaagagaacgttgctgtatctcagtccaggagaggcagcccatcttggccctggatgaagaaggaaacccacagaggcccagggcttgtcattgggctgccagtgtctgccaagccagcattgagctaatcctgtgggaggatgagagctactgggccgttgtatgataggttggtaggggcttgttgatctgtcaaattccaggtgacaagatctatgcaccccatgcgtccttgaggggcctcttccccgcaggctctggctggccgcaggctggttctggtgtgaaaggttatactgccttttctttgtttgtttgtttttttctctaaaaacaaacagcaaaagacagctgaaaacaagaacttcaccggtgggcaggcaagaattctcttctggaaaatgacgtttgtggctctttcccaagttggccttcaaagagcctgcctgctgttgagccagaagatgtctcgtgtgaaggctggggtggcggctgtcttggaacctctgtgagcaggaggccctaagccgcagcagtggatagaggtgcagctctctgcctctctgccctttggtctgtgttcacaggtgacccgtgtcagcctgcatcgcaagcacacaccctgcgggccttcaagtctcactgttccgtatgaggaaacagacagcggactgaggaagcgatggcc

SEQ ID NO: 62684 - DNA, 1016 bp, Homo sapiens
gtctcagcctctcaagtagctgggattaacaagcacccaccaacacacctggctaattttttgtatttttagtagagacgaggtttcgccacgttgggcaggctggtcttgaactcctgacctcaggtgatccgcccgcctcggcctcccaaagtgctgagattacgggcatgagccaccacacctggcctctccttactctgttataagcctgttcctcaccatagcttcagattcccttcatttcatgttttttcaccaagaaggctcaagaaacccaatcccacagaaactgtgacggaacacctgtgctggagccgtgagtttgtctttgggttctccacccgctgcccggcagtccatcagccctggctctgcggggacggagtgggcaggtggcaggccaggggctgtagtgggccctgcagggatggaacggggagggtgggttccccagggttccatcctgcggagggactcatctgcacacacccgctccccctcctgaccaaactggtggcttttggggaggtttgtataaaaccctgagaaggactcatttcgtgggtttggatatagacaacgacgagaaacccaatatttatcaaggcactaaatgtatttcataggttcacatttcatcctcacagtaacgctatgacacaaacatcccagttccctaccacccgcccccgccatattacagatgggaaaaccaaggcttaaggccacctaaggtgtccatggccacgcagtctgtaaatgacaacactgggaggatttgtctctgcaacctgacttcgagtcatttgcattcccgtctgtgtgggactctcctgcccacacactcttttctgcctctcatcctcaccagagcctcggaagatgggcagcgcaggtgttaggttcccccacattatccatggggaaattgaggctcaggaagttagtgatgggcctaagatccagggtcaggaaacgggagctggggcagagcaccggggtggtctgggtcc

SEQ ID NO: 62685 - DNA, 1042 bp, Homo sapiens
tgtccggctaattttttgtatttttttagtagagatggggtttcactgtgttagccaggatggtctcgatctcctgaccttgtgatcggcccacctcggcctcccagagtgctgggattacaggtgtgagccaccgcgcctggcccattttctttagatatatacccaagtagggggattgctgggtcatatagtagttctatttttaattttttgaggaatctccatactgtttcccataatggctgtactaatttaaattcccaccaacagtgtgtaaggattagtgctggtgaggatgtggagaaaacgatacttctgggcattttttcttctattgagactaaagttgcaactcttagtatttttttttatactaccctttaggaaggtgaaattgttgaagtggatgaagaaacagcagctatcttgaagaattcaagatttgctcaagattttctgatcagaccaattggagagaagttgccaacatctggaggctgttctgctttggagttaaaggttagtttggctttcactacctgagagaactattttatttatttatttttgagatggagtctctctctgtcacccagactggagtgcagtggtgtgatcttggctcactgcaacctccgcctcctgggttcaagcaattctccctgcctcagcctcccgattagctaagattacaggcacccaccaccacgcccggctaatttttgtgttttttagtagagatggggtttcgccatgttggccaggctggtcttgaactcctgacctcaggtaacccacctgcctcagtctcccaaagtgctgggattacaggcgtgagccactgtgcccggccagtatgcatggtctcttgaggcgcacttctcttgctggtcaaatgttgttagacggttatataccagttaaacgccaccattttgcctcttaatgtgcatgcttgagcccacttgcccaactcccgagatcttatcgggaagctgctgatcaccagtttcaggtgtttctgtttattgggagactt

SEQ ID NO: 62686 - DNA, 1810 bp, Homo sapiens
tgaggagacggtgatcatcgggctgcgactggaggacacgaacgacgtgtcgttcatggaagggggggcgctgcgggtgagcgaacggacccgggtcaagctgcgggtgtacgggcagaacatcaataacgagacgtggtcccgcatcgccttcaccgagcacgagcggcggcgccacagcccgggggagcgcgggctggggggccccgcgccgccagagccggacagcggcccccagcgatgcggcatccgcacctcagacatcatcatcttgccccacatcattctcaaccgccgcacctcgggcatcatcgagatcgagatcaaaccgctacgcaagatggagaagagcaagtcctattacctgtgcacgtcgctctccacgcccgccctgggcgccggcggctcggggtccacgggtggcgccgtcgggggcaagggtggctcgggggtggccgggctcccgccgcccccgtgggccgagaccacctggatttaccacgacggcgaggacaccaagatgatcgtaggcgaagagaagaagttcctgctgcccttctggctgcaggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaactacctgctgtgctcactgctgctgggcaacgtgctggtcaacaccacgctcaccatcctgctcgacgacatcgccggctcgggcctcgtggccgtggtagtctccaccatcggtatcgtcatcttcggagagatcgtgccccaggccatctgctcccggcatggcctggctgtgggggccaacaccatcttcctcaccaagtttttcatgatgatgaccttccccgcttcctacccggtcagcaagctgctggactgcgtcctgggccaggagataggcaccgtctataaccgggaaaaactgctggagatgctccgggtcaccgatccctacaacgacctcgttaaggaggagctgaacatcatccaaggggcgctggagctccgcaccaagacggtggaggacgtgatgaccccactccgggactgcttcatgatcaccggcgaagccatcctggacttcaacaccatgtctgagatcatggagagcggctacacccgcattccagtgtttgaaggggagcgctccaatatcgtggacctgctgtttgtcaaagacttggccttcgtggatcccgatgactgtacccccctgaaaaccatcaccaaattttataaccaccccttgcactttgttttcaatgacaccaagttggacgctatgctggaagaatttaagaaaggtgggaaattttggtctctttcattggcttgctctttctctctccatcctcctccctacttgagtcctctaccctcagaccaaccccccaaggcgagttgaccgggatttctccttctccctcttaattgcaaagttgaaagggtggcgtggatttggggatggattgaactagtaagtgctactaggttattttaaagcacaagactgccatcacttactttttcccattatcaaaaagcaggctgtgtaatttctgtgcatgacacttatttatttttttttttttggtcccgtgtgtgggcctctgttcttgaggggtctgccgccttcattgtctgggttctcagtgagtaggtgaaggtaggggctggctgatgccatgccatttggtgg

SEQ ID NO: 62687 - DNA, 1064 bp, Homo sapiens
gatcacttgaggtcaggagttccagactgacagtctggccaccatggtgaaaccccgtttctaataaaaatacagaaaaattagctgtgcgtggtggtgggtgcttgaattcccagcttcttgggaggctgagacaggagaatcacttgaacttaggtggcggaggttgccgtgagctgagatcacgtcactggacgacaaagtgagactctgtctcaaaaaaaaaggagggggtggtggcaggctttcgaaggaggaactagaggtttgtggtctagcttagatgttgatggataatggggatgccaaaccctctccctgtgttacattagtgctatgactgaacataaacactgctgtaatggacggtgagatcttcgtgtcatcctatttaaccctcccttgctgtcattcggaggtgggagtgcttctttttgaattcacatgctgtggggaggatagcatctgttaatgcaaaggttaagaacaatgtgctcttcctggatctgttttggacaagtaacttatcctctttaaccctaagtttttttcaaagtaaaatggggatattttctaactcatatggtacttagtaagaattattgtactaataaatatataaatgtttctaacagtacctggcactttgtgcttaaccagtatttttattataacaattctttctgtaggctcttggttgttatcttagtctgtttgtgctgctgtaacaaaataccacagactgggtaacttaaaaataatagaaggtggccgggcattgtggctcatgcttgtaatccctgcactttgggaggccgaggcgggtggatcacctgaggtaagatcaccagcctggccaacatgatgaaaccctgtctctactaaaaacacaaaaaattagccagctgtggtggtgggcgcctgtaattccagctactcaggaggctgagggaggagaatctcttgaacccatgaggtggaggttgcagtgagccgggattgcgccactgcactccagcctgggcaacaagagtgaaactctgtctcaaaaaaaaaaaaaaaaa

SEQ ID NO: 62688 - DNA, 1118 bp, Homo sapiens
ttgatagacatttagacagtttccactttttggccattatgattggttattatgaataatgctgctgtgaacattggcatgcattttaaaagcaagtgcttgtggattttggaagcccttgaataaccaaagacttttaagactaaaggaagatcaaaaaagataaaatattttaacactgattgcataaaaagtataaaaaatggtaatgcctaatatagcaagtttgtattgcttatagcagtgtaaatttataatgattttggaaggcaactgggtgtcataaaaatgatttagtatttttttcccctggaaatcttaattcagtgatccaagagaagaaaagagctatgttagctttttatgttgtatgtgtgttgcagcgttatctagaaacagtgaaaaattggaagtaaatatctaacacttcaaggcaaggagtggaggagaaagagttaagaaaattataaatgtgaactatttccaaccattcagtgataatcttgaaagccacatagcaatatgggaaaatttgcactgattatttgcacggaatatagacatgcaaaaaaatatatatatgtatacactggaaggtaacgtggaaaaaatgaaaatagttgatgtattagggtggggtgatcatagccagtctttgtgaaaatctccttgttaactttgtacatgatatacctggaaaaaattcaaatctgctaagaacattatgaatcctgatcttgtgaaaactaaccattgctcgtattaaggaactcattccatttctcttgaggaacattttactgctgaaacagttggttcttttttaaaattttaaaaattgagatataattcacatatcttaaaactcacccttttaaagtatgtgatttgatgctttttggtatgttcacaaggttgtgcagtcattactactgtctacttacagaacattttcatcaccccgaaagaaactccatacctctttgcagtcacttctcattttctgttccccctagtcactggcaactaatttactgtctgtatggattagcttattctggacatttcatataacatgtaaatgaaatgtggccttttgtggctggcttctttcattt

SEQ ID NO: 62689 - DNA, 1059 bp, Homo sapiens
tgtttggggtgaaagatgagtagtattttaaagcccgtaatgtgtgtgagtacacacgtgacatcttagtaagattcattttgtgtgagaaataagggaatttaggcttttgggttacatttgttttcaaaacatgttaataggtgacaaaaatccagtttgtttagatttgtatgtagtctgcctggaatgaaacttttttatacttacatgatagccctgattaaataaaagtttggtgaaagccagcagggtggcatgtgccccatgatcccagctactcttgaggctgaggtaggaagatagcaagttcaagcccagcctgggcaaaatagcgagaccccatctcaaaaaaaaaaaaatgttttgttaagtagttgagttccaactagatctgtacttttaacataaagctataatcccaagatacctcttatttggggacatgatggttttggaaactggtgcttccttttgtctaaataaataatcactgtaaatctagtcttgattattaaaaggagacaaaaagataaaaggagtgttctgaaccacctgtgcttgaagctcagttaatagtttccagactattaagcctacaaaatgtatatcttacacattttgctaaaataaaaagaccttttagctttgatcaagacaagatcaaatatttggtttgattatactcctaaaacgtacatattctcagacagataaacagatgtgattttctttcgttctttttctggatgtatacagaaaccttttttttttctttttttggtagagacaggctctccctatgttgcccaggctggtctcaaactattgggctcaaacaatcctcccaccttggcttcccaaagtgttgggagtataggcatgagccactgcacccaaccccagaaacgtttaatttaactataggataagttagctatcatttaggtgcctttactaaagtctgttaaaatgacataaaataatgacaatgtgtggggcgcagtgactcacgcctataatccaagcactttgggaggcccagttgggaggatggct

SEQ ID NO: 62690 - DNA, 1014 bp, Homo sapiens
aaaaaagaaaaaattagctgagcatggtggcacacacctgtcatgctggctactcaggaggctgaagtagggggattgcttgagcctgggaagtagaggctgcagttagatgggattgcgccactgcactcctgcctgggtgacagagtgagaccctgtctcaaaaaaaaaaaaaaaaaaaaaaaaagacaacgcctctactcctttagccaactttctaaaaaaattaaacattttagggagagaaatcgatgtttcctttacttacagatggcattgctcttaaatagtcctatgcctattagacagttaaatttaatttttactgagttccttgatattaaaaatataccagcgttttgacctgattactgtagagtgaagatcatcagttgacacagaacttccagccagcattttaatgctttcctctgaaatatgaatggacagcgatagatctctgaatatttgaggagagcctctaataggagttatggagactaaaataaacaagcagacaaaggcccttagttgatttaagctgatttatctcacattacctaaatatccaaaaagtcagcagttattactttatctgtgacctcccaaagccacttaccaaaccaggtatgagtagcaaattcgaagatttgttgcctttttcagacatggtgtaggtaggatctttcctgtattcattcaacctgcctagttgtttgaggatcccagccaggttgaaggttgtaaatatttccttaaggcttacttagcttcagtgcaggatcagaggctaatttctggcagagttctatgtcttaggggatcattagctgtctatttttcctttctctttttactgcaagatttcttcaagaatagctagttacttccttttccttgccatctttaatcctctacaatcttgtttcaaacagttacaacccatgacttcttttattgccacatctacatcttggttgttacctttcctctcttgcttggcccctttactgt

SEQ ID NO: 62691 - DNA, 1019 bp, Homo sapiens
taatcccagctactcgggaggctgaggcaggagaatcgcttgaatccgggaggtggaggctgcagtgatctgagatcgcgccactgcactccagcctgggcgacagggtgagtctccatctcaaaaaacaaacaaacaacaacaacaacaacaacaaaaaaaaaaccgccatgtaggagacggccaaagaggaattagacagatttcctgctctcaggtaacttgaagtacatatgaatttatactcttttccattctgtatcttcttttttaaaaatttttatttttagtagatgtggggttttaccatgttggccaggctggtctcaaactcctgacctcaagtgatctgcctgccttggccttccaaggtgttgggattacaggtgtgagccactgcgcctggcctcccctctgtatattgttatcaaacataattgatctgttttgaaaacgcatcttttactttttgttttctctccattcccactgctacagtgccagcccttagcccctcttatttgtgcttattatgttttgggtgctccagaaatacattttgttttattttattttatttatttattttttgagatggagtctcactctgtcacccaggctggagtgcactggcgcaatctcggctcactgcaagctccgcctcccgggttcacaccattctcctgtctcagcctcccaagtagctgggactacaggtgcctgccaccatgcctggctaattttttgtatttttagtagagacagggtttcaccgtgttagccaggatggtcttgatctcctgacctcgtgatccgccctccttggcctcctaaagtgctgggattacaggtgtgagccaccgcgcctggtccttattttattattatttttttgagatggagtctcgttctgtcacccaggctggagtgcagtggcactatcttggctcactgaaacctccacctccagggttcaagtgattttcctgcctcagcctcccaggtagttgggattacag

SEQ ID NO: 62692 - DNA, 1062 bp, Homo sapiens
aaaaatgatcatatacaactggcaaggtcccatgggatatggccccttctttggctgcatctcctactcctccagcagctacagtgacctctggctgtttcctgagtgccacaggtactctaggcatgcccctgccttggagcctgtgttgttgctgctccttctccctggaatgtcctttcgccagatagctttgcagcttgctccctccttccttcagatctgtactcagatatccccgctgtggccaggctgtccatggcagtcttacgattccagcccctctcctgcaactttttctccttagccctctactgtactatatcttattcatcttttttctttttttttcacctgcctctcctactagaacgtaagctccataagggcagggacttgtctgtcttgttcactgctgcgttgccagggcccacagcagggcctggcacataggtgcttaatagatattgttgaatgattgaactgaatattgttgagaatgtgttgtgatactagtactcttttatgctactgatggtagtgttaatttgtataatcttcctaggaagccatttggctctatatttaagaacctgatactttttgtatatcttttcacctagtagctccacttccagaatgtgatcttaggaactaatcagaaatacatgtaaaacttaaaacacagaggtgctcatttaaatttctatttatttttaaacatttctgtaaaatataacataaaaattaccattttaaccatctcaagtatacgattcagtagtattaagtacattcacatggtgtgccaccattccagaacgcttttcatcttgcaaaactgaatctctatacctattaaacaaaacttcctattccccaattcccagcccatggcaaccaatgttctactttctgtctctatgattgtgacttctccaggtacctcatataaatggaattatatggtatttatctttttgtgactgacttattttactttatgtaatgttctcaaggttcatccatgttgtagcatgtgtcagaaattccttctttctt

SEQ ID NO: 62693 - DNA, 1057 bp, Homo sapiens
agtcccagctactcaggaggctggggcaggagaatggcgtgaacccgggaggtggagcttgcagtgagccgagattgcaccactacactccagcctggggatagagcgagactccctctcaaaaaacaaaaaaacaaacacaaacaaaaaccccacacaggtaaaaacattcatcttgtaattttctattatcaggtttcaaaagatcacttctttcttgaaacatacattgtatgtcttttggtgaacaagattgttgttgtcttcctggtgctgacagtttggtgggggagatagacatgaagcaaatcatcacacgaataaactcatctgcatgtgctgtgggggagaagtacttagtgccctgagaatattggcaggtgggacgggagggaagaaagtagcttttgggtgacttgagatctgacagataagtaggcgtcaactagaggaaatttgggtgtggaaaagagactattgcagggagacatgataaggtgggaggtaacattgtacactcaaggagctgaaagatgattagtgtggctggaacacaaataatttgtgtgtgtgcatgttgaggggtaggttgggtggtacaagatgctattggcgaagtcagcagaagcaagcagggactccagcaggcagaccttgcaggccacactaagggttccaggatttcttctaagagcaacaatatgtccttgaagtattgggggtacatgagcatgacattattagagttgcattttcaaaaggtcttctgtgtggaaaatcttttgatgaggagagagaaaagatgtggagagacagagactggcatttggaggcctttgcagaagtctggtaagaaatgatgacagctgggtggttgggatggggagaggatgattgatttgaagatgccaaaaaggacaaggctttaccaacccccctttcaatgatagagagagagaggcaaaatatagatattatcttcataaccggggcccgaaaagtcaaagatcatgcagttagtaagcagaagtagacctggcactggaagctgtctgac

SEQ ID NO: 62694 - DNA, 1049 bp, Homo sapiens
ttgggaggctgaggcaggcagatcacttgaggtcaggagttcgaaaccagcctggccaacatggtgaaaccccgtctctactaaaaataccaaaaaaattagccaggcatggtggcaggtgcctgtaatcccagctacttgggaggctgaggcaggagaatcgccttgtacctgggaggcggaggttgcagtgagccgagattgcaccactgcactccagcctgggcaacagagcgagactccgtctcaaaaaaataataataaataaaaaagatgataagatttcagctggtggagataggactaggagaggccatttctccttgaggggatgggaaagcaaaggtgaagatgagagaacaatgggagtggggctggaaacgtaaattggtttagaagggaaagtttttgagtgctaggataagtgatttgaactctatgcactaggtaattacattttcattaacatttatcaagaatctattaagctaagtcactgtttttaatgttaagaaatcaaagaattgtttttatagttgtccgacttttcaccaaagacagcacctttcataacctttatctcaggattccttccacgtccaaggtcctgacttttgtccttggaattaagccctaataggagagaaccatctttttaagacattgactgatttctctgtttaattttgatgcagtttaacaccatctaatataatctgccattttgagctatgttaggctggtagatcgcttacctgggcattacttgtttgcttctctggaatccttaaaaggatcacaatatagaatatagtactaaagggcagttgctgtgggagagttggaagtgctgagttgtgggatatttcagaagctctactttttcttttttctttgagatggagttttgctcttgtcgcccaggctggagtgcagtggcacgatcttggctcactgcaacctccgcctcctgggttcaagcgattttcctgcctcagcatcctgagtagctgggattacaggcatgtgccaccacacccggctaattt

SEQ ID NO: 62695 - DNA, 1053 bp, Homo sapiens
aaatgacacattatgtgtaggtacattttcacatttagatgggcaaaattaagtcctgagagcttgcatctgaaatcatatggccaatcagtttaagcgaactctaaacttctttgatgagaactttggcacaatttcatcaattctaggaaaacacttctgcagtacttaataagtgatatgagtaagtaaaatgggaagaggactaagtaagtagttccaaaaagagaaaccttttaaaaatggaaaaaggacaaacttccctgtccttgacttcttccccttcaccaccaccccctttccttggcctaactggaacgcacagtcacattaagtgatgccttgccctttgactgactctctcagtaaaagttcagatagccatctagtggaaagaagactctttaagaatgactttcctccagacacccaatatcatgtttgttcagttggcttgtccaaacaatttttctgtgttttcaccagagtagtatcaacttagcatgaagattaaagctgttctccatctgctttatctgccgttcttaattagaacctgatgacagaaatcaactttgattcaaggctgattgttcccggagaatctcattattattgtaaacagtttttatttttctttctttttttttattaaacacattgattctgagcatctatatggcagaagtgagggtaaaaaaataattttcttcatttaatcgtgtattcagcatctgctctgctagatgccgtggggcatattgaagttgcttaaagtctggtagagaagataaagcatgcacagaaatagtttttaatacaaacttgaggtgataagtgcccaaagggacaggcacaatgtatgtggaaattcagaggagcagttatttctcgttaaggaatcgtgttttctgagttttcttttagaaattaaacagatgtgcattgttctgatggactgaaaaaaagagaaacaaatggtcccttgctttcacactttattttactttatgagaaattaagaggcaaatgtttgtatatcaatcccttagg

SEQ ID NO: 62696 - DNA, 1105 bp, Homo sapiens
acagaggtataggaagtcacttaccccctcattctactcttacttgtcgccattattaggaatttatttccttttatacctttttctatgcagatataaacatagccagttgggttttgtggctgtttttttcagaaatgaaactgcagtgtacattttgttttaaaatgaaggtttttcagaacttggcccagggtatggtggctgtgcatacctgtagatttgctgtcttcattttagcagctgcatggcctttttttgtatgactctaccataatctacttaactgttgatgaagtttaaggtttttgcttatgtaagtaatgtccgtgtgtttcagttggccttactaacactggttatattcatctttaacatatttttctttttttggcctatttggtaagtgaaaaatagctcattgtcataacttgcacttcttcagtgagactgaacattttccttattttagccacttgtacttctatgaattatctattgcttatttttctttgggttgtttgtgtcttttaattggttgcagatctttatatattataaaccctaactcttaatttgcaaatatttcttacaattgatcgtttcttatttatggtggcgtttttccttacagaagtcttagttttgtatgttgtcagatctgtcaaacatttatagctcttggatttggaggtatgcttgcaacgtgtttccatgttttaatattctaagtgtaactatcttaattcagtgattcctaatcatgactgcatcagaataatttaggggaatttttttcagcatatatgctgtgatttccaactaagatattctttcttcgtagataaaatgtggggtccaaatctgtggagtttggtttgttttgttttggagagaggaagaagcttcctggccaggcacggtggctcatacctgtaatcccagcactttgggaggccgaggcaggcgaatcacgaggtcaggagatcaagaccatcctggctaacatggtgaaaccctgtctctactaaaaatacaaaaaaattagacgggcgtggtggcgggcgcctgtagtcccagctactcgggaggctgaggcaggaga

SEQ ID NO: 62697 - DNA, 1016 bp, Homo sapiens
tctttgagagtgtgaagggggtggtgctgcttggttccttttacttaacattcattgagttcctgtgacacacttggagaattagtaaggagagaattcatgcaactgataaggagagaaactgctgtacattgtaccctttgctgtgcactgtaactgtacaatcaagtttctttatcttgacaattgtgttaaaccacaagctattggctatatttcattggttgaaagatgcactttttttccccacgttttaacatccatgaaactgggatgacagcatgacatagtttatttggcagcattttaaattttgtagtataatggttcatcttagtcaacttggagaagttggataattttttatctttcatttttgtatctaaagtacatcagtacggtttttttttttccatactggccttcatgttcctgagtggtctcttctcttctagtgtttctttccttctaattaagttttatatactgctgccagattaatcttcccagaccatgattctgattaaatcactgctatatgcaataactttttttttttgagctagggtctcgctctgttgcccagactggaatacagtggtgcaattatggctcattggagcctcagcctcccaggctcaagtgatctcctacttctcagcctccagagtagctggaactactacaggcaaatgccaccacactcagctaatgtgtgcaatgtgagcctaaaatacactaaaacatgcatgcttgtgctaattttctgtgtgtgtgtgtgtgttttttttttttttggtagagacaaggtcttactatgttgtgcccccaggctggtcttaaactcctgggctcaagagatccacccaccttggcttcccagagtactgggattacaggcatgagccactgtgcctggccttatgcagtgacttttaataagaaacaactgtaacagaaagttcaaacattttaatatttcattttagaccctttgaatgaaatatttacctctt

SEQ ID NO: 62698 - DNA, 1066 bp, Homo sapiens
aactttatgccaaggtcttcataagcccaaattaacaaattgccaagtatgtcaaaacttgtgtctgtgttggcaggacctgtgaagcactcctctggaacatagtctgcaaaccacaacactaagtgattgatctctaaggcctccttccaattgtaaaattctttggtaaatgaccttgtaatatatgcttggcagtagtttagggttatggagtaacagaagcatagccaattaaaactatgagaaaacttaggtgtattataattggcccctctggaatttggccccagctttgaggatcataattacaacgaagtcagcagtttgaaataagttttcaccataggggagaagagactcagtggcactacggcttgctttcagtcttaagtgaaattctacttccttgtcttaaaagaacctcactggttctttcaattgagaaaccttgatggtttgaaagagatacttggaagagagtgattaatgaaaataatattggtgtgtataaagtcattgagcagctgaggggcttagaagctgagaagatctgaaagcaatgtgagcctaaaatacactaaaacatgcatgcttgtgctaattttctgtcaaatttacaaaatctttggagggagagtggaatttagaagagaaagcaaagtgaataacattttatgattaatgaaagaagaatttagtagagtagtgcagaattgaagccctaggcagattctgaattatcctttgtttcagggttctctgaaccctcaaggctgggttaggtgcccaccttggtactgtgtaacattatgtctgttacagtatcagttccaattcttgccttttttttttttttttttttttttttgagatggaatcttgctctgtcacccaggctggagtgcaggggtgtgattgcagcttagattgcagcttactgcaacctccgccttctgggttcaagcagttcccttgcctcaccctcatgagtagctggaattacaggtgtgcgccacacgcccaggtaattttttttttttttttttttttttttttgtatttt

SEQ ID NO: 62699 - DNA, 1921 bp, Homo sapiens
agaccagtctcaaaaaaaaaccccaaaacaaataattcccttcctcttttttcctatattaaattttttacctctggatccccacatcaggatctttgttggtttactcacttatcttgggagaacatatcctccagtagttcctagagaaaagtgatcctcccacctcagcctcccgagtagctgggacccacaggtgcatgccaccacacccggctaactttggtattttttttttttaagtcaaggttcgccatgttgcccaggctggttttgaactcctgagctcaagcgatttgcctgccttggcctcccaacgtgctgggattatagggatacaccaccacgcctgaccagggatggtaattttttttttgatcttgtgtatcagttatctattgccataatactatatctcagatcactgagagacctcagttgcacataatagtaagtgtttattggccatatgtctaggatagttggctgggaggctctgctgatctcgagggttggccagctattagctgatctaggatggccttggttggaatgactagggtgactgcctcttcttcatttgtttcatctttcttggaggaccagtggtctagccaaggtgtgcttttctcatggtaacagtggagggcaaatggaatgcataagtgcttttcttacatttgaagtatatccactacatattcagaaatatcctattttggaactatagtcatttggtgaccagaaaaattatccatgcaaatgtgcagagaaaaaatttaagatatttagtatccttcagacgactaaacagtcgtcactttctcaaggaggtgttctttgcctttttatattaggtaagattctcctttaaatctcactattagcacttggttattgttatttcataattatcacactggctatattatttgattcatattggtctgtctctctagaccttaagctccactgaagacagcaacccagtccagcatagggttagcctggggcctgcagtagtgagtacataataaatatttgtcagacaaatgaatgaaatgattagatctcaggaatagaaggtatttttagggttctttttattggctctttttgtatttgaagtgtgttccttcttcaaggatttggcagagaagaggaaaaacatagaccattactaatttgcaggagagagaagctggcccagctttgggctgtttgctcggcctagctgcattcccctgtgtaatcaagactgtaaagctttgatgggtagttagttctttgtggctttagggctttccgatataagtaattgttttcatgagtgtattaatttgactctggaacttgtaagcaactggaaacaagactgttcctacttgtttatgtgaatgtttgttgttctgaattggatgacgatactcattgttatttcagaggagtggttgaagaatacatttttaaactaattagtgatggagttgcaatacagttttgtcattggtgctgcattcaataaacttatattacagtctaaatcttggaatgtatggaaaattaacattaattaaactaatctaagttacagaaagctgacaagtgaacagaactgaatattaaaaactattccttaaacatgagtttacttcatccactctatggtgtttagttctacttaataattccagccttttcataatttgaaaggagacccatattttgtggcttattgtttgttcaactttgatattgattttaattgttaggacaggaaattgtgatagaactagaaatttcctcccaggattgaaaaaagaccttgctcaggtgtgatctaaatattatatttcttattaatgacaagtttttttgtgttttgcttttttgataattaaggagtaaaatatatgctata

SEQ ID NO: 62700 - DNA, 1051 bp, Homo sapiens
agtacaggaatcacatactttgacattcttctacttgcttccaaagtaaacatatttgccaaaaactttgcccaggtacccacattgtagtgggggcagccttttactgggagcaagctccaagttccttttttttttttttttttgagatgcagtttgctctcttgcccaggctggagtgcagtggtgtgatcttggctcactgcaacctctgcctcctgggttcaagtgattctcctgcctcagttttctgagcagctgggatttacaggcatctgccaccaagccctgctaatttttgtatttttagtagagatgggtttcaccatgttggccaggctggtctcgaactcctgatctcgaagtgatcctcccacctcggcctcccaaagtgctgggattacagatgtgagccaccgtgcccggcctccagttcttttctgtttggtttgtgagtgagtgagaatggagtgtgtgtaaagggggactgggaggctgggaggttgacctttgtgcagtctacctacttgtgaatgggaatgtgattccatgcctattgctgattctcaagcctgcctcggtaccacagtagttcacagcaagggctttggagtcagccctgtatttgaacctcagctctctgattttccagctggggatctatgttgggcaaatcaagttaatctgcttaaacttcagtttcctcacctagaaaatgaaggtcataattgcagcctcactagggtatctgtgatctaggagggatttttgatagtggtaaacagtagattcctgccttactaatgtgtaggtcagtttatcatctacctagcaccatcacttttttcaaaaaaggtcttttcaaccaagaatatgtcatacatatctgtattttctgactagattgcaggttcttggtccttgtcttacttgttttcgtaactggcttatagaacttgatactcagcacatgttaattgaatgactagatgatgcatggtctcctttgagcctaccatagcatttggatttaccatcattatgtttactt

SEQ ID NO: 62701 - DNA, 1028 bp, Homo sapiens
tttagtaaagacgaggttccaccatgttggccaggctggttttgaacccctgacctcaaatgatccacccgcctcggcctcccaaaatgctgggattacaggcatgagccaccgtgcccggcccccactcctattttcttaagattaatttgagctatttagttaagctttattaaaagtattggccaggcatggtggctcacacctgtaatcccagtactttaggatgctgaggcaggtggatcacctggtcaggagttcaagaccagcttggccaacatggcgaaaccccatctctacttaaaaaaaaaaaaaaaaaaataggcgggcgtggtggccagcacctgtaatcccagctcctcaggaggctgaggagaatcacttgaacccaggtggcagaggttgcagtgagctgagatggtgccactgcactccagcctgggtgacagagcaaaactccgtctcaaaataaataaataaatacataaataatctaccagacactgtgctagtttctaaggctttagatgtgaaagagaacccttccttcaataatctcacagaggactaaaaattcagaggagccaggcacggtggctcacgcctgtaatcccagcactttgggaggctgaggcgggtggatcacgaggttcaggagatagagaccagcctggctaacacgatgaaaccccgtctctactaaaaatacaaaaaaaaattagccaggcatggcggcacgtgcctgtagtcccagctactagggaggctgaggcgggagaatcccttgaacctgggaggcggaggttgcagtgagccaagatcacgccactgcactctagcctgggagacagagcaagactccgtctcaaaaaaaaaaaaaataatctcagaggagagtgagatagttattaatacagggtaataagtgccctaatggagccaatgaaggctttgtgggaacagtgacaggcaccaaacccagctggtctaggtgaggttaggaagacttccaagatgagatgatgctt

SEQ ID NO: 62702 - DNA, 1017 bp, Homo sapiens
ggctggagggctgtctttgataggaccatccacttggatggctagaagtaaatgacttggcttcttgtcttttaaacagtttaggtttctttgtttcagagggttactttactttctgtgtctgctgttgtcaccgggaagttcatggatcgaattctctggcatagcgcacacacattagtttgtcttcttatacgcatcagtcattagctgtcttggctttgggaaatgagaacttagtttaatcctagttttccttttgctttctgctttctgttaatccctttgtggtatagatcctgagtctatcagtcaggatccaaccagagaaacaaaaccaataggacacacacacacacacacactctttcatcaagggatttattataagactctagcttatgtattgtggaggatgtttaagaaagcccaaattgataggacaggtcattaggaagagaagatgacaagcaggctggaatcccacaggcacagtctgaagttgttttctatgggagaaatttcttctctccttcagaaagtcttaaggcccggcttttaaggccttccaactgattaagtcaggtctaccaagagtgatctcccttaaagtcaacccatgaagtcccattagggacttcatttgcatctgcaaaatcccttcacaacagcacctagattagtgtttaattgaattaccagggattgttaaattcatcaacacattgggagaagccaaagaggagctgcctggaaaatcatcctgccacaggtgtgcctctgcagacgtttatcaaatcgaggtggggtctctgctactctctccaaaaaccgtttctctcttagttatacaactacctgctgtatacctcacccaggaaagcatggttggctaatctttgtcaggattggacctcactcgggttttcaaatgttgcatgtaaaacaattttttgactgaaaaatgtttttctattgataaccgtttagtgagctttttaaatatttgtttaaact

SEQ ID NO: 62703 - DNA, 1135 bp, Homo sapiens
acaaaggaaaactctagaaatgtggagagggtagttttaggacaaatataaaatatcttttagctcagaaagttgtatacgttgaaaatatgtttaaaaggtttaaatgcgatttgtagatcactcattcagtaaatatctgcctgcctatagtgtgtcaggcaggtatctacagcttttttgtttttgtttttgttttttttaaacagctcttagttttgtcacccaggctggagtgcagtggtgcaatcttggctcactgcaacctccacctcttgggttcaagcgattctcctgcctcatcctcccaagcagctgggattacaggcatgtaccaccatacccagctaatttttgtatttttagtagagacggggtttcaccatgttggccagcctggtctcgaactcctgacttcaagccatttgcgcaccttagcctcccaaagtgcagggattacaggcgttgagtcaccgtgcctagcctacagtcttgtgtatttcaggaactttcctaacatgtaaatgttgatgtccttgagggtaaccatacctttcccaaatctccattgataaaactgtaaaatctgagaaccacctagattagtttttctcaatgtataatatttctggtcttactgcatggagatttttacagagaagtgaaattcaaccagtcaattttaaaataacactcctggctgctgcatgcactgtgccaagactgtttagccactaatggagaggacttgtctactttgcttctcctggttttaaacaaagtcttttagagggtgaccacctcagtgagtgctacctccctactgtcagagttgttcaagtggccaaagagcagcagcaacactgtcatcgacgctaatagataaattcagggtcctgtccaggagagggccctgtatcaaataaacctctaccctcaccaaaaaatgttagatttttttaaagaaaccatgattccatattccaccagtcagcctcactggcagacgcattagttcaggcctaaccaggagtgaggatgttcatggctggactgaaggaactgtcctgctagggaggtctgggccggccacttatgggtcagactttggaatttttggaagtagtaaaaggag

SEQ ID NO: 62704 - DNA, 1002 bp, Homo sapiens
aggcccatgtggatcacttgaggccaggagttccagaccagcctgagcaatatagcgagaccctgtctcaacaaaaaatttaaaaattagttgggcatggtggtgcacgcctatagtcctagctgctcaggaggctgaggtgggaggatcacttgagcccaggagttcaaggctgcagtgagctacgatcatgccactgcactccagccagggagtgagaccctgtctcagaaaaaaaaaaaaaagttgtttacattttctttttgatttatcccttgacaaggactaaagtccctgcagtgaatggttaagtgggaaggtgcatggaatcactgttctccaaaagcctgagtgaaggagagaggtgtcattgtttttcctttgtactgtgcacagggaagaagtttcagaaaacaggacttctcaccaggaattccaaagttaaaagaatgtggccctggggcagatggagaagtttcagccttgaaacaagtgaacttggaggaaaacttaattttcagtgtaagaagcctaattcacaggaataatttctcctagagtaaggccctttccagccaaatctgtcggtgctattgagctggtatttcaagtatgtccatctgcatttaaacgagttgctccaagacaatctgattatacggtagttactttggtgagaatagcgcctcagtggaatggaaacttcattttgagtctaatattagaccttgctttggaaaattccttttaaatgatcacaagctgggaatagcaaaagaatttaactttcgacagacagcattcaccaagaatttttaactgcttatgttgggtccttgggaaagcagatgtgagaaacctaccggaccaagtggatgagatgagaattgacttgacctgatgcagtgtttatatccattgctgataagtttccctcctcgtctcctctgctcaaaatgttttcattctttgagcgtgagcatgctagggatgaagattgta

SEQ ID NO: 62705 - DNA, 2981 bp, Homo sapiens
catcggtgtccctgataggcagccagtgcctttcatctgcatgcagtaaacttaaaccatgtttaaaagaaggctagccgcaaccacatggtggaatgctgtttaactctttaaggtcgtgttctcagacacatggaaatgctcacaatattatatttatcacatcagaaaatatagcttaatacaaagtggggagaaacagaatctaaaactatgtgtacattaagattagagttgtgtttttgtgtgtacacacatgtatacatgagcacacgtgcctgggcatggcactggaaagaaatgctcacttgattgctcagaatggtaatctgagtggttggcttatagataagtttttctttcttctttctttttctgtattttctaaaattcctgtaattactatcttattacaaaaaagtcacaagttaatacagaacttacagctttcataaatacataattagaaaataaaagaacagacgatgtctttcacttattattctttttctaattttgataatactgttcctcatttaagtaccacaaattaaaactaaacatctaggccgggcatggtggctcattgcctgtaatctcagctcttggcggggccaaggcaggctgattgcttgagaccagtctggccaacatgatgaaactctatctccactaaaaatacaaaaattagccaggcatggtggtgggtgcctgtaatcccagttactcgggaggctgaggcagaagaatcacttgaacccgggaggtggcggttgcagtgagccgagattgcgtcactgcactccagcctgggtgacagagtgagactccttctcaaaaaaaaaaaaaatttaaattaaaaaaaaagaaaactaaaactaaatctcctactctgcttctgagatatcatagagtccagttgtaggatagcacccttcagtcagtaatttttgtttttgttatttaaaataaaattgctgtctttgtaaatacttttgaacattactttttttttttaaattagcatgttgatgtgtgcacatgccctgctcttatttccagtctcgaccctctttgttccccacattccttggggtagttgagtgggagagggagacgtggggcacctgtgtgtgtgcgctggcactaaccgcacctgatgctcctgaccttggcttcttcctttggctgttggtcgacagtcaggctgttatggcttgttgaggggcatcccccgcactcaaggagcccgcttgccgttgattttcgtttctgtcagtgaaattagtgtacttttatgaggactgaagtcaatgatgggttgaaaaggaaagaagtaaaaggaacaaatgtgagaattcagcactttctaatttctcccaggtaatctgtccccagtggatcaccaaacggaagcctcgtccattcaaatgctatcactttgattccaagtattcttatctaaacacctcaattactattaatagtataatttttctctctctgtttgaaatgtaatatcaagttgtgtttatatctatagaagtagaagcatttagcccatcccagatgtcagagaagatccttctaaggctgctaaagcaccccaatgtcatccaggaactgaaatatgatgagaagaacaagaaagcccccgaatactacctctaccagcgcaacaagccagtagactacttcgttctcattctgcaggtcagaagaattattcaatagtggtttgctctcactgagtatccatctttcagtttggtgtaagtgaatgggtgtcaccgtgtacatactgaacctttctatagggggtagccttagacatgggagaattttatcttcctgttttcatatctgtaaagtaattctaatataaagcaatgccaatagttactttaattttcaatactaaaaggtgcttagtaggctcggtgcagtggcacatacctgtcattccaccactttgagaggccaaggtgggaggattgcttgaggccagaagttcaagaccagcctgggcaacatggcgagaccaccatctctacaaaaaatttaaaaatgagctggatgtggtggcatgcacctgtggtcccagctacttgggaggctaagacagggggcggggcggggattgcttgagcccaggaggttgccatgtttgcaccactgcactccagcctggatgacagagcaaaaccctgttttaaaaaaaaaaaaaaagttggggggatgcacctagtgattactgagtcagatgaaaatggtgaattcaattgttagtattttttgaagagtgtgggagagtttaccagtacatgtctgaatctcagtgggtgtttgaaatttaagtgtcatgggttattggtcctttttccatccttttttccatccttcatgaggacttaagtttatacagcttcttagagatatcttagcatctcttccattaacgccatcaaaataatccatttgttgttgtttttattcctggttaccaaccaaactgttttatagaggaactgataggataattacagcctcttacagcagagtagctaattccttctcactgtaacataattcagtagatgaggtgagaaggtcaattcattctaaacttcctttgagtggctttggtgcttgggttgacaggaggccttgttttatcacagtttcacttaatagagctctatccttggcatggaggccaaggtggatattagtcgataaaatgctaatgtggatcaaatgtgtagattcaagctcgggaaagtgttgtgttcatgtgtgaccccatgtttgggcagcattgtggtgtttggaagcaggagtgaggagtaggaaaatgccgagggttagctgattacatgtcacattcttacagtccttcttagaaacttctgtttgcaagtttactaatttagtacgctgattcatcttctaaatttagttttcctcaattgttttttttc

SEQ ID NO: 62706 - DNA, 1334 bp, Homo sapiens
tgtgggcctgtcgggattgaacgtgtggagatcagagaacctaaaaataagcattatcttggtttgttttctgtgccatcttctggccccagatctcaagacagcaataccaaaatgccttgatggcatcccggatggacaaaaccccccagtcttcagacagtgaaaacactaaaatcgaattgactcttacggagctgcatgacgggttgccagacgagacagccaacctgctcaacgaacagaactgtgtgacgcacagtaaggccaaccacagcctgcacaacgaaggcgccatctaggccgcgctggctgcacccgcccaggcccgcacccgcccagtcccgagggcccggccctgtctgcccatgacttcactggtgtgagcttgtccgccatgctgtaccctgcaacatcctgagaccaaagaccttgtgcccttcccaggagccgcggaggaggacagtgagggaggaatggaaacgagagatgtgaagttggcagccggggcatggcgttcaagattttggagatgaactgattccgcccaaatagaatcatgtttattttttcagctctcccttttatcattattcacactcctctgccctcgatttgcatgaagttgaaaattgttgcgatttattttttcaagagatcatgtttttaaagtgtcttttgcagagttttaagttgttctgtctgaactctgctgtgatcccatgatgtgaccctgatgggctggacttgcccctccggtagccttccttggccctcccagcgaggggcacccttcctctgtgccccagtgggcatcaccgtcgatctcgctggctgaatgaagaagaccgtgttactgcagaacctgccaagtctgtcatcactgtggggtgtagcctgcctcagagggacctgcaatcacctctctgagctcagtggtattttgagaatttaatgtttaactgtacccctttccctcaggaagatttaacatttgcttgggaatgtgattttgctcccaccctaaggaatttttatcaccaaaatgaatgttaatgaatttaaaacccatggtttatcattggcaagaggcaagttgacttcatcctgtcattccagcctggggtctgccagccagccctcctccccgacccagcgcctaagctcacagagtgtcgtcgcccacctccctggtccttgctcttgttaacccaagatgctgctacacagatgccaaatggaaatcttccacagggctttttcagtaaacacgtgatgtggagtgcaagctcctccccttcccactagaacatactttaacagaaaacgagtcg

SEQ ID NO: 62707 - DNA, 1041 bp, Homo sapiens
gagggcatctatccccctcttcgggtctgcgcagtgctggccttccctgagctgtggggagccaagcctgcctagcccagcttctctggcctcaggaactctgccctgtcaacctatctgggctcacgtctgcttctccacacacagtctctcggggatgccttgctactgggagagcctctggaatcagagctagtgtgttggtgcccttttcagagctctgctgttcctttataaatcctaaagaactgagtctggggagaggagaggggatgccagctgctgcctctgacttcagggagaagcagacttcttaatactgtcttacgtgctcggtgtgatggcttcttgcaaattattctcttataaaagagctcggcaggagtggcatcagtgaggctcccaaaggatgaaattttagccgccaagttcgtattcattttctgttattctttaccttctgttagtcacactattttataacattagggaatctaaaataattcctgtcaggtccctgaaggaatgaaggctaacatctcctttggggagagcttaggacccttcaaacaacactcatgtctgagcggccagattcctcctccaggccccattttccctcaggaaaccaacctctcagatggttggaggagaaacactgggctgttgcttctttggggcagcaggagaatgactttggcttggaaggcctctgccattcatctctacaaagccagtggggtccggcagagaaagaccgtggaatagctgcggtctcgatgtggctgctctttggcacctccgctggactgccctcccgcggcggtgaccttttcaagtgtggaagggagtgggtcgagtggaccagatgcagacccctgagttctggatactgatgggaggcctcaccctcctttacggggcctctctgggtgggacagagcctcacctgctcctgagcagccactggtgccccacggttcctctgaaactaaatccctagcatccagatagtcctgggacactctgcctgctctgtaa

SEQ ID NO: 62708 - DNA, 1061 bp, Homo sapiens
ccaggacaagagccagtttcctcagtaaggaagtaagcaatggcacctcagaggccttctggaccctaacctaccagctcagtcttgtatttctcctcaaccctttgcaaagaaaagcccatatctgggctcaaaagcagaggggagtttttcccatgccaccagggagcttgggtcatgctacatagcgtgcaaagccagccctccctggcctgctcttgcttggagccccagagaacaaggtgagcaccttcctgtgccagcccgggtgagtcatctgcctaggatcacccctggggaaccacaggggcaactctggttgcccaggagacctcaccttcctgggcctaggcaaggcgaggatggctacagatccccggctggccttcagatgacagaggtggttgtgtgtttttactaggcaggacacagacttgatcagccagggcctatacaggtctgctcctcaacccaaagagagaatttgagggcagaagttcatggtacctgcttagctcaaattcctattgctctatttcctagggaaaatgtatttctatttgtatctaccattattttcctaggcttggaaaagctggtcctttagtgtacagtgctgacgacagcacaggtaaatatactcacagttactgttccgtattagtgtgaagctctgcattcaacatttgcactgttccttgaagtcacattagaagatggtaagatgccccactccctcccacttggggatgccaaccacttcaacatggcattgaactccctgcagggagtgaggtgaggagggaggaaagaacagagttcaatgtaacctttcaagttcaaattatgtaagaatcaagatttaagccagttgattagcaccccgatatctgtgtaagtcttaagattttgttttcctaagagtttaaatgtatgattttgaatttgcctgacgcatatgggacaagcagtgaagggacggaacctccaaacagcaggagaaaagccctcctcatttacagagcaggcagagtgtcccaggactatctggatgctaggga

SEQ ID NO: 62709 - DNA, 1032 bp, Homo sapiens
tgagtcctttaaacccacaaatgtatatgctttattttatattatttattatgtacatatgcctgttagtacttcgtctgtgactaggacaaggtctgtcttgaagcttcctcatccatggatcctagggttctgctgtcctttaaggcgggtgagagggtagtgttgttttttataaacaggttgctgcttttatgttggccctagcatccccagcccctttagttgggcccacctgtattccttatgaccagtgttttggatgaggatggaggcaggtctcctaccttgtgggcagggcctctcaagtacctccatgaaatatttccaaggtggtttcttggtgacaggctctcttcccctatgtagggtacagtacagctgtgagtccacggcctccctcctcccaaggcaggtcacttgcctggccccacagtgataatggtttcttccacttaccttagattgcataatccatctttctggataatggaagctgcctgcctatctgggctcttaatatgccttttcttggttttgaggcccagtgccaacattgccttggccctcaagtaagaccctgctttgtgtctgactttgatcctcctcagcctttattcactgtatcatagtgtacaggtcatgcatttgagcagtgaagttttctgaacacagtattcagagctgtgtacataaacctaaataagcacaaatgacatgtataggattgagctgattgtcttaatgaatgcattttataattcaaatgatgtagatgtacagtctctcctatttattttgtaccaatttatttgtaaattttgtgattgttttacaaggtttttgtttatttctattctatttagataaatgatgttctgttcaccctgctagcagatgtgtgttccctcttccctttcatctgtgcaacaccaaccatgccattgtattcagcttggctgaaccaactgccctacccacttgcctggctttgctggtgggaaagctgggactggatctcagcatgacaac

SEQ ID NO: 62710 - DNA, 1037 bp, Homo sapiens
tccagatttctttgtcctctaagagttgattgctgtatattaaaattgaacatcagaggatgggaagagggctctgtaagccagaaccttactaaagtagagggcacaatcagtgtgaataaattcacttcagaatctcaagtcaaggccaggcacggcggctcacgcctgtaatcccagcactttgggaggccgagacaggcggatcacctgaggtcgggagttcgagaccagccttaccaacatggagaaaccccatctctactaaaaatacaaaattacctgggcgtggtggtgcatgcctgtaatcccatcatctactcaggaggctgaggcaggagaattgcttgaacccaggaggcggaggttgcagtgagccaggattgtgccattgcactccagcctgggcaacaagaacaaaactccatctcaaaaaataaaaatcccaatcccaagtcgaaatcacctcttgttttaaacaagaatgaatcattactgtgtatgttagggtattaaaactgtttcaccagtacagtgaaagttgtttcaacattttaaacaaacagtggttatagactctttctttaaccattgtatattttcttccattcttgtcattggtcaataggggagggtagattagctgctccagaattcaataaagtgtaatatttctaacggtgactttgacctattctgtagtacaactgtaatagctattggtcttcaagtgggtttagatttggtgacatcagtttgatattctcttaaaggaaataaatattcaagaactgattatgttctaacatgattatattcatggtgttacataggcctcaattttttcacagaaagatttttggaacaggactgtgaagtgaggctttttaaaaaattattttataagcagagaacacagcctgataacttagtcaaggatatactgtctgtctcactactttggacttatatggcttcagattaagtcatccaagaaacatacatacattctaaatggtatatattgggaatatatg

SEQ ID NO: 62711 - DNA, 1563 bp, Homo sapiens
tcctgacctcgtgatccacccaccttggcctcccaaagtgctgggattacaggcgtgagtcactgtgcccagcccaaaatttactacctcttaaaaacagttttttcccatgattaaagcatgtggaaaaactgatctaactccttaacttcatcttacttttgctgagacacttaaaaatttatagtactggcaagaagttccacttcccccaattcgctgtacatgtaaacttgatttagacacctggtgatttgtagtaaacagtcttacataaaccgttggtttgttgacttagttggtctagggatggcagtagcgaagccaaggtgataggttatttctgtgtgagtcattagttttctctatacccctacctcatatgctcctttcctccaaatgtgtgttcaaaaacatcttccagaggaagtatgtatcctccctgagaatgtcagaagcctttttttctttttggtatatggtaaagcattaatttctggcttccactgccatgatttcataaaatttagaggaaacaagaatgtggtgagtcctatgttgaaaaagacatgttttgtgaaaagcttgtaatttctttaggttatataccttttgcaaaagtagtatatggaccttatgttaaatttttttttccagaaaattatgacttacctgtttgacttcccacatggccccaaggtaccgtatgtgactcaatagaccactgctttaataacaatgaatgcatttaatcattctggaatattaagggggaaagaattggtcagaacccacccagaaaagtcctactttttaagcctattgtctaatcttcattaacattagaagtaatccaggagctagtagaatttaaaatcaaattgctaatttagagtccgcaacttgaatacttaatagacagaaataaaagggatattcatgtgatatttagtaggatgggatcagaataattttatgcccaagaagttctatgcaaaattaagtttgtgtggcaatgaaaggaattttcaggttgtggatgatatttgattaacagaaacagaaaatgtatgtgtattcttgacaacttctagattttgtattagttgttgctaagtttttgccaagagagcactcagccttgatatttagcagagaagtcttcatttctgcagtacggctgcacttaggtttaaggaatactccttgcaacttagtcacatacttacagaattttagtcctagactttagtgaataaacatcagcaaatccctgttttgagaacacctgaaatcacagtgtgcagtgcccttcaggttggtcttaaaaggttaatgccagggttccatttcaggatagtcatgattttaatgggcataactcagtattgtgattagcttacactgtgagccaaaagccagtgtgtacctagagccatcattctgagaatgtaaccagtaaaatttcctaatagttccatgttagtttgtatactttagctctgatgcctgcctctgtcttaatctgtcccttgggtattgatttgcatctctccctagctc

SEQ ID NO: 62712 - DNA, 1521 bp, Homo sapiens
tcttctgtatgaccttgagttaggtattattgttgcctctgttttatagataaaaaacctgagaaatagagggattaaataacttgccagaggtcacacagttagtaagtagtaaagctaagtcacacccaaatcataactactgcactagatcatctcaaaaatgtgcatatatgttactgttatttaaaatgcctttaacctgtcaacagagagtaatgaggaaagctttaaagtaccttaaaaggcattagtggcaaacctgataaaattttttaaaaaatctgtggttaatagtattgtaccaatgttaatttcatacttttcataattatactgtggttatataagatgttaatattaagggaaactggaggaagaatatatgggaactctttattttcacagcttttctataagtctagaactgttttagaataaaaattaaacacacatagtgccccaagatgacatacttctttcttttcctacagagtaaaagtagcagaatacagtattttctcaaagtactgtggtaaagatttcttgttttcagtttttgtgcttcctattttcacccacctcccttatttcaagaaagaacactgaatggggagggtccgggagaatttgagtgaaggaatctatttgctatgcgagaaggaaaagatatttttctttccaggcacatgaggggttagaatttcctcatttaagcgcacgtgggtgtgggtatttctaggtagcatctgcacatgtcatttcattctgcaaggtgttttataaaaccatagtgtacacactgaaagccatatctaataatctctatgtagagcatgtttaaatcagcttctgctgacctttaacacacctcacatacttcaagaaatctcaaggtaatttaaactctttcctgaggcagacatcatgaggaaggtagagatatgttgttaacagccatataacccctataaatatgtgtataattttacatgtaaatctattacatacactgtgtatactacatatgttaatactttattcatttatagtgataatgtgggcttttaagtgcaaaattctgaaatcagctaacccttaaaaggttcccccattcctgttgtggacagaaatccagtatttgacaactccaaagtgtaaagataaaaatgttttcgtgtttcactcattatccaattacatttcagggaaaactgcctttgcttctgagccggatgaaggaagtagggaaagtatttcttgctaccaacagtgactataaatatacagatgtaagtgcttcatgtgtatatttatttatgcagtggaattattttggcctaaagaactgtgaagacaatgaggaagatagaagtttattaagtgaaaatagtttcttgccttctcattttcaaagagtaaaaaggcaaaaatatacaggataacagtggttctcaaatttttctagaaatttattttaaccattttcactgattataattggctacttgaaaattttaa

SEQ ID NO: 62713 - DNA, 1026 bp, Homo sapiens
caggtaatttttaaagatatttttggattaagactagattaagactactttccttacccctcaaattagacattccagatttatccttaacaaaaaaaccccccaaaacattgaataattctttgttgtttttttggttggttgatgttgattctaaaattaccatgaactttccatatacaccatatcttggtgttcctgaattaagctcagtttattgcaactgaggaagacccacttacaggtaaaaaaggagattactaaaactgatgggcagtaatcacaggtggtgctatttggggctgttggcaaataggtacgtgtttctctaatacacttaacatgatagaagcttggcagtttccatttctggatttgatagggaatatttaagattaagaaaatgatgtttgagatgctatcatatatatcccacatacagcatctaatggagaaaaatataagccttctcagttgtccaagaaaaaagactatgttttagaatggtaccagctgtgtagtaagaagaatgttttttataccttgtttgattaagcacttattccttacagaaaacaattatgattttctgtctggacggagtcaatattttttagttgctttagaattagtttttaagattttactcactttagctatattaggacatactttgagttggtacaaagcttgaattaaatgaggttggttcatgatgattaaatactactacataaaattattgcctgtattactttgcattatcaataatgtcttcattttcacataggggacttgtctttgacacactgtatggaaatcttttgaaagtcgatgcctatggaaacctcttggtctgtgcacatggatttaactttataagggggtgagtacagagaacctttagcctctttctaatgttaaagtcaaacaatgtgaagatgacatcatctccccagatgtaatatatttccctattacttttcatcattaaagagcaaattcccttacataaggttagttaac

SEQ ID NO: 62714 - DNA, 1214 bp, Homo sapiens
atcaaaatttaaaaatttccttccattccaaatttagatatctggttagatttttagcagtgtgcagttgattctagtcatcttgataatgatgactagaatcttgataatgactaacctagtagttaggtataggtagactcagctaaaatgggtacttggaagcaagatgaggccactctggtatttgtatcctttattcagtctgtttcactacccatagtttaattttaaacaccatttgccagctgtattcagtttctatcgtgttagcctgaaatgtgctagagaaaataaactaagaccaatagacttatttttctgtttgtctttcgacttaacattttaggatcagacttggcttgtattccagactcagggtgccagaaaagtaaataatacacaataatacttaggcttatcttcaatacccttgttttgttatggccaattaggctaattttagtgatggtcagaggcttctaaattggagggcagtagtaactcctgtaaataccaatttccaaatggtatctctctgttccagcccatcacaacagttttaaaaccagcttttgtttttgtttttgttttgttttgttgctttttgttttttaacaggagagccagtgtaactccttcaagactggagtgacacacactgcatctgcatctgcctcatgtgagttctcattttggcagcagcactctgctaggctggaacctctgtagaggtttgccctttatttttctaaatctataaattactacatagtgtgtcttggtggcaatggtaaaaagtgcatgagaattccaaacttctctgcagaaagttttctgctcattccaaagggactttgtcctttaatatgtattctatcttgtatgaacagcatctactcaaaacagagcccacaactttcatcctgaaaacatagttattttttgaagaactgttttttccttgcagattatggagtaaagaatatctttaaatgctctcagtaacttcaactttcaaagcgttggttgttttctttatagtctaattatgtaacctgagaacactgtgtgctgtcctagtggctgaagcagtcctccttttgggactctagcccttaaaatagcttcttcctttgtcttccgatattgagtaactaggggtaggccagagtaccttctgggagaagaaataagcagatattgtgtgaagt

SEQ ID NO: 62715 - DNA, 1030 bp, Homo sapiens
gtcaggtaaactttatagtaccttgagaaattggttataaaaatgagttatctgtataagcctgaataagtcagacataaatcatgcataggttttaagaagacttcctgggctggattgattggtcctctttttgtctctctatactttcttagtcatttgattagtcttagttattgatctcctaaaacttattataaatatctaaatgtatatcccctctaatatgccatgagctataagctctttcacggcccaggatcatacattattttgtttcttcttctcagcttctagtacctggtacactgtaggtatccaaatgtttgttaaattcttctaactttagtataggcatttgagtgctgtgatctgtttttatttttgaaaaaaaaaatattagctatttctgtttttgtattacaagcagctcctttggttaaagacgatttttaaaagttatttcaataattttcaatttttctgtcttaaattgaaaacagtactgaaaatacaagatatttgtaagtgttcagattctcagatggaatatttttgaagtaggtatttttttcattttatttaaaaatattcttctaatattcttagtattttttaaacaaataactcttaattaccatttaattttgcatttgcttgcaataaactgaaattggcagttgctcaaactccactttacttatttacacatctagttatttgggaatgtgttttactttgtattactaaaagtattgctatgatatctagctgttttaagtaaattaaaattgaggccattttaggaaatttgctttgaaaatttagaaagatatgaaaatatcttttttaggtcatttgtgatctcttaggttagagataggatttttgcctgtgtctatttaatgtgttaggaggattttcatatagttttggaaaatggaaaaaagtccttgggcatttgtttatatgataattggaaagatctcacttaaaattttctcagagaaaaatgtgcgttatcaccttt

SEQ ID NO: 62716 - DNA, 1057 bp, Homo sapiens
atgatctaatggtgataaactgggaggaacttagtaagctctgttcattcagattctttgctgcgtccctgggtcttcagaggtaaggatgttcctttcctcgtggtataaggatgacacctctcaaatgagagtagtatgacctgctttaggggaaggtgagaaaaattcttcctagattttatgacttccttcagggaagaagtcgggaggtgagagtgaccttcctgcttctgctgttttctcaaatgcccaggtatcatattttgggttcagatgtcctaaatcctatcagtaactagcaacagatttgttaaaactcatagctggaatttaaactcaggtcagtttctatttctcatgctgctcccagctttcagaacagaaattatccagtaactctagatgagatatcaataagagacaaaaacccataaacaaagaagatcatccttaattttttccccccaaatgaaaaccctgcctggggcaaaactgcatgtttcttttgcagttgaattgtaatcttccatctttagaatacagatagaaactgtgttaaaacacagtttttcttttgcttaatttttagaaataatcttaaagcttcgttaagcctcaggattactatataagtactgtattagaaatgttgttagaattattattattttgagacagagtcttgccctgtcacctaggtgggagtgcagtggggtgatctcggctcactacaaccccctcctcccggattcaagcgattctggcgcctcagtctcccaagtagctgggattacaggcgtctgccaccacgcctggctaatttttgtatttttagtagagacagggttggctaggctggtccaggctggtcttgaactactgacctcaggtgatctgccctcctcagcctcctaaaatgctgggattacaggcttgagccatcgtgcctggccgagaattctaaaattaaatagtgcatttttttctcaattaaaaaatcttagggggattggaaatacattttaggtccctctcttttgaatttttctgccct

SEQ ID NO: 62717 - DNA, 1055 bp, Homo sapiens
agtgatatccaatgacaagttaaattaaacacagaggtgttttctccagcactgtctcggaagatacatgcttttgaggggcctgattcaggttaaacttcttgaagttaagtcacaaaaaaactatactagggaccttacgaagaattttgttatgtgacttcaagaactagttgactcagatagttttacacttttcaaaacggcaaccagtgacagatgaggtaatactgctttgaattacaagttaaagccattaagattgctatttacaaaatttcaaatttaataaattgcatgttcatgttacttaagtgtgagaatattcttatttctaaagcacattatattaatggctctatttcttatggttaatatttatatttacttggatggagtttattcaagtttaatgtcttaactgctgtgggatatgataataaaagctgttacatttgtctttatattgaagtctgtgcttcgttttagagtgttcctgtcacctagagattgtttttcatgttaatgctcaaatctgcaacttacaaagacttagtatgttggaattgctggctaattgtgctttaagattggatgcttagtttagtcatgctttctagggcggcaagtttgtgcttttttaaaagcaagcttcgggaagttaatttctccgatatgttcaagctcttgaacataggggtggagtatgttccacttgttaataatttagaaatgtgacacagtaaactgacattggcaaaggtacagtcaaggtccggagaccaatagaaatttttggattcctcaagcagataaatctttttgttttgaaatgtatgatggggcagtgggccagccttgtaattgatatagtaccttttagttgatatagtacctaacactttgttttgctataacctcagtgaagagtagtcattagtttgagaccaagagattagtttctcttgaagactgtatcctggagacatggtatttcatgctttaaggctgcctctgtgctgaagtcactgcatactttaagcatttgggtgttt

SEQ ID NO: 62718 - DNA, 1160 bp, Homo sapiens
tgaacaaaataaaattggcccactttactgctatttttagatttcattattgaataacgagaacaaccaggggtataagtaattctgtattatttttagaccttttatgacatcactagaaatttgaggtttcttttaaatgtgaaaattatgaaaggactgctgttttagattggtatattttcttaaaggactgcctttttaggttggtatattttctttccttctaccactggctatagataggtaggtgttaaaccatttttatgataaggactatcacaggtgctagtatgtttgtcaatcttgtacacagggttgtttataaagctattatagtttgtagatttaagatgaattgtatttctagacgcggttaaagttcttggaagtagttagtgctaatttttaccctatggtaaagtatatgttagacttggttagttagagaaagttggagggacctatattacccctctaggacactgtaacggcagattttttttttaggtttatctctaggagcctctggagcaatgtctgtactgtccgaatggataataagtgcatttgaagtacatggagtatataaatgacatcaattaagttttattctctatgctatctttagaaataaatggatacattttgtgcttggggatgaaaaaaattcttacattcaccgttttcataagtgcaatattgacatttagtaccgtgttatcatttgatagctatgaaatatttccctaatagtaataggaaaagattaatagagttaaatcacccaaagttatacttgagctttatgtaagtctatggtaattaagacagtgtgatattagtgttaagataggcatatagattatggaaccaaatggggagttcatagacccacatatatataatcaattgattttcagcaatgaagttaagctaattcaatggcgagaggctagtgtttttttttttttttaagaacaggtttcactcttgttgcccaggctggagtgcagtggcgtaatcttggctcaccgcaacctccacctccaggttgaagcgattctcctgcctcagccttccttagtagctgggattacaggcatgcaccaccatgcccggctaattttatatttttagtagagacaggatttctccat

SEQ ID NO: 62719 - DNA, 1057 bp, Homo sapiens
tcaatatagagatgccagtcatatgtcattattaagaaactagcctttaaaatgtatgactgttgctccttcttcatttccttatggttgtttagttttctgggctgaggataagtcatcaggccaaacctttcagtggaatgtgttttgctatatggttagaagacaagctgagctgctcagatgtcatagtgacctgaaagaggcagcttcaaaaattacctcttaaatagtttttgtttaatactagaatcttttagtgatcactatagatcagaatttgtatttaccaatccaagaatggaacaattaggtttttcatctgctctctacattgactgtgcccaggataccgaagtcaggtatttagtttttacgtttgtaaagctctgatgcttccagtagaacagaatttctgtaggacaatgaattggctttttctttgtgaacacagcttattaatttagcagtggttttatcatattgaactgaaatgtggcacgttattaggcttgtgaattttttgttaaccagtcttttgccttattttagaaaatattgcagtgatttttctctttaaaattctttaaagacttttgtatatttatcttaaattatatatctgaagtttttttttttttagttgcagtttaggcttccagagccatatcagtctttatataaatctgttgaataatcgtttcttctaaaatcaaagtaaatttcttgtacatgtttaaggagtgaaaaggaatttgtgtatatgtaattttgctagtacttatggcttcgatctagaaatgtttatgatggaccaggcacggtggcttatgcctgtgatcctagcactttgggagacccaggcgggtggatggctcattgagcacaggagttcaagaccagcctgggcaacatggcaaaccccgtctttaccaaaaatacaaaaattagctgggcatggtggtgtgcacctgtagtcctggttactcaggagtctaaggcgggaggattgcttgtgcctgggaggtcaaggctgcagtgagccatgattgcgcca

SEQ ID NO: 62720 - DNA, 1144 bp, Homo sapiens
aatgacaacaatgcacgagggttcaaatttctccatatccttgccaacacatgttattttccattaaaaaaactatatccacgcgtatgaagtgtatgtatttgattctaactctcctatatcctcgagaatccatctcttctgaaactctgaagatctttggggtcactaatctggcatgaggcttacaatgacctgccttcattttttacccaagtgtctgatttccttaatagatgttcagcaactttggaacaaggtgtgggtgggggatcaatttgaatctccagtgtctactatctggtagatgttcaacaaataaaataattgcgataaaggtcgcagatcttgtctctctcacactgtagacacccagtggaagtttccaaaaggcatctgagagatttttgcttaattcaaatgaattaattttcatgactatgtgaggcagttagttgttggttacatttaaactgctaatctgatccctgccactctgcttgatgcccgtcagttactctccattgcacttaaggttggggcccctgttcattaacgtggtctgcagtgccctgccaggtctgaccttgcctccctccagggctttctccctttttctttaggcttgggttattccttagatacacaagactcatctctagcaccagctgttttctctttcactcttgcaaacaagttccccctcacttttgcctccctcactcccttccttccttcctctccctctctttattcctctctttctctctctctttctttccttttttgaaacagggtgttgttctgtcactcaggcaggagtgcagtggtccggtcatagctcactgaaacctcaaactcctgggctcaagtgaccctcctgcttcagcctcccaagtagctaggactataggtatgtgccaccatgctgggctaattaaaaaaaattttttttttgtagagatggggtcttgctacgttctccaggctggtcttaaactcctgggctcaagcgatcctcctgtctcaacctcccaaagtgctgggattacaggtatgagccactgcacccggccctctcactttttcacctgagtcctactcacccttcagatctcagctgagatgtcatttcctcagggaa

SEQ ID NO: 62721 - DNA, 1091 bp, Homo sapiens
catgtgactcagcaatttcactcctgagtatttcgcccagaaaagggaaaacctatgttcacacaaaaatgagtacatgaaagttcatagcagctttctatatgatgtactaaaacaggagacaacccacatgtctttcagcaggtgaatggataaacaaactaaaatacattcatacaatggaatactgttcaccattagaaagaatgaactattgacacatgaaacaacttgggtgaattataagggcattttgctgagtaaaagctaatctcaaaatgttacatattacatgattccatttataaaacattcttgaagcaaagaaatcatagtgatggggaaaagatcaatggttgacagcaattaaggttgtagggttgtgggaggatgtaactataaaggggctaacaggaggaaatttttgtggtaatggaacatttctgctactcaaatctgtacacatgataaaaattcagagggtgggagagagaagagagaaacctaatgaaatccaaataaggtctctagtgaattaaggtgttgtatcaatgtcattttcctggttttgataatgtactatagttatataagatggtatcataggggggagctgggtaaattgtacatgggaactttctgtactatttttgcaatttttttatgtcttaaactatttcaaagtaagacatatataaaaataggcaaatgttcttaggagatacatactgaagttttagggttgcggtatcataatttatgtaacttactcttagatgatttggcaaaaatgctgtccacacataccacacacacaaatgcacacagaagggggaggtaaaacaaatgcgtcaaaaagttgaccattggtgagtttaggtgaaaaatgtacagttgtttattgtattagccttgcaacttctctaggtttaaaatttccaaattaaaaattcaggaaaaaaaattttttttttgagacagaatcttgttctgttgcccaggctggagtgcagtggcacgatctcggctcactgcagcctctgcctcccaagttcaagcatttctcctgcctcagcctcacaagagtagct

SEQ ID NO: 62722 - DNA, 1064 bp, Homo sapiens
ctcctgctcagagtctggccgggagagggaaggggggcatccaggagtgggggcggggaggcgcagtgactaccgcagctgcgcgcgcgacgacctggggcgccgggacagggccatctgcatcggagtcgcccctttccgcagcgcttctccccaagaatcgactgcttcggaagtgactcgagcggaggggtgcctaaacgactgaggtttcccatccggaaaccacacagctctgtcgcatcccttgaccctatcccctcttctttaaccgactgggaggttaggggtttctgggaggtgtcccctacacccaccctcatcctgaggtgaggcgcacagaaagccttcccgagggcgaggtcgtgtttttccagttacagtgaggacctgcagagcgagcccttgtccccttcctcagggtccccaaggagaaaggtgggagatgctacgtcagaaagcatctctccagctgcccctctgcagctcctggggaggctccgggcggaaagatgttcagcaagtgcctctcccagaagagaggggagatcagtaaagaaagtgaccccgagctgcggagagtggggagaagcggcggtacagaggggaaaagaggccagacttggagaagcaggaggcgctgggaattgctggggctcatcgttagggcactaaagcatggcacaggccaggaccacaagctgctggaaagggggctgcagacttttgtgtttagagcattatattttaaaatatttcgaaaggagcatttttaaaccaggagatttcacctgtaaagaaattggatttctggcttcttctgaaaatgggaagagctgggatgcccacagtggcagaggtgagttgcccttgccatttgtataagaagtgtgctctcctgttcactacagtccctgccattctccactgaattacgccccccttcttaattcatttactttacctctctgaccctgtgggcatttgagatttcagtttgtgtaaatccagcagggcaggttctcaactggcttcagagagccactccctgtgcagatctcttt

SEQ ID NO: 62723 - DNA, 1048 bp, Homo sapiens
ctaacctgaggctttgggttttggaaagcacatgctacaacagagttatttagcagcaacacaacaagcaagggagggatggtaagtgtaaaaaaaaaaaaaatcatctccatgttcagttcagaactatatgccgtgtggctatcctgaaaagggcaggtgttcacttgccctctgggtaaaagttcccagtcctcaccatgagtccaaatctcctggggacctttatgaaaaaaatgcaaatgctgggaccccaccccagaaccagtgaatctggatctggactcagggacagacctggatataagcaagttataagttcattagatgattttaatgtgtagtcagggctgggaatccttgccttctggaaatcttgaggaatttcagctggtttggcctaactattttggatatgttacttttcaggatagcattgggcagctggagaatgatctgaggaacaccaagagtgagatggcacgccaccttcgggaataccaggacttgctcaatgtcaaaatggctcttgacattgagatagcagcttacaggtactgcaaaggacctgcttacccgagtaaatccagtcacctaggggcaatgctgcccaaataagtggatctagtctctctggcttctgactggtgagggagggaagaagggcatcactggcccctttcaggtgagctgactgctctgtccctctacttagatataatccagctccatctgactagtcccagagtattctgtgtacctctgaaaggatttaaggggataatgtgagtacacagaggttaaaataaaaacccatgagactcgtaactttaaaaatagggtttggggccaagtgcagtagctcactcctataatcccagcactttgggaggccaaggtgggtggatcacttgagatcaggagttcaagaccagcctggccaacatggtgaaacccagtctctactaaaaacacaaaaattggccaggcgtggtggcacacacctgcagtcccagctactctggaggctgaggcaagagaatcgctt

SEQ ID NO: 62724 - DNA, 1040 bp, Homo sapiens
gtattgaatacttacattctctaataagaaaaccaccccttagattgaagtaaactgcagtcctggagcaatcacagatgagttatctaagaatacagctttctgaccttcagctcacgcttcacagtgatcgatgattcaggtgcagaggaagtacaaactaaggtgctaaatctgcgatcatcgtcatttgctgtgaactgaaattaaaactattcatgctacccagccattacccagctaaataatcttactctagatacctaaaacataagatcactgccagagataaactaatggtccacacccaattccactctgatagaattatttcacaaataataggtgtttgtttaatggacacttttcacctccttcaattccatatatccttttcttctatgtaggaaaaaaatagtctagtgtagtattcttcccttttaaacacattttggttcttctcaaaagaacttacccccattcgcgctctgctcagtgggtaaaattagatgcatgttgaccatgtctatgattcgtgtaattacttatccctgcccatttcatattctttcaattctgtaggttaaaaaaatggcagtgatgaattttaagggtttcccccaacatataaaataatgcaaagaatccctagactttaggctttcagcttacacaaatctatttaattaggaaaaaaactattaaggatgtagcttttcacctttactttagaagcacagtaaatatcccaaactgtgatgaagccgaccttagatttagtagtgtaagctagaagaagtgagtgtttctatgagtggaaaaagccaaggtgtcatttatgtgtcagttcatttgtggtgatatagaattagctttttcatccccttacccttagaatccacgtattccccttcccactagcctaggtcataaagaggcgttgctttcactctcctatgccttttacgagtgctaagtgtaggatattttgtcaccagaacacaatgctaccgccccaaagtaaaagaaaccacttctgg

SEQ ID NO: 62725 - DNA, 1892 bp, Homo sapiens
gcagtgagctgagattgcaccactgcactccagcctgggcaacagagtgagactctgtctcaaaaaaaaaaaaaagcacattcacaaggagtgtttggtgaataagaaactatatggtccacttattttctttaaattaaagaatttcaccttagtgttagattattaaaaaaaagtaagccagctttgacttgatcatttgcattactggtttgaaagaactgcaaaatcgtctttttttctccccttttcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgagctcacctccatgcaaagacttcagttttaaaacattatttgcctaaaattagcattgtgatgctttctgaaagaaatattttataaatcctgtttaacagcagaatttctgaatgtgtagagactactacaaaattggaaaaagattggcaattctttgtaaagaatttgtgaattgtgtataaatttattctaacatttaataaaaatgtattttaacctatttgggaatgttagtgtttactgtgggttaaaaaaaaaataaccaggccagggctgggtgcagtggctcacgcctgtaatcccagcactttggaagaccgaggcaggtggatcacctgaggtcaggagtttgagaccagcctggccaatatggttaagcctcgtctctactaaaaatacaaaaattagctgggtgtggtagcaggtacctgtaatcccagctactcaggaggctgaggaaggagaattgcttgaatctgggaggcagtgagctgagattgcaccattgcattccagcctgggagacagagcaagactccatctcacaaaaaaaaaaaaaaaaaccaggtcaggcactgtggctcatgcctgtaatcccagcactttgggaggccagacgggcagatcatttgaggtcaggagtttgaaaccagcctggccaacgtctctactaaaaatacaaaagtagctgg

SEQ ID NO: 62726 - DNA, 1529 bp, Homo sapiens
agagacggggtttctccatgttggtcaggctggtctcgaactcctgacctcaaacaatctgcctgcctctgcctcccaaagtgctgggattgcaggcgtgagccaccatgcccggcctcaaagttgtttcagacatttggtattgggtgttttctctgtgtctttaaagtgtaagttcagtacttgaaatgaatgaataaattttactctgagttttgttttttcaatgaaacattaaaataaaccagcaagcctatttagaaaaattgttgacatacttttcagaaagggaaagctaagcagaatttccatttttcttctctgatatgtgtattaacttgtttcatagtaagttttttcaagagtctattgaatcatcttcgctataaaattttctttaatgtttacacattacatatatatacacatacgtcatgcatgtacaggtatatttaacctaaaaatagttttatctgtctgtttttgtagccattggaaaagaagtttgttcgagtttcaggagaagcaactattggacatgtagaaaaattcctcagaagaaaaatgggtcttgatccagcttgtcaggtacagtacatatatgtaaaagaataggtaaagttgtgagcttacctttagcacactgtagaaagaactctgtaggatttcatgcaattatttttgttatttttgttttatgatgttgtagacattgttttttttttttttttttgagatggagtcttgctctgtcgcccaggctggagtgcagtggcacgatctcagctcactgcaagctcagcctcccgggttcacgccattcttctgcgtcagcctcccgagtagctgggactacaggcacctgccactgcacccggctgattttttttttgtatttttagtagagaaggggtttcactgtggtctcgatctcctgacctcgtgatccgcccgcctcggcctcccaaagtgctgggattacaggcatgagccaccgcgcctggacattgttaatgctaattgaatattgatacatagtgattcacacctccagctttaatcacatttgatttactgtccatttctttttttgagacagggtctgtttctgttgcccaggctgaagtacattgacacgatcatggctcactacaaccttgaggttttcctgggcttgggtggtcctccctcctgtctcagcctcctgagtagttaggactagaggcacatgccaccatgcccagctaatttttttttttttttttttttaagagatgcggtcttgcttttgtccaggctggtctcaaactcctggcctcaagtaatcctcttgcctcagcttcccaaagcactaggattataggagttagccactgtgccaggctagtatccatttcctactgccactgatggcaatctattagtgtcatagaaaagctgaagatagaaatattaaagaggcctcagttccagctctttccattttggtagtagagaaaaatattgcttatcatccgctttctttatag

SEQ ID NO: 62727 - DNA, 1038 bp, Homo sapiens
tgtgttctagaattacaatgaattgatgtttctcaaatatttatatatgttgttttatgattaaacatatagcttaaagtattaaatattgattaattttgctctcatttttcagtgctaatgaaggcacgggacattttaaggtattttactttttttttcattcatttcacaagaggactctgtagcacacaaattcgagtcagattagcaaccaaatggagattgtataaataagttatttaaatatgaagtacatttaataatattatagatttatgaataaaagttattaagtagggatttgttcattcagaacagtagtctaaggaaaattaagtgaatactttttaaaactaaaaccaaatgctatgttaatttggtgataaaaaatgtctcaaagcatttttgcatatttggcatttagaattaaatatgagcttaaaattttatttgcatgtaacattttttgctcaagttattttgccctacttgttacttcaattattcactgaagttttagaggtaagaatgaactcctttgtaacatatttaagttcagagttgatttaaagattccgaaatcacaggtaacattgtatacagtgttactactataatgtgagtcatcaggaaaaggtaactttttaaaaaggggtaaatcagaccttatagtttcttgggaggtaaatatacaaggaataggtgactttgatctgtttagattttcagtgactttgtcaagtgtctgtactgaaagttaggtgaattatacctagttggatatactgtactgttttatgaacacactagctcagagacatgaattaaagcataggaatagataggtaattctctgggtgaagcatattatacatgtgtctcagagattgatgtgatagagggaatgcagttttaagtcctcatgatttttttttttttttttttttaaatggagtcttcctctgttgcccaggctagagcacagtggcgcaatcttggctcactgcaacttccgccgtctgggttcaagcaatt

SEQ ID NO: 62728 - DNA, 1023 bp, Homo sapiens
ccttgtatcaatacactatataattccttaaaataaataaacgtacatacttcagaacaggaactttatacttcctaagggaaataatcttggatggaggtgatttgccacagaggaaatgcataattggtactcaagtggaaatgattattatttgtgatgcaacgtcacatgctacctagttcagtgctctgtgaattaggtgatgcaaacagaatattgttgcttggaacggtagcaattttgctgtttttaaaaggcggcgaagagagcgtccccttccaaggagaaaatctggtgagattcctttaaagtgcggcccgcgcgccccgcagcctgccccggagctgcagggtttgcgccccgcggaggtgagggccgctaaaccacatttcccggcgagcccctcaggctgccgcgcctgcgcagtggtggcgtccgaggccggccgaactcccgcgctctcccgccgcctcgcctcgcctggtgtctctcccgaccatggagggggtcgcggtggtgacggcgggcagcgtaggcgctgccaaaaccgagggagctgcagccttgccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggaggtatttagagcccccgcgcgaccccgctgggcccaagcggcgtcagggacgtagctggccctcgtctgccgggcgccggcccgatcctagtgcgccgccgccgcgcggagcactggagcggacctcccccgacctctgccccggctgcctaggcgtgtggcg

SEQ ID NO: 62729 - DNA, 1050 bp, Homo sapiens
ccaacactttgggaggccgaggcgggaggatcacaaggtcaagatatcaagaccatcctggccaacatggtgaaaccctgtctctactgaaaatatgaaaattagctgggcatggtggcacacgcttgtagtcccagctacttgggaggccgaggcaagacactcgcctgcgaggtggaggttgcagtgagccgagatctccccaccgccctccagcctggcgacagagccagactccctctcaaaaaaaaaaaaaaaagattatgtgattgtgttgaggaagagacagtgggaagaaagagacaacagtctgagaaacaactcacctgtgggctttaacaatacagccatagtcacatggtcataataggtcattttcttaaaagttttttgttttttaaatagttggaagtgttgctgtggaagaccagccagatgtcagtgccgtgttgtcagcctacaaccaacaaggagatcccacaatgtatgaagaatactatagtggactgaaacacttcattgaatgttccctggactgccatcgggcagagttgtcccaacttttttatcctctgtttgtgcacatgtacttggagctagtctacaatcaacatgagaatgaagcaaagtcattctttgagaagtatgtaaatttttacatatatatatatacacacatacgtagtgtgtgtgtgtgcgtgcatatgttttcacatctgtaaccacaaaaatgtaagactgcaacttaaaaagtacgttgtgaaggagaggtacctgaggctatgagaacttaaaatgtggggtttgatctagctggagaagtcagagaaggcttccagaggaaatgatacttgaagtgagatttgagatctgaagattaggtaggagttaaccagatgaagagaagagggaaaagcatgtgtaaaagctctctggtgggaaggatcctggtaggtacagaggctgaaagatggccagggtagctggagcagagaatgggatgggggtgtggtatactatgaagctgggaattggttagggactggaaca

SEQ ID NO: 62730 - DNA, 1060 bp, Homo sapiens
gtaaggaaaaaggggagaatggctattgggtagacaaatacagaaccctgcttcagagtgtaaattactattttgtaattgtgatttatcctatcaagatgtaaaatgggtatattaatgaataaataattttaaaaatgttggctcttttgacttgtaggtattttttggtttattaaaagaaccagaaattgaggtacctttggatgacgaggatgaagagggagaaaatgaagaaggaaaacctaaaaagaagaagcctaaaaaagatagtattggatccaaaagcaaaaaacaagatcccaatgctccacctcagaacaggtgaggaaaaaacttcaggaacttgtgtgtggaggtataagacaacatgttatatagagttcaagtttgttaatagtcaaaaggtaattttgactctctttttctttcacagaatccctcttcctgagttgaaagattcagataagttggataagataatgaatatgaaagaaaccaccaaacgagtgcgccttgggccggactgcttaccctccatttgtttctatacatttctcaatgcttaccaggttggtaaaaaaattgggcgatttctgcctggagagtcatgtaggatgatgatttaccattaagagagaaacaaatgtattagctaaaatggagtttcgttatttaaactccttttttttttttttctgagacagagtctcgctctgtcgcccagctggagtgcagtggcgcgatctcagctcactgcaatgtccgcctcccaggttcatgccattcttctgcctcagcttccccagcagctgggactacaggcgcataccgccatgcccggctaattttttgtatttttagtagagatggggtttcaccgtgttagccaggatggtctcgatctcctgaccttgtgatccgcctgcctcagcctcccaaagtgctgggattacaggcatgagccaccgcatgtggcccctaaactcttatacaatttaaagacagcattcaggaagagagaattggatactgcacagaatagatagaagtcaatgtt

SEQ ID NO: 62731 - DNA, 1044 bp, Homo sapiens
gtttttttttctttttcttcaaaagacatttcctttttaattcttacatagcttacacagcatgggaaaatagcatctttattttagggtcaaaaattgttgagttttaagtgacatatcacatttcttaaactttctcaattgaccttatttgactatactttgttaattacccctgctatttttttcttgtaaagaactctgattttccctaagtttttgtatcatattacctcattcagtaggtgctcggtatatgtagagtgtcagggttaacattagtttggttagttctttcaattgatacctactgtgaattgcgtgtatgaattaaaagtgagatgcagcatgttaggtatatttaatatagtcaaatatatataaaatattaaatgtattcaaatgtatataaaactgggcaggtgaccaaaggttactctgggagtcaaatatatcaccttctcttctctcaggaactatctgctttcctcttcagaggacggaactgttagattgtggagccttcaaacatttacttgtttggtgggatataaaggacacaactatccagtatgggacacacaattttctccatatggatattattttgtgtcagggggccatgaccgagtagctcggtaagaacactgtgatcttatgactgggtctattcaatgaacagaatggtttcttgttgggaattacacagccagccaaattcatttacacttccattattgaggttcaactttctgagaagcttttgcatttataacttatttgaaattggggccgggcgcagtggcttatgcctgtaatcccagcactttgggaggccgaggtggatggatcacctgaggtcaagagtttgagaccagcctggccaacatggtggaaccccgtctctactaaaaatacaaaaattagccgggcgtggtggtaggcacctgtaatcccagctattcaggaggctgaggcaggagaatcatttgaacctgagaggcggaggttgcagtgagccgagatcgcaccattgcactccag

SEQ ID NO: 62732 - DNA, 1169 bp, Homo sapiens
tcaatcacttctcaggttaaagtactgcttgataatgctccttaggaaggaatagagttattggtcaagtttagatttttcacccaaaatgtacagtaaatacatagtgtagtggacaaaatgtccgaatgtaaatatgatggatgcaactaatggtttcctttgacttccccttaggttcaatggataatacagttcgattatgggatgctatcaaagcctttgaagatttagagaccgatgactttactacagccactgggcatataaatttacctgagaattcacaggagttattgttgggaacatatatgaccaaatcaacaccagttgtacaccttcattttactcgaagaaacctggttctagctgcaggagcttatagtccacaataaaccatcggtattaaagaccttttggaagctactgtttttaaaaagggagactaaaagcaaatacctcagtgattaatatttaagctacagagaatgtttttgtctatatggatctggaagtatgctgcttggaaaaatctgaacaggacagttccacgtttctatagcaaccacatttgactaatttccgttagttgaataagaggtattatgatcatggaggggacatttatggtgctttggattgtgtggaaactatgcattttctgttcaaatgctattttaatttattacatttagaaaaaaagttgatttcaataattcatcctgcttcaagattcaaattcagaaatatactatcatcttgaattttagctgaagaatcctatgagcatgtatgtttctgctgtaaaaacgtagttactgtatggcactcaaaaactatgttaaatgatccactaactttttttttcttggcccatgattaatggaatgtatgtaactaggtagggttcctttcttagatctagaggaagtacagccacccactgacatctgaatttatatacctgttgagttttgagtgcacccaaacactcgataaaccaggtgaagaaatttagcttccatgttctacttcagctaaaacagctacatacaacctagtacacttgaagtcagacagacatttcagttgcttacctccagtactgagccttgctttgggaaactaaaagatttagaccaagtcactgccagtttttgcctttgttg

SEQ ID NO: 62733 - DNA, 1042 bp, Homo sapiens
tagcttatttgttaaaggtggaatgttaggttaaaatgtattaatctgaggccaggcacagtggcttacacctgtaatcccagtactttgggaggctgaggcgggtggatcacttgaggtcaggagttcgagaccagcctgaccaacatggtgaaaccctgtctctactaaaaaatacaaaattagccgggtgtggtggcacatgcctgtaatcccagctacttgggaggctgaggcaggggaatcacttgaacctgggacgcggaggttgcagtgagccgagattgtgccattgcactccagcctgggcaacaagagcgaactctgtctcaaaaaaaaaaaagtattaatctgagatacactttaatttttttggtgttacatctttgacaatctaataaattcgcattcagtttcagtgggttcatgttaccttagtaattcttgagtgtcttaagagtaaagctggccacatttgtatctaaactgtttgctttgtttataggattttaaactgtctacggttcttaacctcatctgttaagttcccatgcctggagaagctaatgccaactcatcatgtgataattcaatttgtacaataaattatgaacctggaaaagctggttgtctttatttacaagatatcaaaaatataaaaactgtacaaaatgcaacaaaggcaaaaactggcagtgacttggtctaaatcttttagtttcccaaagcaaggctcagtactggaggtaagcaactgaaatgtctgtctgacttcaagtgtactaggttgtatgtagctgttttagctgaagtagaacatggaagctaaatttcttcacctggtttatcgagtgtttgggtgcactcaaaactcaacaggtatataaattcagatgtcagtgggtggctgtacttcctctagatctaagaaaggaaccctacctagttacatacattccattaatcatgggccaagaaaaaaaaagttagtggatcatttaacatagtttttgagtgccatacagtaactacgtttttacag

SEQ ID NO: 62734 - DNA, 1397 bp, Homo sapiens
ccatttaataaattatcccttctcccttctcccatggaggtcctaaattacttataacaagaaaaattgtataagtaggggttgtaattgagctgtttagttgatggtcacccgttgaatgtttgaaaaataccagctccaatttttgagtagccttaaaatggattaattcaatggactgtggtgtgatggagccaggaatgaaaatattaagctgtattgggtcagagaatgaacttagcaggggctattgtgtgatttgatgtattctgaggtgttcatgaaatagcgatcaaggtaaaatcctacttccaaaagcttttctttcaggaaggctttttccaccatctttgctactactgtgttgggtgagatatagataaaaatttacagtatttatatgcagtgaccttgagtttttagactaaaacaagacaaaatttatttacttttaaattacatccaaaccaatttaatgttgctttctttctttttttaaaagattgaaatcatggcaggtccagaaagtgatgcgcaataccagttcactggtattaaaaaatatttcaactcttatactctcacaggtagaatgaacgtaagtattgataactttaagcagttatattttaaaataatatagatggaacaacaagtcttgtttacttttttctttctttctcagtgtgtactggccacatatggaagcattgcattgattgtcttatatttcaagttaaggtccaaaaaaactccagctgtgaaagcaacataaatggtaagaagttgacatttaaacctttataatttagccattttgatgttaggatttttccctaacatttagtataaaaataaaccattgtcattttgcaaaatttatagcatacaagaaaaaaaaatacagaggcctagtatagtggctcatacctgtaatcccagcactttggcaggccaaggcgggcagatgacttgagcccaggagttcaagaccagcctgggcaacatgatgaaaccccatctctaccaaaaaacaaaaattagccagggtgggagaactgcttaagtccaggaggcgaaggttgcagtgagccgagatcacgccactgcattccagcttgggcgaaagagcaaaatcgtgtctcaaaaaaaagaaaaagaggctgggtgcagtggcttgtgcctgtaatcccagcacaatgggaggccgaggcaggcggatcacctgaggtcaggagtttgagactagcctggccaacatggtgaaaccccatctctactaaaaatacaaaagttagccaggtgtggtggcaggcgcctataatcccagctactcgggaggctgaggcaggagaatagcttgagcccaagaggcagaggttgcagtgagctgagat

SEQ ID NO: 62735 - DNA, 1059 bp, Homo sapiens
cctcgagggacgcttcgcggagggcctcatttttctccactggcgaatgcaatctaagggtcttcggaaactgtgggagcccttgggcgcacctatccgcctcacctcgaggcttctcacccgctggccgcccccttgcgcccctcgttttttctagctcctttcccattccccaccgtttctctcctccaaagctaagaactcgagttgctcctcggccagaaacggcgggcggtcctgcaacgtgcaggcgccaggtccaagcccggactcccctcttcacccacctgccaaagccgcaaattccgcagctggtgtccttcaacgaatgtaaccacctctcggcccggccggaagaagccacctcccccgcacgcgtttagccggcccccgcgattcggcctaatgcgacgattggctatggctccaaatcccgcccttccgattcctgtctctaggtcacctccgcaacacagcaacggaagtagggtgttgagcccgcccacacttccggaagaattgcactggactgtgggtatcctggtctccgcgtgtgtgagtaccgcggcgcgaggttagtggtagctgggtgcagacgccgtggcgctggtgagtaaaggcagaggcgaaaaaggaggaaacctcatggctgtcaggtctgtcccaggcctggttccctgccaggcacacgctagatgagtgtggttcggccaccttagccccgcttcgaagccggctctgttgtagcagcccctgtaaccccaggctttgtgttcggaaagtagcctaagtatcttctgtgcccctggatcgccttacttttcagagcctcagtttccccttgcttgaaaggaaattaagggtgaaattatcagcaaactagaccccccaaactttcctgtttctatgaatcatatacccatccctgattccatatccttggccccacccggtcatcacttctttagtctaaagcccttgtagagtcttattaccaagtgtctgtcagaactaacctctcctgtcttctgttttcacttatacccagttctggttctc

SEQ ID NO: 62736 - DNA, 1019 bp, Homo sapiens
ttgccttatcccttcctacatctttgtgatcatttataatctgatttgcattttaagttacttgcataattgttttatcttccaaaaagtgtgcatgttctttgaaggcagaggattatatattcatctgtagagctacagtgtatctctgacttaactgtagcttcttagtgagtatgtgctacattgaatctataacttctttttctggaagaaggtgggtggacttgtggttttgaagcagagacctttggaaagatgaagtatggattattccgggcctgacatctaaaccatctatgttgtagtcctgaatgttgtctagcatattgctggaacgttctgtctcttgcccgttgataacacctttctgaaatctgctaccaagacaacatgtcaccattatcctttgcattgtttttaggagacccaaacatggcaaacctggaagaaagcttcccccgaggaggtacaagaaagatccacaaaccagagaaagctttccagcagtcagttgaacaagacaacttatttgatgtaagtagtatgcttgtttggtgacactcactggaaacttttactgtagtgtcttgtgaaaaatgagccttatttgagaatgtgttatttttccagattttttttgcattgaagtctacttctataaatttaactcatttagagaggccataccaccacaaggctgtatcttttgaagcttggcatttagtattaaagtactgttattagctgggcgtagtggctcatgcctgtaatcccagcagtttgggaagccgaggcaggcggatcacttgaggctaggaattcaagagcagcctggccaacatggtgaaaccccgtctatactaataccaaaactagctgggcatggtagtatacctgtagtcctagctacttgggaggctgaggcatgagaattgcttgaaccaagaaggtggaggttgcactgacccaatattgtgccactgctctcctgcctgggcgacagagtgagactctgt

SEQ ID NO: 62737 - DNA, 1062 bp, Homo sapiens
ctggagtgcagtgacatgatctcagctcactgcaacctccagctcccagattcaagcaattctcctgcctcagcctcctgagtagctgggattacaggcagatgtcaccacacccagctaatttttgtatttttagtagagacagggttttaccatgttggccaggctggtctcaaactcctgacgtcaggtgatctgcccgccttggcctccctaagtgctgggattacaggcatgagccaccacacccgaccctcaagtgctttttaatggtcatgtaagagatagactgcaaaactgaccactggatttaacaatatggaactcattggtgattctatgggagatagagtggtggagtgagaggggtggaaagcagattgcagtgagccgaagaatgagtaagggatgaagtagaggcagaaagtgtagacaactcttttgacaagtcattttacatgccagttatgtggaaatatttgaaggccttatgctgaaattcaagactgtggctaggccacagacccaacttcctttgtggatggggggttattcctcacccaccttttgggttctctggggtctgaggatgagaagtcactgagccaaagctgggtaatggatttttggttcaggagaagggtgtatatcaggtctttctcatttgtgttatgcaggacctacttcacttgcctgaacttttctcacctggaatgctggtaagatgtgtggtgagcagtctgggcatcacagacaggggcaagaagagtgtcaagctgtctctgaaccccaaaaatgtcaacagagtgctgagtgctgaggccctgaagcctggcatggtaggtgtctagggtcggggaggaagagtggcaatgtgccttctctctgcctctgagggagcgtggtctaggccaccttttactttcagctcaattgtgacacataggagtggttctttttctggaaggaaggtctcttgggttctttgggcacttaatggacattgaagacttgaacctaatcattacattggagaagagaaaagagaaagcaagtccaaat

SEQ ID NO: 62738 - DNA, 1836 bp, Homo sapiens
ctgttgttgcccaggctagaaagcagtggcatgatctcggctcaccacagcctccacctcctgggtttaagcaattcttctgcctcaacctcctgaggcagggattacaggtgccatgcccagctaatttttgtatttttaatagagacgggatttcaccatgttggccaggctggtctcaaactcttgacctcaagtgatctgcctgcctcagccttccaaaatgctgggattacaggcatgagccactgtgccctgccgaaagtttgctatcttttgaaaccacttgaggcaagagactcttctatattgttccatcattcagctgtgttaaacattcctcattgcctggcaaccatcagctccttcaagcctgggagtgttgaatttgatgtctgctgtctagtgggattgtggcttaaggtttaatgtgggagtgggatagtggcagagtgtgagcttagtggcaggaacattcaagtttggatgttttgtgtgtgtcccattacctttgaattggaacttctgggactactttctcttccccagctacttacaggtaccgtatccagcctggaagaccatggctacctagtggacattggtgttgatgggaccagagcttttctgccactgctgaaagcccaggagtacatcagacagaagaacaaaggtgagggcaagaaaaggggccagtacatggtggtgaggtggtacatgtggggattatatttaagtgccattttgatgagtaacatgacagaatggtgaccctgaaggtgctgtggctttggtaaaaccagcacttaatcctagttaataggaaaggaaagatgtatgaagggccagcgagtggtaaggtctcactaagatctgatggaacagtgtcagtttttctaacctggaagattccactgcaattagggcccccatggcttctgaaccagcagtctcctggcttgtgtatttttgtgtggtaattgaattccagatcaattaggataacttcgtttccttcttgtagttggccccttaaagattgggaatttggggagtaactgatgctaactgggcaggtaggccatgggtcttttcaggtattacttgggcccacgttaaaagtccttctcatagatacatttttccttttggggcctgggtctgggcttacaggtgctaaactaaaggtgggtcagtacctgaactgcattgttgaaaaggtgaaaggcaacggaggagttgttagtctgtctgttggtcactcagaggtttctacggccattgctactgaacagcagagctggaaccttaataacttgctaccaggactggtggtcaaagctcaggtacagaaggtaagctgttatgctactactactttttaaaataaaaataattcttttcaaaatattaaatgcataaagtctaaaactactgtctgataaaggtagtcactagtcacttacgcccattgagcatttcaaatgtggccagtgccacatgttgaaatgataatattttggatatattaggttaaaaaactatactaaaaagtcttttgtttctttgtagtttctaaaatgtgactgctagaaaacttaaaattacttgtgtgactgacattgtatttctgttggacagtgctgatctgaaaggtcaaatggaattaaaaggtttataatgaagaacttatccgtcataacccccatctttaactcttttagcttatcttttgaaatttctctccatatttttgagtaataagcttctgctggtatctcttgatttttccatcttaggcattgagttttaactttttatcaaggtagaaaagat

SEQ ID NO: 62739 - DNA, 1038 bp, Homo sapiens
acaagcccagtgaggggcagagggttcccgtgggttgttaggggtgaggacagccctggtgtctgcctggcttgctgtgaatgtgccttcttgactgggtgccctctcctggaggctctgttttttttgttgttgttgtttgtttttgtttttgttttttttttttgagatggagtctcactctgtcgcccaggctggagtgcagtggcgcaatctcggcttacagcaacctctgcctcccggattcaagtgattctcctgccccagcctcccgagtagctggaattgcaggtgcatgccaccactcctggctaatttttgtatttttagtagagtcagggtttcaccatgttggtcaggctggtctggaactcctgaccccatgatctgcccgcctcggcctcccgaagtgctgggattacaggcgtgagccactgctcccagccaatccggaggctctgtttttatggaagggaagtagagctgtgttcagagagggcttgggggagcttcctaggccccatttccccctactcacgtacccctttccaggaacatcaagtgggttgtcttaatgaagacctttcctcttctcatctcctgcctgttcttctgttcagatcatgagtgacaaatttgtgacctccacaagtgaccactttgttgagggccagacagtagcggcaaaggtgaccaatgtggatgaggagaagcagcggatgctgctgtcactgcggctgtcggactgtggtctgggggacttggctatcaccagcctcctcctcctgaatcagtgcctggaggagctgcagggcgtgcgcagccttatgagcaaccgaggtggggcacctgtggggcaggggaggtgggccaggggtgggagtatgtgttgtaaattacacctgttgttaggtgagttgttgggcttcccagaacataagaaaaaaaaatttggggccgggcgcggtggctcacgcctgtaatcccagcactttgggaggccgaggcgggtggatcatgaggtcaggagatcgagac

SEQ ID NO: 62740 - DNA, 1127 bp, Homo sapiens
aggtaattcagaggcagccccatgagtttagtgtacaggagaggaaagctaggtccagggagtgaaggctagtctgttccagctcagaccagccttgagttccctagccttgggaccccagagggtttcctcagccacaccctgcccagtggggccatgagtgagtgaccatgctgtgtaaggaaagcagggatggtggcttttctctcttctagctgaggaaaggcagcgaacaccaggcgattgtgcagcacttggagaagtcctttgccattgcctccttggtagagacgggccacctggcagctttctccctgacctctcacctcaacgacaccttccgctttgactcagagaaattgcaggtgggacagggtgtctccctaaccctcaagaccacagaaccaggagtgactggccttcttttggctgtggaggggccggctgccaagaggaccatgaggccgacccagaaggactctgagacagttgatgaggatgaagaagtggatccagctctgactgtagggaccataaagaagcacaccctctccatcggggacatggtcacagggactgtcaagtccattaagcctacccatgtggttgtgactctggaagatggcattattggctgtatccatgcctcccacattctagatgatgttccagagggcacctctcctactaccaagctgaaggttgggaagacggtcactgcccgagtgattggcgggcgagacatgaagacattcaagtatggaggctctgggggtgggctggcttcgagggagattgttgttgttgtgggaggactgggaaagtaggtgggctccaaaaagttgcatgtaagtcagattctcttttagttaacaaaaggcattcaccaaagaattattttgcaagattcttttttttttcttttttttgagacggagtctcactctgttgcccaggctgaagtgcagtggtgtgatctcgcctcactgcaagctctgcctcctgggttcacacccttctcctgcctcagcctcccaagtagctgggactacaggcacccaccaccacgcccggctaactttttgtgtttttaatagagatggggtttcactgtgttagccaggatg

SEQ ID NO: 62741 - DNA, 1052 bp, Homo sapiens
aggctgggtgtagtggctgaaccctgtaatcccagcactttgggacgatgagggaggtggaaaacctgagcccaggagttcaagacctgcctgggcaacatggtgagaccccatctctacaaaaaaaaaaataaataaataaaaataaaaattagctgggcatggtggcatacacctatagtcccagctacttgggaggctgagctgggaggattgcttgagcccaggagattgaggctacagtgagccatgattgcgccactgcattccagcttgggtgacagagtgagaccttgtcccagaaaaaaaaaaaattcagatgagcctgctccttactaataactgcaaaggttgggaatggaaaccttcagcctgacacatctgtcttcagtggtggtgtgacagtggaacagggtgcttttgtgagcttggtttggtggagagtagggagaaatcctgacctacagattactgtgttacagagatgaagagaaatgattcagcttatttgtttctccaggtatctcccaataagtcaccccagattcgttcgaaccatcccggagctgagtgttcggccaaggtgagggggacattagcagcactgtcttacggaaagagcactgggctttggaattaggaatcccgaattcgaatcttgattttaccagtgttaggattgatttttgcctttctctgtccaagttttcttgtttctctagtggggatatttggttctcctagggctggagggatcatatgaaaattaatgcaaaagctgtgtacaggttttaagtatcaatttaaagcctggtttcagttctgtttgtcagcatgtcacaaaaagaaacatttttgctctcaacccaattttctataactcagtaattccctaaataagcaacatgtatccaagaatacctgttatttcaacctagacgactgtgtggtgggctggaggctgaataggaatttcaggtcatggtggggtagattctgaagagaagggtgttccatgagatactctgtggggaggagaacgaggagttctc

SEQ ID NO: 62742 - DNA, 1067 bp, Homo sapiens
gggcttagaaattatttgaattggtaagtaggggtggcagttttgtgattcctttgaggtgattgtggactgataactttcaggctacatccctttgtggtttttctgagaagaaaaaagaaaatcaaaggctgagtgccgtggctgacatccataatctcagcactctgggaggccaaggccagtggatcacttgaggtcaggagttcgagaccagcctggccaacatggtgaaaccttgtctctactaaaaatacaaagaaattagctgggtgtggtggcgggtgcctgtaatctcagtttttgggaggctgagacatgagaatcacttgaacctggggggtggaagttgcagtgacccgagattgtgccactgcactccagcctgggtgacaaagcaagactctgtctcaaaaaaaagaaaaaaaaattacttgaataaatgaatgctcattttattaaaaaaaaaaatcaagaaaatgctaatggaagggtagcatagggcagagagccctggattttgagtcagaagccctgattttaactcctggttcagtagcataaaatgggcttaatatctcccctgctgaactcacacagttgtcaaattcagtgagagataatttttgaatgcagttttgcaaagtaaagcaacagccaaagtattatgaaagaagtaaaacaattttgtttcctgagtttataaagcctattgtgggctacctgctttaaaagcagcttgttcataagtagatgaatgaaacggaaaagattagcctcgggccagtattgtggacattcccctttgaggagagaaacggccttggagggtgagtatgagtaggggagtcccgtacagtcaatccgtggccacttgggagagatggtttcaaactggaagtcttatccagagatgggtttactgtttacatttcctttctgcaaacagtgagctggaggatggccacactgctcttaacactcactctgttagccccatggagaagattaaacagtaccaggccggccagactgttacttgcttcttaaagaaagtaagtagtttt

SEQ ID NO: 62743 - DNA, 1861 bp, Homo sapiens
gagcgagactctgtctcaaaaaaaaaggagaaaattggagtgcatatttagggcaagacactgcataaacagtgaaggatccaaatccaaattggtttagaaattaaaaattggcctctggagatggttaacaatcgctgggcacagctgagcttggaggaggctacagaggtctgtgggattggttctccagtttgaggacatctctggagtctcttttgcctcctggtcagctgagaccctggaagagatgcacattctgctaggctagcaaaggttctgagctggagtctgagggaagctggtgagaagtggaggttgggcaagggcagtgggatggaagggtggattcctgtctcttggaaaagtgtactggggccctttccaccttgtggttttaggaaagttttaatggcgggaaaccttgtatttgtatttgccctactctggttcctttttttccctcagtacaatgtggtgaagaaatggcttgaggtggagattgccccagacatccgggggagaattcccttattgctcacttctctgagcttcaaggtcagtgtgcttgagatccctggagaggggacccaagttccctaagcttggcccagtgcctggtgtgtgggtttacagtggatttgaggaagcttgttctttatttaagggttgctttgggagatacttgctttggagacttaaatgctgtggttttggataaatgacagcctttcttcaagcatcacaggagtttttttatccttccaggttctgaagcatccagataagaagttccgggttggccaggccctgagggccaccgttgttggcccagattcctccaagaccctcttatgtctgtccctcacaggtgtggggatgaaacagtgcctggtcggggaaggggagcggcaggaaggggtgggatgggttttcagctattgcttgagttggaggaccccttcggtattggaatcctcagaaagcctggtgtgggaccttcttggaacagtttttctcttgggctttgctctggcccagttactccactgctctctgagttacctttacctatacaggttacccttacctacacaggtgtttttctcaagtccctgggaaagagttgtccaccacttggccctgaggtccttggctacatggcagggtgatctcagtctagatggttctggatcactcagcccagataccccaagtctgggcagcctccaccttccccagcctgtgtgtggctggcattcccgctcctcccttagctcatttcctcttccctgaatcaggttggttcttccaccaggtcctcacaagcttgaggaaggggaagtggccatgggccgagtggtgaaggtgactcccaacgaggggctgaccgtctccttcccctttgggaagataggaacagtcagtatatttcacatgagtgactcctactccgagacgcccctggaagacttcgtcccccagaaggttgtcaggtaagcgaagtgttcttcctcttttcacctgtctgtggaattggtatatttaaaaaaaaacgttgttgtaatacatgactttttatcagaaaaacaggtatatgaaatagaaaatgaaaatttctgtaacccctctgtttctctaccactttttgccattatgtactttgatttctatctttctagactttaatgcatatatatatagtttttctttatataaataatagaatatcatttgatatactgtttttttctcatagtttatcatgaatttttttccttttctatgctaatatatcaaaatctattttgtccttttaccttattttaaaacgtttgtttagtattctggggttttttta

SEQ ID NO: 62744 - DNA, 1082 bp, Homo sapiens
tacccagaaaagctgaggctgttcagattgctgcaagaatcctgtctgctcaggctcttgttttccatggaaagggtcagatatccagatgtgggtgtccaaggttgcagatggtagtcctggtgaggggagatgctttagcctccagggttccattgtaggggtgagcgtgccatgtatggagttggcttgaggtcagcttgctgtatggttagacatcaatgttaatgaggccaaggctttaggtttgacctctctggcttggtccgcctctccccatttctacatagctgggccccaggcacctgcttctggcctggcaagatgttaggagagagtagagttgggctctaaaggttatatcctgctgacaggtccagagtcatattcttatttactaagtatgatggttgcaggtgtattgggggtggcatgggacagtggaggttaaaggtgtgcatgtaagccttttattcctttagaacaaacccggagacgaaaagcaaagtagaagatccagagattaactccatccaggacattaaggaagggcagcttctgaggggctatgtagggtccatccagccacacggtgtgttctttcggtgagtgaggggggctctgcacccggacccaagtgccttccctgagcctgtgttgctctggggtccactgtgttcctcggtcaacttctttgatgggaatatgaagggaggagagtttatgagtccccactcatttttaaaattccaagttttctaatacttttaaaacaactgttgagttattagttatttggtgttttggacaaagaatatggcatttctaatttctgttctaagtaagtctggggccgggcgtggtggctcatgcctggaatcctagcgctttgagaggccgagatgagagaattgctttgaaggccaggagttcaagaccagcctgggcaacaaagcaagacccccatgtctccagaaaaaaattaaaaattaaccaggtgtggtagcatgagcctgtagtcccagctatttggaaggctgaggcgggaggattgcttgagcccataagttcgaggttacatt

SEQ ID NO: 62745 - DNA, 1902 bp, Homo sapiens
cgcctctgtgttcctccaggagaagcaaaccaagccagcagaagcgccccggctgcagctgtcttcaggcttcgcttggaatgtgggactagactctctgaccccggccttgccacctctagcagagagctcagacagcgaggaggatgagaagccacaccaagccacggtgctgtattttgcagggcatgtcctttttgcagggaccccttggtgtcagtctcttgtgctctgttcctagactgggtgtcttcctgggtgagtgggggagggggcagcggccagtcccaggccagggggtatatatagagccctgggctgcccagccaactcgtgacttccaccacagacctcccctaggccttgaggagcagatgactcacggtgtttctgctttccatagcagataaagaaaagcaagaaagaaagggagttggagaagcagaaggcagagaaggaactgtcccgcattgaggaggcgctgatggatcctgggcggcagccagagtccgcggatgattttgaccgactggtgctgagctcccccaacagctccattctgtggctgcagtacatggctttccacctgcaggccacggagatcgagaaggcccgtgccgtggctgagagggcccttaagaccatctccttcaggtctcagctttgccccagggagcacagtgtcttcgcacgttctgggctgggaagtttctcaacctgtggggtagctcctcctaggcaggccggcagcattttgggtggctgccaccaggggcccatgggtcctcaggctttctgccatagctgcggccatctgtgaaatagatctactcatttatattttatagtcttcttccctgaaactgctaagggtaaccttcacaagagtccatacacttatatgagggaaccagtttgagcagaaacacagtaagaaaagaactcactacatacctgggcgaaatccctgtggtggttttccaaacagagggagtttttgaggcctaatgaagagggaaggcagtcctttgcttcatcctcttagcttgaagagagaatcagacccaggactctgcgtccagcccaaacctcaggcccgtttgggatctggtgggcatcctttctaggaatggaggcagaatccaggagagcctcagactcagccattggggttggggcaggggtttctaatgctgcaggagctgtggggacacagcctcttagggtctacatttggggtgggatctgaggacacagatagaggctgggagggggaggtggttcctgagtctgtctggatggggcgggaggctcactggtttcatgtggcgctcatgtgctgactgctctccctccagagaggagcaggagaagctgaacgtgtgggtggctctgctgaacctggagaacatgtacggctctcaggagtccctgaccaaggtctttgagcgagccgtgcagtacaacgagcctctcaaagtctttctccacctggctgacatctacgccaagtcagagaaattccaggtaggaggttgggccacagacgaactcctgggagttccagggccacaatctcagagaagagcccctggggtgctgggtccagtcctgctgtgagcttgccacccaacatcggggccccaacttccctatcttccaagtaaaagaagtcatttccctcacctcttcttcaggcctgtggggtcaaggtgagggaaggagtggctttggaagtgaaggggcagtggacccctggtgtgtctgccttgggctgctggcagggcatcacagacagaaggggacgtcccggcccagcatccgctctggcgtctctcctactcccccttgtcattctcatgttctaggctaggaccgccctcccatgggtgcggatcagca

SEQ ID NO: 62746 - DNA, 1058 bp, Homo sapiens
aaatcctatgccgtgttagggaaggggacaggactaaaatggcccacaggggtggcagggagggtgcagtgagtaccaggggttcaacacaggggaaggctctggggctgatgatctctttgcagttgggttctattatctgatttggtgtggggaagagatgaagcctggcctttctcagaaggaaacagtctgaaatttcacgagtcagaagattctgcgctcagtgggcaggccagaactagctctcgtaacctagtgctcatgtccaagaagcaggccagccccagcttctccttcctcccatccctgcccgccacccgccccacctctagaacctttggatgctctcccttggccctgtccggcttcctggcatatgactcagtcatttcccatggaaaagctctcaggacacttaaagctctgccagagaaaacgtttaattccctcatgaccaagacaaaaaagaactggcttcaacaactagctgggtctgtgctggcctccaagaccttgaatagcccagatatggagaggttaggtaatgtggccatagtgggcgtgggatgagacatcatcagttcacgccaacacccgtggctttcctcagcagcccaggtttctccatttccccctctgggctctgaatttgtcctcctgtcccagactcatagcctcccctaaagggcagaaggtaccagtgaggctgaggctgaaggaacacccagagactccaagatcggaggggagggcccactccctggagcctactgaccccctccagctggactgacagcctgccagggacaaagcaggaccctgaccacaggaccctcgggaatagcccctctactcttgctccccagggaactcccctggaagagggaccctcagcatttctgggagtccaggggcctgctgcccacaatccccaggtagcctcagataaggaaaaagataacaagttggtactgaaaataaagcaagcgaagagggatttaaaaaatctcaacttccttttcatcctgacaggatttccccaagcgtgctgcaga

SEQ ID NO: 62747 - DNA, 1056 bp, Homo sapiens
cagagacaagcaggcacattttcatttttagtgcttactactgggaatgtgaaggtctgtttagtcttgtccagctaacataaaccagccggaactgggccgtggcagggaactttgctgtagttcccttatttggaatgaaattcattgtttttcactgggaggtattgggggctttggggaggccccactgggccctgccccagggtgtggcctgagtggcctctccaaggctcactgaggtgcctgtgccacagaggctagccctgggatacctcagcccctgccaggttcacagactgcggacagccgcgagccacgcctagtgcctcaggaatggagagtgtctggggtcatgtccaactctgtcagttcacagaggagaaactgaggctcacagaggagcagggacctacccagactcacagggcaagttgaagcaggtggaggtctagaacccagggcccctggtcctctggttctcagacctctatactgtggggccagggtgcctctggcctaggagctggtgagggtggggggtgggaggacaggggtgcggatgaatctggctggagtggtctgcagcttgggaatcccccaaggcctctggggcaggctagtgtgaggcctggggcagtgaggccgggggagggctgtgggagaggaggaaggggaggtgagaggagagggagaggtgtccaagaggctgggggagctggatccggccctgaccccgctgttgtcagtgtgactttagccttggtttcccccatctgtcccagaggctcagtctttttactttttctctttctttttgcacctctcccaggaggtctcctggatgaactgagttggggatgtttctttttctttttttttcttttttttgagacagagtcttgctggagtgtagtggcacgatcttggctcactgcaacctccgcctcctggggttcaagcaattctcctacctcagcctcccaagtagctgggactacagcatgcgccaccaagcccagctaattttttttgtatttttagtagagatggggt

SEQ ID NO: 62748 - DNA, 1169 bp, Homo sapiens
ctggggcacctgtcccaacccccgaggacgccctctgggctccctggctccagtttctctgcagcacttggcttgcactctccatctctgagtacttttgctctcctctccctcctcatctctcactcttccagactcgaggcagcagcctccactcttgtcctggctctgggcatagaaggaagctttcagctggggttccctgcttcctattctctactgccaggcccagcctaatgagtagagaggatggggccctggcaggatggccataagcctcaaatgctgatgaggcggctcatcaactcaatcaaattatcccttgttcttgatgaaggaaacactatagcagcaaggggctgcctcccagctcctccacagcagggtcacctcctcttcctggcctccccagaccctagtcacttccccctacttcataaaaagaagttaccccctcccttgtccagtgttgtcttctatacctcctgatgcctggatttatatgtcatattaggcatagcagcagaagacattactcctgggtcccagtcctccttgccttccacccactgtgtggccttggcaaagtctctatcatttattgggccttctttgctacacctgtaaaatgggcccagaacttctttgcctgcttgaaggtaggggctggccccagtgctctctggaggctcttccccattagagagcttggtgactgtgactgtgatggtttctattccccagtgaatttgttccatgttttattctggagttgctggctctgccttagactttgagttctgagagggcaggtttaggctgggaatgaggtgctaggccttggggaacctggatgagagaggacttggtgaggaaagccttgagctaggtagaccatcatggaaaccaagatggcacccaagggaagaggagctgtctgaaaggggtcaggggacaggagatggcagggaaaagagggacagctatagtagtggggagggccttgggagctgaatgggttcagagagccaaggggcctaaggttccctagatggcatgagaggacagatgcagctggggattctgtcagaccaggcccccaggggcactgccagccctgcttcctgcctgcaggctttgaggtattaagtccccacccaggtcatata

SEQ ID NO: 62749 - DNA, 1051 bp, Homo sapiens
ccggaagtcgtgggcatgcctctggctcaggggagcatcggccgactgggcttgctctcccccagatcccgcccagccctctgctgatgactctaggtcaggcctgaatgtccctcctaaccgcttccccagacccactcagaagtgggagcagcagggtcttgagctgcgggctcaggacccagtccagtcccttacagggcccaggcctctgagttccatctgctgtgggacagcctccacctttcccgtggccccttcctcagcccctacccctctgtcctcccacctgcccgctggctttctcttcccacccagccctttccctggggtccaagatcccagaccttgaggacaggggctggtgtccaggccagggccagggaggatggtgctgtcctgttgtcctggtagaggcccctgagcttgtgttggatggtgacattgtccctcagacatggcctgagtcctggtcctgcctgtgacctgctgggtaacctcacgcaagctccttagcctctcagaacctccactttcttctctgtaaaacagatatcatcatagccactgccacccacacagttcctggtgcacggtgcatgctcattgcatggcagctgctctcttgatgatgatctgggctcccggcatgcctgcccagggctggaggggcctgccatcccagcctccctcttccccctctgttcccacctttccctcttccctgagtgtggggtgccagtgtccaccttaagatttctctagaaactttgcgagtctgtggaagcaggcgtatgttgactgtggacattgagaggtgtgcatgtaaccatgtgagtacatgtctggtggtcagtagatggctgagtgcgctcagtggtgaatgctcccaagtgcttatgagcccatgtatatgcacatttgtgtgacatgatgcagaagaatagtgcaggtctgtgttggggtgtgtggtgtgtgtgtatgtgcatggttaaagggataggttggtgtgggggggaaaagcctggattctggtgctgcactgcctggg

SEQ ID NO: 62750 - DNA, 1073 bp, Homo sapiens
atgctgtgaactaggctatagggatacagtagtaaaaaagacaatggctctgggcaccatggcttacgcctgtaatcccagcattttgggaggcctaggcgggcagatcatgaggtcaggagttcgagaccagcctgaccaacatagtaaaaccccgtctctactaaaaatacaaaaattagccaggcgtggtggctcgcgcctgtaatcccagctactcaggaggccgaggcaggagaatcacttgaacctgggaggcggaggttgcagtgagccaagatcacgccacgactctccaccctgggtgaccgagccagactccgtctcaaagcaaacaaacaaacaaaaaaagaaagtggtctctgccctagggaggctcacagtccatcagggggaaagacaggcacaaataaccttgcagcctttcccagtgcagtgctactctgcagaacacagaagctgatgggagtgacttctcaactctcctgaggatggcatagaaccaaaatcattctggatgcagaagagacaagtcaatgcattgcatacaacaagtgcctcggggtatctgggcttaatcttgtgtaagaaccaggattgggaaaggctgcttggtgatgcgtcctctgttagggggctgatggggtcctcaaaggtccatagtaaggcccctaacctagtctgggggtcagagagacttctgggaaaaatctacgtccgaaggatgcatgagaaaggcagatatataggtgggaaggaggaaggaaatgttcccagcacagaaatgggcctgggccaagcctggaaatcaaagacaggtgtgggaggtggaggcccctttagggaacccaaagaagtttaattctgcccagttttacaatcatctctgtcccccaagttccatccccacctgtccttctcccaccaggagtcaggcatccccagctttccaaccattctcctaaatcctttcccccagagggagccctgttcagttaatgcagttaaacgagtccatatcaggaccaccctggcaatctgagattaggacgtttggggtaaaataagactga

SEQ ID NO: 62751 - DNA, 1073 bp, Homo sapiens
taggtaagcaggtcaggccatggatgggttgtgtccccagacagagtggaggcaggggctggtgtctctccccagtggacggtcctccctgccctggccagaatccaagcccacaatggtgcccatgccatggccccagcaggccctcctccctgttatggtgcccatgccacagccccagcaggccctcctccctgttatgctggagttctgcagatcacctctttctttggggcgccctggcccaagcccaggctggtatcgtcaagaataacagcttccttcctccagggagaaggacccgccagcaactaaataaacacaggttttatggggtgattaatacatggaaaaagaagctcctatcccagtatctcaaggtctccttgctcctctcagaaatgtcaattcaggaagagcagctgtgagtcccagcaggacttggctggcgggccaagagcccacttacagggtgctccagagcatcccttggtgcctaccactgcctaggcactaagcgggggcaggtgggagacagaagaatcaaaaacccagcccctctcctggaataatgttttccctgggggacacatcatataactgatgcaaggtggcccaagttcaattctgcaatcaagtgtgacctgaagagtaaaactgtgtgtatgtgtgggaggggagtgcagctagagagcaatccaggaggacttcctgtaggagacaagttttaagtcaggaactaagtgaggtgaaaagaatggattggttgaggaacaatttaggtcagacaggggggtgtccacaggtgcagaggtggggaattggcggtcagtaggggagcagatccaggaggggaaggaatgaggtagaaaggtagtgggtgacttgtggaggtgaggggtgtgcacaggtgtgggtatgtgtatgcatcacaggggagagagccatgagagctgaaagcttccagcagcttttgtgctgtcaagttgttcagtaagagggactggctggttgacagtggagaagtatgagacccagagatggggagaggcctgcccaaactctcccagctg

SEQ ID NO: 62752 - DNA, 1004 bp, Homo sapiens
gtgctgagcatgagtgatccccagccgaggaccacactgccatctgggccttctgcttcccaggctaaaccaatatttaccctcagctgtggctgctaggggccaagaggcaaatattagtttaaggagcctgagccagctgttgggctgggggaaacagctgaggctgccgatcatgatttcttcctctttgatgattttcatttctttttgattaagaaaaaaatcttgcttttccttctgcttcagagggttttctggtgcttcctttctgcttaccccaaattctgccagctatatcagtgccccacaccaaaccctcccctccattaggaagctttcccagacctccctcattcaaaatgacccttcctcctcctgaccatcggaagcacttggagacctaagtggtataagcagctttgagtcatgtattgtcctgctctttaaagatccagcatatatcctctttgtatataaaggaaggtattattgtgcccattttgtagataaggaacagaggctgagagaggtctgataacctgcccaaggtcacacagctggcagttggtggagctgggatttgaacccaggagcttgggctacattaccttccagcttctctagatgtgagtccatctgatctccctattaggtctggatacccgacaagagcggggacagtggccctcctgtgccttccagagtcgagcttacaagagctcaaggcatcaaggatcaactgcacatgttgggcacagataggccaccagggccccagcagtgctggtacaaggaagaggggcagtgcagcgcccaggatgccagattcagtggggaaggtcggtctgcctgccttatagttccccggaggctcccgagggctttgtctggttcagttattcctgtgcactctagttttctaccacaatgaatatatatcaagttgaaccatatgtaatcaccagtattggactgtttttaacttacaagaaaggcaatct

SEQ ID NO: 62753 - DNA, 4101 bp, Homo sapiens
acgtgtcccggcaccgattatgtaacttgttgcttccgaatgtggggccaccccactgcttggggtgagaggttgcccatctggtttttctaagccttacccatcaagtggtgcagtcttgggccgaggttggtcccatggtgttctcccatggcttggggccccaaacactgccctgacctctaacttggtatcagctcactcaactgtgacctttgccgtcccttctgcggagggtgttctaaccagctcctgtgtctcgagtttcatctatttcagggcttcgacacagctgggctcactgatgggatggttattttggagctgctggctgcctgcagctgctcctgaccctgaggggtggagagggagagaagacagacttgggctgggcactggccctagggattcgttccgtttttagctgtttcccagcagcttttgtccctcccctcccaactctagcaagatttcaagcaaggctaaagggatcctcttcctacccccttctctttgtacatcctccactgtttctcctttctttcttctttatcctctcacctctacattttagctgctgcttcttggtctttggtgatttcattcaatgagtatttcctgggtacccatcatgactgatgtgaaatcctgcattaaggttcaaaaagcccatggtctgaggacaggtgtacctgacttttagttgagactgtgctcaagccaagcaaatactaatatctgaagttatcgggtagcttctgggtgctgggggtggtcccactttacctcggatctttccaacaacaactcagggcaggtattattacccctattctctaggtgagaaatttgaggctgggaggaaggttgcttacccaaaagccaccagccaagtgctggatcagacatttaaacctaggcctgatccagacctggatcaccccaaagcccatgcactttcttctgaatcatgtggcatttcacatgccaataacaacggcttatattaacctaatgactgtgccaggtctcctattaggtgccctgtgtaccttactccttttcatcctcacagcgtctcttctaaggggagtattagatacagattttatgtaaatcagtagatgctgatttcactgctgaagaggccccaagaagttcagctatttgtccagtcatatagccctgtcatacaggaaatggcagggccaggatttgaacctagactgatgacttcaaattcattgcacttaactgtgctcctgtcctgcctactagtatatgaatgttggttactgaaaaaaacctaatgtacttttaggttgcattattagaagtatagcatatataccaagggaggtgatggccacactatgccttgagctggttggtgcacatctagagtactgagtctggttttgttcattatctaagaggtgggaaggtgtgtggggactctgagtattccctgagaattgtcttcagtactgggctgataggcagctcaggaggtagtgggttaaatacagggaggtagattttggtttaaaagaaggaaatactctttaaagacagattaactccacaatggaacaggttgcctggaagttagtgagcacctggtagtgtgcatgtttaagtagaaggggactcctgaaggggcagagagaccaggatagcttgcatccagccccattaagagctctgttctgagggtctgcccagccccaggagctctggactgattgtcctgagggggtggtgtgggccctgtgacagctgtgttcctggaggctctggctggacatctctgagcgacctgattcctcttctccctgctgttactgccccttcccctctctgtctcccaccctctgaagttcccaagggtcagtgcctggaatcccagaggggtgagggagcagggactgttccccagggtccaggtcagcccactggctttcccccactctgcaccatttgtctctcctacctcccccctgcacaggccctcctggcctctgcctctgcctctctgcagccccccagcctctatgcaccatcactgtcacagagtcaattccctggaataatcacattttctggccggctccctcctcctcgccaacacgattccaggaaaccccaatcagccaggccccaggaggcttctccagagcttcaggaggcttggggggaagggcccacacccagagctttctgggggccagacaacacagttcctggaaggggcagtgaaagggtgaaagaaaagagggaggtttagtgaccatgtctacattcagttggaactgaattttggcctctgctgtccctaccagaccaatcccccaagctttgctgtcatacctgagaaccccagccatccttaacccagttcctgaagagacagcacagattctcccttggagaggttcagggagaaggcccaaaggaagggatcggtccatggtgcggcttacagtggcaccaggcatatttggagagattgactcacgcagaaaggcttcaataaacaaggagagtctggaagtgaagaatgcggcattaggagttggacagacctttttttcaatcctggatctgccacatggcggctgtcataacgccgctgagctttatctgtaaaacgggaacacttccacgggctgccgtaaggatgaattgcaggggtaattcatggaacatggtgatcacttttattgaaagttataggactccataaagcagaacataacacagccattagaagaatatggtgttggaaacagttattggcacggagaggtgttcagatgctggggataagatggaaggagcccaggagttaaatttttgaaaattttgaaaaaagctaccagggttcttagcctggagtccttgcccatgaatggcttcatgtagttcatgaatgccgagaaattatctacagaatttagtgagaatgttcatttttctggggaaaagggtcaatgtcatcacattttcaaagtgatgtagtacatataaaaggtaaaaaacaagtgatgtttatatagcatgactcaatttttgcactaaaaaaagtaaccagctgggtgtggtggctcacacttctaatcgtagcactttgggagactgaggcaggaggatcgcttgagcctaggagttggagaccagatgggcaacatggcgaaataccgtctctaccccaaaaatacaaaaattagctgggcgcggtggtgcatcccagctacttgggaggctgaggtgaggatggcttgagcctgggaggcggaggttgctgtaagctgagatatctccactgcactccagcctgggccacagagcaagatcctgtctcaaaaaaaaaaaaaaaaaaaaaaaaaaagccaaacaaacaaaaaacccaaaaatacagcctttaaaaaggccaaaagatcatacatccaaatattaaaaatgcttttctctgggtggtgggcttataggcgattgttttttctttttgctgaactgaattttctacaaaataccgttttatattttgtataacttgtatgatttaaaaaagaacgatgagtttgattccctgttaagccactttcaaaagggtatcttggatagatctacttctcagcctgtgtcctgacatggcaatggtagcctcaaaaggtgattgttaaggttagatgagacaatgtacgcaaagagggtgtctgtgtgtttgctggggggtggttgctccctggctttccaggatgttaggccttcgtcagtgcactcgacagacggttactgtttgtcaacagaatgcttggcgctgttctagctgctagggataagacggaaggagcccaggagttaaatttttgaaaattttaaattatgaggaatacaagtttactgtagaaaatgaggaagtacacatatgcatatagcaagcacctgtgagcatttggaagcatccacatggtttcagtttcggtgcttccccccacctattcctctgcttaaacagatgtcctgcaagagtcgtttcttgactgtgttcgctaatttatgtcacaagcatcgtgtgcgccattagccatccgggat

SEQ ID NO: 62754 - DNA, 1421 bp, Homo sapiens
cacttccctttgactgtccaatccaaagccagtctctcaagttgtatggctcaaagagcagtgaccacaatgggtcatacagtagggacccacctccacaaattagaaccagagttcagactccattgggcacatctgggaggaaggcaacctcctttgtcgtcttgttggtaccagtcattctcaagtatctctgacacctgtggtggttcagtttgctgagcctgccacctggtatgaattagactgggtgtgatgaacattcatccatggatataccctaccattttgcgttgccttataaccaaggcacactccccataagagtttactgcagagaaagaacagcaaaacagccaccctccttgaatttacaactcattatctgcaacaggttttctttaaatccaagacacaggatgggaaatgggtttccccaccaggtactcagaggtctgcaggaagtgactcccgggcaaggcagacttcagtaatccctgaagcgtgagcatgtggactgcatggctgggtggggactggtggatgtctctggagctccagaaccttggagaattcctcatggaattcccctcccagctcttagtgggctctgtggggtcaggaggagcccttcctccaggttttccttctttcctcctcagcagagaaactggagaaaggacattaaactcagtgcagtcgatttgagtgctgaaatatttccagaatcaatggtggtgctaaactatctccatgtttctagcatttttaatagtggagttggtttgtttttaatctcatcacaaaaatgcagtgcccttggggaagggaccagccccttggcctgccactttccaggtgtcctttatcactttgacgggactctttggtctgcagaaaatgctctgtcttggcatgcttctagactgtaagatttgggttttgttttgtattttatgtttacatgcatcttatatttccctgaaaactaaataaagttttgggcctttttaaccgaacggaatcacctcttaattctccctgtcaccaaaaacacccatccagctgaacagccaatgtcccattatcccaaattgcaaagtggacttcaggatcccagggccctctgaaagaaaggacactggagggtgggggcaggtaggtaagctctcgcttttttttttttttttaacagggtctcaccctgtcacccaggctggagtgcagtagcatgatcataggtcactgcaacctcgacctcccttactcaagcgatcctcccacctcagcctcctgagtagttgggactacaggcgcaccaccatgcccagatgatttttctattatttgtagagacaggttcttgctatgttgccaaggctggtctcaagctcctgggctcaagcaatcctcctgcctca

SEQ ID NO: 62755 - DNA, 2378 bp, Homo sapiens
gactttgggggcagtgagagagagctggaaaggggcaaccctgagcagcaggtgtgccccatgccctgtgggtttcccctatgtccaatgactgtagacgggctgtcttgccaggcctcagccccgtctaccctaagcctggccccaaaggtttctctttcttcctccttgattttccatcttgacgaaggcattatatagaatcattttaatcactttcagatgttagagcagcgtattttacaggcatttatatccattgctttcctcagcaaggcatgttactacttttatcatctaaggaaaaaagacaagggaattccagtcaggcattattttcctattactagtgtttgcagaataggtgtaggactatttaagtttagaccttggtttggtagttcttgtttttaataaggggaaaaagataaaataacccctatttttcctgttattgtatttaactaatatattatttctttaaggttactcacttcccctacccctccaaataccttgcattctcaatcaaaaatggaaacaatctgagagacaggaaaagtgcaatattaccaagatggatgccagggctcattggggacaatggagggaataccagtggcgctcagagagcaagaggcagggagcggggtgctgaaggaatcctagctgtggaacaggtgggtgggttggtggagtttgatcttgtggcgttctcctctcccccttctttgggaagatgataggggtccctgccagatccacccagaagaaagggattcaggcatggggcccttgacctctaggccccagtccctggagcagaggcaggccctcgggagctgttccttgttttgatttctgttgtggtgcagccagctgctcagagagacctggcctaaaaatgactcccagcagccctctctcaccccagtgtcctgatatttgggctgtgatccttctggtgtatgtttgaatctttctaaaactgggtgccctcagttcagtttctaggcaggaagcctagaagtcaccagatctttttgggggatgtgagaaccttgagccgcgcacaccctggtgagacaccaattcccacaagcctgcagcagggcctggggctgagcctgggctgcccattcatctcagcgacttcagcctgagaagtgagccctgcctgggctccacacccagagagtccatacaaattctgctccgggaagagtcggggggtctattcaagtttctctgcagacaaaacttcccacaacaggtaccaatctggcctccttcctcagcaccggtagagaaagcaacagaatgggaagtttcctctgggttggagcctcagagctctgcccctcaaggtgacagggacgtccctgtggcttgttccctccacctccagtactgtatgcttgctacttcaaccccctatttggtgaatttctgcacagacacagatctctgtgcctggaatgggactgtgccctgtgcgggtctctcccttggcgtatatccatctagatatttagtctttgagaatctcaaagcagagctctctgggaagagaactgtccacattgctaaataattaagattccctcacttttttgagggccatgtgttgtgagagagagagagagagagagagtgtgtgtgtgtgtgtgtgtgtgtgtgtgtctgtgtatgcaagtgttggtaacttcccacttgaactaaataacatggggttagagaaaaaaaaataccaggcaagctgtctccattgaacaagtccttggcaatgggcaggtcccaagggactcacagcttctggcagcaagtgtgtcattcacacacatcattctggctggagagtgcaatgtgtcatttttttttctttttgtaattattttattaagtatttagttggaaatttcacactggcattaacaggtctagcataagtggcctaggcagtcatcccaggctccaaaatgaagatgtgcaaaagagatgccactgggaatagaaacactgagttggttcagttaggtcatcccctgcagacgtgtcatcgagcaggctgactcccacccctcagccatgccatgggtatgagaagccccttataatgaaagctgccagccctttcgtccttgtttcagagggtgggtcaggtggttggggtgagaacttgctcacggtgcacccaacaagacctgcaggtgcatataagtttagtcccaactgcagggccagaccaaacacttcctgggaagtgtgtggagggctgtgctagaccttcctgagtttctggctaaatcatcagccctgtttggtgcagtctcatgtctctgtggttcccaagctgcatgatcagagccagtgagaag

SEQ ID NO: 62756 - DNA, 1910 bp, Homo sapiens
ggcagaacgaaggcaaatcagacagcctggagaagatcgagaggcgcgtccaagcactgaacaccgtcaaccagagcaagaaggccacgccccccatcccctccaaacctcccgggggcttcggcaagacctcaggcactccagcggtgaagatgaggaacggagtgcggcaggtggcggtcaggccccagtcggtgtttgtgtccccgccacccaaggacaacaacctgtcctgcgccctgcggaggaatgagtcactcacggccactgatggcctccgaggcgtccgacggaactcctcctttagcactgctcgctccgctgccgccgaggccaagggccgcctggccgaacgggctgccagccagggttcagactcacccctactgcccgcccagcgcaacagcatacccgtgtcccctgtgcgccccaagcccatcgagaagtctcagttcatccacaataacctcaaagatgtgtacgtctctatcgcagactacgagggggatgaggagacagcaggcttccaggagggggtgtccatggaggttctggagaggaaccctaatggctggtggtactgccagatcctggatggtgtgaagcccttcaaaggctgggtgccttccaactaccttgagaaaaagaactagcagagggcctgggctcttccagcctcagtgtgcctctctggccgcccactggatgagcggtgagacgaacaaaagggaaaggaaaaaatgggggtggggggtggggggtggacaacattcaacactgcagaatgggtgacctcaaagatgccccctgtccaagccatcccacagctggaaggtaggggatgggggtgcccacactgagtgaggaagggaatggaccagggagtcccaggcctgggacccagagccaagaaagctgagatatcctgtgcaccatagggacttcaccaatggattacatgccatctgggacaggccatgtgggagaccccagttgtgcctttgctacagatctggaaaagacaaggtcatgggggcctccagtgtcctgcccctgcttggcccagttttgattgctggcatcttgccaccccaggtatccctggtattgtcctaagctgtatttgtgaattgtgctggtttcctgggcattgccacgcctaccacaggtgggtacattagaagccaccactggctttcaggcttgggggtgtcttctgagctcaagcctgcttctgggccaggccattgtcactgttagttgaagaaaaagcagttcccaggtgccagcaaagaccatctttcataactgtcactgtcttggccttgagaagagagcccgctctccgtggggcaccccatggaggacacagtaccagagtttacagagagggtgggcgaagccaccggtctcttcctaatctgcacagactattttgggtatttctgggcgggcagttcctttgcatgtttcgggagaggtttgttgatttggggcttatatgtcaggcctttggtttgcgtcttattttaggggttgtttgggggcctgggtggtcggcctcacatgggaaggggatgggtagtggatggggtttctgttgtatcttgtgggcgggtgattttgcttttgtttttgtttcacattcttccccctccacaagccaaagtcgtttcatttggtttccactgtgtggactgtgctggagcttggcgcctgccagaaaaatttggggctaggcaagccccaggttgcagacatggtgaagcagagaaactgttcttctggttcctgcacaacctcagaggggcaaaaaccctccccaggaaggaggagggtgttcaggagccagacttttggagagaaggcagctcccagcctgctgggtgaccgccattctgcgtgtgttc

SEQ ID NO: 62757 - DNA, 1686 bp, Homo sapiens
ctggcctcgggcctgtacctcccaggtcacttcatctgcatcttcccatactcttctgaccctagagaccctttcaaggaactcaaagggaggacctagcaacatcgagggtacgaggagggaaggggcagcagaagggcagtgttttcttcatacgtgtccttagtctactggcaggattgtagggactgggaacagtgcagtttagggggaggcagagtgggccagctcaacccggctgttaacacagacatggaggatcagggagggaacttggcaagtgggaacccaccaaccatgagatgatagagacctaggtttgaattctggtgcattatttactatattgggttttgggccacttactcagtggctcggtttattatctgtaaaatggagataatttatcccagagccaaagtatgatactcctaccttgggatgtcatagggttccagatcctcccaactcactggcttgtctgcactcgtaccccaggtcattgataagaactcaggtggctggtggtacgtgcagatcggtgagaaggagggctgggcccccgcatcatacatcgataagcgcaagaagcccaacctgagccgccgcacaagcacgctgacccggcccaaggtgcccccgccagcaccccccagcaagcccaaggaggccgaggagggccctacgggggccagtgagagccaggactccccgcggaagctcaagtatgaggagcctgagtatgacatccctgcattcggctttgactcagagcctgagctgagcgaggagcccgtggaggacagagcctcaggggagaggcggcctgcccagccccaccggccctcgccggcctcttctctgcagcgggcccgcttcaaggtgggtgagtcttcagaggatgtggccctggaagaggagaccatctatgagaatgagggcttccggccatatgcagaggacaccctgtcagccagaggctcctccggggacagcgactccccaggcagctcctcgctgtccctgaccaggaaaaactcccccaaatcaggctcccccaagtcatcatcactcctaaagctcaaggcagagaagaatgcccaggcagaaatggggaagaaccactcctcagcctccttttcctcatccatcaccatcaacaccacttgctgctcctcctcttcctcctcctcctcttccttgtccaaaaccagtggcgacctgaagccccgctctgcttcggacgcaggcatccgcggcactcccaaggtcagggcaaagaaggatgctgatgcgaacgctgggctgacctcctgtccccgggccaagccatcggtccggcccaagccattcctaaaccgagcagagtcgcagagccaagagaagatggacatcagcactttacggcgccagctgagacccacaggccagctccgtggagggctcaagggctccaagagtgaggattcggagctgcccccgcagacggcctccgaggctcccagtgaggggtctaggagaagctcatccgacctcatcaccctcccagccaccactcccccatgtcccaccaagaaggaatgggaagggccagccacctcgtacatgacatgcagcgcctaccagaaggtccaggactcggagatcagcttccccgcgggcgtggaggtgcaggtgctggagaag

SEQ ID NO: 62758 - DNA, 1052 bp, Homo sapiens
tctatggatttaatagtaagcaaaaaacagacatggtctctgctcctaactttgaaaacctgataaatctatacacccgttaccctgaaaaatgcccacatagctgcacattttgaaaagtgcacataattttagagtgttcatagatcccctggaagcacagccaaggtaaaggtctatagtttccccttgaaaaagcccaaccacagtgcccatagtgacttagagtgtcaagtccttcataaaggctgagctaaagcatgaacttgaaggatcaggagttagtttcacctagggaaggcaggtatgggtactgttgcccatcgtctgactaggatttctgaagccatgtctcttcctctaggctccccgaacctacggacaagacctccaccacgcagagaatccagcctggtatgtgtactgaatttcttctcccctttccttccttttctgtgaatgcgctatagccacccgatcaattggctatcttgcggcagagcctcttgatccaggggttttccagagccctgctggggcttctagttttgtggggctaggggcagggagggaagcctgcagatcccagccttcctggaggcctggctggacagtttataatcggaaacacactgcactccaaagctaaataaatccatcccagccactgcattggcagacataaacatttagactgcccggcaaaagtgtccagccagggcattgccagaggctggaaatggggctcctgtccatgctagcctggaagcctttcagctttccctggtcaggaatgcccagtggaggtggtggatggcagagtctgggagggcagagggcagatcagtgaacgtcttccagggaggagtgtgagttgcaaggagtggctcacgccccagctttaagaggttaacactgccagggtccctggttcatgtgggtggggtttcctggtgtccagaccctcgggcaggtagatacgcatcaggggccagggcttggggtgcctgcgatgctggtggcaggctgagagccttggaacaaagaactgt

SEQ ID NO: 62759 - DNA, 1012 bp, Homo sapiens
acacaaatacagcactcggggccctaagcaggcctgaccgtcacctccatgagccccctctccccatagctctacagtgtccatgtagaaaaatcgtcagtgagggccagtgggctcatctttgtcttttctctgagatgcaagagcaccaggctctgggccagatgctgctaagcgctcactgtgtgacccccttgcttttctgagccgtagttgttggctcacataagattaggtatttttactcgttgcttccatccacccttaaaattctgtgcttctgtttgcacccattgcatcagggagccaaagacaggcccctgactcccacccacgtgttaactcacctctgcctcccaatccctggggaggcgagcttggctcagcctgcctgcatgtttctgtgacagaacgtaaggagccacctcctacctgagctttctcgcaaagctcagacatgttgataggaacttcagctttcatattccttttctcccacctaatgagcgcccaagaacaaggtcagatcaggaagacggtgggcggggcggggggggaggtgttcagacatctggtgtggaggagccattccaaagagccagatgtgtccagggagcagatggggacattgcaacccagacttgggggcactggccagcgactactggaccaggaagtgaagtccccatgggtttgggtgaaaactcaacaccacgaggaaaaaaggaaaagcttgttttcagaagtcatcgaatcaccagaaattaagtcagccctatcatttgccttttgcctttgtttatgagcttttggttttgtttccttttgttttgttttgtttttgttttgctttggttttagttttatctagtcatgtgcttttgtcttttcacttatggtttctgcttttggagccccacttagattttctcaacccccaacattatgtcaatcttctatttgttaattctgctatatggtataaagccagtgtctgtcttacttgtttttc

SEQ ID NO: 62760 - DNA, 1023 bp, Homo sapiens
ttggaaccaaaaggcctctctcagtggggttgggtaagtcgtgggggcaggaagggagtggggagactgctgacagaggggaaagtgttggggaagaggaggcttctgtggtttggaaactacaggacatccagcccctgcctccaaaaccaaagcaggcctatccccctcacccacccggctgaccgcctggccagccctccccagggcaggctgccaccgtctcctggtggcgtggtcagtgttcacggccccagtgcttcccagaagcccggaggatcccactggagctcacagcctcccttccctcaaccccatttccgacgggacatctcttcccaagaccctgaccaccctgaatcatgcagctgcccgctgaggccatgtccgtctgtctgggcctcctcttgtctggcgcccccagatggggtttgtggcccaggcaagtctctcttccttgggacacctgtgagttggaaggcctgagacccacaaggcctgtgtccacatggaaagtccatgcctctgccatctgagccaactgggtggaaacccaggagctgggacggcctggtctgcctgcctagccctgccagggaggagggctctgggttctcatccctgcaacctgtgcagtgaccggggcaggacgagcctcccatccaggagctctcaccagcagcacgtgaactcctggacatctgtggttgctgcagccccagagtccccaagaaccttttgcaggagcagctcaactttaccggccagaactgatatccctggttctgcccccacccccaagaggtcaggagaaagcctgagcttacatggcccacgggattctgtcttccacgcaccccgggaggctgcgaaggctggggctgggccctagtggcccaggaggctgagcccacatgatgggctagaccttgttctctgccatgaagcagggcagggctcctctgatcttcccacgagaagggctgtcatttttccctgcaaatgcaaccttgcctaggaaaa

SEQ ID NO: 62761 - DNA, 1795 bp, Homo sapiens
gctgatggtccctcagtagccctgttgcatggtgcagagctgaagtgtcaggggtgaagacaagcatagtcgagaaggcttcctggaggcattgagcagggctgggagaatgaagggattagacaggcagagcgaggagtacagggcgtggtggggctgcgactgcaaagcaggcatgcatctatgtgccccaagcagaagaaaagcgggagctgggcagcaggaggtgggagggtggggcctcgggaagctggtgagccggagaactccctgagaagggtgagccttgaggcaagccctccgggctgtgtggggaggagggtggcaggcacaggtgtggcaggggctgggcagctctgcaaatagtgctttcttccagctggatccacagtgcctattgtcagggaggcatccaagggcttgtcaatgccaagtgctgccagctacctgcgtggagccagctgccaggcaggcaggtggggcagtgagcatgggggtgctccctccaccatgctgtcaccctgcccaggttggacaggcctggtgtccagttgctgtggcctgactctgtggacctactggctctgtggacctctcatgtcccaaactcctccaaggccattttccttgaatagttatttctcagcaaaatatatgggttagtggtggcctcggtgtggcatgcagccctggaaatcccacagaagtgccagagtgacaaccactgctcacccgagttgtagcctcagggcaatacctggccgccttccctttgggggacaaacaggtttctactgactgagcccatgagcatctccaaaatgttatttttccaagtttgaacaccaaggggcctgtgaagctggtcttccgatggctggtcggtcggtcatcagtaaatctgtacgagctgactaagtgtcaggctgggatccagaagtgacagaggccaacaaagccctcatggggctcaaatattgcgaagagacatgtgacaagtaaaccaaggaagtaattctaggtgttgacaagtacaagtcaggaaacaagcaggcgctgtggagacgtcagcagcagggagggggcaggggtgtggtcaggaaagacaccactgaggtgttgttaaagctggggacaggtgggccttggtgaatgcagggaacagcagaaggcccgctggttctgggagggcaggagtgagcaagggcagagacgggtgccgggccaaggagtattattctaggtacagctgtcactgcctgcctactcgaagccccgcagcggagctgacagaggtgacttgcctcctctgactcaggtgtacctttgcacaggtgtcctgtgagtgggcaaccctggagatcctctgcctgcccccaacacacagacactgcctttgtcctcagtggaaatgacaggtctctcacccccctccccggctgaagtgcagggaaaagatcaccccacacattttctccactgttacgtaacagatttcagcaaagtgtaaagcaaacactttctggggagtataatttttcaggaccttggggaatttgggttgggaaattgccccttcctcattctctccccagcttatcctgtggccatgtgatattacacccttcagcagttgggttttctgtaattgttccggtgggagtgggggatagctgccctcatccctctcagcatcttttcagattccataacctcatcctctgggtttccagtgctgacctagaatcctggcctcattgtgggggtgtagctgtggtgacccagttcacccaga

SEQ ID NO: 62762 - DNA, 1064 bp, Homo sapiens
cccagcaagccataccagggcatgcagccgccattgttactttgtctttggaaacccctctacccttgacataagcaaaagtgcataaggcgcctcctctttaggacattcatttgcctcaaatactgcattggcttccctctccagcaggcataatttctggcagcgtggtgacatcagggtcctggtcactctgatttgtgtgttgagcaaagctgcatccaacttcctaggattgtttcttcttaggactgcaggccaggggaagaagtggggagatgagtcaacaaaatttttcctgcctcacctttcttctctgagtctttgcttacttcctggcaccgggcatgatacattgggagttcttatacttccatggaagcaagaaattttgagctcctggtccatcattttttttacaagtgagaaaaccaaaccttgggaagaatttgagaatttttactcccctctagggtcaatgctttagtcccagttgagttgtgagcggagaacagaaattcactcagactttctcaagagactgttgaagcaataaaggaaaatctcaccaaacccaggggtgagaagtaaatcagccttaggaggctggaactgggaaccaaaagtcagcacgagccaaagcagcttctctgtctctcttacttaccatgtagattttttttttttttttttgagatggagtttcactcttgttgcccaggctggagtgcagtggcatgatctcggctcactgcaacctccacctcctgggtcaagcgattctcctgccttagcctccaagtagttgggattacaggcacctgctaccacggctgactaatttttgtatttttagtagagacagggttttactatgttggccaggctggtctcaaactccttacctcaggtgatccacccgcctcggcctcccaaagtgctgggatcacaggcatgagccaccgcgcccagctaccatgcagatttaaagcacagctatgctcttctaactgtagaccagcctgccttctcctctcatccgaccatgacagcagcttgtttga

SEQ ID NO: 62763 - DNA, 1273 bp, Homo sapiens
cctccccgatgcccctgccggcccgagagggaggccggagagaccccgtcggccccaggcctccccgcaggctccctcatgccgggctgtgactaactcatcgcagcacaaggcttctttctgagcttccttggcctccgcctccgctctgcctctctctttcctcctcctcctgcccgtcccctccccggccccctggctccccatgtcccccggaccccgcggtgcagcgggccggtctggggccttgctatatggcctgtccttggcgccctgtgagctgcgagccccggctgcgggctgcccctgggagcggcgctggcgacagagcagccacccccgaggaggccgatggacagggggcgccctggccgcggggccatggctggccgctggctcaccgcgtgctttctgccctcgccaggtgccgacgccaccgccgagcccatgatcctggaacagtacgtggtggtgtccaactataagaagcaggagaactcggagctgagcctccaggccggggaggtggtggatgtcatcgagaagaacgagagcggtgagtgccctggccaatggccgtccactggggttccggtctggcccccgggccgagctggtttttgttcctccctcctcccccaccgctgcagctatacgttatttccatctggcagagagagggccgaggcggctgaagtttccccctgttggtttgggctgcaggccagcagtttgcctggtggtggaagaatgtctccttgctcggggtaattaaccagcctgtgttaattgcacgtttcaggcacagcgcgggaataaatggccagccctgctggggtccccgtgccctcggaggcccgtggggcagggtgctctcagctcagggatgcccagcaacaaccacgttctgagccagggtccagggtccaggcaggacagcccagccagctggtggggaaggcaggccctgctgtcaccatggggtccagggtccccgggtcgctggcaagtttgtggaagggccaggcctgcgggcgttggttggggtctggttggggatctgactgccccctgccgagctggaggccccaggacctggaaagcaagcgcagtgagggggatgcagccaggcctgggccaggcaaggtccggcactgacaggggccgtactgacagctgcccggggcagctggttctcagggtgccacggagggggcaaaggtaccttggtgtccctggcagcaggagtcatggcaggtgaagagaggagagc

SEQ ID NO: 62764 - DNA, 1085 bp, Homo sapiens
gcatttctgcctgaaatacaatcccggctttagcagggctgctcgggactgtgcacgtgcgaatgtatgtggcacactcagctgtgcagggtcccttctgcttctccaaagggctgagatgggcctgcagggcccacacctcatgggagaaaactgccggggggcagtgggtttctttccctggaaggaggcctccctttgggatttcctagagttctgtggccattgccgtctgccctaggttggagggagcctccccctacagaaggacccaaagatctaagtagtgcttcttgcacctgggtgcacacaagcaccatagggacacaggggggatgtccaaaaactactcatgcctgagtcccagaccaaagaaacctgtctctctggagcccagcatcagtacttttaaaaagctccctgggtgattctgtgcttccaagttgaggattactgtgctagaagaaccagactgatggaaacaaatcagaggcagttattctgcaatggaaagacagatgggcttgggcctgaacaaaatcatactgaatgaatgtgatgctcttcatagcagctgtgggagctagagtcgtctcttgcctgctgtagaggggcctctggttagtcttttgtgaaatggaagataagggggatgttgtgggcatgaaatggggcggttaatgtgcctggcacatcacatttgccaagtcaaactcaggcgtgtggggaatgtggctataggctgaggcaccaagggggctgtgtggaacttggagaccctcagcaatttttgtagccaggctagtgacatgaagccccctagccttcaaggagattggcagacatatagtttatgccagtcgcagtggcctatgcctataatcccagcactttgagagactgaggcgggaggatcacttgagcccaggagttcaagaccagcctgggcaacaaagtgagacctcagctctacaaaacataaaaaaattagccgggtatggtggtgtgtgcctttggtcccagctacatgggaggctgaggtgggaggattgcttgaatccaggaggtcaaggctgcagtaagcc

SEQ ID NO: 62765 - DNA, 1090 bp, Homo sapiens
ggcgtgatcatgcctcactgcagcctcgacctccctgggctcaagcaatcctcccacttcagcctccagagtagctgggaccacaggtaggcaccaccacgcctggctagatttttattttttgtagacatggggtctcactatgttgcccaggctggtctccaactcctgggcttaagcaatcctcccacagtggtctcccaaagtgctgggattacagacgcgagccaccatgcccagcctttattattattatttttaagaccagtcgagtgcagtagtgagatggggagaaagagtggaagaagaagtttgacgtgtaattcactgggaacagttgagatactcaccatcttcagagcagccaaggaccctctcctaacctaggcctatccagttgttcctatgaagtccttggatgtatgtgtgctggatggggtgggttgtccttaaagtcaggggcacctgcagtgttgttctttggtttctcagcatcacctgggcctgtcaagaatcaggttcagcatctaagtacctttgggtccctgtatttggccggaatctccaggcccctggttttctcctggcctggcttcttgctggtattgcgagcaatgccaggacggacagccatggcagggacatgagcactatgggctgtgtgagggagggacatggcatacctgccatttccaggaacctactgcttttgctttcagctttgtccctaccacttactcctctttgtgtccagaggcctaattcccagccctccaaaacctttcccaggcattaggccatttcagtcttaaccctgcaaagaaggcagggcaggtgttttttccccgtttacagaagaaggaacagatgttcagagatttcctagctatcccagagtcagcgagctaagtggcaaagccagcacaagaaccaaggttgcttttattcttgctccagatctctgccctctgtgcctcctgaatcatccgctattttggactcgggttgcctcaattgagcctgcattcaagtggttttcccaggaaggacagtccgtttctctggaaagattcatttccgctgtggtccc

SEQ ID NO: 62766 - DNA, 1204 bp, Homo sapiens
ggatccctgtgagtaagggtgtcctcagctcagccctggagcaccttaggctctttgagtgttggaagaggatcaggtctgggtacataacttcccagctggagggtcagatccttgctatgctaagcagtgatgacaggctggtgacaacagaccaaactaagactgtctttgtatgttggcaatggcccccccagggggaccttgcaaatatgcagattttaacatccctcatttcagatctgtcagggtgggacaagttcttctggcctgtgagctcctgccatacacagtcctggagcctgctggctctgagttgctcatttgcatttggccacagggttctggtcaggggaactcccctctcccccacccttcctccatgacttggctcgctccttctgctccaagcccatggctcagtggacactaggcagctgtctcctggggcgcagggagggtacccttgaaggctagtggataggaagcaagtttctgaatggacactggtactaggtcttccttctgggatgaggtggctccttccagactaaagctggcttttctggctctggctgtgcctgccttctaggtttgtctactgcacatctgacaggtcttgtgatggaacctcagtgataccaagatggagacaatgaggtccttgtcctcagaggactcctggccagatgggggaggtgggcaaggaaacagcagttttaaaacagtgtcacaagtgctgcacggggctggggccacgccatgtaggggtctctgagcaaggcacacagacctgcatggctgctgagcctaatttactgagctttctaaatgggtcagctgggtgaagaggacagtacctgtgcagaggacatctgttcagtggtaggagccactgtccccatgtgccacgtcttccatgtggggcatctctttcatagccctggagcacctactgtgtggttctgtttcagaggagctattgcagattgctacttgttcaataaaattattgaagtttaaaatgttctaattaatatgtgttggcccaggagccacctcccaccttttccttattgttaggaagagcccagccgtttcctgggagacaaaggaggccatgaatcttgactccttgtgattccaggatcactgtcctgcagccaggttcctgacactaggagatgcacatgaaatatcctcc

SEQ ID NO: 62767 - DNA, 1321 bp, Homo sapiens
ctggttgaacctgggctcaaattctggctctgtgtgaccttaggcaagtttcataacttctctgtgcctcagtttcctcattttctttaaaacaaaaatgctaatgttatctgcctcacacatagaggattaagtatgttaatgtggaatagtcctggcaccgaataactactgtacaagtatcagttctcagcagcagcagcagtagcactttctgaaggcctgggacctagtcctgcctccattgccacttttctccctatgtgaccttgggcaaattccttctctatgctgggcctcagttacccccataaaggcaagagctggaacaaataacctctcaggtcccccgccacaatctctggggctcagcttctgtgctgcttcctaagcaatgcagggccacacccaggctgcctcccccagggaaagccaacccccagtttctctgtcttccactctcacgccaggaaaaggatggatggagaaatttaatttatattggtgtgcttatgataatggccacttagtgtcatggttgaaaatgccagctctgaagccagacagctggagttgagagtctggcttctctcctctgtgaccttgggtagatttcttagcctctctgtgcccattacttcttctgtacatttgggataatattcatacccattttgtgatggtttattatgtgtcaacttggctgggccacagtgcccagatatttggtcaagcattattctagatgtttctgcaaaggtgttttctaggtgagattcatatttaaataaatcagtggattttgagtaaagcagattactctccataatgcaggctagcctcatccaattggttgaaggcctcttaatggaacaaagactgacacacacacaccctccctcagcaaggaggagttctgccagcagctgcctttggactcagctgcagctcttcccttagtctctgccggcctcccccatcacattttggactctcaaacctccacaatcacataagccagttcctaaaataaatctccctctgtcttcaagctctctatgcacctcccattggttctgtttctctggagaacactgactaatacacacctcatatggttataacgaagattagataaactaatatatgtaagcatgtttagaacactgcctgccacctagaaagctcccctggaagtgctagatgctgttatcgaatgagcatctactatgtgcgaggacattttcacgtttcctcatttgctgatcagagccacagtacatgatgggtggtgggattcccattttgcaaatgagaagct

SEQ ID NO: 62768 - DNA, 1048 bp, Homo sapiens
cccccctgcccccactgcaagcagcagggatttgaactggaggcctccgtctccagaacctgctcatccaaacatagcttgcatcatcctatggggaggggccaagagaggaaccgtatcacccggggatggggcggggtgggagtagaggccccaggagtccttgtttagatggggagggatggagtgctggttggaggaactccacccctctttcccagccaggccagacctgtggaccacaggagatcacccatcccagtttgtccagtttgagccctgaaagtcccatgtccctgttttcctgggactgtgggtcactgtacctgtggtttgagtcacccctggaccagctgcagagaatgaatggctgagtggtctgatgggagctgttttaggacacagcttgggaggccttttcaattacattagcctctggcaacgctagagggagatgctagccccgcccttcctcccctcctcttcttcctgtggctccctggccgatatgattcagcagcaagtcggaagcaggctagactgtgacctaccaggagtggagtcaccggcagggtgggggctgtcagcaccagctcagggcaagacttggagcaaggacggagtgtggattggagaaggggactgatgggaagagggggggttcttgagttgttagggaactgagccccagcagagggccctgctgtcctgccagactggaactggttatagggcagtgggaagtggtcatggtgtgaagggggatccctgcctttgcgtcttgccctcgtatgtgagggatgggagagtcccagccactggatacctaaactgcttatcaccctattcagcagctaaaaatatgaaatggctttgctaaaggatgcccaactggaaacttccagaaggtctcctattagggcagcgcctgctcgggcaggccagacaccctgaaggattcaggattcctcttcgttcccaccattcagtcacagcctggtgacccccactgccaggacctcagcctccaccccattaaccccatgtg

SEQ ID NO: 62769 - DNA, 1013 bp, Homo sapiens
ccatctcactatggaggtttcacagataattcgaattctcacaatagccctgtgaggacactcagagtagcctcctgttaggactggggaatccgagggctcctgccacagtgggaaatatcacactgcagctcgatacgcagacagacatctgatgcaggtgccacaaaacagccttgccaggggtgactcgctgatcatttctagtctgttcttcttaaaatgctcattgggaccattaaattgattctgaaactcactaatgggtcactgcctgtcatttgaaaagcactagtttgaagtggcttgtccagggtcaccagcccctgagggggcagagctgggcccagaacccgggtctgtggacattcagcactggactttgacagcccctctcctgcccccaacccccagctgtcaacctctcctcttaacaaaattttcctccagccaggatctgaccaaatcactccccaattctgcaaacttctggatttcacagccagacatcaaagccctgctcagccttgcctttcctggcccgtccacccactaccctcactgcccagtccacaactgtttggagctgcttgctcctgcttgtagagctttccccctgcatccctctatggatccaaacccccttgtcctttaaggcctcctcctccaggaagctacctgggatgttctgtagcccccaggacctctcttttctctgcactgagtgtaacccctcctgtaattctcagcgtggattgtctgagaatgttggctttctcgttggacttatgtcacatatatctcttctgcctgcctgcacaggccttaatgaggttgcctacagcgagagcttaaaaagtgcttttaggttgataacagcagtcaaaatcattatgtacctcaagagccccacgtcactcccctggccaaggttgcatcttctccagccctcatattctagatagtgcccatgtccccagtgactgctgggctctgaaggtcacccccaagtc

SEQ ID NO: 62770 - DNA, 1013 bp, Homo sapiens
acctgtgttcatggaaggctggggaacagaatggaatgtgtgcacgttccgtccctacctgacttttgcagggaggggctgtgaagcatttggccgctccatcaccaggccagcaggggttatctgcctctttcttgaggtggtattggccacgtgggccagttcaccactggtctggcaagttatgggcctgggaataggaatgcctccagccccaagacaggtctgaggctcaggaagtgagctcagctgtggccaggcagttctgaggggctccccctccccgggcccggccctgtctctgctccgcctccaggacccaccaagagagacctgtgttcccctgcagagtgtgcctgccacaaaagagccagagcttgtccatgaccctcggctgacaggctgccgacgtgtcagcctagtgcctgcacctcctccctctccggctgtttggacctttccaggcgactgtgcacctcccttccctccagcctagaacataaacacgggatcgagtaacagcatattttgactctggggcgactgtggagtggcttatcaaattatcaaagcctgtggatttaattggaattttgtagataacccctggcttctttcaagtgtgctgctgcagggtccattgagaattcatgggggctggggtgggggaccgtcttccctttccatcttccagagaagacaaggtctgtcacagcccagactcagtgggggaggtgggcagcaggcctgagcgcctcggctttgatcccaggccactcgctggcttctgcaggcggagagccagacccatctccggtcagttagtggttgctcttccagaccactggccctgcacagaaaggatgttcttcatggacacctttgatgagcctggcacagagcagccatggtggttttgcctcctcacacggaaggataatgggatttgcgcccttatgaaagaggctccagcaaggcccttgccccttccatcatgtgaggacacagcattt

SEQ ID NO: 62771 - DNA, 1068 bp, Homo sapiens
tagatttgaaaagtggtgagtgcctggggctcctgtggtcaaaggcagaagctccatccctggagaagctgacccagacagggctcattggctcttgggggacagatggagtgttgtgcagtggtgctgaggttgggggtaaggattgggggtctgtgagtagggccaacaaggtggtagagtggggagccagtatactgctgacccaggggctgacattggcatatccatcaaatcctatagaaaattttgtaggggaactgcccgtaagagagcccccgaattgttttcatcagggctagaacctgctttctggaccctggaagtgaaaatccactgtgtctgggaccaccagcctttatgaagtctgcagagccttggaagggcaatgagaagctatggacccacgtgggactggcagttctccagcaaggcatcctgggaaagaaaacccagacgtttcatggtcaggaaggggcagagagttactccagagcccagacaccctgaagagtggtggtgggggcaaggggtagagggaaggaaagggagcccccccaggcctatgcctccaaaccccgtattatgtgagactgagggagacacacccatctcttttgctggcctttgcagccttcctttgagacaaggcccttatccgcctctgtcatgtttctatcatgaggctggatggggggtgctttgttaagacatgttgggcgcagtggctcacacccgcaatgccagcactttgggaggctgagatgggtggatcacttgaggccaggagttccagaccagcctggacaatatggtgaaacccccatctctgctaaaaatacaaccaaaaagttagccaggcatagtggcacatgcctgtagtcccagctacttgggagactgaggtgagagaatcacttgaacctgggaggcagaggtcacagtgagcaagattgtgccactgcactccagcctgggtgacagagcgagactctgtatcaaaaaaaaaaaaaaaaaaaaaaaaaagacgtgttgattgctcctagtgtgtgcctagccttatcctag

SEQ ID NO: 62772 - DNA, 1058 bp, Homo sapiens
ttggtagcccatctgggatgctgtgggcacaagagtcctagaggcaacctgaggccacagcgtgttaggctggccttggggcatgaaggtcgcctgtttgctccagaagaatgggcttctcccacttcttcctcagctagcactccagagaaagagcaccccatcactattccatcagcagctgtttaccagggctcagcctgtcagagctgatggggctgggtggcctggtgaattaaagggagatctgaatttgttttcctcatctacggaacgctcaggctagtggagagaagacctgctccatcatcccaggaccatttaaggcaggatgtgactgtaccactgtgcaatttgagggtgactggagagggagctcagagaacagtgacctcattgtgagctgaggaagtcagcagagacctcctgaacgaggggggcctggagctggcccccacaggatgggtaggcttggagggtggaacgcagggcaaaggcttgtgtactgccgctacctcagccccttgtctcaggagtcaaactgcccgggttcaccctggaaaccctggctctgctgattaccaatacagagaagttgcattagcttctctgtgcttcagtttcctcatctggaaaatggggataatgatagaatgtacttcgtggggctgtttcaagcataaaataaatgagtgtatctcaggtgcttacaactatggcagctcctagtaggggccaaataaatgttagtccttattattactaatgttccatacatgcctagcattttacaccacaatttacatatataatctgatttgatcctcccaactaggtgatcatccccattttactgactaggaaactgaggccaagggaggctaatagacttgcacaaggctacacagccaggaagcacagcccacaccagagctgtcattcctgactcctgggccagggctcccttccacatcagctgcccaggtgccgagaacacaatagctgccacaggactgaggacctctctgaacttcagtttccacttacaggattgcagt

SEQ ID NO: 62773 - DNA, 1051 bp, Homo sapiens
cagatcgtctgtctctgcacagaactctccaggacttccccttccatcacgacaagccctgagtcttcaccacagcctcaccaggccctctgtgctctggcccatcctgccactcagatctcattgcctgtccctctcatcctggctcactccactccagccacatcggccttgccaggctctttttgcacgtcctgcttccctgcctgaaacgttctccctctccagcgtagcttgcttcctcgcccccctgcaggtctctgtagaattgctagctcgaggtcaggccttctttgccgccctatataaaatgacaactcctgtactgttcccgtaccatatcctacttgattttcctccgcagcactgatctgatcttccctggcacatgacattcttacttgtttgctgtttgtctccctccaccggagtgtaaactccctgagcgcaagaactttgtctattttctttactgccctttccttagtgcccagtgctgtaaagtggatgctcaatatgtatttgaaagactgattggacttcaaagatcatgtgactgatccttctcattctaccaaggaggggcctgaggcccaaccttgagaggctccattccttgcctgaggtcacacagctggggcagcaggactagatcatgactcccctcctgcctatgcctcagaaaggaaatcagccacacacaaaggggccctggcctcatccatcctgtctcctgtgtgtttttccagtttacatagaatttcagtccagaatagcaaaaaaaaaaaaaaaaaaaaaaaacaaaacagttgttcctccagaaccctggaaactcttccagtgggtccgtccttggaaaaacagcagcgacctcagggtgggaaggtaggaagtggaggaatggtcttccggcagcaggggcaatgggatggatttggttttgcaattaaaataacagctggttctgtttccacagcacggttctggaaggtgggtggtctgtctaaagtatcaggtggggccttcccccatcctggcccaagagggttcg

SEQ ID NO: 62774 - DNA, 1074 bp, Homo sapiens
ctgacttgattggatctaaggatagaaccgcaggaggaatctacattttctattgccttccctcttttagtttgtttcaatagaccttgattgagctcctctgtatgagtcagggcaggctaactgctgtataacaaactcagtgactcaacatatttattttctgcacaggtcccagacctaaacaagtcactagagggctctgctccaggcagtcattcaggaactcagactcccccagctggtgaccccatcctgcgtggagttttgcatctagccagcaggcaaaggaagagagaatatgaaggactgcagggagattctgtgggttatgccaaagggaagggtacattaccctgctcatgtgccactggtcaggatttagttccatgattgtacctcccagcaagggaggctgggaaatgtattctagtcataggtccaggtatgtgttggataccatgatggacagtggaaatatcaaggcacagacatgactttcaagaagctcacaggcttttggaaggaaacagtttcacaagcaaatcattaagtccagtatggtaagcatagttctagaagtgtgaccgatctgcaggagtgatggggaggagggagctgtggaacagcaggttacacctgtggagacctcaggcaggccaggcagtgtgcagggacggacaagcaagggtggcagggcgtgtgactagagaggtcagttgagcagaggtcatgaataggcttgtgtcccacaggcagcagagagccaacaaagggtgtgaagccgaagatgaaatctgcagagtggggagcaagttgcagcaacattagagactggttcaaacttagcactctccttgcctggacctgcagagaggtttcacatgtatcttggtttctcatgccaggaaatttctaacagaggaggaaggggtggcagtggggaggtgactctccaagtcacctggtgcaggcagtgcttctggctggagtttgctgcgcctgcctgacctttgagggttccactcagcaacacagggcctggatggtggcttccagtgtcttcaaggatgc

SEQ ID NO: 62775 - DNA, 1073 bp, Homo sapiens
gtagttccagttactcagtcggctgagatgggaggatggctggagcccaggaggttgagcctgcagtaaaccgtgatcacaccactgcactccagcctgggtgacagagtgagaccctgtctcaaaaaaaaaaaaaattctaaaaagctaggcatcgtgatgaacacctgtagtctagctacccgggaggctgaagtgggaagatcacttgagcccaggaattggaggctgcagtgagctatgattatgccactgcattccagcctcggcaacagcaagaccctgtctctaaaaacaaataagtaaatgcaatgcttcaaactacctcttcatttatttgacctctaccacactcccagatagtctagtaaaccttattcttagggaaaatgtaacaataaaaataacagctgacctttctaaatgttttctatgtgctaagcatctcatatggatgttctcagaacagccccacgcagcatgtagctcccaccagcatccatactgtacaggtgacagcacaaaggctcagagagctcaaatgaattgccagatgccacgcagctgatgagctgcatgtggagaggcctgcactgacccaggtctgctggctccaaagcctgccctgtccccacagagaccgcttaatgacacattacacacccaggatgcctgggctccatggttccaccttaggcctagttggttggctcctcaagccgtgagatcttccacatgtcacctcccccttctagaactacatttgcccatctagaaaatggtgcaactgtttcttttcaggcttgccttgcagagcggagggcaggtataacagctgctttggaaagcactgagcccagagatgatagctgtgtgaggaggtcccttgatcccccagtctgggttcttaattatctagggcagggatgctatacaaagtgagttgttcctgaccccagggaatttttaaacaaggttcacctgcccagccacctctcctgagaagcctcatagacagagtcgactcaggagtacttaggctcttagtgaagatctcttctagaaaacggcct

SEQ ID NO: 62776 - DNA, 1010 bp, Homo sapiens
aggtcgcgaagctaagcgcccactgggcagccagcagccgtggagtttcttcgcagggctgtgatctccagggaagcctcttctgtccttcctccttcgcacccccgcccccccggtttctttttttggcattggaattggcaagtggctgcccttgtctgttacaacggtgaagtcatctgtccgcctttgatggatggtggggggagctttcgtcaacccctcacagagcagccccgtcgggaaagcgcatctcctcggccctccccaggggccctgggcgctcacgctcacacagcccgagatgctttcagagctcgccctggagaaggaagcctcgcgccctgcctcccacgccagctctgtctctgccttcctaggcctggggctgggggcagaaggaagccgccgcccccttgcccaacctccaccctccgcgctaagctttgatttccctcataaagccattgtgtccgtcggtgtgaggagaattgtggcttttccttttatccctcctctggacgtgacccttaaccgggttcatttcctcttaagtgatgctccatctccagacacgaggaggcgaatgtttgctgtggtctccgaggaaccgcccctcccccttcctcccccaaactttaatgagaaggggttaaggttgactggggcagctccagagcctatgtgacagttcccctttcatctcagccggtcctgtcttcccatccctcacaccttaggaagtaaacacggtgtccttgacccctctgagcgtctgtgctcctgtacttgagatagaagagacccaagcacagaggactgcatgttatttgcaaattgggtatttagaggagcagttccagtgctcaaagcattaatcttaacagttaaaacaggcgctggttgctgccctggattgtacattgatctctgaagtgccttttcttccactgttgcaaagggactggggtttgtggcaatgtcagcctcgggctactctttttgccttt

SEQ ID NO: 62777 - DNA, 1060 bp, Homo sapiens
gagaggaatgagaacaggccaaaggtaggaatcccttctcaccaggcagccgcatcaaatcaggacttagggggaagcatacggaggctgcagcaaaccagctctgctgtgagtttcaagagggctcctccctgagaaactagaggtttggcactgaatacgttacacttatacatgtaattaccccacagaaaaaagtttatcaagcactaaaaatccactaggttacagataaaaaaatctttgattgggaatccttgaaggttgaagttcagagtccctgagcagtggctccatgtcgccgtggtgacatcaggggcctgagaacaggtgtttctgttttgtttttgtgatcaggtagatcatgcatttctgactttaatgtgcataaagatcatctggggatctggtcagaatgcagatgccaagtcaggtatggagaggacagaggagggcctgacagttgtgtccacactcagccacctacctttttcctgcagacatggagaagggctgtcacttcctgcacatcttggcctgtgctcgcctgagcatccgcccgggcctgagcgaggctgtgctgcagcaagttctggagctcctggaggaccagagtgacattgtcagcacaatggagcactactacacagcgttctgagcagagacacgcagaccagctgaggaggacaaagataaggtggcattcacccccaggctctgactttcagcatcatgcaggggcttatctgtctggaggcagttacctcataataaactataaaatatagtcatcttgggaatgggatttggcataaatgttgttggctcccttctgtccactatgtccttggtgtacaatgactttgatctcagccatgacacaacaagaaaaccctccctgttgagctcctggctggactgtgcgttgttcgcagagcagaatggggaggaaacagtgttggcagcttaactgatgtgtgtggttggagtctcttccatggcaaagggacaccacagggtagtgaacattcaggaactgaggggcatatggcctgatcac

SEQ ID NO: 62778 - DNA, 1020 bp, Homo sapiens
ttttttttttctccttttatttttccttgtggttgggagaagcaagaaaactgatgcaacacaagacaggtgtcagggcccagaagaaggagtcatggggtggagattggaggccttgatcactgtgcctcgctcaaaactataacaacaaataacaaaaatgtgttatgagtgttgaagaagaaagttgtcccttaaaagtatgcaattccagctttttttttgttttaacctcattgccccaatgaaccaactcccaaggacgtgtcctctgggcagaactggtttgacactaggccaagtatcaaacaccacattaatggtgtagggaagatgattattatgtaatctttagaaactatcctgaatactaatttggaagtctggatgacacaactgctgtgttacctaagaacactctctctctcaactatttttcctatttaggtaaccagagaagacaaagacctgcacagaaagatccaccggatcattcagcaggactgccagaaaccaaatcgtaagtggtataatgtacaagtgatgccctggtgccctggaaggggatactgtctcccggggagcactggatggagagtcaggagacccgggacttttcccagtagtgacttggaaaggtgatagtcaaagtacctgccctccctgagcctccatctcctctctaaaggagtgttgggctagcacagttgttgtgatcttggctgtacataagattcaaccttggagccctctgaacattcagagcccagattctaccctggggattttgtttccatagaggatgaggtgggggctagacaaggaattctgatacagtgaggtcaccacactaggacgttttgatgtcattctgcttctcatgttctctctgatttgtgttatttcctatttcatgcttgccccccttctttgaacacaaacctgacatttccctctattctaacatcaaagcctttcagtgttggaagggatggttctagacatgactgtttatgaacg

SEQ ID NO: 62779 - DNA, 1003 bp, Homo sapiens
aatccccaaattattccaacatacaaaaaatctttgaagtccctaggaagagattgtatacagcctcaattttaatggaaaagggggctaatatatatatacagtgttttggttttgtataaaaaataagtcaaagattgtccaacagtgagggtagctttttttattctgcactatggagtgttgagttcattaaaaaaaaaaaaatcacaactaaggtagggaacagttatgaaaggtgacctgccggggcacacttctcagtcctccttaaataccatcctgctaggccggtacataccaggatctttttgactcagcagttaaaaggcctgttggacaaattcatgaaccagttggtctaggagttgttctcaggtgccgtaaggtgagacttatttcttttcttttttctttttcctctctttacaggtgaattttaagaaggacaccacttccaaggcaattcatagtatatttaagaatgctatacaactgctgcaggaaaaaggacttgttttccagaaagatgatggttttgataacctatactatgtaagacacttgcaacttaactttttttctttgtagcttcaattacaaatatatttattacttatgaataaccacttaattattcttaaaaatcattaaggaggtacataaaatcagaagtgaaagttggcccttatccttccccgaggtatctcttttaataatacagttgacccatgaaccacacaagtttgaattgcatgggtctacttatatgcagactttttcaaccaaatgcagatggaaagtacagtatttgcagatgtgaaacccacatatgagggctaactttttgtacatgcaggtttcacagagccaacttcaggacttgagtgtgtgtggattttggtatacctgagggtcctggaactgatccactgagtataccgagagataactgtatatccttctagacatttatctgtacatttacagatgcatacatata

SEQ ID NO: 62780 - DNA, 1021 bp, Homo sapiens
gcccacctcagcctcccagagtgctgggattacagccgtgtgccactgtgcctggccagaaatttcttgaataccattaagtccattaactttaaatgaaaacagctaatcagaaatatgacagttccccatcatcttccctttgcacgtgctggctggttttcagttggaaatctcaaggacagcccctgctgtccaccagaggagcagacgaatcaatacattgatgtgctttcctggttccttggccctggccaagcccatgacacttagggcatcgcattccctcatgcaggatgactgggagccatttagtgcatctagactgtgatccctgggcactcacaaggaaggaggcccacccagcacctcatttactgttgtcttagcagcagtttgggcctgggaaagaattgatctcaatgtaatttgtaatttctgtagcatcttttttctggtcacttgttagataaagtggacgacccagtgtggaacattcaaattgcaaggatgcttgagctgcccactatctacaggaaagtttatgaccagccttttcacagctcagccctagagaaagaagaggcactaaggtaagtggtgacttatcactgctgagcacgtgaccacggcagaaaactgaagcagctgagcccagatgctgggatcggcctaggttcaaatcccgaatcatccacctatgcactgtggggctctgggcaagccctctaaccctctctatgcttcaatttcctcaactgtaacatgaagagaataatagcacagatgtcctagggttgtcgtgaggaaattatgggtgtaattggagtcactgaaggaggagtggaggcaggagcagagaaaaacacttggaagaaataataatgcctgacatttttccaagtttgataaaaactttaaactcacagatccaggaagctcaatgaaccccaaggcaagaaacctgaagaaaaatgcaccaagtcacctcataatcaaaatatgataccatagcacgtca

SEQ ID NO: 62781 - DNA, 1004 bp, Homo sapiens
caatcacagtaggtagccttaagattgctttgcaaatataacgagaaggtaagagtagaaggagaaaacctaaaaatgattctcatcgtctttaaattgttcccaactagcccattctctccttttaatttaattgcccttagtttaaaagctttccattggaaggtggccagcaaagactaattttttaaacaaaatttagtctgagtcaaaatcatgttccactcagttaaagtaaaagaatataatattagctttcataaatgtcacattgaatgtaccatttggacttagcttatgagcaaagttaagatttcctggccctgagtattcgaatgttaaaggggatttatctttcatgatggaatagacactgaaagtgaagttctgtcaggctccagtcttctcattatattcatttaattacacagcttgagcctccttttggcaacttggctcaccctttaagtgaaaggtgggcctctttttctcagaccaaccatcagtctgatcatttcagtggtgctatgtgaagcatttattatcacctataatgtctgcataatgacaatgagatttataaatacctttaaaattcagcctaagtagaagagggcctggggataggaactgctacttttgaaaaagtagcagttggggattttttgaagaaacccagtaagctctgagcagcggtaatgctgattgcgtccaggttcctacctggactcactgaatgcacagagttctctgtgctccctatgttgctgtttccctgggtatagtaggtgtgttcaaggaaaattaatgcctctgtacattacagagccacagttgtcaaaattatattaggttgattttgatgaagggtttctctataaagaaatacagagagtagatcatcttgtgtaaaaacacagcctctcctgcaatttaaaagcaaaataagatgtacggaataattatgtattttttaaggtattaaaaatccaaatgactgaagc

SEQ ID NO: 62782 - DNA, 1393 bp, Homo sapiens
tctaaccacactccacacgatgctctcttgtttcagggtgggagagaaaggctgattttctatgtgagcagtcattcagtttttgcacttaacttcccaaggccaccatttttagtagagaggtgtagaccagcatcatgagggtacccttgagggtactaatcgttagtaccttgaggtaggataagtgaaatgctgaccatatcccactgggcttgtgtattacattgacttgtgcagacaagcagtttatactcgtatgtagtgagaggttgtttcaaaggtggaaggagagtttgataagggatttgcttctccaggctattgaaagaggtcatctttcagtatggctgaatgcaatgacagcatgctaattcaccagccttgcccaaatctctcttatacccttttgcttttctcttgcagtggatgacagcactggagttataaactgcatctgctggaaaaagttgaatactgagtctgtatcaggtaattttatttgccacattcctttacttttcacctaactaatggattttactcaatgtagttcatcaaaacagctatagggctaaattttcacatttatctgctggtgagttacattgatctacctgaagcactatacccagagctttggctgctctgaaaactgatgccataggagagccagttgcttttctttctcccatctctttggtgctcactgcttcctaagcctacaagaatgtgaataggttacagggagtttcagcaattcatttttaccatgcccattattacataagtcaaggtgtcttagcctaattgcaagtcaggtctgaatccccttgtcccagccatatcacttgaccaaagaacattttgaagactgtttctctcacatggttgccactaacttctgtgctgccatggtccagattttctaaaatctctgtgttcaaacaaataataccaggaattctaagactgagaaggtaagataggattcctttggaaattatccattaagtaatataaattaaaagaactttaaaattgtatagtgaatacattgactataactgaaacaacatttggagttgcttgaatatattttaataatttttagatacttttttttttttttaaagttaggttctcactatgtttccagggctggtctcaaactcctggacacaagtgatcctcctgcctcagcctcccaaagtgttaggattacaggcttgagccaccacacccggcctaatttttagatattttttaatttaagttcataatatgaaagaatatcgtgcaatattggtgatggtttttggttctagagaagctttgaaaactggaaccttgtttttcctgtgttttacaacatatacagtatagtgccata

SEQ ID NO: 62783 - DNA, 1029 bp, Homo sapiens
catgtcaaactttaatgatgggttaaataatagtgactcttttatttaaatcagcatataatacttatcctattattctagtgggtacaatgaagtggaaataatatattcataagaattatattaaatctggttgaaaaagattatcttaggtgttttaatgctgtcaaacataaataacatagcatcgattaaataacagcagttaaactaaaaagagagcaatcaaaagtacttttaaaaagagaaaacagtcaaatgtcttgctgtggttgtggatgttcagggttggctgcttgaaatccgagtcaacctgcctgtgaccctagatccctgaacccttatagcttgaccctcctccttcttgggggcctgatgatccagggggtcctctgatgcttttaggcctctgtgggctgcatgtggaacagcaggaacacaagggccttgggaaaggctggaacatgagctctgttatctagtatttgttaccattttcttttcttagttcattaagctttctctcagttgacagagcagccatccaactttcctgagctctcttcttatagaagatcactttgatacaagaaaatggctctctaattcttttttccatgtcttcagccatctttttgtagatgctgtgcatctgatacgtatagttcacgtttctatatacttggagaagtttcttctttctaagcagtgtatttcctcctcagttgcttttctctgagttttaaaattcaaactatctgttatagtcttctgatctctttctccgttgttctgtgatgcttttaagattttttttttttcatcagccacttggaactggaagggttttgttgcatcttcatcttgagtgactgtccttaaaggcaagtcattgttgtcagtccgtgagatgaaaattcacagggctcacttttctgtcctttttcaagaaagtctactgtgtccacaagtgaagacctgttcagatttttattaagtgttgccacatacaaagttgataccattgga

SEQ ID NO: 62784 - DNA, 1620 bp, Homo sapiens
gctcggcttctcgactgcccgcctccgaggccgccggccgcttctctctcccagagtggccgccgcccctggagactcgccgtgacacgggcctaagccgccgccgcgggagtcctgaccgctcggacccgtcggatcaggccgggtgggagcgagcttgcgggcaggtgccgctcccggagggtgggccggaggcgaggcgcccaccgcgcggctcgcgggccgggctcggcggaggggccgctcgcgcagcacccccaccgcgggccggagcccgggtcgccgccccgccttctcccgggaccgcccggccggagctgcgggggccgagggacgccgcgcccgccgccgccagccgggctcgcgcgggagagcagggaagagaaactttgccttttattgtttttagtccttaagtgcaaggaactctgtgttgggaggaaaaatgtccttcttcaatttccgtaagatcttcaagttggggagcgagaagaagaagaagcagtacgaacacgtgaagagggacctgaaccccgaagacttttgggagattataggagaactgggcgacggagcctttgggaaagtgtacaaggtaagagggggaaaacgggaagttgtactgcgaaggtaaaacagccactggcctggagtggcgggaggacttctgctcccctggtccttatcctgtccttcttttgactgttacggttcgatgcaactttacttggctgatcatccaaggagtagctaagaagtcgggtttacggtggaacaaaatggggcctggatggagtttaaagagcgattggaaaaggagacagggttataaagtctactctttcaaacttcaaaggaaatgagagtgttctttaatttataggaggggtctggttgtgcccttcaagtattttagaatgagaaactcattgcactttgcagtggatttgtctactgactgcattcgcgtgcatgcttgtactccaacagttctgtttttagggtccagtatatatatttggttgtatctagagctaatacagaactagttgggatcaaagtgattgctacttgcagtctcttcttgagttagttgcttgacagcatactataaaatagaatggaatttctgacaaaatttccaaaaaaccttcatgtggtactagttttaaatatatttatggtaagcattgactagaagtcagtatcagcgcttaagcagttaaaaacacacacgcatgtatttatttcaatagaaagaggcttggcgtttcaacctgaaggcattaatgttaactatttaatatctcctaaggaacatatgaatgatgtcattggagtattttcatcctgaagggcgaattttttatgagacagcgtttaggggaaggacccacagggttgcctagaagtgaaaacgtaagaaaataacttatgtttatacaggactttgaagtttttaagtactttcaaataatttggcccccacaaaaatcttgtgaggtaggcaggtcagtattagtatccacatttcacagatgaagatattgaaattgttcacagtcacatgagtctcagcctagacttgaactcaggtcttctgagcccatatttagtatt

SEQ ID NO: 62785 - DNA, 1007 bp, Homo sapiens
ttgacaaaatcttcgtttagtatatcgtttccataaccagattatttgatagctatttctttatcttttttgctaagctgaagaaaaaatactgaaactcaaaactccatgtagttttagacacacgcttttttttttttttttgcatgcagatcctcattgaattttgtgcaggtggagcagtagatgctgtgatgcttggtaaatacctttttgttctttctgttcatatcttaaattatacttgataagatgaaagaatttcaaccatatataaatatattcaaatatgtaagtatcgagtaaagttcagtaagttaactcaagtatgtttttatattcttggataattatagtaaaattctaaaatgaaatgttgagtgtgtcaagaatgtgatctttgtagatatagttcttttaaaataaattccctgcatatgatctttgacagtgatgatatatacagaaaggtatatagcctgctaatatgttttcactgtataaaaagcagatttttttttttactttctccttatagaacttgagagaccattaactgagtcccaaatacaagtagtttgcaagcagactttagatgcattgaactacttacatgataataagatcatccacagagatctgaaggctggcaacattctctttaccttagatggagatatcaaattgggtaagttattcacttaaataaaacattagaatttttactctgaaatttccatctttatgtatgtgacttaatgtggttttattactacttaaatatgtgaaacatggagaactaactccatgctggtttttaaaaaacacttttttaggtaaatactcatttttctataatttctaaatatcagcacctaattgaatgctttaaaaagaagataagaaagaatgaatttttattttcaaaaaggcatgctttttaaagaccaatttcaagtttgtacccttaaatttttgtacgtagacttaatacttgtaaatgtttt

SEQ ID NO: 62786 - DNA, 1062 bp, Homo sapiens
accagaaattgtgtagcttaagtttagtactttgtagacatagctttgtaatcactacctagatcaaaaagtagaactttgacaggcatcccagaagctcttccgtatgcccatctcagccactgcccttctcttctccacattttatcctgacttttatattatttccttccttgtgtttctttatggcttagtcacccagtattcatctctagatgttagggtttaaacttgctcatataaaacttgggtttttaaagtctcttaacttacaggccttcccccattcctttcttttctttatattatggcatgtgtaatgggggatgagggcaatatcacccacatgggtgcaaaaattagttctttagggccaaaaaaaaaccttatgcattacaatggtttgtgaccttccaaaggccccagtacatgaagagatataacactgtatctatggcattaaaattttatgggaggagggatgatgtgaaaaaaatgtttaaaatgactccttagaggggctagtaatgaaacactgatccatggaacctgggctgtttggcctgttgtgtttccctcaaactgcattttgctattgcatactcctgatgattgaagttcctttctgtatttccttcagtttggcagatgaatccaaaggcttgatcagtctcaagcctgatcctttggcaagacttacaggtggttttgcattctttcattgggaggcacaccgtgtctgctttgtgcccttttttgatgttgcatctattgaggcttaatgcctacacctctgtcttttggggttgcaaaacgaattccattattttgttttcattattttcgataatgattttgatataaacaccaattatttcattattttcattcattataaaattagtaatgaagataatgacttggctgtctcttatcctcaattgatgaccagtgttttaaaaaatattgttagttcatggatttaattttatttggttggtttcaaatccattgcagtttttattcttattgaagctcatgttgttccatctttagtcagtg

SEQ ID NO: 62787 - DNA, 1032 bp, Homo sapiens
tcaagattaagatgggagagacatctttttctttctgtttaacttactttttataataagattagccttattaaagacttaaaatgctttttctccccattgaatacaatgaacaatgcttaaaagttctcattaatgcttttgtgtgattatttcaagcggattttggagtatcagctaaaaacacgaggacaattcaaagaagagattcctttattggtacaccatattggtatgtattcagttttatgaatttatagtattagtcatgtcagcagttataattactcatgaatttttgtccacataattgattataccatgtgttttgcaatcactgttcttaaacatgttaacttttaattatctgtcttcataggatggctcctgaagtagtcatgtgtgaaacatctaaggacagaccctatgactacaaagctgatgtttggtccctgggtatcactttaatagaaatggctgagatagaaccacctcatcatgaattaaatccaatgcgagtgctgctaaaaatagcaaaatctgagccacctacattagcacagccatccagatggtaaaaatattcttaaaaaagcttaataagaaacaaatgatactaggaagcagaacttgatgttatattctcacaattttccaagagtatttaaaattggatacatggttcgaagactatatgaattagaaaagtgatttttggtatatttctcttaaagaccattaaaactcttcgagctcacttttcccatatatctgaaaatatgaatgatttgagttttgcatgagaaaggtattttctgtactatgaggaagtgaggtatatagattgatctatatttgtgaaatttattagaaattttgtgctttttggcatacttgtgagtatatggctgtctcagtgattatgtacctacttacatatatgtctaacatgtatttacagatgaataagttttacaaaatcttaatagtctcattaactagttatttaaatgttgaattaatactattaca

SEQ ID NO: 62788 - DNA, 1032 bp, Homo sapiens
ggtagttatttccattatgtctctccagttactagaaagcaagctccttggggacaggggccgtgaactaattaattaaaaaatgtcttacagtgagggtaaatagtaaatattgttgacttaaaaaaatgttgttaaagcgattgggtaaatttaattttgctttatagaaggactacttgtaatatattaattaaaaattgtcaattttataggtgggcaaataaaatgacaaatcttgaggcaattactgttaggttattatgtaactccatcatagtgttttaggttgacctatttatctgggggaataaagcaggaaaaaattgctttgttgtgtgcagcaagtatacccctggaacacactttctattattattttgttacccccacacttgaagcccttagtctgcgacagacactgttaaatgttgagtatacaaagatgagtaaaatggcttctcattctcaagaattttagaaccatgtcaaaaatacaggtgtttatagatacttctaacagaattctaaagctttttataattttgaggctttgatagggtttatagagatggttactttttaagaagtaataatgaggccaggtgtagtggctcatgcctgtaatcccagcactttgggaggccgaggcgggtggatcacctgaggtcaggagttccagaccagcctggccaatatagtgaaaccctgtctctactaaaaatacaaaaaatcagccgggcatggtggcacatgcctgtaatcttagctactcgggaggctgaggcaggagaatctcttgaacctgggagatggagattgcagtaagttgaaatcgtgccactgccttctagcctgagtgatagagtgagactccgtctcaaaaaaaaaaaaaaaaaaaaaaaaaaaagtaataatgtagtgacctgacatttgctttaaatttcaattaaaattttttattacgaagttttcaaacacacagaaagtacatgtacctactacccagatataacaattcttatcattttt

SEQ ID NO: 62789 - DNA, 3213 bp, Homo sapiens
gagtctcactctgtcacccaggttggagtgcagtggtcactacaacctctgcctcccggtgtcaggtggttcttgggcctcagcctcccgagtagctgggactacaggcatgcgccaccacacccaactaatttttgtatttttagtagagatggggtttcaccatgttggccaggctagtctcgaactcctgacctcaagtgatcttccctcctcggtctcccaaagtgctgggattacaggtgtgtgccaccgcacccggcccatttttgttatatttcttgtgagaagaattgttaattctttaaattcagcaacatttactgaataaagatctgaaatcactgtaggtctgtaaacattgttttggtcactctaaggtcatgttttaacactaaaaatacattaaatcttttttagccaatacctgcaagtaagcgtgcatcttctgaccttagtatcgccagctctgaagaagataaactttcacaaaatgcttgtattttggagtctgtctcagaaaaaacagaacgtagtaactctgaagataaactcaacagcaaaattcttaatgaaaaacccaccactgatgaacctgaaaaggctgtggaggatattaatgaacatattaccgatgctcagttagaagcaatgactgaactccatgacagaacagcagtaatcaaggagaatgaaagagagaagaggcccaagcttgaaaatctgcctgacacagaagaccaagaaactgtggacattaattcagtcagtgaaggaaaagagaataatataatgataaccttagaaacaaatattgaacataatctaaaatctgaggaagaaaaggatcaggaaaagcaacagatgtttgaaaataagcttataaaatctgaagaaattaaagatactattttgcaaacagtagatttagtttctcaagagactggagaaaaagaggcaaatattcaggcagttgatagtgaagttgggcttacaaaggaagacacccaagagaaattgggggaagacgacaaaactcaaaaagatgtgatcagcaatacaagtgatgtgataggaacatgtgaggcagcagatgtggctcagaaagtggatgaagacagtgctgaggatacgcagagtaatgatgggaaagaagtggtcgaagtaggccagaaattaattaataagcccatggtgggtcctgaggctggtggtactaaggaagttcctattaaagaaatagttgaaatgaatgaaatagaagaaggtaaaaataaggaacaagcaataaacagttcagagaacataatggacatcaatgaggaaccaggaacaactgaaggtgaagaaatcactgagtcaagtagcactgaagaaatggaggtcagaagtgtggtggctgatactgaccaaaaggctttaggaagtgaagttcaggatgcttctaaagtcactactcagatagataaagagaaaaaagaaattccagtgtcaattaaaaaagagcctgaagttactgtagtttcacagcccactgaacctcagcctgttctaatacccagtattaatatcaactctgacagtggagaaaataaagaagaaataggttctttatcaaaaactgaaactattctgccaccagaatctgagaatccaaaggaaaatgataatgattcaggcactggttccactgctgatactagcagtattgacttgaatttatccatctctagctttctaagtaaaactaaagacagtggatcgatatctttacaagtaagtgtacatgagtcattgtttgggttttcctttgccattttctcaattcagagtttatgtgaaattgatgtcttgaaaataaaacagcattaaattaatgtagtattaacaatataaattcttacagcctatgaaagcaattaaaaagaactaaggagattgtggatctaatctttaaattttgtggtaggatctacctatttttgcagacctgatgcagataaacagtgtaatatggttgcttggtgtgattaggttcctttattggacatatctagatgcaacattagcaagaatcaacaatgtatgagagaattagaaattgaaagaatgatgtctttttaagcacatttagggtgtaaacaatccttgatttaccattggcccatacagtcacagacattgctactgccatgagaaccattgtggggaaaacaaaacaaacactaaagcccagaacacttggagctttgagtgtaattctcaaattttagtgtgcttaggagttactagcggctatgtagaagtctggagtgggtcccaaggatcactatttgtaaaaaaaaaagatcccacagagttctgatgcaggtgatccatgggctgccccttggaaaatacttcctagaccctctgggttgatagtagcagaagagaagacagaaaagcaggaacaacctaagaaaactgacatagatggatctctagggcatgagtgattagtctgcctatctgccccaaattcctaggattttcttacatgtattcctaggattttcttcttttttcagtttactttctttcactgactgaaataaccaccactctgaaattcattcactgacttaatagcctcttttaaaaatgcaaataacttgtataagaatgaagaagatattaattattgaacttttagtaggagctgaagaaatgtgaagtttggaggttaaggtgtagataggtgtattttttggagtctgccaactttagattttagaggaatcctgggtagggtaccatagtcctggactttggaagaagagcatgaggatcctggaagcttggagaagagaacagtaagaggagaggatgcagaaaggtgattggaaggtgccaaagagaaactgtttaaaatttggatgcattttgagtttagcattttcacattccatttttgcttcctctgccttctaaccctttcttccatatcaacacccagtaagtatctgccctgaacacttagtttaccaaaatgtatttgtaggagtcttatatgtctgttatttctgtttgcatttaaatgtttttggataccagttgaggaatgaagagtttagtcttaataaagaattttaggtcatagctagcagccaaatctggtacttttgggtgcagcagaggcactgtctttctagtaaccctaaaatcatacat

SEQ ID NO: 62790 - DNA, 1404 bp, Homo sapiens
agacctgtcaatttagtttttttttaagagatgagccccacaaattcatttttaattgttttgtcagtgaaaaagcagaggtatctgagaaactacaaattgaaaagatgaaaaaaaaggataacatgtaaagttctactgattagctatgtgaactgctcatcacttatgcctaattataatgtgtcataaaagctatacatgaagatgatcaaaatgcatactttgaaaaaatttgatttcatctgtaaagacgtgtaagtcagatgacgtttaaggtgttataactggttccacagatgagtctattgctttatatttatactttctatgtgtagtctgcatggctgttcagttgttttgttttaaaaaagaaagaaatgtttaaggaagaagaaaatgttttctacctccagtattccttgtacaaagcctaactaaaataaaatctcactcaggaaacaagaagacaaaagaaaacattgaagaaaacacgcaaatttattgttgatggtgtagaagtgagtgtaacaacatcaaagatagttacagatagtgattccaaaactgaagaattgcggtttcttaggtgagtagagaaacaacgtaattaaaactggtttgtgacttcttttcagtctctgaaaagtcagaagaatagagaaacaagggtaaattattggctaatttttttttattcttttactaccgttccactcgaaagaaaatttttaaagctttaaaaaaaaacgtatttcagaagtgtaatttttgctgtcttctctatcattaccattaaattttatcagacgtcaggaacttcgggaattaagatttcttcagaaagaagagcaaagagcccaacaacagctcaatagcaaactacagcaacaacgagaacaaattttccggcgctttgagcaggaaatgatggtaaagtctgattgttataccattttatatcattttgtgttaataatgacatttactgcattaaaaacagacaaacaaaaaaggttgtagaacttgttctctgattgccagatttctctagctttgtgatttatttctggcatttttacccttttggtgttctggatgccttttattgatttattcttttttcttgaaaggattttctatcccagtctaccttaagctggtttatggtgtgatgggttgttttttctctcatgaaaacttatgaagccagtaaacaaagttcctagatttgcctattgctgggtaatttttcagtgctctaattcgatctttcagatttggaatccaagattttaagccagtttagagcaattgccttcaaacctagctgagcagtaggactcctcaggggctttttaaaaatgtgctttattctctggcttctacagttaagcctccaca

SEQ ID NO: 62791 - DNA, 1057 bp, Homo sapiens
gaggccgaagcaggaggattgcttgagcgcagaagtttaagaccagcctaggcaacatagtgatagccctatctctccaaataaataaataaataaataaataaataaaaagataagttggtcatggtggcatgcactgtagtcccagctacttgggaggctgaagcaggaggatagtttgagcccaggaggccgaggctgcagtgaactgtgattgtgcaactgcactccagcctgggtgacagagtgagaccctgtctctaataaataaaatagaaaaaaaatttccatgttagaaaaaaagaactcatttttttgagaattttcataacatattttagtgcatttgactttttcagtattgtgaaggttatagtacattactaaatttaaatactagttatgttctcttaggaaacatctttactataaggtattaatatgggtgatggaaaagttatcatcttgagctatattgttttacagagtaaaaagcgacaatatgaccaggaaattgagaatctagaaaaacagcagaaacagactatcgaacgcctggaacaagagcacacaaatcgcttgcgagatgaagccaaacgcatcaaaggagaacaagagaaagagttgtccaaatttcagaatatgctgaagaaccgaaagaaggaggtaagtgtaaactactgtttttaattactaaagctttttttttaaaaaaattgttttaagactatctaaggatttaggaatactaataatacttgagagttaaatagcacctattcattctttcattcggtcttctcaacagtcatatagagttgtcataaggtcaatcattattcccattttactgccaagaaaactggagtaagagaggttttagtgacctgtttaagttcacctcaagagaggttttaatgacctgttcacagactacccctaaatatccagctaaaccttgaatcaggtcttcaaattgagtttaatccatcttaaggtctaccattgtccttaatgcaacacatttaagtccttatataaaagtattttttagaaa

SEQ ID NO: 62792 - DNA, 1040 bp, Homo sapiens
tgattgtgatcaattttattagggttggaacaaacagaaacctcagccaaactaataaatgcattttcacttttgttacacatctcaaatacccagattcattgactttaacatttaaattgagaagaaaattgaatgtcatactgctgaatcttaaggatttgctttaaaaagggtagagtcaaacattaataaatacagtgattttatgatttctttagataaagatgaatgaaatggtatgtgattttatttgatgtggcttccatttctaaaaatcactattttattactatttctgatgttttatgtagaattgctgtatatactgtgaggtatgacattactggggctacatgttaattttctctcaagtagtttttgagatattctttatctcagtgaaatttaaaaaattttacagataaatatatggtttaatcctaaatataaaagtctcagttattgtttttgtttgggggtaggagagtttcagccacgaacatgtttgagatcgtgatatgcatattttaaataattacattatgtatttttttttccttattgctaaacttcttgcatttggggagtctcttccttttaatggtgatttggtttcatgagggattactgatgggaaattttaaatacacgatgttaaatcaaaatcagtctctttcacggaccatcaatagcatgtggtgatttggaatctggtttcttttggtgcttctacttgtaaacacatgattgtttttcatagttggattacagatctattgttagatggaatatacttctagtattttgaaatgattaaaagaaggagctctaaaatgtacttcattctgtattttatctgctataataaatcatagcttactaaacttacttttaagagtgcttatattaccaatttttaagttgacaggcttagcttaacttgtcagcaaaggggaatattctaatcctattcaagatcatcagatacattcatttttaccacaccgtgtataaaatggtgtgtttatgaaaaaact

SEQ ID NO: 62793 - DNA, 1006 bp, Homo sapiens
tccatttatttctcctttgtgtattctaagacttgctttccttttttgtttttggcctcattaagtagattttatttagcattatttctttagtatgatcaagccaattatgaaattttgcacttttataaatggcattagctttccttatgttcaatatttccaactatgtcaatagatacgtttataattttatgatctttcaacaaggtcagttgagtttatcacctgtagttcagcatcagtgctgcaagtaattcttcgctggttgtctttggacctttaagaaagagaatgatacatagggttattaagcaactaattaacctttgtgtggtgtaatgtccctttctgcactgagattatgcatgttctcttctttcattctttttcaccagactaacacctatgctaatgcatgttgaaaggaactttttaacaactttaatatttgacttgtagcttatctgctctcataaatgcttgctgtggagaaagtatcatttccccacctcctgcatgcttatacactgtaggttataaatgaagtggagaaagcacccaaagagctgagaaaagagctcatgaaacgcaggaaagaggagcttgcacaaagccagcatgctcaggtaacagcagcagcttaatgctactaaaaccagaaagcaccattttctcacagcttgataaaccatggttgaaagggtaaattttaagtgttattattatatgatgttgacttctccccattcaaaaactcctggaatcttctttatttaatactaaattcctactaatggtgacatttaagttgctaatatgaagttaagtggaatgtttggaaagttgactccagatgaaataaacaagtatatgaatgtataatccactgttatctgattttaatcttgatgggagcttatagttttaagtagtaatgccaatgtttgttagaaaacttttaggacataaaaatagaggatggtatataagctttgtgcttaca

SEQ ID NO: 62794 - DNA, 3114 bp, Homo sapiens
tgggtagtggtagagccaggattctcatccagataagtttgggtacatgtttcacacactgattcgctgcaccatgctgcctctcatatttaagctacctacttgtgctgcaacttaaactctcgtcagcttgactcagtggttcttggccatgtcttgttaccaagtgaagaggaagtccttgctggccacacatgtacttttggttaatttggatttcaaaccagattagaataatatggtttttgccttataaaggaatatagatttttattaattccaaaaggccatgtatcaaattctaaagtcaaaactgagaattaatgttgaatgaattaggtaatactatgttttaataagactttgttggtgatttttcatataattttggtaacaggccagtattttctgagtagagctgaaagtaatcataaattccttcagtaaatctaatgaggaatttagtaatctaacaaatattaaaagtatttctatctactgctttaagcgaaggtacaaaagctttataactttacagtctatttcaaactttttttgagaattcataagtaatggtcatacagtcatggagctagaacatatttgatcatttaagtccagtggttttcaaactatactaacaggaattttgactttgaaagaagcaactatgggagtccctaagacggcaagaactctgggctgtgagcccctgcttctgcttcaactcaagcaacaccacttttgctgtggtttataaactgggatttttgggggtgaattttaaaaaagggggttctactagcttaaaaaacaacagcaacacactagagtttggaaaccactgatctagttcaaatccttcattttacagatgagaaagaggtccatctgttaagtgacttgttccaggcctcaagaaactcaacatttgtataattattcttttcgtttacaaaaagtcattcagatatattctcacctgggaggtgcattctattctgatccacagggtgttgctcagatcatgattcagtcttttcagttgtcatcttgtgcagtcttcaacgcccaaatgcaggacgtaagtcccacgtgcctgtgggaggatggcttctcctgttttacctgccttttcacatgtgccttttcattgttggcttcatttgccaaaatctagatgattgatacatgataatgtttgtaatgacaataatagtgataacctgactttagacttcagtattcttcagagttttcacatttggttctcattgccaccaccctaatatagggatggagtcatataaccattttacagatgaagaaattgaggcacagaagactgtgatctgcctcaagtcacataagagattaacggtagagctggaactagagcacttttaacacggtgttctgtctaccccgccacaaattctaatttgggattttcatgtttctcaagaaaataaaataccctctcaatagtataagctttgcacatgtgagaaattgaatgctgtgattagatttttattttcgtgtgaagtgacattttgattgcatatatgtttatgtagatgttttaattatggatatggtcagaaaagccatgttaaaagtagtgattttcattccgtttaactctattttccatttattcaagtagtcaataatgaatagtgagtttctattctccttattgtagttttaagttaagttggaaattccaagctgtattctttcttgcagtttctatagggaaataactagctcatttaacactgtaatttttgtttgtgacgtctgatatatacaacaggagtagatagaatacagcttgatttcaacccctcctttttcctctcctgaaattagacttgttttttattattggcagctgtttgactttttactgttttctaagagagtaagtaaaacattgatttttaaaaggagagggagaaattatgaattacgatcacttttctgatcattaccatttttagcctttgttttcatttaaaatgatcaaattctatacaaatagcccaatatatcataaccctttcttacagttttctagaccccaaagttatatttttaatgtttatagttatctgattaatatgataaaattgtttatccacatttaaacttgtacttttaaagggcactcattttacaatttatgtgtttactttaaaaaatgatttttggccttaataatttgggttcttttgttgttgtcttttatttgttaatccaagtgattaagttcatctttttttttttaaggtgtgtttgtgtaatctatttgaaatgtgagtgctcttttcatacctgaaagtaatttctaattataaattccatgtgaatgttattgtatttggcttttgaagttagggaatttagtgaatgtgtaataacattaacattttgtttgttttgaggtaatgaaatatattgattagtgtgtaagggaccttttcagataatttttagctttaatataaaaaatcctttatacagtgtccgactacatagtcatccagattctgcttaatttttcaagtctacagctctgtaaggcagctgggttctttgctaactctaattgttaggacttgtatacactggacttatatctgcctatcttcacttttacctgttgatccctatcttacttctggagccacacagtgctagttctgcctgcttcagtatataaacagtcatagctcctctttaccctttaggagttagctgctttaaggaacacttctctagttctttcaggcagtcattgtgaggcatggtttctgaaccctttattcccagctttgagttttctgtggtttacttttgaacttttaaaaatgtgatactaagggaagggacccactactctttatgtggactgagaccaagactgttgatacttgggaccaattgagtggaagctccttgaaggcagaactctctttcattaattttagtaaccttctaagtagtatagtgtccaccatttactaagtgcttaataaaggttttctttgaattgaactcttactgtgtttaatttagacataaatacagtaatatgaacaaaaa

SEQ ID NO: 62795 - DNA, 1050 bp, Homo sapiens
tttgagacagagtctcgctctgtcacctgggctggagtgcagtggcactcagtcatagctcacttaacctcgaactcctgggttcaagggatcctcctacctcagcctcccaagtacattcatgcaccaccacaccctgctaattaaaaaaaaaaattttgtgtgtggagacagggtctcactatgtttcacaggctggtctcaaactcctaggctcaagtgatcctcctatgtcagcctcccaaagtgctgggattacaggtgtcagccaccagacctagcctaacttcttacaagttattttgtgcctagtattttgctggtcactgcaacaagggagagggtaattataggaaacaacaataacaaaatgacatatttgaatatgcatgtgggtactgactattgtttctgcgtcactggattctatttaaaactttcataggaaacagagcaaatgcagcgttacaatcaaagacttattgaggaattgaaaaacagacagactcaagaaagagcaagactgcccaagattcagcgcagtgaagccaagactcgaatggccatgtttaagaagagtttgagaattaactcaacagccacaccagatcaggaccgtgataaaattaaacaggtaaatatgcaagttagtctcttctcttttaggtttaaaatttttgaatgaccattagaagttctacaaaattcctttctttctaaacaattagagccaccttaggcttgttgatgttcactttaattctgtgggctgggactatagatacatggcatataccaattagtcttccccaggatggtggtcacagagagcaaagcccttcctcctataccccataccagctcctgagctagactggtcctaagaccagccctgggaatgagatgactcggacaacttttcaagtcaagatatatggcctcactgtgatacttctgtagtcatggtcacacacacaaattaactcagatcactaagcagataggaggatcaaggttttaatcagaagttcctgctcttctctgaagctg

SEQ ID NO: 62796 - DNA, 1095 bp, Homo sapiens
ctatatatttgcttaatttactatagtagaacagatcctaatagattggcctaatgggccaatagatcttttacaggaatagatctattaggccaaccctttagtaccagatcccacattctgtactcacgggtaaaatgtatgcaggctgccttctgaagtgtcagttttatgagcaaatcttcttagaaaggaaaaacaaaagctcaagctagttctttttaagttctttttatatggtatgtaatagttctagcttctaaacttgtaaaaatgaagctatgattcatttcctaattcatggcccttggtttttatagaggaaaacttgaatctcagtaatagcatgatatttgatgagtaatttattattatggaagataattgtatttgtgaaaaattgcttagttgatctgaaatttttttaaatcccaactttattttcagaatgaaaaatgccacttgttggttgagcatgagactcagaaactgaaggagttagatgaggaacatagccaagaattaaaggagtggagagagaaattgagacctaggaaaaaggtaattttaaaagctttaattaaaatgatatgtgtgtactcgtccgtctacccagctattggctctttacctactgtgtcaggtacagtgtcaggggcaggaaacatagagatgaaaagacaaagtttttgtccccagaagttttggaatctagtgacaagcagttaggaattggtagggtcattgctctgaaggaggtgagtacaggatacaagggaaaggaacagattttgtaagcagaggaggaggagagcttaaatctgcctgggtaagtcagggagggtcttcaagaggagatgccttgcaagccaagtgagtcttgaagggtgagtaagaacttgctaagcggatgggctgattggagtggaatgggatgatttgagtagggagaagagaatgagtgaaaaggaagcgtacagagaattgtagatcgttctctgacattggagtatgagagggggtgtgtgccagtgtgtagtcattagggaggaagaaaaggaaggaaggaaggaagcgatgacagctgagtctgaa

SEQ ID NO: 62797 - DNA, 1050 bp, Homo sapiens
tagagcatgaattgtaaagtcatacaggtgtgtgttcagatctcagtactgacacttactgattaattttctcacttaccatttctaggcctagttttcctaatttgtaaaatgagagtgatactacctatttggtgttgtttatatagcagttatctagtacctgagctatagtaatggttcagtgaatggttgctgttgctattattgtttcttgtttttattatcagtttgggcagtaagcgcccattttccatctgggtgttatgctcctcctcatttcacctaggccttgtgaccttttttggtcactgtatctcagtagcacctatactgaaccccaaacattctgtatctgctctcctttctttgtttttctttgtaacaattcatcaccaccagacacatttgtttattgtcccctcttgcgagtgagaatataaactccttaaaagcatgccatgatcgcttcatttattgatatgtacccagtttctagaacagttcctggcacattgtacagatgactacatacctgttcagtgttgactaaagagtataaactcagtagagagaaaaccaaactcagcatccttttccttcatctccatctcacctttccccactcactgcaggcccactcactgccagatgttccttcatctccatctcacgtttccgcgctcactgcaggccactcaccatcagatgttcttttctgcattcctgttctcttaactgacatctacgctagaaaccagaattatttttcatttctgtcacaccctacattcaatcaggcgccaattaatttggactctttttcataatgtgtctcctttctttctcactgctatcctggtgcttgtttaaattattcaggaatttcctaatgggccttctaatttctagttccctttcctttcttcccactcgcctgccatcaccggaggatttatcctcaaggacatctcttgacactgtcatactgatgttgagaaatcttcagttccatcagagtaaaatgtaaattaatgcctcagtttgact

SEQ ID NO: 62798 - DNA, 1020 bp, Homo sapiens
gtattatggggataaaaatgattctgatttaagttgtacctttaaacagcttatattatagtctagtgtgaaagaaaatacaggcgcatcgtaactaaaataacaagtaggcaggggtaagtgccatgtgggagaaacacataatagttaataataggtaccatatattagagtgcatagtatgtgtaagtacatcattatcacatttatacttcacatagcaaattatccctatttttacagcagaggaattgaggaattaaatggttctctaatatagggaagttaagtaatggacccaaattgtccatttatgtggctgagctggacttgcacatagggctgtacaaagcttatgatcttaaaaaattgagcaggcgtgtcttcttgaggattatatacaaagaaagtgttttggacaagtagttttatcttggctgtcagcataaattctatatataataccagcacatagcaatttctttttccctttctttttaagacactggaagaagagtttgccaggaaactacaggaacaggaagtattctttaaaatgactggggagtctgaatgccttaacccatcaacacagagccggatttccaaattttatcctattcccagcttgcattccaccggatcataacaaagggaagcattctgtgcgtgggtttggctctttcagtatgtcattctgttctcatcttctgccacagtctctcagatagctcatgaagacaatcacctgcctcaccttctaggtgttttccttttttgttttttttgttttgttttgtttttaagcaaagatgaagggaaaacgaactaagacagacgctaggccatgttggcaaagtagcatcttggtgactaaggtgactttgtatattcatcttaaaaattatgttctttagacactgctacctgaaaactgttggagaaataatgtttaaagttatttaagaaaaactgttacatcactaagtattaataaattcttcttacctgacgtaactt

SEQ ID NO: 62799 - DNA, 1051 bp, Homo sapiens
ctgtgagttatatttataaatatatcttcagaaattaatcttaaaagaggcattagttcagaatacttttttaaaagtttaaattaaatatttaggcacgtcaggaattacttttccttattttgaaatgaggctacttatgtcttggttttattttgttccatgtttaaatcattcactttgatttgagtgggaaaagcctgaagcctttatcatgtggttgctggtgtgtgtaattattaatgaaatgttcactcctagtcccttatgaggcttagaatttcaaccacgtgtcaggtcagacagtattataaactgtactttgctgtctgagacagcacatttgtgaatgatgcttgctgcctgccattttcaacctattctctcttaagagtgctaggtaccaaattgtgaaagtttgttttcagttatattacttttgaggctggtgaaaaatttaaatgtaactttgtgggaacactgattcatatttagaaaatgtaaatgtctgtagcactttcttgcagttaatttgaaaactttggatgctgaaccttgtttgtcagtgatttagatgatttaaaaatgcatgtgtgatttgaattttataattgttttgacaagcataatttacttggacaacttcgtaggtagccttaacttctggccaagtttgttttttatataaatatatatacatatatacatattatgtatggttgtaaattcatacacttatcacatgaatgtgttactgtatacaaaactcttaatgctttattctcaaatgctgggttgaaaaatgttttgaaagccttttaaaatatatatctttataaagtaatattcaggatgatgataaaaattgtttatattgttatgataaaaatgacagtataatgttgcccagtgtatttaatgatttatttgaagagggattgggaaggaacgtcttcataccactttctcctttgaaattttcagtttattgacttttaaaaaatgaatacctcaggcagtagacattttttttctagtatcatttaattga

SEQ ID NO: 62800 - DNA, 1052 bp, Homo sapiens
ttgattaaagaaaatctagaactgaagtgaaagaagagagttccagttctaatagtcttttgattaacaattcttttctgagaaatgatttttataagaaatggggtgattctttaaatgcttttcttaagttgaaggcacaacagttaatggctgtattgttgctattccgttgctgacatgtttttgataaagctttaacattcctgctactaattttggcggagagtgtttgccaggtttcaatgtgggctgcagctttttgtgctccttctctggtttgcagtgtaatgagttcataagctaaattttcagaaagaattttgtttaagattatgcctcttatctacttgagagcaacatgtcttttcaatcatgggattgacacatgaaaaataaagttatttcttaatcaattttgggaagcagtcttttattgagaatctttgaaactggagtgtcctgcctgagaacactttgcagttgttggtcctagttatattgtaaaacttgcagtccccgcaggtcttctgacccttccagagttagtattcctagctgtgtgtagtccacagcatacacgcaaacacacacacactcaaatgtagtttttagtgataacttgctgggggttgtctttcagaatgcaaacccctcctttgggaggtgcttaaaatatttctatcagcctatgtatatatgtgtatgtttttaatttcttttcctcttgggatggatgatttttctcaccaagcatttcacaaatcatatgacctcacttctgcaaaaatagtctcttcgtcattgataacgttcatgcaagattcagtagacgctaggcagcatcactcggcacgtgtccagctggagggaggcatggagtgtcattttctaatctgggagcgttgtgcactattgagctcattcttgacttaaaaaaaaaaaatgaaacaaaagaggctaacatccattgccatccagctgaggacataacctcatatctgcccatcctctttctgagttttgtccagagaaggtagtaagtttggact

SEQ ID NO: 62801 - DNA, 1046 bp, Homo sapiens
ggggtccctgcggcccaggagggcctggggggccaacaatgaagctgcgcacatcaggacctgcagggtgagaagctgcatgagtgggagctcagatctcggtggagagaaagacttgggagttagggagtctctcccagggtgtcaatgcccctgagagaccagaagtgaacttcagggttcttgtacccgagtgggagaattttggtgtggaaggaaaccgggcttaccccaccagtggctctcgtgtggccttcctgtccctttaagtgcctccctgccccacttacagggaaaagcaaggcctgcggggtgcctggtggggcatcaccgtcggggcacctacttgtgaggtagctgatcagctcgctccggaagctgtcgctgttttcagctgcataggttgccagggctcctgagacacccgggggccctcgaggccctgggggaccaggaggtcctggagggcctgggatgaatgacaagccggcagctgggcagaaggaagagaaagaaaggtcggggtagtgctgcggaggaagctgaattcccagcctgtgctcggggcgctgtgggccccacctgaaaggaggggatgaggctgggcctcccgggtgatgggaggagagaaaagcaggaggccagagcctgctgtttcctgacatcatccaggaatggctgttcccgtcaggctctcccactcccaattctgagcctcattcaactcagccctccagtcactgagaggtggagccccaggtcggccctaatcacacaccgggctgcgcctgggaaagccatctctccccacctctgtccctgccacggctgaaggccccttgccagcacatgtggcgctctccagggccctgcacccagcactgtacaggctccaggagcacttagactgcccttgctaaagcccatgggagcccccaaggcccggctgcatcccctgccctccccatcccactccacagtgccctactatgtaagtaagacgagaggtcctccacgctgatgctggaccacacattgcctgggat

SEQ ID NO: 62802 - DNA, 1127 bp, Homo sapiens
ttactgggataaacttctcaacacttttggaaaggtgttgatcttgctgaagtaaaaaggaaataaaacaaatggagcttccagaaattaaagtcattttgtgatgccttctttagatgtggagacagaaagccatctagtggtgtctagcatagaaatggaaggactttatttctggtgatttattgacattaagaatgtttttcttgattcacatttttaatgttttgtgctctttatagcctatgagtgcaacacttagagaaagattaaggaaaacaagattttcatttaattcctcttacaatgtggtgaaacgtcttaaagtagagagtgaagaaaatgatcagaccttttcagagaaaccagcatcttccacagaggaaaactgtttggaatttcaagaaagttttaaacatatagacagtgaatttgaagaaaatacaaatttgaaaaatactttgaagaatctcaatgtctgtgaatctcagtcacttgattctggatcatgcagtgctctccaaaatgagtttgtgagtgagaagcttcctaaacaaagattaaacgctgaaaaagccaaattggtgaagcaggttcaggagaaagaagaccttcttcggaggctaaaactagtcaaaatgtatagatcaaaggtgagaagaatttcaggaccattgcataatttttatttttacataaattacaggaaagtaatttcaaaaatagaatttttttttttaccataataagcaataagccaaatattcagaaacctggcttccaacagctttaattcaactccagatttagagtagaaaaggcccttaaacaccaggtaaaactttttaagaatctcagctctgatttaatatgcagttaaacttttctctctagtttctagcccacagcaatattagaagtattaaatgttagatgcaagtacaatgggaacagaagtgaaagctgacagtgaattagtaaaactaaaaatgggctgtagagtacaataaaaggtatttttagtaatgatcttgtgtctcccccaaataattaatgtgattcagccattttatttgagaaaatatatatatatatatattatattttagatttcaacccatataggt

SEQ ID NO: 62803 - DNA, 1057 bp, Homo sapiens
tagacatagagtcttgctattttgcacagtgtagtcttgaactcctgggctcaagcagtcctcccaccttggcctcctaaggtgctgggatcccaggtgtgagccaccatccccagcctaaaaaaatatttttaacttgaatattgtaattttaaagagcagttttaggttcatagcaacatttagtggaaagcatagtgtcattttttaaaaagtacagttgtaatacagtagatttttccctgtattattgcttcttgacatagttttggccctatttaatgatttgatttttcccttatcataaagatggcccagagcttaagccaacaaaatagccatagaactcaagttgagtgacattgtaaccattctacatatgaccatcctactttttcctagatagaagtcccattcatccctgtgtatgttagcctttaaacctgcacatccactaatttaacaactttaattaagttgaactagcatgactagttattgacatacatgtttttttttctgtttcagaatgatctgtctcagttacagttgttaataaagaagtggagaagctgtagccagctcttgctttatgagttgcagtcagctgtgtctgaagagaacaagaaactaagccttactcaattgatagaccactatgggttagatgataaattactacactataacagaagtgaagaagaatttatagatgtttaattcctgatttttgctccagaatatctttgagaatgacaacttaattaaaagatacttaggcactttttttttttttttgagactgagtttcgctcttgtcatcctggctggagtgtgatggtgcgatcttgactcactgcaacctctgcctctcgggttccagcaattctcctgcctcagcctcccgagtagctgagattacaggcgcccgccaccatgcccggctaatttttgcatttttagtagagactgggtttcaccacgttggccaggctggtctcgaactcctgacctcaggtgatccaccgcctaggcctcccaaaaccattagggctca

SEQ ID NO: 62804 - DNA, 1080 bp, Homo sapiens
ggttagctgaggtgggcggatctcttgagctcaggagttcgaggccagcctggccaacatggcaaaacctactctctacaaaacatacaaaaattagccgggcatggtggttcctgcctgtggtcccaggcacttgagggggctgaggtgggaggatcaattgagcccaggaggtggaggttgcattgagccaagatcataccactgcactgcagcttgggcaacagagggacaccctgtctcaaaaaaaaaaaaaaaaaaaaaaagaaaagaaacactggggactactagagggaggaggcagggagggaggaagggctgaaaaattatggggtactatgctcagtacctgtgtgacggaatcattccgtaccccaaacctcagcatcacacaatatacctaagtaacaaacttgtacatgtactccctgaatctaaaataaaagttgaaattattttaaacaatgtatttttaaagaaatgctgatagctttttaactgttgtatacattttaggattactgattacttttaaagaaacctacagttggttaaagaaaaaaaagcatgcttacccattgcattacagatgtcttttctctctgagacagctaccaactcttctcgtagattgcagcttagggcataatttgctatatctttttgattgctgaactttccaagttttttgagtagtttcttgcagttttccacattctttttgtgcatctgaaatttttgttcccatgacaccccacaaaattaattttgaaaaatgtaatttatcctataaagacattattcttatattttaaatacattatcatcattaagataacatcttaccgccatatctgtagtgcctggcatagtaggcactcgagttatttgttgaaaggtagaatggtatgttaataacaaattttagaaaaaacattttgtatattcttaaactgagagaatattttaaaagcttgagattgctttgtttctaatatatgctacataataaaaactgaccatttttattcagtgatgattaaataaaacctttccaatgccaaggaaagactaccaaca

SEQ ID NO: 62805 - DNA, 1070 bp, Homo sapiens
attctaagccaggagtgtttcaaaatatatctgtgagttatttttcttccaacagtttacatttgcagcctccagttcttcatgacccatttagtagaatcattctactcagagctaaggatttcctgtcaaacccggtggtccttcaattctctgtagcatttaaccatcttaatttctcattcctttggctttcatcaccccaaattaattttgcttccaacatgtcataccactctacctcttttactggattctcttttgcctctaacacttcaatatagccgttcttcaagattttgcccttagctatgtttgtgtttctttccatacctctccctgggtgatgtcctctgtttttctaacttcaacgatcactcctacaaactaatccaagttctgtggattccaagccatgccccatttctatagttttcacctcccagcagctcttcttagtttgccttttttgtacatcccaaatctacttttcaaggtctagtttaaataccaccttctccttcataaaacctttcttgattttccaagcctggagaaattccatctcattacaaaccacctttgaattagcatgacactctacatggcttctggcaaccaatcatatctatgtgatcattttcccatgaagactaggacatgttatctatctttgtatctccctcagtgtctttaactaggactttgttaatgtgggactcaagtggaacaacacttaaatgtttggtgagttgaataaatgaattaatgaatgagaaaataaagtaggcatttgtaataattggtgctttgatgtaataattagtgtacatgaatgtattgatggctaaatacagggaaatattatggcacaaaagccaaatcaatctttttttgttttttttgagatggggttttgctctttttgcccaggtggagtgcaatggtgtgatatccgctcactacaacctccacctcctgggttcaagcaattctcctgcctcaccctcccggagcagctgggattacaggcatgtgccaccacgcccaactaattttttgtatttttt

SEQ ID NO: 62806 - DNA, 1050 bp, Homo sapiens
ctaatctgatcctacctactccattaatattatttccaactatgccctggtatgagttttctgagccagtcatttattttcaccatttcacagacatgcctctagcccattcccttggcacttactgtctctgaatctgccaatgcccagctcaaataccaccccctccagcaagttttccccattgcattgtccctcatctgccttttttcctattctctgactcactttccctgtaaaactgaggccatgaggtttcacttccctcccaactccctttctctcttccctttactcctactataccctccagccttgctcctctctctaatctagcatctatgttagttacatagatctgatgatagagaattcaaaaacaacttataagatttacatcagtaaaagtagcttttattattcattgttacattgtacttttaattacgtcacctgctttaccttgtttttcttttccagaagacagaagaaattttatcagtccagtaaccttggtatatcagaaggagggcgtgctggcttctggaattgtaatgtattctttttttcaaattaattggtttaaagaaaattcacaattcccatttgttgccatttactattatgagccatattttaggatgtcagatctgtcacattattaattaaaatggtttcctctttgggtactattaaaaaggatttattatgaatagcttcaaatctatacaaaatagaggggacgatataatgaactaccatatattactgcaaacaaacacaaatagaatttaaaaatccattgcccttccgcaatgaaaaaatacctaatatctgtaacccaattccatgctcatttctacacttaatgtattagcttatcagacacgaatttggaatcctttgtctaagctgcagcttagactcttgtgaatgcccatttaacttacatgtatcataatgttattgttgatattcgaatcagtattaatagcctccatttacttggtgcttgctttgtgccaggcaccaagctaagtactttacttg

SEQ ID NO: 62807 - DNA, 1050 bp, Homo sapiens
gtctttgtgatttatagtttaaggttagatgtcataaaaaaaactcaggaaacttttcaataatggtgataacggtgaataactctcttccttatgagtcaaatctcaatcagacaccacagaagtgtcactattcagcagcagtttaattttttggagtgggaaaggtggtttgcctttttcttgatccactgggtgaccagattgttacccaactatttattttctaactatctaaggctatgagggcatgaaaggtacaaataataaattaaagtcagtctgtccttaaaaaaaattattatgatgaatgctcaatgttcctatgttttctgcgtctatggggttaagtatggttcctttttgtcagttgttctggtgagtatttctcaggcttttagccgtgattgttttcttaacacaaggttttattctctccctgaagccgaaagatgatctatatcctttgcttcacccgactatgcattgctggactccaacaagtgacttgtacattggctgtgaagagggtcatcttttaatgattaatggagacaccttgcaagtgactgtacttaataagatagaagaggaatcgccattgggtaagaaactgtcctacttcatattcctgtatagccatgggtgttggtttttttggttttccctatttttctctttcttggagacatctttgaatcctccttcttcttaatcctctggctgttactgtgctgttggcattctaccatcactttatatgcatatttcatgtaatcctcagaacaacattatgaggagagacaccttaatctccacgatacagaagagatatgttaggaaacatggcccagtccacgtaaactgtggagctgacacctgaacccaggcaataatacctcagagtccaagttcttggctactgtgctgtatccttttctatacatatgcccattctgcttagtctgctaatcataccctttcctgcccccaccccaacccttttctccaggctgatcatctgttaagcccaaaagccatcttgaaaat

SEQ ID NO: 62808 - DNA, 1047 bp, Homo sapiens
ccataaggttgtaaatttttgtaaggatgttgttgcgggattgtacgaccagtgttacctcccatttaccgtaagatttccacattattttccaaattctgttttgagtttggcagccaccttgccttactccggcttcttggacgatagagctattcagggttacttttggtcataatctgggtgtagaataattaacatagaacattcctgattgtattccctgttcttattttaataaattgtcagtttctctctttgggcaagttctcacattaactgaacaaattgcttcactctagtctcattccttttgtgtaaaaaagggacctctatagtgtctttcaaattgaatattctattacaggcatttttaaatatttttaatgaaatatttaagggaaaaaagtgaaactgtagagtaataattacatatgggagactctgtgatgtcatcctagttgacctagctcacacctttcattttttcctcttcccacaggtgtgtagaccacactccaaaactgaaactgtggatggcagccatgaaggaagatcccacagtctcagccctgcttactagtgagaaagactggcaaggtttcctagagctctacttacagaacagccctgaggcctgtgactatgggctctgaagggggcaggagtcagcaataaagctatgtctgatattttccttcactaatatgaataatagcatgcttttattttaccaaggttcaggttgcatgggatcatcttctctgactgatttgacatcaacagccaaacggtgggggtctccttaacgcccccctacagaaatgaaaatgcatttcctgtctcaggatgctgaaacgactctgagggttctatcatagtccatgctgaaaacccccaaattatcatctttagcaaaatctggacttgaatcttttttttttttttgagacggagtttcactcttgttgaccaggctggagtgcaatggcctgatctcagctcaccgcaacctccgcctcctgagttcaagcgattctcctgcct

SEQ ID NO: 62809 - DNA, 1034 bp, Homo sapiens
agggtgtgcatggaagcaagaactatggaaacctagctccagtctgcaggctctgagcccctagttcctcactccagcggggctccctcactgcacagaacccaccccttctgtgtgggcactgctgaccacacagatgacccagacccaaagagcctggcagaagctctgtggttggagctgggctccgtctccaggtctggttcagggggatcaggaaggctcttttccacctgtggcttcactggccctttgagatttcctatctcaccgttacttcagttacccttgcagggggccagggagtcaagaatataccgtgttcctccagggtttaagccggccatgccttcccgagagcataaccaacttgacaggggtgcccagttaccccacaaactgaaggaaggagatccttcccccatccccaggagtgctctcaaccagcctcagaaagcttgagaagatggaccctttgcccaccagggttaattcctggtggggcagctcggctgtgatcagggcaaccaaacctataggaagccttccagtgtgagctggaattagactgaacatgtgcttgggcctgcctctccctagacgcagttgcggggcactccagggaatgaaccagctcaagtgtgtccctaacagcagcctggagctacccccaatccctcacagcctgaccctcctcattccatcagatgcatttgtagaatcggggcaaatttccttatttatttatggcccatgcctttccccctcttcatcctgatcccgttttgctttgaagagaccccagtaaccaaaaaacagcctccagaagccaaaaccatgcctggatctcccatagcttctcctttgcttccaggagaaagttcactgaaaaaaaaatatcttctggcttcttgtgtgtacagagacaacagaactcggtggggaaacgggaatcttttctgcaccaaagctgcttctaaagcagaaagcagtggggctcttggtgtttcatgctgccttatttatattaaagg

SEQ ID NO: 62810 - DNA, 1012 bp, Homo sapiens
ttttttgcagagaaggctttccattccttttatctcaaatagcccaggccacactcacagaatcttggtagaaggagtctcataagttcattaggttttactccctgcttcatgcccacatttcatctagattgtcacctacccttccctaaacagtccgggtgaggaaagtccataggtacatgtctaatgtttcacagataccaggtcactgagcagcacagctcgtggcttcatgggaagagtataggcttgaaagtcagataggtttggattcagatcctggctctatgatgttggtgagtggcctcacctctgtgcctcagttgccttatctgtaaaatggagataagtgcctgcctcagaggtttgatgtgagaatgatacatgtaaagctttattgtgcaatgcttaagcctcaataaatgggatgcagtggttgtaattcattaaaccctcccatggtgtgtcagggccctgaggcttgtccagttttttcctgaaagaagaattacttctctgctccttctcttactctgtaatcctctgtttatttctacaagaagcttgagcaagaagggaggtgtccacggcaaggcagctgagggtcagaaaacgtgtcagggttcattcctgggccattttctaaacgttggcagtgagtctgcctgcagttacatgaaggccagtccagaccaaacggggctgcaaccgtctctgtctccagggctacgtctggaagggattttgctggaagggattttccaaggcacttacactgttagcactttgtttttctgactgcagtgcccctcccaggaagaaagaatgtagaagttactttatccagagctttccacttcactccaggaatttcaaattcctgctcctgggagtaaaggcagtgaggttcttttcccaatcctaactccattcatgtattcagcaagcattcattatagcaactaccctcttccaaagctgggtactcagaacctaatggaagagctgt

SEQ ID NO: 62811 - DNA, 1003 bp, Homo sapiens
aaactagatgatatagtaggtgtctctgtagaggtttcaggaatcgccttgtccttccacttgaaggcacctgattaaagtttttgttttgtgcaactaggcataacttcaggtgcttttctgatgtccagcatttcggtggctaaagtcattgccctaattcttgtatgcacctagctttttcaggtttataaataaaaattagagtatcattaatctgcagaatccaccgttatggatatgacattgttcatataagtagaatggccttattaaaaaaaaatagtggcttcatttactgagcaaagccccattctaggggtttacacatatttatttctcctcctcacaatggcccttcaaggtgggtgttatcctagttttacaggtgaaagaacagactcagagggacttgccccaaacggacaacaacagagaagagattcgaatttagatttgctctctcccagggccttggactctttctgccacctcaggcgtctgtctggacactgtagcccagaacacatacagatggcataaagaatcccacaaagttttaagtgtcaatactgagaaaacagcaagcagaccaccaactccaggcctgagacttctggtcccttcctgctgtctcactctgatattagcagacctagtgagctttggagactccttctgccaagagattctgtgagtgtggcctgagctatctgagggtgaaaggaaggaaaggctttcccttccagcactgtttgcttttctgtttaataggcacagtaacaaccagttcctgataatattcagagcactttgcagtcctctgctggaagtccctaggaaaaatacaaagccccgcaattatcaaatgactcacttccaggtgcataacacagtgggacactcactgcctgggaagaggggctcagcttggaagcaaccctgggctgctactgctttctctcccttctaggtcatttccctgaagctgatgcaggagtcc

SEQ ID NO: 62812 - DNA, 1087 bp, Homo sapiens
aaccggctgatgaacccaggacaagaaccattatcccagctcacaatcgggtgggctttctgtgtcttttgtatttcctttgtttggtaggttatgttttagttttaaagtacaatgccacacaaaacatatcatatcctctgtttgaaagaagtagcgcattagcaggagtcatgaacagacgcatcagaaccttccctcctctgtcagtattcagctagctgaccttggcattccaggtcatggctctgggcttcaggctctccaccttcaacatgggggtcatggggtgggtacaaggtgctacatggtctctaagatgctttccatctcctttaaagaactgtcacaagttttgttcctactttgtgccaggcaatgctcaggcagctgagtcatacatgggtctgtccatagccctttagttgttgtgagacctgtttcttcttttctggtctcagtggagaagaaaaatttggccaccattacaaacctgatctcccaatgcttatttatttttgcatcttatgctggaaagcatcctttcaagaaggcagcacaaatattatagcccaaacgtgcaggtgctttagcaaaataattaaggctgtggggtctaaagtgagatagaaatgggaatgagtccatgattcactaaaatctaagagaatgaccttctaaatactagtattagggcagtattagtattagtaatcagaaactgaaacctggggaggttaactgtacctcgcagctaagatatggccagggcacaactgttttgtataataggactacagaatagtgaacccgaatacaggagtgatgggaggagggaagggaggcagcacattcaatataataattattacaatgttataatttagtacttaaaatacacattttatttttgtaatatacaatagaaaaaaaatttcttactacaaattctgccaaattcttatgacatctggggattcatggcacatatcagattttgcaaaggaaaggcatttcttatgtttctcagatgcagatatggactcgcaaaactaaggaacccaaaagtagctttgccactgtgggg

SEQ ID NO: 62813 - DNA, 1033 bp, Homo sapiens
aaataacagtggattgacttagaattccattttcagtaattgtgtaagtagaatttaagtcatttcacaattatattcactcatctgcttaagatatggaacgctgtaatttgtcacaaatgcactctacaaggcgagtttaagttttcaaggtactctgcagtgtgagccaagttgacagcaaaaggccctgtaatacttcaccaaatggtccatgattgttatttcatcaggattggatgggagtgtttacagcaaactttcataaaactttgtggcaaaataaaaacaaggaaaaattgagaaacactccttacagtgtgccctggagatatatgtataggtcatagacatcctgtgaaagataaaacaaacattgtaaagagaggagaaaaacctattgtgggcaagaaaacgctggattttagctgtgttattgtggtaagtccaggccaacaattcttggccagttagaagaattagtatacaaatgggtccctgatttctacctgaggtctagatcggtatttctagactgataaaggacagttgttacttttttgtctcccttaaatctaccacagattgatatttttgcaaaatatagtaaatatagattactataaaaatgaaataaaaaatcaaaggcatacaaaatgtaagcctttttattattagatttaataggcataaaattacttgcaaattgctataaagttatataagtgcttattctcaattttagaacttgtctcatcatggacaggtaacaatttgcagactgacacctatctaaagaattatatatagtagcactaatttattgctgataggtcatgattagaatgttaaagatgatggataagcgtaattaaattcttgctatatatgaggtattttactaaattatttatttaattttttcattttaagttctggggtacatgtgtaggatgtactggtttgttacagaggtaaaggtgtgccacggtggtttgctgtacctgtcaacccatcaccttggtattgagcc

SEQ ID NO: 62814 - DNA, 1037 bp, Homo sapiens
ttttataaagatggtttcactgtatccaggcctatttagccaaaaggctggaaaatgtgaagcatgttcaatacagaaggctttgtgagaccagaggaatgcaaatgtgaagcccagtgatgtttgggtggagagtgaatatggtgatgtggtacaactcagtgatggggaggatggcactgagagaagggtggcaggagaagcttaacaagagatccacaaggatgcagggtgaccttcacacgctctagaggctgtggcccctggataaattggccctagacaccagaaaccaaaaccagattcagtctccaaagcaagggtttgaagctattacttatcagccctgctaattaccaaccctgtctgcagcagaactacagtaggagaaactggctcaggtcaaaagaaagaaggaccctggtactcttcttaaaatcaagtcaaaggtagagctgctctattatcccagctttacgcagttttgagaatgaaaatgcaatccaaggttttgttaagggcggaaacaaaacagttccttgggagctaaactacctcacatgacaaatctcaaaatgtctctactttttaaattgtcaatgccacaaacaaaacctgaggtctaacattcacatcagcaatgcctgcagccctccatcactcctggcaactcctgacagttagtgcaggctgataattcctaccgcttacaacacagaaggccaaaggcttgggttttacacatctggaggaaaagcaaaaccctcccattctgtcaactacttcagggagtttctcaattatctaatttccatctgatttaaataataatagtaacagcatgcttccctcagagtttagagatccaaaatttcccaaccttaccttaaatggtttaaatgagaacaaacttccagtttcttttaggtagtttcaactttgccaacattttgctgaaagctgaaaacaacacttctggctactagaatgaaggtgacaggcactgagaaatgtcatgaatctgacgcttctcatca

SEQ ID NO: 62815 - DNA, 1001 bp, Homo sapiens
cagtcttggcttactgcagcctccccagttcaagcagttctctgcctcagcctttccagtagctaggattacaggccaccatgcctggctaatttttgtatttttagtagagacaggatttcaccgtcttggccaggctggtcttgaacttgaacatgatcacagggtggtcctgatctacccgcttcggcctcccaaagtgctgcgattacaggtgtgagccaccgcacctggcctcatttctacattcttttaatctgtaaaaagtggtgctttttgaacttctcctttgactggtcacaacatttgccaggttcccttgttataagtaaaataaaatctttgacccaaatcctttttatgcctgtatgaaaatcatgattttgtttttttttaaattatcacttagcattgtattattattgttgctgctactgtcactaccactgctgctgcaattgcttactgtttctaccatgacgaatattttttgagcaatgtcagtgctcaacttcccatgtagccctaacttaggaagaaaagagcaatttgatgcattagaaaagcaacacttcggataacttttatgaacatgtatctcacccagtgaagtgaaggcaaaattccacagccacgcaggacgtttttttccccataccttcccaacttgtaggataacctgtgggtagcttcactttgataatccatgccagagcatagcagaaaaaaacaaaacaatacaacctgctgaacaaatcccgttacttttcctgcccatccagacagatgtagtacctttttattcaaactcatttctaaggctgttcttctattctctgttaccctgttcttactttttttttttttttgagatggagtctcgctctgtctcccaggctggagtgcggtggtgcgatctcggctcactgctagctctgcctcccaggttcacgccattctcctgcctcagcctcccgagtagctgggactacaggcgcccg

SEQ ID NO: 62816 - DNA, 1034 bp, Homo sapiens
attgctgatggggagagggtgatgtggtgtcactgggagtacagttttctgccctatcataggtgagttctccccttctcccacttctctgcttccctcctcacctgattctttctggcttgcccctagaaaccccaaactttccctcctgtgatgcctggcccagctgacatctgctgagatttttttttccaaacaacaaaccatgatccaggtatattttcaaccaaatccaatgttactcttaagaagaattctggtatcagttattaagataataaaatttccccttatcctgttacacttcagaaatcccgttttcatcatgaggaagtaaatttgagcccagcccctggctgaatttgtaaaacctgaattaaggaggtataatctggaggctagtgcctgatttggaaactagaatggctcagaagtccctgaagctaaattattgtttgccagagccaagcttctgctggtgcaaatggaaacagtttgtcttgtaagtcaactcaaagtgatttctcctctgacaaagtgaagagatgagagaaaaaatgtgtaccctgaactccagaatcctgtttcttctgtgtaatttaaggccagggactaagcacgttttcttaaatgaaacaaatggtgctataaatggtaatagcaaccatgcatcttcactttttgatgtggctctgatgagctcctgttaatgaaacaggacacagcagatgcaaaactgtcagagtagaagatggaaaatgagattccatgtgaaatacagacttcagtgcccagagatctgatcttagagaagacaaatgatgtttgcctatttgtgtgtgtgcatctgtgtgtgtgtatgtatgtttggtggtggcagtggtgtgtgtgtccatatttgccagtttatgtgtgtgtatgttcgtgtgtgtatgtttttagttgttagaagtgctgggcattacctgtttttttccattaaacctgaattacgtaaatctatattttaatgcaggctcttggaaggcatttta

SEQ ID NO: 62817 - DNA, 1045 bp, Homo sapiens
atttgaaagctaaatctctcttgttttttatcatacattttattttgttaatcttttaggtgggagctgctcatgaggaaggttgtaagctagccaaaggcaagagctggggtccatccaagataccttaattattggccagtaaatcctggcttctgtgttagcttggagttctccttttggtgatgtttctgtggcgtgtgtactgacttccacagagctgtcaattttctagggttctagtcagattgattgactcactctgggccttcctggtttgcttctgaagtatctgtggcctcaaatttttatcacccatttttcggaattggggcacaaatttcttctgagggttaattagctgacatcccagcctctagcagcctttctgtgttctggctctttgccttacactggcaagatgtagcaaaaaattgttagcagtgatggttcctagagcaagtggtgactgttcacttctttcctgtcttcttcaggaatcagtactgagatcaggggaagcactaataccaaccctccattatgacaaacaatgtagaatgtggccattttaaatatgtgtagtttgtagtcacttaacaataatggcctaattccagaaagggtctgtattggcacatccatggaactcttccaaagaatggtaaaaatcctatatttagtgaaaggtaccatgtctttcagagtctttctttatgatctcaacaccagtttttttttttttttgagacagagtcttgctctgttgcccaggctggagtgcagtggcgcaatctcagctcactgcaagctccacctcccgggttcatgtcattttcctgactcagcctcccaagtagctgggactacaggcacccaccactgtgcccggctaatttttttgtatttttagtagagacgtggtttcaccacgttagccaggatggtctcgatctcctgacctcgtgatctacctgcattggcctcccaaagtgctgggattacaggcctgagccaccgtgcccagccgatctcaacaccattt

SEQ ID NO: 62818 - DNA, 2030 bp, Homo sapiens
gtgacctgatgttgcccattctctctggatttttctctcaccacactccctaactctctctttttttttttgagacggagtttcactctttcgcccaggctggagtgcaatggctcaacctcggctcactgcaacctctgcctcctgggttcaagtgattctcctgcctcagcctcctgagtagctgggattacaggcgctggccaccacgcctggctaatttttgtatttttagtagagatggggtttcaccaggttgtccgggctggtctcaaactcctgacctcaggtgatctgcccgctttggcctcccaaagtgctgggattacaggtgtgagccaccacgcctggcccatacttcctaactctctgcttcagaccttcaggcttctttcagcccttggtaacttccagattcctttccacggaactttgcacttgccactgcctctaccggggacgtctcctctctctccacttgtcacctcccactcacaattgagatctcagttaaagcttcggtttctcggggaagcactccctgaccttgctgaccagctcagagccccctaccctaacccctcttagaaccacgcatgctgctctgtgttagcacttaacgcatgtataagtcagcatttattttgtgatgatttgactggtggtctgtcttccccactagacttttaactttgtagtgtgagaggccatatttattttttcacagtttcatctctggcacctagcacaatacttggcatgtggtaaccaagtatcataaataattttgtattcattcaaccaatatttgttaagtattcgctaactgactctagtgactattgcacaaagtgagcaaggaaaacaaaacaaaaggttaatggtggaatcactgtagaaaaggaagttgcagagtaactcgatttaaagaggcaaatgaataaaatgtagaagttagtaaaacagttccagtctttgaccaagaaaggctcttggcctgtcccactttcatgcacctactactactaagtccttgtggtttctcaggattacaaactcagtgatgtgccagcgcttcctatgagacatcaaaacagcagtggggagtcgctcagagctctgggaaattcaactgagaatttttatttcatttagcaaatatgtacttagacgtagccttttatggggtaactctaaaatgttaggagcagcaggaacagcctcacctgttcagaagtgattcagccacaggcagaatgtactttgatggctgtatgaaagagttatagcctagatttatttatgtcatctaaggcatatctacagacagcatctttcagaatggaaatcaaattctggagatgaagaactgtttttgaaagaaattgtgtttgtactaacacggtaacttgagagcatcaatttgagcctttgtatccagaatttactgaactgtagaataaatatacgatacatcatatctcttatgcattgcactgtgaatatttcgtggttttaaatatgtgccatgattaggtatgtgctttagtaatcaactgaataagggtttaaatcaatgaaatcaaagtatctcctttcaattcggcatgtttccttctgggaggtttaaaaatatatcacaaagaaaattctattgccaaggctaaagctcttctggtgatatcagaattgagcaatgggatcccaagtcttggtctttagtgctccattttttaaagaagaaaatcccttaaagtgctcatggaagtcttcagcttttccacagatttgtgttgcagttagataatattactccaaaagtgaataaagagtgagagttttagcataaaatggccttgaaatgaaatgaaccaataaacaaataacattcaacaaatattactatatatttatatacttatagtgagctgtttaatatccaatttgagatgccaactaggggctcctggcaccatagagatcaagataagattggttcaaatccctaaagccatgtcctgtgaaagtcc

SEQ ID NO: 62819 - DNA, 1080 bp, Homo sapiens
acctgttcttccccaaggcagcctcagagcaaagtttgatttaattggctgtagcccgagaagcaaaggtaacaggtgctgggtgcttggagcttcctgcctggacctgctttgtcttggcattaagtccaagagacataaactaggcaagatggccccataaggattgaggaccagaataaaactctaatgtgccagagctcagagggaagatgaggagataaaaatgtagataaaaaaaaaaaaatcactcttcctcacttttaaataaatgataaaataaatgttgggtaggaaaatgggcattgtgttgaatttaaagaaggaagctgatctcgtttctttgtcttgctcactgtattccctggtgaagttttatgtataaggtaggaggattcaaggaaggggacagatgtggggcccctgctgtgaacactccagggactgacttgtgggacgcttgttcgccttctggaaagagtccatctgtgcctcctgccagtgagggggctgcccccaccaccccagctctcaccacttctttagcttgagggctgtgcctggcatctggctgcctgacagtaaccatcagttgttcctcatcaggctcattcccggttaggggtgggcaattgtgaaaggaaccaaggttgaactaacaagccatgagggaggtgttgccctcgtgtttcccagcaactgggggtttataccagtaatgatatgaagacaaagtagagtgctttggggcatctttcaagcaccgttggcctctagcaagagacaagatgggggactgggagggctgcgagaggggaggaaggatactgtgcttgctagttcctgcaggtagctggtgcagcagttaagaaattcatagaatcatggattaagaacaacgatgcagatcctggcaaggtggcagcagttgtgccatagtgtttgaatctctccaaataacttcataaaaacacggataaactggggtagcaaaactaaaattcagggatgagctttgcaccaaatatacaggtgtcaagcatctccacaaacccttaataagagcacgtgaagactaac

SEQ ID NO: 62820 - DNA, 1521 bp, Homo sapiens
ggcactatcagtctcatcagcttccagacagctacccccatagacagtgatgagagtggcttgttgtcctcttggtaaaacctgcttcactccagacttcaccttttcccgtatacaaccaaggaggagagttcaccctttttcctgcctcagagcttttgccatcatgtctagtggatcagcccctgcccaggcaccaagtcctgccagcaggtccttcctttcactctcttttttgtctcctgctcttgtggcatgttgagttgagagtctgaaaactaagtttactcccagcgccattctgctgcaccacagtctttaaccaccgcaggttttgggttcatctaggcagctacactcaaaagacacccatgggcttggctgatcctagttttttattcagctttttcagtggatataggatatgtagcccagtgtgttggcaggacagcttcgagtgtctctctcagcaggagttctcacagagtccggggctattcccccacttaccacctcccaggatggctcaggtttaagggaatgaagccacacaggtgggagcaggagctactggcttagagactgctgtctataatagtaaactgttctgggagccttttcaccagaagccatgaagtctggtcctatgtatttccggggaaacagaacacaaggaaaatacttacctgtgagtaaggagaaagggtgttgcacaccttttctctcagcttgtgatcttagcacatgggggcctttgctgttgacctgtgtagccagttgttaaagatgtagtggtgaataccgtgtctgtccttctcttccctgcagtgcgactggctcaacaattaccacctgacctgcagggatgtgattgggaaggaattgcagaaacagggccgccaggaagctctcgagtggctcatcagagagacgcaacccatctccaaacagcattaataaatacctccccggttttgtttttgtaaaatgctctggaggaaggaagaaacgtggcagatccctgacatctttcccctttcctttccttcttccctacctcccctttttactttagactttaagaagaacagaaaatcttcttatcctctttgatattttattgcaaacactcagtcttttatgattttttaattgttgagaacaagccaagaataaaattgctgcaccagaaggagggtccctccaaagttgaacacttggtgaaaggaagatgccccgacttctttggccagtgatggggaatcagtgagtgctccatgatggtcatgttccaggtgctagtacatcattcatgatcaccttaatgctcatgagactatatttatgatcagtgaataaaaatgtcagaactgtgctttgtcttagctgtctctttcttcatggtgctgtcccccggcatgtcgggtgagctgatctccagggctgctggctctgtggcagacatttcctaggtggaagggcccctttgagaagagacccctggcctccccgcacatttgg

SEQ ID NO: 62821 - DNA, 1045 bp, Homo sapiens
tcctccatagctgcagtgaggcgtgtttagcaaatatgagcctatgtgtgtccctacaaaaagccagatggatggtggggcctcttggccactgtacataccagattgttttcttgtgttacatgaaacattaaggaaatggaaagcaaaatctattatcgtatgtcctgttttcacacagacaaggagaaagatagtaccagcccttctcggttactactgtggtcactctggggcagtgaaacccttcacaaagcctggggcacaacagtgcttacttgcccagctcagagggttatgggtcttaactccttcagaccctggactggtaaggccaggtcagatggcagtcctggggacatgagaaaggcctgaagaatcacacagatgttcaaggtcagagcagaaacaagggtcagaaatggggtaggaactgttagcactagacagacaaaacagttcccaaaccaggaagctggaagccaggaggacacaaattccagagcaaggcaggggtcagaagttccaatgaaaagcaaatgactggtgggagccgaaggcagggtaagcacggtgggttactctcggaataagaatattttgttatctgaggcagccaatggcctttgagtgcctctcaaggcaggaacatttcctcactggcgcccacttgggcctcgttcttgacactgtaaaggaaagggtctttgggggttaaggaccttcccttccacaggagctgtggaatgggattctcccagctagaagcctcttctgcctgttccagttcacaggtgggtgatgagaaagtccatccacttcctgcttagctttcctctgtgcttgagcgcctctgcttaaccatccgtgcccttggttcagctaaacattcccactcacaggacccacatgggccttgctgataccgggtgggttatgcagcttgtagatggatatggaaaaggaaactcagcctatcagcacaatgtctggtgtgtctcttcagcaggaagagtccttccagtgtccaggggctcttgtccag

SEQ ID NO: 62822 - DNA, 1108 bp, Homo sapiens
acatctgtccccattctgcaacatgcccctgggttttctttgcaggaatgcttcacatatgtcctcaagggccacatagctgtgagtgcagccgttttcccgactggaaccaaaggtaggtggtgcattctgtcacatggcaggctctttttcttgtttgagaatcaaatatgtctatgtttgagtgaaagaacatgtcgttccttcactgtgaggtccccatcccacttcaggcccagccaggtgctcatggggtgagtctccataacccactgactgagcccagaggcctcagggagccgggttaggattgggcccagtaccccctgtgcaccattctcctgaccacttatggtattggatgacacatgtggatggctcccaggagaggacaaaccagatatgaaggtcacagggcctgagtggaagttggtgcagcctcctgtctgccctttagtactgggccagtgcttcctttcgggattcttaggatttattttactgggaccctgacttcagctatgtactactttgcttgaggcctggtgggtggagcattggactgggcattgacaagacctgggctgccttgcttttgggtagattagacatgtactcatctccctaggcctcagtttcctcatctgtcatgcctgcctgtctgcttgcagtctggttagagtctcatctttgtaattctgaaaccttagggtcgcagagctggcaagggaacgtccatgtctgatacggcctctgtgtgctgtaggtgtctatccccgctcaccagcatcctgaatggatgatcgcctagcttcagactgagctctgatggtttctcaggagctctgattgttagaaagttcttccttgtgctgtgctgaaatctgaaccctccagtaacttacctattggtttctgtttcacgttctggagccacacataataaatttaatctctaaagcgctgtacaaatacaattaagtggctctttatgtctttcaggtcaccttcttgactcctttgcccgttcagctttatgggattcaggcctagattacttgcacgggactggacatggtgttgggtcttttttgaatgtccatgaggg

SEQ ID NO: 62823 - DNA, 1138 bp, Homo sapiens
ggggtttcactgtgttagccaggatggtctcgatctcctgaccttgtgatccgcccgcctcggcctcccaaagtgctgggattacaggcgtgagccaccgtgcctggccgtaaattatttttaaaaatataaattatttttacatgtctcttagtgtgcagataaattttttttctttttttttttcttattttgagatggggtctcatctgttgcacaggctggagagtagtggtgtgatcacagctcactgcagcctcagcctccccaagctcaggtgatcctcccacctcagcctcccgattagttgggactacagcccacctgattttttctgatttttttgtagagataaggttttgccatgttgcccaggctgatctgaaactcctgggctcaagcgatccacctatcttggcctcccaaagtgctaggattataggtgtgagccatcacacctggcttagatatgattttgtgttttattttattctcttagaatcatagtgtgaacattttccatgtacattgaggccttaaaaaaggatccaaatgaaaactgcatctagtggctcttctgatttactaacccagtcctcctatttttaaatgtttgggttgtttttaattttttgctgttatcagtaatcctgcaataatctctccgcatttatcttttttatttctctagaatgattttcttacgatgatttcttaggaggggatgcttttgaatttttaaacttagatatgttgttttgggaggttttaggataaaatactgaagcacaatagttgagtgaaaaattaaatgaatagaaactattggattttagatagctttggtgagagcctttgggagttctcccttgctaaagatgtgtcctgtagattggtcagttgggatgaagcaattgaggaaaaagtgagcttttaatgtacctcctctaatttgtaagaggcacacatgaatttatctcaccagatgatttataagcaattttctcataggttcccaaaggtggtgtgacagagatctcagctgctgacaaagctgaggagtttcgcaggtaaggatccatttggggggacccaggagcctcgtgctgattttcttgctagttgaatgaggctggaa

SEQ ID NO: 62824 - DNA, 1024 bp, Homo sapiens
gacaggaagctccgtctccatggggctcactgacccttacagaggaggcttgcctggcttcccttgtgggagggtctcagtttttctaccctaggtcatctgcctcagaagggagagagtgctcgtctccttcctttttatttgggagcgccagaggtttgtcggcttcaaggccaggcctggcaggtcaccactaggcggatcatttcaactccttgtgggggcagttctcaggatttcaactaatagcttttattcccttctccgggcagtgatgtggaagcctgagaaacagctctggtgccatcacgtggtggacatgagcaattgcagctcagaggtggaaccagacgggagtcaggcttccagcctttctgtgcgattccactgaatccttgcgcagcagctggactccaagctgaagctcttccctcccgctacaagcgaccccttaacatcttaagtcagacaggtgacagggattttgatttcttttctagggctatttaatctccgaggatcagatgtggagcacaatccagtatttttctcctacgcaatcataggactagagacgatcatgtgagtgtttgccctgcatctggaactcccttccagagctcctcagagccctagtgtgccctttctggtcctggcccacccatcactgcctgatatttcactgatgtgcttcttttttcttgcccttttaacattttcccttcttgttttccttagcagtaggtgtttatttatatcctgcctctctttgagcccccaaaatggtttgaaacgcatgaaagtgtctatagttcgggccacccatttgatgtcaagttttctagcagccagtgttaaggggtatatatgctcaattatacaattctgggtccacaatgcaaataaacccagtcattttgaaggtcaaaaataatatgggaaaacccctccaactacgctttgttgaattgtcagtttattttttcaaagcatttcgtgtggccttcttttcattactgttcta

SEQ ID NO: 62825 - DNA, 2219 bp, Homo sapiens
ggagctgacaggaggattttgccctactctgccccagtgggatatttgaagaagcaggagctttgtttgtttccactgttgccacctacttgccacttagtttggctttggttattttcgcaaagctcgtttgggtggctttttgggtgctgctgaaaagactgagttttttttatccactcagctgctaactgccactcgaacgtatttgatattggaaatagagcatagaggtttctaggttccatttcccttcttatgtcagcatttgtagatttaccttcctaggcctttgtcctccatcttgtaccttctgctttagaggctttggggtgtgggtgtgtttccttggcctgtgcgatagtgatgggtaagcagcatgttctctgaaccattgtgtggatttatgaagcagtgagggggcagagagagaggcctggaggtggggctgcaggggagggcgtcttgctgtagaaacagaggtagatgggggatggctgtggaatgtaggcagattgcccagaggggtcctgggaagaaagcgtgacagcctagattctgggccaagttttaaacagcattcccgaactgatcttcagtgcagccctgggtgtgggggcagccccagcctgctttcttgtgtgacatcctcaccagaggggtattgcggaatggggaggatgggtccagtgagtggcccagggtcagctaaatattttccatcagcgtggtttgaagtttttttcactagagcagaagctctgacttgttgcttataggagaggggagagcaaatgttgctgttcagtacacatttgggtgcctactatctgcaggatgctgtgcgaggtgctgagtgaataagacagatgcccaccctgctcacaggtggctgttccctgagttatgaatgctgccctggtagggtggttgtggtggcaatggggtgagctcctctagcaccacgatttcatcttgcagagcaacagagaggccttggcagtgtctgaaagggcaagtgtgatttggaagtggtaatcacagtgagtcagactacagggaattcctaggtcttagcactgaaaggcaagtcttgcagcccccaggaacatcaagtggtgggtgctgttcccctgacccctgagactgggtgagttccctttgctgggtagtgtgttgatataggtccctgtgtgtcccctgttgcatcagtatttacagtagtgtgttaattgctggtttaattatctgtcttcccttctatattgtaagccccatgaagacagggactgggtctggctcagatctgtaaccacagtgaccagcagagtgcctggcacgtatctatgcctggcagatctagatgttacacaggcatttgtgggatgcgtaaatgaatgaattttactggtgaggcaatcaaggctcacgacagtcaagtggcttggacacttcttgtatagggcttgaatccaggcctcctgcctgtttaagtagcgtgctcctgtaagaaatggtgctgattaaagatgtttagggtaggttctttcactgggttcctactgctttctgggaccagggctggagttaaagcacatttgtttcttgcaggcatctcctggaaggacaaggttgcagaccttcggttgaaaatggctgagaggaacgtcatgtggtttgtggtcactgccttggatgagattgcgtgtgagtgctctggtttcgctgtttgggcatgttacccgatctctcctttgggtctctgggtatctgtgtgttcatgccattcaactttctgagtggccagggaataagaagaagactacgtcaccaaatgggtataggagatgccaactaggatgaaggagaaagaattacagggagctggggaggggagtgaggcttgtccagagcagtattacagctgggtgatgcccacctctggccagtccctcaggaccatggcacctctgaggaagggcatttcctacaaatattttatgtctgtcagcctctgtaggtgtagaagtgggctcataggagaggccttctttctttacacttgtcctgtggtttcctaaggtctttatagtgagaatgttctgggagcatttctacctcagaaaactaggaactaaaagttcctccccaagccctttgatgtaatagtagtttctcagtctttggaccttaacccaccttcatgcagttgttcagca

SEQ ID NO: 62826 - DNA, 1107 bp, Homo sapiens
ggaaaggtgaaacagctcccctggggtgtctggtggagcagaggagtggctgtaattgctgagcaggaaccatccctccctgtgtcttgttgattatacgagaccactttggccataggtctacagttctccattctctgttcttgactcatactgtgcaagtggagtcctttttgtgcagggaccagtgccaggtagcttgggtctcaggactgttctttcagagcttgacacacagcttgttttcagtagtgtggtcttctcttgcccagaggtttctttggagtcaaggacccatctgccccactaggagctgatgcctcttactgctcttgcctgtctactgtcattttgtgcagcttctgagcagttgttagaaacctttcttcttcttttttttttctcccctgcttcaggcacagccatcatcacagaagagcatgcagccatgtggactgacgggcgctactttctccaggctgccaagcaaatggacagcaactggacacttatgaagatgggtgggtacaggcatggctagcccaaacttagttggcctgatctgggcagggatcctagaggtcctcaggactcctggatcttaatccttttatgcagtcatggacccttttgagaatccaaggaaaactgagaaaaaaaaaaatggcatgcctatacatacgtaccaatgtgcattcaattttggaggacgctggttcaggatacttattttactgaggggaaactgagggctagagaggacagttgatttgctgcagatcacattgctgtgcatttcactcctgtactgggggccttctactatttgctgcctcatgattcagagtgagataaaggcaaggagtcattggcaacagaagccagaaagctttcccctgaggctctctctgaggatcttggatttgcttctggaagcttagctctggagaagagcagcattcaggacaagcgaacaggtctggaacttgcttgggctagtcgcttcacttgagtgctttagtttcctcatctgtaaaatgggttaatcacagtaagtaacatataaagtggtgagaattaaagcattactatgtggaaagcatatag

SEQ ID NO: 62827 - DNA, 1151 bp, Homo sapiens
atacagaggcaaggggattatcagctgagaagaccttggttttggacatgacattttattttgctgaagcctcctggattggatgaagcgtttccgctcactctgtagcaggaagggacagggtctgcatgggagagattggtgatgctacctcagaggaggacccaaacaggaagtttggaaacaagtcagtatctacagaaacttaagttagggaattgttggtgcttaacacagaaattcagccttacttttcagaaaaataacagatgcctaaatgtcagtggcaaggaggggagaaggctattattggtttgatttttgagtaagatctcagtgaagaaagagcagtttttatctgtttctcctgatgtgctttggttctcctaatgaggaaatagaggctaaagggaacagctctctctgcccttaattaattcaatcttctgcagtgtgtgctaatctgttgttttcagctagactgttggcttcttgagggcgggggccaaggattccccagtcttcatagtccccgctgagcctagcacaaggctaagcaggcagaacagtctgctcatgactgatcgaggcccactttgttgtcatctttgttttccagagtgagtatattgctccatgtgactgtcggcgggcttttgtctctggattcgatggctctgcgggtgagtcactactttttctctgttcttgctgcacctttgttcgcctcctaaaaataactgaaccgagtttcagcctgtgatatagaagcaaaaagaaaatgcaaaccagatgctccacattgactctctgcagaaaggtgtgggttcccagtctttccctgctccccaaggtcacctttcagtaaccctttttattcctctctgtatctttgcttcaaagttttaacaatttttatttttaaaaagtttttgaactttttattgaatataacatacatataaaagttctatcaattaaactgaatatacctgtgttactagcaccccaaataagaaatgagactttaatatagtttcagaacctcctctcttagcttattggtcccagataattctcccaagtgcttggcttttggtttctgttttcactcttggcttaaataacaaaggttaactctaagctgcatt

SEQ ID NO: 62828 - DNA, 1097 bp, Homo sapiens
ccacactctagctagggtaacagaaggcgatcctgtctccaaaagaaaaaaaaaaaaaaaaagacaaatatctagagtatgtgtgtgctatacagagacttaaaagtggccaggtggctattatagctgggtagtacaggtaggcctctctgtagaggtgatatttgatctcaaatgtaatgatgagaaggacctagccataccatgatcagaaatacttttataggcacaaggaagcacatgtgccaaggccttgaggcaggaatgagctcaggatatgcaaagagcagaaaggaggtgggtgtgtctggagcatggtgaatgggagcagagctgcaagaggactggcaaagtcagatcagctggtaccttgactgggccagagtttggattttatcttaaatataataggaagccattggagggttttaaggaggttgctaacatgatcttagatatttggaaaagctcactctgagtgtatgtgcagagtggattgtaggggcggtagtccaggtagagatgatggaggcttggactgagtgctgctattagaaatggagagaagtgggtggttttgagaaaaagccagcagctgtgcttctttgtgcctttttcctagcatgctacagctttggtttattttaggccctatgctgtgttctaaggagaccgcccctgggcgttgccagcttcatgcctgggagaaggagagtgacagccctgggcccagtgcttgtctggcttctgcatagcctgtcagtgtggaggtgaggctgtggccagccttgcttagcaatgtctttctggaatgttgaccacttaggtcatgtctggacattcttaccccagaccttgtctccatcccaaactaaacatgtccatttgctgttaattccacctccctttggaggaactctttccttgcctttgctgatggagaagtctaggtaaaccctgcggatcttccatctctcccaagcttgcccagaaaggggtggggcatccctagagtactatgtccctgaatggaagagtccagccgggctcagacctgcactgcattctctgccagtctttgccagtatcttcaccct

SEQ ID NO: 62829 - DNA, 1032 bp, Homo sapiens
ggagaacagtggcctggttaagaccatccatgaattacccctgactggtcatggttgtccttgaccaccagaatcaggattttagagtgacatgatcagagggagcagtgtttagtatgggttggagaaaggagactctgggaattgagaaacctgttaggccttgcaggatctcagagttggggtaaagagggcctggacttgggtactggggttaggagcggagaggaggggtaggatttggagaagtagtacaacctggattaaatgtggaccttgcaggcaggtggtagaggggattgggaaggtttgaagcctgggagtgtttgtggtgccatcaacagaaggaaatgggttccttgttttagttcctgtggagaagagccacatagttggggcgactctgttaagtgggactctggatccttgctgtgattgtgagaacaagaaggaagggctggcttcatgtgtgacctgccatagtagcctcctcagtaatagagaggctgctgttccctgtggctcttgttcctaattgtttcatttcagggtagattctgggttgatggagtttctcctacggctggggaggggagggtgttggagaagtgaaggggaatcttgaattctgtcctttgtgtactttccaaaacacaaatatacacacccacacgctgttccctgcaagagagaaaacgtacctcaaatgcataattacgcaaggacttggcactgcagtggtctgcttctctctgtcctctgcaactctaagggtttcttctttttaaactcagagcaagggttgtggtattagggttgttgtattaatgagcttgggccctgggggacttttatagcaaggaatcgtctgttctctctggtaatctggatactttcatgtaccatcctagtcgtatattgggattcgtgggcaccacttgcctcaaagcaggagaatccttggttggagtcagagctgtgccagcactgccttttagaaatcttgattcctcatcctcctcatccgtagac

SEQ ID NO: 62830 - DNA, 2823 bp, Homo sapiens
gtgaggaagtaggctggccactgtgatttgagcctgagttatggtatgagtcgtaggtagcagaggagctgggcactcccccatttaagaagggcagaccattgccttgtcttcaaggaattttgttttttcttttctttgggcccctctgatgagctcttccttgtttcctgtcagtcctaggcctcagcctttggatgtgggcttcatgtcacctggattctctgctggattcaccagtggcatttttaattttctgcccttcaagcattggacagttgccctaggctgatttgattgcagtcaccctgttagtgttgagcagatggtggttcccgcaactggagcacatgatgattatgtagcagttggtttgggcagttctgtaagtcccctggcacagttgtctgaaattggggccctcctccgaaagggttctcacaggtcgtcatggagcctcagctgaagactcctaatagctctactatttgtgaatctttacctccaggggaggcctcagtgtacagaaagattcgacctgctaatgttacttgaattaagagttgaaggtttctggttaagggtgtgttggaagctttgtagtgtttgtatttcaatttcagttttcttttgcctggagttaggatattatctgtgtgtttactagtaggagacaccgacatcttatagctgagtcaagtttatcttgatgttcttggtcctgggtgctgttcctttgccagctttttttgtttgtttggtcatcataaagctgatttttggacaccctgactgatacttaaaaatgttctatctttgacagtaggtgtggcctattacacccgaagcaattccttctgggagtggcagtgaggccatctaagccacaggggatgttccaggctttccctcagctctttatctcctactaatgatcctgcaatatcagaattagatggcttttccctccatgaggaaactgaggctctaatctgagacagatgtgttttgtagcaacatcctgaaaatacaaaatgtatcaagcttgcttggtgttagctgttgctcttattgcagaagtcactgtttagacttcacagacttacatttttgcactcttgctgtccttccatcttcatcacccctctccactctttcttttataatcttaactgtcatttctattgctgtagcttagctgtctgtcttacatacgtggagaaattgtgttttgtttgtttgcatgttttctgactgctgctcagggctaggtctggggcaaatgcagagggcaggtagttagcatataggtaagcgtatgagctctagagcctctctgggttcagatgccagatttgctacttactagttgcttgacatcaggcaagttacatgaaattctgaagtgtcaattaaactttctgggtctcagtttctgcattcgcaaaaaggagattgtgacagtgtggtatgtaccgcatgggctattgttaggatgaaatgggttcatactgtagatgtgaatgcttgaagcacttgaatgcttgctgcttgaatgcttgatgtcacttgaaaagtctcgtcatattagctgccgctattgttgttattactgttgtggagatgaatgagattccctttgaagagattaaataataggtaagccacagtcataaatgagaacacaaaaagaaactggtgaatgtcatgggaaaggacctcattagcactgtctaagtagaatctgtgagatacacatgtaatattcaatgttctcatagacacattaaagtaaaagagcagtgaaattaattttaacaatatattaatccaacatatccaaaatattattttagcacatcatcattataaaaattattaagaagatactttacattcctttttatgctgtggtttcaaatatgggaagtttttacatttacaaaacttcgcaatttgaatgtgaaattttcattggaaatatttgatctgtgtttagatttcataagactgacagttgaaaaggtggactcacgtacccaagttgttctaaacatacttagaagttttccagtaactgaatcttgaatatcagtttttaaatttgtatttcaatttattaaagtgaaataaaattaagtattctgtttctcagtcacaatagccacatttcaagtgcttagacacatgtggctggtggcaactgtaatgtaagtttacttaaagtgtgaactgaattcaaaggtgacagagtattttaagctggcaggatcagggaagtcttcatggagaaagtaggatttaaattggaacgtgaacaggtagaatttggatgcatggaaagagggagagaagtacaagaaataccatggaaatctttttttaaattatactttaagttctagggtacatgagcacaacgtgcaggtttgttaacatatgtatacatgtgccatgttggtgtgctgcacccattaactcatcatttacattaggtatatctcctaatgctatccctcccccctccccccaccccatgacaggccccagtgtgtgatgttccattgttcagttgccacctgtgagtgagaacatgcggtgtttggttttctgtccttgcgatagtttgctcagaatgatggtttccagcttcatccatgtccctacaaaggacataaactcatccttttttatggctgcatagaattccatggtgtatatgtgccacattttctgaatccagtctatcactgatggacatttgggttggttccaagtctttgctattgtgaatagtgccgcaataaacatatgtgtgcatgt

SEQ ID NO: 62831 - DNA, 1073 bp, Homo sapiens
aaatagagggatggggtggaggaggaggaaagaggttctaggtaaaagtattagtggcagcaaaggcaaagaaacagggaagcttcggatgctcttcagaaacagtgggacaggtttccctggcaagagaccagggaagtaaaaagcagtggtgggaaataaagctgttgttacaggattcttcagttgcaggtaatagaaactgccttgagataccttgagcaataaaaatgctttataaggattcaagggcagagccaccatattggcacaactccagattgtgaatggtgctctcagagttatgtgtgtcagggcctcagatagggtgtcttgtggaacatgagggcaggaatgtagcaggccctcaagaagaactgggacgggagggttttcaggtcttgctgcatatcagtttctctttttcagccaactggttgggtcatataaacctgacaacacctacatttatatcttttcctctcttactttcaagataccagattgaactagaaccttaatcccccaaattcaaagtccaggatgagaacttgattggtatatgtagcaacttggttctgcatggtcctggttactctgtgtgtgtgcacgtgtgcgtgtctgtgtctgtgtgtgtgtctgtgtgatgtcagacatgagtaatgggggtccaccagtccaccatgatggagggggtggtagataagggtatttctgtaagttgagcaaagatcacaaaacatgtccattctggctggctgacttcctgcctctccccagaggtcctggtctacatggttgcgacaaggtcaggcctgtattaacctgggaacaactcaacctcaagattggatctctgcctggagacatggatttcctggccttaggagcaaatgaagggcttgaaatgaataagcaaagggatcggatatttgaggcaacagtatgaagtttaggatactttgatgtttagaacagtgttccccaaactgtgtgtgttcttcagtattcctgttgtgtcttgtaagatgctctacaaaaaatatatttgttagttgagaaaatagtgaaat

SEQ ID NO: 62832 - DNA, 1023 bp, Homo sapiens
atgtaattcttttctaggtctgtgtaatttttaatgagtacacagtatactgttgtacgtattatagtttatttaactgaccatacacttctcctgcttttttctactataaacaaagataaacacctaaatttctgtgtacttatctcctattcttgaataaagtcctaggagtgaaagaggtaaccagtcaagttggaaatggttagtagctgaacttttctggccacaaatggctatttggaggtagtatttaagaactgtgaacattagtgtttctggcagctttggtcttggtctggtggtggagtgatcaatttgaagacctaactgggagtggggcagaacgtagaaggcacttctctctgtggcccacttcgaactggacgttgaattgctgggggcaggctggttttgaaatttgctctcctgttgttgcagacggcagaatgcctccaaaggtgacttcagagctgcttcggcagctgagacaagccatgaggaactctgagtatgtgaccgaaccgatccaggcctacatcatcccatcgggagatgctcatcaggtactgcatggcaatgggcctctcctttcttttcagtcttttttccccagccctaatgtgtttgtaggattctaattgtcaacccacaaccagggccacaaccaagcccttccagggcttgctatggggatctgtgtccaataggtctcactgaatgcttgtggattggccctagcttccttgattccagtgacttagccatctttcaatgaagaattagtgggcaaattaagggacagaagttctggaactttctgttgctggcatactccacatctcctctgccacactgtgttcctagcagaattgtttgccctgtctctcttttgcccaatccaggagagttggagaggcagagacctcatgtgatagggttgatgggcggtagggtaaaaggattctaggatccactgtgaagtcattgagtcagcaagtgtttgagtgcttacactgtggt

SEQ ID NO: 62833 - DNA, 1949 bp, Homo sapiens
agtgaaaaatcttgtttgtgataaaggctgaaggtgtgggaacttatttctaaaagcagacctgtatatgcaagacttttaagtgagtcattctctgtaaggcatagtttgaaaatacctggcagtgtatgggctaatgtttcatcgtggactaggcctgttgctcttggcttcctactttgctgcatactttgcttagctcttggctgtttctaacatttctgaaaagtcataggatgtggaatgagcagatgtcataatacagcaccttgcaagagcctatctgtcactgaagattcattactgttcattgagactgaaaagatcatagatccaatgttgtgaatttgatttagccatctttgagtgagcatatgtatatgttaattgtagatacatggatacagagatgacatcatccctgccttccggagaagtggtatacacacctgtttacacaatttatcacattgcatttatggttagttgtgtgtctaactctaataacattaaacatttacatgacatttgttatgtgccaggtactgtttctaagtgccatatgtatagtaactcatttactccttatacaaattatgagggtcattagctacaactttcacttcctccatcttggctgccttttcaaccagtgccacctcaatggctaggacttatataattgcaccaactttgttctctccttagctccagctgctcactcattcaatcactttccatcacctgttttccttgtgggtacagctgcctcaaccaccagggcccactgtattcacttcagtggtagctgcctcactgcctcagccattgcctgttgctatcttcttcaccttcactgttgctgccactgccccttaccacatcctaactattggttatggtattgggacttctttcatcatgtctaatattgatgataaagaagtagctgcattgcacccagaacatgaatgtgatcggcctgaaggatgaggaagtaggaagagggaaagtgttgagtgttgatgggggtaggtagcattgtggaggggagtgtcagtgagactgataaagctgatgattctgtgggggtctgatatgccagtcaccaggggaaacgtgatgatgtgatggtggtagtgatgaagatcagaatgtgggaatgaggaggcaggttgtgatgaccaggaagcagaggatgtttttgaacagatccagtttgtttttgttggtttttagtttgcagttgaagattttgtgctcatgattggttgtgttaacgttattgatgaagttagtgactgataatattgatactacaatcagcactaaacacccagtcagtgccaccaaaatccttacgtcagaatgtacctgaatggaaggcagagtctataaagaaataaatgatcttgaaagaaagtatattagactcttatatttttgcattttaaaactcctgaagccaaggctgtactccagaccagttaagtcagatgtttcccggatagtcctaatgtgcagccagtgttgaagtcctgctcctaaagaaagcttcatttttgcttgactgtttttaagaatgataacttgctcagaaatatggtttgaaaacacaataaatctattctgaagctcctgaaagatatcagagtaaaatttttagatgctggcaagcttgggagatcacaatgggctttattttgaacccccagtggaggtgttgacatataaacttggatcagaccagatacttccgatccctttttctctgataggtgagaaattataggcccagtagattagacgaaaggatagctggatgtggtggtgtgtacctgtagtcccatttacttgggaagctgaggcgggaggatcacttgaacccaggagtccagcctggacaatgtagtaagaccccgtctcccctcagaaaaaaaaagaatgcc

SEQ ID NO: 62834 - DNA, 1030 bp, Homo sapiens
ctggttcctggacgcgtatgcccgcggaactgctgcactcggcctgagggggcggcggccgtcacagttcctggcccgcgggaaggccccgttcttggaggaagttggcccctcttcgtgtccggggaggtgggcgagcctttgccctcgcttctgttacccaggaatctaaacctcaagttacaatctcgacaatactgactcctgcaattcactctactgatctgtcaccgccacaaggatagacggtcgcgggcccctccctacccaaatggtttcagaggctgtgtaagggaatattttggtataatctccaggaaaatccccccagtagcctgccctgggctctccttgggcataggagggtgagacagataatttcccggcctcaagttaaacatgttttagtttattcccctgccataaccaggatgtacttatcagagcctctgacaaagtgggagacggagagaggtgttcagagttcatggaggccacaggccagactccctggccatccccaaggggtcacccacctgctaaccacttgagacatgaatgcactcactttgcagcatggccaggctttcttgctgaacacagaccatggctcctgcttgtgtttgtgagtaggggggtcccaaacctaccttgacctggatttgccgttgccacagcttgttaagggtgagcagaaaaccagacccaccctgtggaagtatgtgggaggggtggagaacttccatctggaaggagcttcctgtaagtgaagtgctggaaatggagtcaggcaagtggataatgatgagttaggctgtaggcctcaggtggtctttagggggccaaggtgatctgtgctagatttatagactcacagccttttaggagcagaagagtcttttctacaccagctggtagagtcttttttacctcaaaggaaagtccagtgaaaggctgagagaggggaagccattttccacaggcgcctcccctactggtagaatttgagtgccattccttgtaaaagtga

SEQ ID NO: 62835 - DNA, 1132 bp, Homo sapiens
taatttccttggcacatgtgctgttgcaattaacctggtagagtgttaaggaatttaacttagccaagaggctttgagggaggattatatgcaagtttggggaaggaattgataagattctggggtatgggactagctacatacacgtgcgtgcaagtttacgttaaattatgtagcattttagatttagcagtattaaatggttgcttttcttggaatggcttctgactacatagtgcagggtacgttcctaattttggctttagaagactcctagtgagagtgtttttaaagattgaaaaaataagagtacagtgcaatttgtcgttttcaagttaaatacttgactgttaaaaatatttgtgtaattaagttatgggaccaacccatttatagggttaagttacttaaccctataaataactggaacattataaatggagcatttgtagaaagtttttatatcgaagtctccattatattgtacttgcattataacttattttcctttgcttaaatggagcagattaactttatggaaggaggaccaggataaaataaaggcagctacatttaactcttcatctttctgaagagttcagtctgtgataacacttaaggtgcccagaagtgctggcatgttggtaatagtttttaaagaagaaacgggtgtatctattttgaatgttaaacataatttgaaggagttcttgagatagttggttatgagacattcaatgtattgctacattttacatatatgatatcaggaaatgtttggtgaacatttgacatagttgatcatatgacacttgggaaatattttgcatgatagaaggatagtattttcgtaatgtaagtttcaagcattgactgaaagggagaaaattacacactttgctgtctcacccctttcttcaatattatgctggcatgaatgtgaattctgcctaattatgtttaaagtgtagatctggcctttgtaaaaccagaatgtcttttgagaccaagagaacataacatcagcaacagcccaactcctacacacaatcctaaaacctagatacagggtggtgcccaacttctgaggttttgaggcttcctgaagtaggcctatcatgtctgagtgctt

SEQ ID NO: 62836 - DNA, 2173 bp, Homo sapiens
acattatcaatgaattagaaattcattgctttaaaaatacttgttttttgaaaaactagagctgcactaattttcatattagaatgtttgattttttttttttttttgagatggagtctcgctctgtcgcccaggctggagtgcagtggcctgatctcggctcactgcaagctccgcctcctgggttcatgccattctcctgcctcagcctcccaagcagctggaactacaagcacccaccaccatgctcggctaattttttatattttagtggagacagggttttaccatgttagcccggatggtctcgatctcctgacctcgtgatccgtccgcctcggcctcccaaagttctgggattacaggtgtgagccactgcgcctggcagaatgtttgattttttttttaagtggacatcaaatttattttcagttaaaaatgctgaaagtaatacatttttacttcatctgtcatagtgaatgttgataatgataaaatcttatttctctaagcactttgccatagctaaataccttagtaaaacatgcgatagacaagggtccggtcactagccacagaaaggctgtcactgttatagcagaatgtaatagggaaggaacattttatgcctcaataagaacagtgtatttgcttgagatagtaataacctctgagaagctgattaattggtaatcacttaagttagatgattttatattgtttgatgtcttataatctaaacgtccctgtgctcttttagagtgtctgccttgaccagtcagcatttcaggagggattgtgactgtcagttaagtgctttgaagagagaacccctgctttgtgtcacacctgaatgtaacaggacatacttcttggggctgtttaatttgggctcaaagggaagagtgccatctactgaatggccagcatcaagttgagcagctcctgttttccttacagaactcagccagttcctggagaaaccaggcccagcttcatttggaggatttgacaggatcttagtaccaagtggaattgttgcctgcttaattttaattatgcttcccagcaggaggcctaaacacatgatgaagaactaattcagtacttgttggaatgcatgggaaaagagaaacctgaagaagttgttgagccttatgttaaaaacagccgagtagtggtgaaattaaattaagtggtaaagaaaattattttaatgagagcagtctttcaatagcaggtctggttggttattgatggctcctgcagacaataatgatgttaaaatctgcttgggcttagaatcagcaaacaaatcatttgcctaactggaggtaagggttttaagaatacttgaatacttcgattgtttttttctcctgccctttttgtctcattttgtaaggcaatgattcctacttgagtgaattcactgtttcaaagtagattttgttgttgttttggtgtatggtagtggtttcctggtttttgtttgttttttctttccctattttccaaaaacttactgtggtagcagccatgggtagaactggaggtagtagaactagttacaggtcagtggaggtttaaggtatctggaataggcttgtcaaagccagacaagaaggaactttgaaaatatgaattgaaaggaagctttgaaattgttgctataaaaatacacttgattgttacatatttatatatattatatgtaattacttaattagtaatcatttttgttagcctttaaaacctgccaaggatcattttaagcacttcacataaattatccaaagtttagtgaagtaacttgcccaagatcgtaccgttaacaaagggcagagccaagatttgaggtcagggctaatacccttaagcactatgctatatactgctgatttatttatgtttatttttgttggtgactgcacagaagagttgaaccaagattagaatgatatttctgccttggctggaaaatactgatgctggggttcttggtttctgttgttgtttttaaggaagtggtaacatgggtaaatacgattgagaattcactagaatcaggacgtatacatgagatgaacttccaaatgttttctatttgattttgtctatgttaacttttgttccttctgctatatttaaaaccacaagaaaagtttactga

SEQ ID NO: 62837 - DNA, 1049 bp, Homo sapiens
tttaatgtatcttataaaaccttgaatttattttaactgctaaggacacttggtcctgaaggaaaccattttctctagggattgaacaactttattttaatcaaaatgtgaaaataaaaatagtgttgttactgccctttaaaaatggaacagtctggctgttcctcagagttaacgtggttaaaaatggtaacggtttacgatccagcacttctcataggtatatacccaagagaattgaaaatgtgttcccacaaaaaaattgtacactagtgaccatagcaacattattcataatagcccaaaaatggaaacaacccatatgcctatcaactgataaatggataaacaaatgcggtatccatgcagtgggatattatgcagtcataaaaaggaatgaattactgatgcattttatattataaatgaaccttgaaaacatgctaagtaaaaaagccagatacacaaggccacatattatatggttccacttacatgaaatgtctagaatagacatttatagagacagaagggagattagtggttgtcaggagctgcagggagggggaaatggggagtggcagcttaatgggtactgggtttccttttgaaaaggaaagatgatgaaaaagttctggagctagatagtggtgatggttgtgcaacattgcgaatatactgaaaaccactgaaatgtacaattattagtaaattttatggtatatgaattatgtctcaagtttttaaaaataccaggaaaaaaaatctgtgcgtgcaaattcagatgtatggaagaataactaaaataacttatgtggaccttatttctaaaacagaactgttttcccagtagaaagttggatgaaacaagaattaccgcactcaacctggtttagcctgctttgcttaaagaggctaggttaagatgcttttcttgtccaggtagaaatcaggaggtggtttgtgatacttgataactcaggggtgagtctaattttttttttaacacttgattttgtcagggatgatctagagaagctgaagaagcc

SEQ ID NO: 62838 - DNA, 1053 bp, Homo sapiens
catttagaacataaggttttagaatatgatttatgagaatgcataaatcagtctaattgacatatgtattacctcaatacttttttttttttgtgataacatttaaagtttcccctcttagcaacttcaaagagatttaatcttattggcagccagttgaacggtatagatcaagcctatgactttctcacctggaaaatcagtcacaaaaaatgtttcagatgccttcaggaagagatacaagaagagtctcctttgctaaatgccaggaatatcaaatcttggacttcagagactggccatataaggaaagagatttttatagacaaagagggttgaagtaaaataatgggatagaataagcatattaagctggataagtgttatgtaatcctaggtcatctcttaatggccatgtccttgacattgttgcattaagaatgagagctcggagaaatagtccatgtgttggcatgctagtctctaagttagaatagatgtgatcacaaatcatgagtgctcttaaagggtggatcctgcattcactcatccacttctgccttcattcaggctcaagcaagtggtggtgactttggaaagataaggagagaaaaggaaggacaaaaaaggaaaaagggagtaaaaccagactggggaagtgggcagcagggatacttgggcaaattcagagtgcatagtatttgtacatgtacatgcatattgtatttataatactaagagctatgtaaactgtaaaatactatttcaggaaagagtatagtatgctagaaagagaatttctgactaggtggtgtggattcagctttctcagctctaccattaccctaagtgtgtaaccttatgaaagtgttagaatctgaaataatcgctattctattaatacttctctggctttccttcctgattaagatcatgctaagtttgaaaacactttgtgcgtgctcatatgctgtatacatgttgttattgtttttatactgttaattatttctcttcatctaaagtattgcctaccagaaactttatcgagag

SEQ ID NO: 62839 - DNA, 1644 bp, Homo sapiens
aagtgctggtttgaaatttacttgggatccatccagctggcagatcagctgtgctaatcagatgggcccgtttctggggaatgggatttcatagagggagcagtgttcttgaagtatagttacttaaaaaccagttaatttttaatttaaaaattctcataagtgctatattaaaatgtatatagtgcaagtattatgtatatagtgcaaatactttgtgcattcttgtaaataataaatagggacaataaagtcattgtgctatactcagctgcctttaatttctattttgaatctctgggaccgtaatttgctagttgcctgcagtgtttattaggattaactcatctgcatttcccactaatgtagatcattagttctaagagatttctcaggataaatagtgccaaatatgtttgggaaactactttctgtaccatctcttaaaggtttatattgtaccttagcatagcaaagactgagaagtacagcaattaagtacagggtttgctttgttttgttaaaactcagtgtgtctcaagtatgtcactagaccacagaaatcagtctctagttccatcccgtggagctcctgtttcttagaacactcttagggaaaacactgcccttaagttatgagttaacaaatctctagagtttatttttttgattacattttggaactactacaattaaaatttgtagttacaaatatctcagcctaggggatataatgcttttgttttaaaaatcagtattcataaggtcattttacatagaaatgttaatttctatggggtatgtctttgaattgatattgacatatatcttgggacattttggtattttgtaaatataattttccttttgtttcaaaaaattacattttttgataaacaagataatttctttagcaagtattttataatttaaaattatattttttcattaataaaataaaatataattattttaaattcaactgtaagataaatgttttagtagcaattaaactagtctgtaattctcatttgagctgaaaggaaaaccaaagatttcaatagtccaagatactgccatgtaatcagttattaaatggggctttgagactctcaacctagacaatcatactctaaagataagcaaattacttacgtataccagtctactgtttatattctctaatctgaatataaagggttttaaacatttctttgctttccatgaattccttaaaaatgacatctgagaatgttttttaaaaaatgttatatctaaatgtggatcttgaatcatccccaggttgtaaaacaggaaagttgtgtcgttttgtgagtaataggaaatactaagtatagacaagcttctaagtgtaagccaatgcatacattaagtaaattaaaccaaaaaagattaaccagccatgtttcaggttttggaacatgtaatgtataaatgtaacctactagaaaaatagttctttgccattaaccctcaaaccaaatcatgagacaattttttcagttgcatttggaagaccatgtttgttagctttggcttaccatttgctgaataaataaaaatggcatgtttaatgctaagtagtatttataaccagaccatcaaacaccaagtggaattctg

SEQ ID NO: 62840 - DNA, 2062 bp, Homo sapiens
ataagccactcagctacttgttgctattacccttaatttcagaaatattacacgtggtacttcttgaacgttaatttgctgagaaataagcatgttttgggatgagtactgagttcagtgttccatatttggcagttgataaaaaaatatgggttgctgagtttcacagcataagttatttggcaatggtattatctcagattcagcttttaatgaatatttacaatattaatatcttatttttccttgatttttttttctaagaaaagcccagattaaaacaaaaatggataaagtataagtgagtaactatggcagctcaattgtctaagaacaaagaggcaggcatcagagtctttgattcctgtcctaactcagcaacttagtaactctgtgtccttgagtaaatcccttaacttgtctaagccacaaaatggatcttagtctatgtattggagctatgatttttaaaagttgttttgagcataaaatgaaatgaaggatgtaaaagtgcattataaacttgaagacactatgctgatagagattacacagctccttctaatcaagactttcttggcatagtttattaaatgacataaagctcattatacaaattttctcaatggaataagacagtaacggtcaaatgaaacataaatccatgctaacgactatgaaatcttttggcctagctaaatgtgcagactatataatccctttggtagcatatgtatgagtttgtgacctgaaggctgttgtattgcaagcagatttttataagtcagcaaagacatctgaaatcacatcacaattccagtgttaatgagataactagctgcatcactgctacccttccttggctcttgggtttagggaaaaccttaatcctcaaactaacataattcacaataggttctgatgatgctcaaatgtatataatctttagttccatgaataaattgcatactagagttactcactttcattttgcatttgcagactttgtgttcttacattgaatgatatgttttctaatcaactgattcctttaatgattaattttaggcttaaacataatatttacaaaagcaggaaagtgcaattgaaaactagcaaagactaagacaattagtatcaaccccattttatattgggaattaaaactgttttgaagatgacagcacagccgaagtaagggttttttctccttatcacaaacagtagtaggcattaatttttagaagtagaaaatacctttccttatgcttgggaaataaatggaattttttacaaaataattacaggacttggagtagaaagtgaaaaattaattttgtggtttagagtattaatttgctctaagagttaataaaaggaaatgggaaatggacaaatcagatttgtctagtcaacactgaatagattcctcaaagtattgaatttgaaacaattggcacacatttaaattctaagatctctatagcgagtaaaacttgaagttactttttatctcaccttcctcaaaagtacccttaaccatgcacctggagcaaaggaaaaaccctttctttttattggtcttctttagctatcacagggactatttgggcagtggctatactaatgggaagatgggattataattaggttagttttcgttctttctagacccatgtctttatttgaaagttctttggattcctgtggtcagtgatacagggaaactctaggttcttaacagtttccaattattttctcaagaattccttaggttgcaaaatattttgatgcctttatggataagagatgggctggggttagtgacccagtgcattttttcatacccccaattctccccatatcaaccctttctctacccgactctgcacttctctaattgggtattatgtgacaactaactcttctctgcattgaatatattatattgttacttatccaaaaatagttgccagtaatttttcctagtagttctggaaaattcctcttccttaaagatgcaggaaaacagttttactgaccaagaggtgttttttcaaag

SEQ ID NO: 62841 - DNA, 1022 bp, Homo sapiens
tgatttagttattttctcctttatctcctgaagattttttttttttttggcttgccatatgcatgctattttgcttttcctttgtactttgggtttttgtggtgtattttttgaggagggagatttcttttgcaaataaaggcagcactctgtctctccttttttcaggaaacacctttttttctgtgtgatgcagtcagtttttgtcatttccactttaacgtgaactaagaagtcatccttttcctgtgaacaggaaatttcccagctgttgataaactgtggagccgcctgtgaaaaagggcaagatctcagaattccttctctcgattctacatgttctttattgctttctacatattgctgatcttttcatttctaatgtgtaccatctgattgacgagatggtgacttcctgtttgagagttagctccattctttgtgtatcatacccacggtgatagtactttgtgaggactgtggcaacagtgctgtgctctcctctgatgtaaagggtaagctgggaaatcaagacattgaaaggagtattaatttgaaaataattctatagcattttcttggggaaaaaatgctcaccacctcctctcttttctaaacacaccatttgaggatatcactatttcctttgtattgagccttttatgtatgttgaactatcatttggaatatgatctgctgatgtacctgggcacctctaatcagcatctaagtatctagctcatgattcttttcagtatcacaaatccattctaaagtggaactgtaggaaggatctgtcatattactgttaaattatcattggttgcaaaagttttcccagtgcctacaacactgtcttccttctttccttgactctcatcttttaaaattatagtttataagtgacatttaatttataaatcacttaaaaattacattagatccattgtgaagtgctctcttttcacctccattaccttgggcctgggttaggtgccttgtctgttagctgacacaggatc

SEQ ID NO: 62842 - DNA, 1049 bp, Homo sapiens
aagctacacttggttgctctgttctgactgtgttaagaacacgggtctaggtgcactgattggtttctggtttagcaagcacaccttgacttttgtattatggtgaaagcaaatgcttgttaactgtatagtgccttttaaaaaaattcctgtaggaagatattaatgcttagaaaaatcagtagatttgattaataaatcatctataaaaaacctgaaatatttttcaactttcatttcctagagtgtagtaaaggcagtaactgttaaacgtgaaatcaaataaagtaatttgcacctggaagaaagcctttctaaaattatttctgtagtttctagccacatgattgaaaaatacaataaatgtatattatgttattacttctcatttgcagtttttataaactttaaagcaacttcagaggtgctaacttgggccttctttcttccctccacctcccctttttatttaaagcatcatatcatttattatattggaccagcaggaatgagtttaaagaggttgagaactgtttcagattaataacttggaaatatcccacaggagtcacagtattgcttatcttggattaagttttaagaatccagtcattgagaattatttctataagctgccatatttaaagttggagtgaggaagaaccttacactgatccacataccccaaaattcgtgtcagtgtactttatggggatcttgtagtttgaaggatggcatggtccacaagataaaaagcttcatcatgacagtcaataagtaatgttctgggtttacatagagtttatatttctttcctcaaggttctcagtttttcattttcatgtataaggtatacatcgcttttctaaaacaccaacaatgctagattatttttgctttgatttgctttgtttttttcatattcctttgaatgatttagttattacttctctttgtttaatattttttaaagggataactatttatcctaactttctctatactggaaaaacaccccctttccttcccccatttacaggattgtgcaa

SEQ ID NO: 62843 - DNA, 1088 bp, Homo sapiens
ttgcttatacttgatgcttttaaggatttgagctcatagggtgtagtataatgtagtgccaccttgaccatgaaatttgtttactgaccttagtattaacctagaacattcttatgcctcttttcatggtgatgtggtgtcagattacaatttgactggctttcaagataattggtcttaattatttctaagtcattggttaatgcagtgtaagaacaagcattgtttaaaaaagaatataaatggcttttgagtttcttttcttagcatgcaagtcagattagagtgaaagcaaaagcacatgacacaaaactgtggttcgctaatagattgtaggcttcctgtagcttaaattatacacaccacagtaaactgttacccagtggcaattttgatttcccttttgtattagttgtaatctgtgatacttttatttaaagtaaagccatgtattaaaagtttattaaaacatatattgtctttttttaatctttttcctcttcaccccatacatatatactcattccttttagaccaagctccagggtaacttgccctgtaacctttcaaataggctcctttctctgaatatatctgtagtatatctgtagtatatctattataataacagagtgtgctacaattgtctctccctctcccctgccccaacccactaaattgctagtattttagggtcagagacaatgtctcgttcatttcttacattttttaccatgatacctgttcacttgtagcatgtaatagtaggggaatgaatagttagtagaataaatgtatttaagaaaaaagtagaaaagaaatatatggtgaattgatttaccaactcagaatttaaatataaatttaaaaaatctaaaatcaaagtaggttatgtgatcagtactgctgtaggttgcagagaataaattgatactctacactttagttatgtttgggagcagtatgtatgattctgtaaactgaaatccctctaatatgtacagaagaaatacatttacagactagttttgtttttgttttcgttacaccttctatcatgccactgagtatatagcaaatctatcaac

SEQ ID NO: 62844 - DNA, 1183 bp, Homo sapiens
ccttgctctaaccacattgagtgtggatatcttgctctttaaaacaaagttcattgttagggcagtattgcaacagaattgccacacaaaaaccagcttaagaaatgtacagcacttcaatttttttgtaagtaatggattgtctattgtaatactgattgctcacagcttaaggggaaacacagataagatagatggttaagctttgtgccagctgctagtaacatgcaatattcttctttgggaggagcctctggctttatcactccactaagttttttttcttttagttcacttgtctgcttttttttttctttctctttcttaaacagtttactgaattgttatttttaacgattttggggatgacactgactgttcaaatgaaggcaaatagtattctcccaaatgtgctagttatttaacttgaaaatgcttgaagcagtgttttgtactgaatttattggacccattaatagcataatctggcaatactgtatttcgagacatcgtgacatgaactttgtgtgtaagagtgggttcattgaattaaaaaaaaggcagcttctaaagagccttttatttctgtcataatgatgctttgtcctgttgctgttgggtatttgtcagaagagttggggcaggctgcagcccaaagttctgttccatgcctcatcagttccgtgcttctgtgttctttctagagtttgtgacgtgaatggtgagttgaactataggagaattattgttgttcattgaggtccatgttcagcaattttttttttcgcaactgggggtctgtctgatcttttttccccctcacacactgagtttctctttgtacctgagttttaaatgcctttggagtgtttaattattcactgactgaagtgggcatgtagagagagagaggctgtgctttgtgttatctatactctctggtgtgtggtcatgtgtacactttgggtagacactcatttggtgcaagcaaactgaataactgcctctgttgaaatcaaatctgaatgttgaaaatggctaatttctgtaaggcttgcaggggtgacattgtgtcatcctttttgaactaagacttcttagcatctccttgcttcagcttcctcctttttacttggtagtaattggatttagctgacttctaacttcataaggatgtaagaat

SEQ ID NO: 62845 - DNA, 1292 bp, Homo sapiens
ctaaatagacactatagaactaagctgtgagtctagtctttgtgagcctcagaaaaacaagagtcctacttcaagctggaatttaaaatatagcaagcaatttcagtggaccttttaggcatgtgtgagtgggcacaaaaagctgagtcatgaagtttactcttcctggtgaattaccatgaaagcttgaaagaaaagcactctcattattttaaaatagtaaaaattgttttagattcttatggaaataacaccaacaaaatgttttgtatattaatcatgagcacatacctagaaaccctttaaaatcaagaaattgtaacatgaggcattacctggctttttagagataaaagttaacagtttatttaatgtacagtagcacctgaaatgtgcttaaaattgtgcttaccaaaatctttagttaaataaatttctaagtgcagttcatgttttaaatttttcttatatgaacagatcatatggtctacagtcttatgtatctcattctaatgtagataaagtgaaaagtattgggtaagataaattgagggacttgggacacgtcactctctctctcaggatctgttctacctttctccatatgagaaatgaggtagaataagatttgataatatcttacatccttttaagctctaacatctttaaattctaaggatagtattcctcttttggctctcattaggtaatatcagggaaaacaactcctcttgttggaagagttcttatttatatttacaaagcaatgttgtttctctacaatcctaacaaacgtatgaaagttattctttgttgttttaaagtctgcatttctgttgtttttgataaactttcctccataaattaaatagttaattagtttaatgttttctctttttcctgaatttgatattagacttctcaggtctttttccagattttctcactttttattgagagttcagtttccagcagtggactggagacttgggttgttgtctctttatcttctcattatttccagtttcttcatgttagaaataattttaattcccccccattttttgatatgaattagtttggtgtcataaaatatcaatgtatacatacatttttagaattcttgttcatatcaactaggcctacttttcaaagctaaatcctgttttatcaggaaagagcctagacctctttaaatgcacccacaagcttgcatggcagttaatgtccaacacagttcaaaatgaaataatggggcatatataatctggagaccaggatctagagaactt

SEQ ID NO: 62846 - DNA, 1034 bp, Homo sapiens
ttgagtcaatttagtggtccgtaccttgcatgtagttcctttttgtttggaactcaaagttgtgtggaatgttccatgacattttattataccatttatctgcctgctcattgagcttcttcatctgcccatctcctaatactctttgtctttatgcatcttatttatatgttttgctaagtactgatggcaaagatactaagtgtctttatggtgtgtgggtgtgtgtgtgtatgtatgaaaaatatatagttatgtgaatgtggtctttccctgtatctcaaaatcttattgtactatattcgcctatttttgaacagtggttgaccacaggtaactgaaactgcagttaaggaggggaactactgtattgataaaatgttagtgagtactttttaatatttaatgatgtacttaaaacttgtccctttggtatttaggtcaaataaaccaccattatacaactaccccacttgtacatctatttttctgtgcatgctaggcaaacggaccattaagtctattacaagcactagaattttagttcttcttaatagcctgttcctctcagtggatggtatttataaaatacatccataaacatggcgtgatgggtctgttttctttcttatatttcattgaaggagtaaattttgattatggggcaatctggatgacatggtaatgctaataaacatcattattatgattttataatatgatatttgagcaatgtaactttagaaaagtcactcaacaccactgagtatagtttcctctcatctgtaaaaagtgatcattgaatctagtctgaaatatttcaagagaagctcatataaaatcaatagccttttaggaataagagcctagtgctttgtgggataattaagtttttctccatttgtgcacttagtgccatctgtattactcagtgctgctcaatgccaggttcatttgggttttttctcccatttttcttcatttttatctatttctgcttcaagttttcagatctgtcaatttccatgtcagtt

SEQ ID NO: 62847 - DNA, 1033 bp, Homo sapiens
atcaatgaaaatgacccagaatacattagggagaggaacatgtctcctgatctacgacaagacttcaacatgatggagcagaggaaacgagttactcagatcctgcaaagtcctgtgagttgaattagaaggctgtaatttttctccctctttggaaatgttagtataataaggtagaagttttctcaaactaccctcaggttaaaagaggggtggaggaggagtggtgaccagttgcttccagtctttcaaaggagaaatggacatctaatttgtgtatttgatttgcagagccttaatgacaacctagtattgtgtttggtggtttaaattttgtgtgttttctgggtatagcactttattaaaggaggatacccaattcagactgaatatgtaaagaaaagaaaggcatgactcaagtcataggaaccaataaataagttaggtatatcccatgcacgtattttcttcttcctttgggtaccttgacgctcagagtggcatgagaagacttaaggtttttgaggaagtctgtgatttggcagcctagtattacatatgtctactgcaagcacacgtgactacacactaaattaactaaattaaaagtagattataggccaggctcagtggctcacagtgtaatcccagcactttgggaagccgaggcaggaggctcacttgagcacaggagtttgaaaccagcctaggcagcatagtgaatccttgtctctacaaaaaaatttaaaaattaactgggtgtggtggtgtgcacatgtagtcccatctactcctgggaggctgaggcaggaggatcacttgagcccagaaggtcaagactgctgtgagccgtgatcatgccactgcattccagcctgggcaacagagtgagaccttacctaaaaaaaaaaaaaaaaaaattcaactcaagtggaaaaatcctgtctgcacagcaatagtcagactttgtgaatcatattcaaatgatctgttttcttacaaaatcttagtggaaatgtattaatacatgatg

SEQ ID NO: 62848 - DNA, 1091 bp, Homo sapiens
cagggatttctcattcaagtaatagactgataagactgttttctagctaataacctatgaaatggatatttgctacgttaactgggtcaagattgagatcagattcttcactttctttatatctaggaaaatgaaaagaaactcttaacttagtattaattgagcactgaactacacactcagggagaatctagaaatgtgaaagacacagtttcagtcctcagataatatggtatagtagagcaggaaaatagttaaacaatcacagtcatacactaggtaccctaagtatagtatagggaaagttcacagtgaagtgtagaagagaagaaatacagagatccctcctaacttggatgattaggtgacttcaaggagaaggtagcatttgtaatgtgttgaataaaggaaagaattcattaggaagaagaacagtggaagtcaatacttccattggatgaagtagatcgagcagggctagagaagtgcaagttgtgatcagagaatgctgcaagaacctcataggctaaagcatgaggtagtaatggcagataaagcaaaaaaaattacatagcagcagactatggaaattttgcagtaccaagccattttgacctaagttaggagtcagtacattttctcatcattgcccattttgtttacacaattttttataaaagtgtttgttttggatctgggttcacattttactttgcctaccacttactagctatgtgacattacgaagctcgtttaacttgagcttcagtttccttgttggtaaaatggggaaaatacctcacacggttgtgacaattaaataaaataacataagagcatgcagtacagcacgcagcacgtagtcggcaactgttttttggaaattatatatttattgctaatttgaagtacattatgcttttgtggcaacacttgaagattttaattccttagactgtattttggttttttaaggtcttgaatctgttaccctgatggcattctggtttattcatcttcacaaaatttaacaactaccactacctcctcttctatgctcttctgtatctgagaaagaagacatagtttat

SEQ ID NO: 62849 - DNA, 1049 bp, Homo sapiens
ttagccgggcatggtggtacacgcctgtagtcctagctactctggtggctgaggcaggagaatcgcttgaacctgggaggcagaggttgcagtgagctgagatcgcaccactgcactgcagcctgggcgacagagagagactccgtctcaaaaaaaaaaaaacagaaaaagaaaaaaaacaatctgaatgctactattttatagtaaaatcttctagaaagtgagattcccagatgagtaaagaattactagccaaagtagatgtagataaattaatggatttaaacatttcataattatgtggctttttaactctcttaattttaaataattacagattcataagtatgtagttttgatgctttgtaaaatctctatttctggttatctcaaggtgccaacattgtcacttcaaaatttaaaactaactgctaaaattttgatgtgactttccttaagcacacggacactctagtaggttgagttttctggctttggaacccttagtaagtagattgttaggattatatttaagacttgttaatgaaaacatcttaaacaattgactactagctccctttttctctggaataagagattcttcctagcaggagttctctatcttgagtctttggataagcttcaggcagtccatgagccacctgaaaaatacatgctttattgtttaaggtacacatttagggagggaagggttcagggtcaggaacaagcctgtcacccaaaaagagggtaaggagcctctgctttagagcatccacaacatacagttgaaattttcatgcaaagcaaaataagccaatagttaatgaatttttgtccatgttagatatcatttaggaagaactaatgacatcttgatcatccaaggaacagttttttgtgcctttgtcacaaaagggagttgtcctgattcattaatgtaattatactaaattttctaaatggtgttattgaatttgtttattctaacataaagttgggagctttctctgtttttcatattttgtaaaatatccctctttaatctc

SEQ ID NO: 62850 - DNA, 1023 bp, Homo sapiens
gccttattacattgctaaaacatttcagttttgtaaagtagagcaaaaatgttaagtatgtaaaataacccccaaaaaaccctcccctttcgtagaaaaccatgagctgttttccaagagcttcatctccatggaagtgcctgtcatggtagtaaatggcaaggatgatatgcatgatgttgaagatgagcttgctaagcgagtgagtaggttaagcacaagtacaaccatagaaaacatcgagattactattaagtctccagagaaaatcgaagaagtcctgtcacctgaaggctccccttcaaaatcgccatccaagaaaaagaagaaattccgcactccttcttttctgaaaaagaacaaaaaaaaggagaaagttgaggcctaaataaagtctttttataattattattataacaatgtgacattgcacatctaaataccacatttaagttgatcattaatatgcaatggtagatcagattgggggatgtagcaaactggactttaagaactggaaagaggttttacaaaagaaaaactttcagattcatctctcattttatatgtccagaaatggctttgaattttaagcaattactagttttaattagctctgccctcatgaagtattattataattcaccataaacagctatctgtctgaattacttcaggccttctccataatatctgttagaaagaaattgccagtgagcaagtgagaatttttatttctcaatacctgcttcacttgataatcatattataattttttatcatgattattgactatatttttggagtcccattgtttcagtgggcattaacagaatgctttaaaaacttctaagacaagaatctatagcattagtatacactggcacataattttttaaaaagttttaagaaaagattcatttggaattttattcacagtataaaatttcctcacctgaagtaactttgtttgccaaaaaagttgttttaataaactataatttttgaaaacttcctttttta

SEQ ID NO: 62851 - DNA, 1223 bp, Homo sapiens
tcttaaactgtatttttctcttagtattgctaatgagtaaagaaaagtctcataaggtagccaaatgaaaaagaatgaaagggaaagtgaaaaattaaggggacaaaagatgggatgtgaaaagaagaattctagtttgatggtgactcatattcacgataggatacaaagtgtgatttgttggaaacatgtcccaaatttctaaaattctgcttctctgccaaaagcaatgtctttcttggttgatatttgagttttaaaagggtcaaatctttctaattttttgtatctttagagggcagcactagaagaaatcagcaggtctaatcccaccagtaagaaaactaccacttcttgatttttacagatttaaaaaaatcttttcagtgacctttctttttaatgtaaatacaaatttaaacctaggcttaatataggcgtttcccctttcacccaagtgatgtcacagttcgatgcaaaatcaatgatccagaatgatcgtgggtaaaaataactcaaagtgtttcttaagggtgagttggcatgcaaaaaattacattgattacagtgtgttttggagctggctctgtttgtgtgcatatgataatgcagagttgagccagagcctggaaatgtcattctagatctcactaactactggaatcagtgttttaatctcttggtggaaactttcagttgcttaactctctattggaagatttttttaatgttctacatcatttatgttgtattacaatgtatgtagaaatagtaacctgtgaactatgcttttccataactttttaaaaatatatatatctaaatgaatgcaatgtgcataaatattttttaaacataacagtgaactattgcaccttttgctaatgcctctatttacttgctttggcataaagaatgagccaatgaacctctgtgtcctgtggaaaaatgtataaatgttatctgatattgctcttagatgtaatgctaattaatgttaaatcacaaataaacagtattttaaatatacggacttgtatcatgaggtttccattcacaggtggttacttagcctattcatggtctgttgagttttatacttcagtgaaacttggtaagttattgatgcttctgaataaagaatgtcctgataaatatattttcaaattagttgaaaattatatatatatacaaaacctgtcttttttcagcttatgttagag

SEQ ID NO: 62852 - DNA, 1025 bp, Homo sapiens
gggattttgataaaaacagtcttgtttgtggccactagagggagtaatagatctaacaatccaatgtttccattccttgcactgaacttccctatttagtctgtaggcaccatgtttgttgtgaaatacccagaacttgaaagagaaggcatttcctttgttgtttattctcctcagtagatcgttctcgactttgtttccttagcaggtctcattacagatatcacccacagtggagaacacatagaaagttgtggtgtgctctcagaggctgtgataggatatgacacctcagagttttcatacctgtgagtgacaagacaatgccttcttcaataattgacttttttttttcttttttactaaggagctaaccgataatattttttgttgatgccttctgtgtaccaaacgttaggctaaatgcttttcatatatgacttcatttggccttcccagtatcccaacaaagtagatgatattattcccattttgtagataatgaaactaaggcttgtagaagatgaaaagtaggtggtaggattccacccatagagattcagacttctataattactcatgccatctgtgtgccagaccctgtgtggctgcagtacatttccatggtttttaggaagaggcagttatcttagtttggactgtaagtcaagccacggtgaacttgtattttgatataagtagatttgggatcaaacattgacttttgatttggaagacttttttccctaacaaatcacctcaagaatgaagaaattggtggatacctgagaagcaggaatgacctgtggtgatagcaacctttaggataaagaaccagctcctaaatcttacaccatgacacctggaagacaagttatcatacttttgcttaagatgcagcagagacttgagaagaagccctttttctttttcttttcttcttgatttccattattggaaacagaagaaacattctaaggaaaatgtttttaaaaccagaaaaggtagcttaatctagttacaga

SEQ ID NO: 62853 - DNA, 1065 bp, Homo sapiens
aaggagttgtttggcctataattatgtctttatgtacacagaggctggttaattactgagaaggcgatggatgcgttgccatcgaaacctacccaccttgcattgggatgggatgctcttccctctgtcatggaccattttggctctcttgggttccttagccttgctcttcctgcctcatctattccccactcaccagccttttctgcctaaatccgtcactcgtccaccctctagtttctccttggaccttgccaaaatgtcctagtcagattctttcttactctttgccctgtgatctttgtactcagacttggcaaacaccatgaagagctcttctgtcccctcccttgtcacttgagtcctaattctcagagctttcccagccacagttttcctgggtacctttcccttttggaaaggaatcatctggcagtgagatgaggaactggctcacagctccttctccttgggggcctgactcttgctttcatttgttagaaaggagtggccctgtagaaggcccaagaatagagggttaggaactgtaagacacaagcagaatggtaggaacaaggagaactgtgagactctgcctctcccatggcctaaaagtgctgaccaggcctcctctaaccactgcccataccacccaccaccacccacacactcaccagtgggtatagacatgggcaggggataagtagcctccgccctacagtggagttcactgggtgtcacctgctcctggaggcattatctcagctctcctggactctgccctcctttctcccagaactgtgagtctggcagcctcttcctggttcagcagactcctgggcttctcctgtccaacacccagtacttagagggcttattagactatgagctcatcaagggcaggaagcacaccttgctcctcctagcatccccaggccctggcacctagcacatgcatggcataatactggggcttaggtcacgagtcaaaggcatgaatgcccttccctgcctggtcagagcctcggtgccggccgttcatggcttctcgttccagtggtgaga

SEQ ID NO: 62854 - DNA, 1074 bp, Homo sapiens
ttccgaagatttggagacgagtcagaaatactgatctccaactcccttgggtggtgagaccaatccctgcaagaagatgatagttcagacctgaagagctgagactgcatcctgtgaacagctgtgaccctgagaaacaaataagaaagaaggagactagagtgacttctgctgaaatcgagggctttgatggcaactaatgttcaagctggtcacgtttttgcatggcagcaatcttatgaattcatacattcttcaaatgtacattgaatgtctactatgtgcagatgcttctttctgaaaactctgtaggttgaagtatggtgggggtggagtagggtatttgtctttagtggagttatgtgaagagcattcttaaatcaggccctatttcctctgcatcccaaattatgttccccagattcaacttattttttccagttttaaatatgatctctgctgactggtaaataccagaagaaggcttttttgaggatattgttacggctttcagaatcacggagctcccaaggactgtgtgtcctggaaaggagatccagggaaaggggacagggccttggaagttagagaagttgaattgagccattcctggtttgggagcaaaaaggaggctccattagctaccaaggcaaaacagtagctgctcatccatctctcatctctgatggaaacagtctcccactgacacatccagaaatggggattcatctggagatgcctgggcaaaagtctagaggtgaaactgaggaaaatgaagagggtgctggcgtgcagcagcagcaactaattgtatggcataatatcaataatggctacaatttattgaacactgactatattccaagtatggggctatgcattcattatctcccctgatcttcacaacaaccttctgatggatgcaattttattaccctcttttacggaggagggaactgaggagcagggatgccaggtaatttgcccaaaggatatatagctagtaagtcgcggagctgagttttgaacttaggcctctgattccagagcctgtgctcttaaccatatacacat

SEQ ID NO: 62855 - DNA, 1072 bp, Homo sapiens
tcgagagagaaaatgtctttctaagacttgttcgaagtacacaaaaatattgggcttaaagagactctttagaacagagagagttgaaagtaaaggggaatttttgaggcaagcgaagtcaatgaggtgaatggtaactggtcacaaaatttttgttctaaagcatctgaaatctcaagttcttgggagagaaggattttggaaaggggggataaactctttggtttagaggaggtatcaaaacaccttccagctggtggggtgtcacaggattgatgtccaggcgagggacattaattttctaaccaaaaagagtggaaacattttacctcttttcctgctttcaaaaacctgttactgcaaagacctcggatttgtgggtcaatggatttgggtactatattcttcttaccgtatctttttttcttgctttcttcagagtgtgaacatggctacgcctcttcattcccgtccatgccgagcccccgactgcagcattcaaagcccccacggaggttgagccgggcacagaaacacagcagcgggagcagcaacaccagcactgccaacaggtagcaagctgggaacgcttagaagagggaactggagggaaggagcacatttctcctgtaatcccaagtctgaaggagcagcacttgatgggttcctttaccactaccctggggatttggcccttttaaaataatgaagtctagaaatcataacctggttttgcatggaaggaaaggaatataatctggaaagacaaccaaagaagttcttgctgggattattaagatggctatgccaagttgagagacttggcagcatgtgtccatgcatgcagccacctgctaaaagtaatcgtgggctggctttcaatattctggccaagttttggacagtccaagaagattaaaaaaaaaatcagaaataggtctggcagggtataaagcagaatcaagggtttgttaaaggaataaaaatatttaggtagaattggtagtgagcggatgtggttatttgtttaaggagaaaagggaagaccatgctgtgaaagttttgcctcttt

SEQ ID NO: 62856 - DNA, 1032 bp, Homo sapiens
ggaggcggaggttgcagtgagctgagattgcatcactgcattccagcctgggcaacagagtgataatccaccccccccccctcaaaaaagtaactttataaatttatgctgaaagtagttaactcctaatattataaattcctattcccctttcccccattccttaaaatcttattttcaaagaagtaaaaaggagagaaaataaatgatataatgtgatattacaaatatgttccttgcaaataccagtaattttatcatttgggatccttctgatagttggaagtggcacctataatatataattaaaataaatgcttgattttactgtggtcttggtcacagccttctggcacacttccaaaaatcaacattgctaagatgttactgctgttagagaatgtggctgcaatagctatctggctttttggggagcatcagataagttcaaattccagcttctttactatttggtaccacaggtgaaaaatctcaaggtctgtcatccttaaaactctactaaataagccatgactgcagtgtaacactgatttcttcctaaatatctcttcagtcggccttctttcctgttaccttcattactatcctcctaatctcagctaccatcatctcttacttggacgactgcagtaacttcctacctggtgtccctgcaactacagtttttttttttgtctggttctgttgcccaggctggagtgcagtggcgcgatctcagctcgctgcaagctctgccttctgggttcacgccattctcctgcctcagcctcccgagtagctaggactacaggtgcctgccaccatgcccggctaattttttgtatttttagtagagacagggtttcactgtgttagccaggatggtctcaatctcctgacctcatgaaccgcccggcttggcctcccaaagtgctgggattacaggtgtgacccaccgcacttggccagttcttatgaattacattggccagccttcttttgattccttcagtacgcgttttcttctacctc

SEQ ID NO: 62857 - DNA, 1876 bp, Homo sapiens
cattattggaagggcttggttggacacatacctcagagaagcaaaggggttgtttctgaatgtgctagtgtgtgatacatttaattacttgtttatcgcctgtactgtttggattactttctctgtgtacgtataattaggcatctctctctgtaatatactcctaaaccttgtactgtcctcacagctgactaaatgataaagtagcttcagtcacctatcttttctttcagtttctctttccatcattatggttgttgtttgcttatttccaggctaattcaaagtgttattgagaacctatcaatttgttgtcccatgtagtatagttaataacgttttgggtaacataattttagtcttttaaaaaagtaataaaaatactaacagtagctagcatctattaaatacttattaggagctagatgtttttacatctgtttctctaattctcacagtaacctggccaaggcatgtgtaatactccagttttacagatgaggaaactgtaaaccagcgaggttaaataatttgtctcaaagttacacagcctgtgtgagtgacagagttaatatttagattcatgactttctttctctaacaccatgggtctttatgatctttttgtgttgtttgctggttttgctttggacttcacaactcgacttgtttgcttatcttatcccttccacttggaatggcatctccttaacagtttcagactctactagtagcaaatgtacctattatttaagccttagaccaaatgccacccttctaaagcttttcttacagtgccatttggaagtaaactgtctcttttgagctcccacaatactttgtacctttctttgtatatttattttgccttcagttataattattgctaaacatatcttaatttacccaatggagactgtctttgatttcctgtagtgtaagacagccttgaacactgaaggtactcagtatttgttgacttgacattacaggtaaaaacccatcaaaataggagtaaacactattgatgcttttgtaaaaaaaattggaagaacatggcaacatggtaatgatttgtatatttatgatcatttttgcttctcgttatttgaaaatcttgctaaattttgctggtggtataattaaatgtggcatgcatttcctggtttggtgaaaaggttcataatcttagctatcattttctttaaaaaaagataataaagaaatgtctgtttggcaggcaggaagaacctgctgttttaattttgttcacagcagtgggtcagattatgatcttttggagctagctttgataatagactcaatataatattggaattcaacaattggttattgttgagtatattatctcttgcactgatggctgtcagtgggattgccagactgtttagaataagtttatggctgtttagaataagtttatggcaaatagtctgctcttctctaaatacaatgtttccatttattacttactgtagtattttatatgtgcattgtctttttgttttgtttttagttttcttctcagagagaggcaattaaaccaaaacttgctcaccagtgggggtggggaatcttactattgattatttattcaaattttgaattatattttttcttctaaacgtctttaaataggccttttccctcttctaacttgactgattaacatttaattcaaacaaagattaacaaaattttaaacacttttatggtgataaaggcacactgtggttataatttattgaattttgagctccgagtctctgttaaactaggatttctgactgtgcttttatagtttcttctatctgaattcttgaaacatcataagactctatttacttccctcaaa

SEQ ID NO: 62858 - DNA, 1267 bp, Homo sapiens
gtacaatttggctcctctctctgactcttcttcctcaccctttgcactttagatgacataacaaggaaatacgttaaaactttagatttagggtttgtttcaaacttccttgattacttgatcttgaaaatttaggatttgttttgaacttcctttgattgtcaatctagggtgacttgcaagtaatgggtaattatgctaatgtctcttaacagtcttatataccccaagatgatgttttctgatttgaaatttttggtggaaatggagttcatttgaagtggtatagttcctgacactgacagaggacttataaagataattacaaatcaactgacaagcacttattagacattgtgtgctaggtaatgggaataggataaaagaagtagaagtcctgagccctgctctggaggattatagtctaggtagaagacaaaagatattataagctcctataagcagcatataattaagtgctaagttgtatgtgtttgagatgggagttgaggtaaactcatagcagggggttatcacgggctgaggctaatatgaactgcttagacatgagtggttattcctctgcatggttctctcttggagtttgccgtaattggtttttatcatgttttcagtatgtttaaaagggctttcaggagaaacactacatctgagtctcttttgctcttttaatcattatagttgtcacttactctggggtgaaagtgaacttgcagcttttcagcatggataagatagatataggcctgagagtacatttggagaatgtgatacaaccttcttactaatttatggtcgcttttctggtatgtctctgatgacagctaaaatacagagtctttttcttttctttctttttttttttgagacagagtctcgctcagttgcccaggctggaatgcagtggcatgatcttggctcactgcaacctctgcctcccaggttcaagcagttctcctgcttcagcctcctgagtagctgggattaagggcatgtgccaccatgcccagctaatttttttgtatttttagtagagacggggtttcaccatgctggccaggctagtctcgaactcctgacctcgtgatccgcccacctcggcctcccaaagtgctgggattacaggtgtgagccaccgtgcctggcctaatacagtgtcatttttaatggctgtgttttctatgaaggagtgtctacaatggttctccctctttttgtggtggcaatgttggtgaatgcccaaatg

SEQ ID NO: 62859 - DNA, 1057 bp, Homo sapiens
ctttcctcctatatgaatattccccttaaaatgagctattatacaactcacatcttattagtagggccacttttaaaggtgctttgctattttcattttctgcttctagatgaacagctatattacaaagcattctttaaatgtgctgttttgtgctatgtaagatcaccattttaattagagatcagtaacagtatttcgtcatttccctcttccatcctggacaataatttgatacaataaagcagttacactgggctctgggtgggaatagagctgtgagagttagacttaaacttttgtagaagagaagacttaattcttgcattttgtacataaaattaggtcagtgtcttgtagaacattatcactgcgtctcagatctcacttgccagcacgtaggaagtttgttttggtttcaaaatgtactttaccccatggtggctggcagggtacaatactattgacatcactgtgtttcaaatagaaagttaacaagtagctactgttgtgattgcagattgccttcccagtccctgtgagagaatgctttttcttttggacagcaacacttctcagccccttggtaccattaaatcagccaatgggggctgccagaatagagatgaacaccaacaaaaggccaaagagtagaaaaactgttaataaggcaaaaatctttaatcagtttccaaattgatgtgaaagataattaaaaaatattctctcccatcgatggctaagttttgacagtagtccaggttcagagcctgatctctctagagaggagtatcccttccctctacccagacccctggaaagttgccaaaggaaaataagctattttgtatttagaacaaattgccactgttttctccagtgatgtagccctatttcccagactttgaaacttggaatacagaaagttcttgtgtgaccaaagaagaaatatggtgaatgaatgatcaagtttttctttttaactaaatccttataaacagataagagaggggaagtatgcatagaaactaaatttagcacagaatggatgtcaagt

SEQ ID NO: 62860 - DNA, 1674 bp, Homo sapiens
catgagccaccgtgcctggcctttgtttagctttcttatttcatgaaccgaataagctgaacagcagaatatgatcatacatgttttagtaaataaaactcatgaaccacaatatgcttttgatatatcaggatccatttttaatgtcatttttcattaggaaaacaggcaggcagggttttttggggggataaatttgggttttcagaagattctcaacacattaagttttagagacactttggtatatatgtgtaggaaaagtagctagctgctgtcacgtgcaggagtgtgtgttgggagttgagaaacctggccacaagccactgcagctttgaagaatgtggctcatgagaggactcatagttcattacgtaacattcagcagagcggaaaatataagcactgtctccatcacttgacttgctttccattttgatttagttatctggtaaagtctaggtatcctatagtggaagaatgaaagacaagcaggttccaatgaaggaccatgcttccaaaggcatcagccagtggatcgtttgtggggccaggcgggggttagatctattattgttggacaggggtattagagttttgaaagactacttgaaaaacataatcaaatgatacttggagtttgttccgaaagggtattctttcctctctcttcccacaacagtgtgcgcttcctattatagttgatatacctgtgctttaaaatagcacagctactagtagaggccattttataccaaaatcatttcccttcatgttctgtggtacatcagtttggcagtagaggttacagagtttgaaatcaaaaggagcattggttccttcagggaaaaatgataccaatctaccaaaataaaagccaaacagactctcattgttctttatcccacaaggggcttgccctttttgaaggtgtggttaattttgataggactcttctctctaacagggttagtggctgggaattaccttttcccctgggcaaaacccactttaaaatctcattttaaaacagaactcaaagtgtctttgaaaataaaagtactttgggaactcttcattgtgtaaccccatccctctcagcaaggggactccagttttctcacagggcacttcctgctgcagtacctaattctaactttgttttactataactcatgctaaaataggaaaggtttcagctttacagtttttattagctgttcatgtgtttttaaaaagtatgtgttaaataaaaataaagtaaatgtccaccaaggagctaaatttttaaaaatcagtttccattaagtctagttctataaatgtttcagtaccaggttttttctacttgctgtttgtctaatgttcatcataatattcagaagagcagccttaactttccccaaccttctttcccttcttttactagaggtgcaggaccatgcctttcatgaatcgttattctctatgtcagctcttctctcccttggagacttgaaaaacatcatcatatgatacttgcagtttttttcctcagtgaataaggattttttttttttttttttttttggtggagtctcacactgtcacccaggctggagtgcactggcgcgatctctgctcactgcaacctctgcctcctgggttcaagcgattctcctgcctcagccgaca

SEQ ID NO: 62861 - DNA, 1053 bp, Homo sapiens
gacggactggcgtcaaaggatttaggaaatttgctgcctaaattaagaccaccactgtatatcagacattccccttggcaaaaaatattcctgtctcttcaccttgttcctctgttctccagacatcactgataataagcttgttgtgtaacatttcttatacctcttttcctcatgctgttagtttttgaaggtgcgctatactcgataattaatgttcttcttttttttttttcctttggcagaggagattgaagtggatgttgaaagcacagagttctcccatggagaagtggacaatataagtaccaccagcatcagtgacattgatgaccacagcagcctgccgagtattgggagtgacgagggttactccagtgccagtgtcaaactttcattcacttcatagaacccagcatgacataacagtgcagggcaaaatattcactgggccaattcaatacaaacaatctcttaaattgggttcatgatgcagtctcctctttaaaacaaaacaaaacaaaacaaaactatacttgaacaaaagggtcagaggacctgtatttaagcaaatacttagcaaaaagtggggcagagcctcccaaggagaacaaatattcagaatattcatattggaaaaatcacaatttttaatggcagcagaaaacttgtgtgaaattttcttgatttgagttgattgagaagaggacattggagatgccatcctctttctcttttctagtttgctcatactacattgagtagacacatttaaggatggggttatgaacccttcctgagctttatggtcctaaaagcaaaataaaaactattcgaatgaaaagacaagaaaatcaggtattaatcttggatagctaataatgagctattaaaactcagcctgggacagtttatcatgaagcctgtggatgatcaatcctttattattattttttttttttgaaaaaagctcatttcatgctctgcaaaaggagagactcccatgaagccttttgaaagggatcatcatgcagctcaactttctgttggatt

SEQ ID NO: 62862 - DNA, 1001 bp, Homo sapiens
agcttatccataaaaaaaaatagatgtcttttatagtggaaaaacacatggggaaaaaaatcatctattttgatgcagcatttgataatgataaaacacctcacacctcactctttatagtgcacaaaatgaatgaggtctgggctaggtagaaaaagggtcaatgctatttttgtttttagaatcattaccttttaccagcttttaaccatctgatatctatagtagacacactatcatagttaacatagtaagttcagcacttgtctcattttaatgtaaagatttgcttccattttcctacaggcagtctctctcttcctcacagtcccactgtgcaggtgctattgttactcttacgaatattttcagtaatgttattttcttctaagtgaaatttctagcctgcactttgatgtcatgtgttccctttgtctttcaaactccaaggttcccttgtggccctctcccttaccctgggaaggcctcttggagaccttacccctggctgtttggactttgtatactttaaataatttaactacccttaattacttaaaaaaaaaaaaaagctttatgattttcataacttattgctgattttaatggattgttaatttcagtcctgtagttttattttatgtttagatagggctgggcaaggaaaaagaaaataaagacaaccatatttagcagtgcagttgagttgtgtgttaatgttagactatccctttgtgagtgacactttaacagcattcactgcttctatatatagtgtaccatcttggtcatacattacgcctcaacatatacttgtgctcttcctttgcctccagaagaagtttttccttgattgtgctatgtttcagtggaagaaattctttgaagtagatgtgagtgaaaaactgcatgcctttagaagcccagtatcagaacttgctacgtttcaggtgctagggacttaatgaaaaacaggacaaaacaattcctttttgtggccc

SEQ ID NO: 62863 - DNA, 1050 bp, Homo sapiens
atgagaagcatgatacccacagtattttacagttgaaggtggttaagctctctatattctgaaacaaaatataaaccttgaccttaaaaagctttgttagaaaatttaatgtagagttttccccattaagaaaggagacttgaagctttgaaactgtgacagactgaaatgttaaatattgagttatgggcccctaagtagaaatggttgcatgtaacttaccaaagcttgacgtttgactgttgttaccatttcaaggaaagaacagtcctaacctcccgaaaataaaatgttgagttttagtggtaatcacaggtaacaagtgctattttaattaacatgtagggaggccacagagcatactggaaaacagcaaggactctagagccagactagtgtttgtttattaccatttattacctgtgtattcccatttattacctgtgtattcctctgattcatttttctcagctgtagaatggaaaaatctgtttcagttttaaggattgaattcaaatgtgtaaatagcttaagagtatccggcataagcactatagaagcgtctgctattactctgcagagtggcagtggtgaattatctgatattttttccttaacttgaatagcaatccacattacaatggataacaatacccattgtttatgatttgaggcatccaattataactgtattattgaagtgttatcaaattaccaaggctgtagggtatatttagtattcctagttaaaggtttgaactaatttgtatactagggcatgtttcttaatgggaagggggtgaaggttataataaaagtcacccctaatgcttgtttaaaattaaagaggaatttgtgggcctgggaccaaccttagacttatccaggccaaggtatgttgtttgacgaacaccgcaggtgatcctgatgtgcatccccgtctgagaactgttaactataaaagtttgactttggaaatgaagaaaaattaccttttagcctaatcatgaagactaggcgtcaaaccaaaacaagatgcatcagttactg

SEQ ID NO: 62864 - DNA, 6176 bp, Homo sapiens
gttttaaatgcaacaatgggtgaacagctatgcaagttcttagatcagataagatgcatagtgtggatcttcattagagtaacaatatagtagacaggtagcagaatctgtcggcttgtactgttctcaattttttagccatccctacaccaaacatctttgaatgaagccaataaatgtaagcctgaattagaaaaaaatatttgccacacagaaaggcattgcctttgtgtgttacctttttttcccccttttaaatgaagctgtgctaatgtgcttaacattaaggtatggaacatttaaaatctaacctggtaatttgcttacccagatggggtgagttttacaataattgaataggaagaccactggtttcttttacattgcctgtagtattttagtcgagatatgtataagtaggaacatttttgttactaataaagctgcttaaagtgttttgggattgcttggcagttaatactgctgagtaatgccctataaaacagtacagttgcataaaatatgttacaataagagtatctaattcagtgcctcatacttgactttctcatctttagagagatctattcagctaaaataggcacttagaaataatgcatggtataagctcaagtcttatattttcattagtatttgtggttaagttgaaaggcaactatatgggcttaagtcacagctctgccacttaactggtagacaatactgtatcagtttctacatggggataatcacagtacttgcttaatagtgttatgagctgcaaatgaaatatatgtagagtacttaacgtacagtatgaaggctgtcatcagaaactaagttgacaatgagaattataaaaataatgttgtagtttttgtttttcttttttaggaagttatagaactaaccaaagaccttctgtcaactcaaccttctgagacgcttgcaagttcagacagttttgcttctactcaacctactcattcatggaaagtaggagacaagtgtatggcagtctggagtgaagatggacagtaagtgtagaaaaaaaaactctaactataacatgaaataataaaatacaatggtaagaagtttttattcagttttaactaccctattttaatcttgacttctattaggcagtatgatttatagagccaatttgattcttgggtggttgccattaatacagtttagttttagctttagattaagttttggggagaagaatggctgggattctggaggaaagaaaaacaggacaatgaatgggtgttttctaaaataatctaaattattttctctaattgaaaattgagtgaatggttggtttttctgagaattctgtgaagagcatacactgacatcattcctataagaaatatcttttcgctgggtgtggtggctcatgcctgtaatctcagcactttgggaggctgaggcaggcagatcgcttgaggtcaggagttggagagcagcctgaccaacatggtgaaaccccatctctactaaaaatacaaaaatcagttaggtgtggtggcgtgtgcctgtaatcccagctacttgggagactgaggcatgagaattgtttgaacctgggaggcggaggttgaagtgagctgagattgcactactgcactccagcctgggcgacagtgagactctgtcgcaaaaaagagaaaaaaagaaacctctattctcaaagacattaaatcacgttgagtaggtacatgtaagagacttgcccagcaatattatgattgggatgtccttttttgatagcagataactaacttcaaccactcttttgtattctctttgctgaaacaaccatttgattatagaagtttcattatagacacatgtaataattttatcactacagtataagtcttgtaggctgagtactaaacctttactcacctgcttacagccatgatatctttacaggtgttatgaagcggagattgaggagatagatgaagaaaatggcaccgctgcaatcacctttgctggttatggcaatgctgaagtgactccactgttgaacctcaagcctgtagaagaaggaaggaaggcaaaggaggacagtggcaacaaacccatgtcaaagtaagtgactttgacttttccattttaggtgcaatcttccccatttggatacttgaagtagtctgcagagagaatctatgcataagaaagttgtaatactgttttaccgttgttttgaagattagcaacaaagggtcaacattgtctgtgtaagtgtgcctaagtaaagtgaagataattttgattcccatttaggcattcagtaaatattaagaagataactatgtacaatgaacatcttcccagcatattttataagccaggtactggggctataccacaggagaccacctcaggccttgtcccaactgagtttatatttagagaagaaaactcatcattaatgaagtgctttaatagtacagtgtaaacattacaaaggagctataacaggtactgtaagggaacaagaggtactcagcctccacttttattattagggcagatttctttgagaaaatgacatctaaactgagatttgaaaagagtaagagccaagtacaaagctacaaggcggtatgatgttgatctgggcttgaattctttgttattaatgagcattatgaccttggagaagctgtttaactctgtttcctcatctgtaagataggggcagtacattattgggttgtgaggattcaaacgataagtgttagtaaagcttgtaacagttctttacatgtagtaagagcttagtaaattttttttaaaggggggaggtgagcacgtacaagtaacaaatccctgtggtaaaaacttggggcctggaaggtgggtggtctgagaagagattagagaggtaaagtccagaacataaagagcttgtaagccaccgataacattttaagtagaggggatatgatgtgatcacatttgagctttagaatgatcactgtcagtagggagaggcaactactgctgtgatccaggtataagatgatggcctgaacccagggagttgcaatgggaatggggaactatgcagttttgaaaagtaagaggcagaattaacaatattttggtgaacttctgcatatttgccacaacttagtcttttgatttgtcaagagtttttgaaacttaagttgctacatatttatatttgaatatgcaaaaattatatattaatgtaagcattccaataaaataaaattctagaacaatgtatatatatattttttaatgtctttgtcatctgtgtaaaaagccatagcttcatggtggtaatatggtaccggggagtctagatattgcccctcttaaggatctttcttttcatccttttggtgagaagtcagtgttaactgagcagaaattattgggggttttaggctctgatcctatttagaatcttatttagaatgtttttgaaacccccaggtgttttgttttggtgagaattattagctatgatttccatttgtgctgctgcattcttccaatgtaggtaaaatattttatctgcatcgaatctcttcatacatttttttctaaatgctgcacttgttaactatgtctatttggaagtagttgaaggcttagatacccattaatactgaaactcaacttattcctaaaacaactggtaacagctatacaaaagtaaaatagaaagtcataattaaggctgggcgcagtggctcaagcctgtaatcccaacactttgggaggccaaggcaggcagatcacttgaggccaggagttaaagaccattctggccaacatggtgaaaccctatctctactaaaaatataaaagttagctgggcatggtggcatgtgcctgtagtcccagctacttgggagggtgaggcacaagaatctcttgaacccaggaggtggaggttgctgtgagccaagattgtgccactgtactccaactccagtctgggcaacagaacaagactttgtcgccaaaaaaaaaaaaaaggcatagttgaaatatttaccttatatgggtaaatagattacagttatgtttgaaagcttccaaggatgccattttttaaaaaaacatttcttagtaattctgggtgattggtactgattttaatgatttagtactttttattcatagaccattgtatatgtttattagattttttttttgcactgccggtgtcttcaaggaagtcattcttgtatgataagtcttaacagttgacatttaactttttttcatgcagaaaagaaatgattgcccagcagcgtgaatataaaaagaagaaagctttgaaaaaagctcagagaataaaagaacttgagcaggaaagagaggaccagaaagtgaaatggcaacaattcaacaacagagcctattctaaaaacaaaaaaggccaggttggtaaatctttttacactttgtaaatttgagaaatgcaactgtcattaaaataactttaaaatgaaaagagatggagattttttgtaaagtatgattaactcagattttgtattccgaatccttgttgatgctcaatttaacttattgaaaaatgttagccattgtctctgcaataaaaatattacaaatgagagaatttatatcagaaattacaaaaggtctatgttcttttccttctataaactaatatttgaaaaaatagttgctacttagaggcagtgtgcttaactctatctgctttgttaacatgccttcatgctgggcatcactggtagattttatttaaaagtgcattcagtttcccttgatacacttaccttgtgtgtgttgggtagaaaataactgtagcattcatataggaagttgagaataaggataacctgactttcacccatgtgttactcttcactgccatcaaggtagcccttccattgatggacatggcttctggaaagaagcgcttccttttcataaagatgtttattttgtgacaaaggccaagggacttcacaatttggctatcataacaggccccacagtaaaccacaatacagccagagctttaatcatgctagaatggctagctcacagctgaagttaggatttgcgtttacaaaactaaaattttgacgtatcagaaggcaagtgttatgagtattagtaaatgtaatgatattttccacaacttagaagttacagtaaatggcttccagcatgggaccacttctgtacccattttttaacactaaacaaaggcaatatgtttttcttcttttaaacgttgaaaccagaatatattttaacattacttaaaatttgaaattttttattttttccaacactaatcaggaatgatttctgttttctttcccttaggtaaagaggagtatttttgcttcacctgagagtgtgactggtaaagttggagtaggaacctgtggaattgctgataaacctatgacacaatatcaagatacctctaaatacaatgtcaggcatttgatgcctcaataatcagaaaaactgttggatttcatctctgcagggctttacatttacctttttatccttatatttttctaaaggtaaattatttgttagatgagtaagcaagataccattgtcgtcattggttggcttcagtagaatgaaacgtgaagaaattgcatttgataactgctattcatttaacttttctcattatcagtaccacggttccctcaaagtttgttgaataaagcaacttttgtagatgctgtttcatacagcacttagatgaattattgatcttcctaatatcaggcgcctacttaacctatggtgtgtactttttgtaagttgtaacttgaaattttcagatgctttgaacttgacacatactctagcaattcattggaacaccaaggcaaaaacaccaacctgctaaaagagatcttttcatttttcttattttcagctttaaaacttagctgtcgttcagttaagcttaaagataggttaatttgtaaatggcaaagtttgttttgaggtttttcctcaataacttgtttcccaggcctattaggccatctctaaaattgatctagctgttttatttttatgtactcttagttttatgtaagaaaccttaggatgagctcccttttctaaggtgt

SEQ ID NO: 62865 - DNA, 1078 bp, Homo sapiens
gcttgttatatttggtgaaaagtctgttcagactgattttgtggcttcctcatattaatattttttgaccatcatatggtttctaatttcttgtgttcctctatagaattagatccttatcccagttattaatttgtttgccctttgttttatgacaaaatgctttttttgcatcttttcaatgacttcattttgccagtaaggtttccatgtttatctctttcatgtactgtctttcatagagactaaagttattcagcaggcagcaaaataatctactaaagtcctgcctttcttttttcacttaaaaaagtgggtgtgataaaatccaggctagctagctgactagctccccgggcagtctatgataatcagagatagtcaatttattaggctgttttgctgaataagctggttctaaaggaggcaggggtcaagtcacttgtctcatatattacagtggctctctgcatccccgaaacgccttccttcagtaagcagagtgcttgagtgcaccccatttgacctgctgatatgtagatcacaacacctgatgcttcctggaattgccgattactgtaactgctgcccatctgtcgatgaaggagcagtttcagaactcagacttgagggaggaaaagtaattaatggtatgtaccttcaagaaccccctcatacataaaatagtttttctaatactttggtccatacgcacatgtgaagaatagaaatttagaaggttcttcatagtttgttgggagggttatgtaaaaccatggcaaagttaaaggacattaggagtaaatgctctggattttttctaaaaaagggtcatttcagcacaggcctctgaattcactaatatgcacagcttttcaggacccttttctttgatgaaatatatttctttaacaaaatatatttggaaaacagttctgtcctaaaagaaatagagttctaaatctgaaacctacaagtgcagaattcatgtctgtgcttaagttaaatgatccctaggtggatctggaagtatttaatgatagagatttgtgtgggctcttgagtcaggctgactgga

SEQ ID NO: 62866 - DNA, 1101 bp, Homo sapiens
ctattactattttagggatatcagaactgcaaacaaacttaacggaaatagggtccggatttgggattctggaactgcttatctgggcgtaattaagatgagttgaatactttcaagttctacatttagaataaaattgcagtagtatgttatttttaaacacacacaaactatctgggttaatttcaatatgaacaagacccctcttcgatacgtagaagccaggcctgtgggcttcagggtgccagtcaatacaaaaaagatgttttgggagcagtttctcccactcccaggcccttaagtgagaaataacccagtggtttgccacctgtccatttgatttgctcatatgttgtgagtatacattgaagatgaggcaacagaggcacaccgacctcttattttcttacactctgtaaagtgctttctgtttgccccaaagagagatgccttgactacctttaccaacttaagcagtccttttttaggaaaagaaaacactgggtgccaatgttttgtatattgcttcttgggcagtgggaggaggggtatttgttgaactggttgggttggggaagttgggagtggagttagaaatagcattatcatcaggtctttttaatatttctagaataattcctcattagagtctgagcagaactgccttaccatgtcatgatcatcatagtggaaagtactgtagggggaaaccattgtgataaacactgtagtaagcccctaaaaggcttgcttgcaggggttcagttaataatgacctggaaatcatttttctgtaaagtatcctcttttctataaccatttaaaacagcactgtccagtagaactttctgtgatgatggaaatgttctatatctgctattcagtaccatagccactagccacatttggttggatatttgaaatacagctaggtttacttaggagctgagtttttagtataacttaattagccacacgtgactaccatactggatggcaaggatttagaagtgcaagttttaatacttcagatagtaataacagaatgtttttcctgaccagtcttgatcagagtttcttcccattttattctatcattag

SEQ ID NO: 62867 - DNA, 1059 bp, Homo sapiens
ccatttcattttattgctttttattgtttccctccggcctcttctcccctcctaggtcttttctctagctcagtttggagctcacatcctttccacccttttcacctcctccttcctccgccccaggattatccctgggacccatcctgagctgagcctacagccagccagccacgaaatagaggtgcgcgggggcagggtggtatggagattctgcggcctttgatttgacacctcccggagctaccgccacaggcctgcccatttcacctgccgggaagataactttggcttctggtggtgggtgggtgattgactctcaaaatccaaagcattggttttttctgggttacttcctatgactgctcctgctttgtgtttgagtcctttgtaacctcaaatgacacccggggagacctgacccacatgtagagatgagggtttagccccagcagggccccaaggccgtgccagccctggcgcggacaccttgggatgtaacagtgttggggatcagagctcggtgcagagagccggcgccgagttaggagcctgttttaaagccatgcaacttgagtttcacacagtccgggccaggaagattctggagacagttcccctctctgctagcacctcctgctgactggtcccctgttgatttcctgttggagagttaacagaggtagatggtaatcgtccttcttctaacagcctatcccccaggggatagagggttggccctctggctctgcagaggtttcagcgtgcctcctgatttctttctcttcctaatatggtttttatctcctgtggtttggagaagtttctgcctcagtagtatgaaagaggttccaggagaccctccctggtcccacctctcctccccatgcttctctaagctggccctgctgacagtttagaagttgtcgccacaaagtaggcagctctatagactcacatctcaggaaaactgggttaaaatgttttttaaaagaaggtaacatatacacaggtaaaaatttgaacagcatgaaggccctgtgatgagaagcgggtctt

SEQ ID NO: 62868 - DNA, 1058 bp, Homo sapiens
cttcctcttggtctaaacagaagttcaaaaagggaaagaaatgtagtttcaggggtgtgttgggctgagctccaaaagaaactggataggatcccaggtctggtgtatcagcaatttccaggcactcaggagaggaagagatcttgagtcaaccatccagcctgctccttaaagggcgagcctgttagtgtccattggtggggacccataagtcatcagtggccacgtgaatctggacttggaactctgactcctttccaaagaactttgtaccacctctgctgttttcctggtttctagctggtggggatgctgtgcccagggagtgggtccaactcaggtcaggactagacctgcttggattgcctaaaaacctgtgtcttccccatggagagaagccatgttctgttcattcttcaatctctatgacagtggcagctatgtgacgtgccaggttttaatgcattcattatcccatttacaccttaccaattatccagagaggataggtattatccccagtttagagacaaagggtcatagattaaagaagctatccaagatcacatcaggtagtaagcatggagctctggaacttaaccaagagctccgctgtctgacgcccaagcccaggttgttaaccactgcaccactttgccaccaggaaggctgctctgtacgcatggaagtttgggaggtttcgaggaggtgatgcagatggacattttatctctagaggaagagaggaaagagggaattttttccttcctgtctttacctgaaatacttactttctcatattgatcactattgaaatggagtcagacaaggccttgcatctcatgctacgcaatcagttttgggtttcagcccagctctaccactgactagctctgacttggacaagttattaaatgcatctgagcctcaagttgcccatccgtaaaatgggaataatgttacctacctcacagattttgtgaaattggtatgatgtaggcacatctaaagggttaagcccccagaggccagccatagtagatgctgataaaaatacc

SEQ ID NO: 62869 - DNA, 1028 bp, Homo sapiens
gtggtaaggggaatgactttttcttttggcccttcaaaatcgtaaatgtttttgcgtattgtagcctgcgtagtgccagctacatctaacttcctgtgatgtaattgtttcctcactagcaagagagggaattggaaagactgtattttttgtggatttgatgtgtacgtatctttaacctttcaccccttcccatttttaatagttgtagctggttttctgggggcagggggctgggaggtagaacaggaagggaggcatcctcccctttttgtcatattgagctaaagaatgctaactgatggtggtagctttatagcagcgactcccattgttgagcaagatggaatttgtgaaagccatttatatcctccgtctagtaggcgtcacttagccagggctataattagtggccatgcgctatttattgtgtgtttggtggtgagaaccctgggagctgagccaagcatcctgccctggcacagccagacagggtgcccggagagaccggaaggcctctaccaggatcggggttaggttgttacccttagaatcagacctggagagacaagagttgcttctccaagtcagtctttgagcctgggatgctctccttagaaaaatgtatgtgcccaataaaaatgtgcacaatttcaaggattttccaatgccctcttggaaccatcagtggaacctaggttaagatggcatccccaggaagggactgctccaggtccatcgcctccagaggcagaatctgcaagtatcttgggaactgtaaagcttctgtgtgcttatgtctcttgtgacaatagctgctgtaaactgtaaaggtcctacttggggatagtctttgctgggaccccaaaagctctatcctcaccagtggggattaaagactggcagaagtgtagtgtagggccgtggctcttaggcaggcacaacagtttcatatctaggttactccagtgtttgattcttgtgttttgccattgcccttagattctaatcccaactcactcccacca

SEQ ID NO: 62870 - DNA, 1052 bp, Homo sapiens
tcttccttccagactgtgtcagggaaaagggaggcaaggtcctggtccactgtgaggctgggatctcccgttcacccaccatctgcatggcttaccttatgaagaccaagcagttccgcctgaaggaggccttcgattacatcaagcagaggaggagcatggtctcgcccaactttggcttcatgggccagctcctgcagtacgaatctgagatcctgccctccacgcccaacccccagcctccctcctgccaaggggaggcagcaggctcttcactgataggccatttgcagacactgagccctgacatgcagggtgcctactgcacattccctgcctcggtgctggcaccggtgcctacccactcaacagtctcagagctcagcagaagccctgtggcaacggccacatcctgctaaaactgggatggaggaatcggcccagccccaagagcaactgtgatttttgtttttaagactcatggacatttcatacctgtgcaatactgaagacctcattctgtcatgctgccccagtgagatagtgagtggtcaccaggcttgcaaatgaacttcagacggacctcagggtaggttctcgggactgaaggaaggccaagccattacgggagcacagcatgtgctgactactgtacttccagacccctgccctcttgggactgcccagtccttgcacctcagagttcgccttttcatttcaagcataaggcaataaatacctgcagcaacgtgggagaaagaagttgctggaccaggagaaaaggcagttatgaagccaattcattttgaaggaagcacaatttccaccttattttttgaactttggcagtttcaatgtctgtctctgttgcttcggggcataagctgatcaccgtctagttgggaaagtaaccctacagggtttgtagggacatgatcagcatcctgatttgaaccctgaaatgttgtgtagacaccctcttgggtccaatgaggtagttggttgaagtagcaagatgttggcttttctggattttttttgccatgggttct

SEQ ID NO: 62871 - DNA, 1139 bp, Homo sapiens
cggccttggagacggttttctgttgggtctgtcgggctctgagcactccttctttggaacgtgggttctttcaggctggccggcgtgagtgactgaaagcagcactcggtggtcttggagtcaggagagctggggcccgtcggcctgcttttatagacttgctattgtactgcagcgtttagggttcagttaagctcacacagtgtttttgattttgaaaggtccttaacaggttgacagcataactcctaaaaaaaaataaaacccagcagcattgccttggcaaagattaccgataaaagtacctttttttttttttagcagatttttaatcaccactttccaaaatgaatttttcttatatgaaatttcgagttttctatattgcattaaatgaaaaacaagaaagaaatgcaagagaaaaatgttaattttttttgtggggtgggttctcaaaaatgttttttatttactaggtgattatccagggttttcgaagttacagagatcaaacaattgtagatcccttcagttcaaaacataatgtgattggtaagtgttcttggtttactcggtcatatttatagtctatacagataatgtaaattctgtccatttctatattggcttaaggagacaggaattgtctttgaatattaagttatatttttctgcgtgaaataacttttctgtcttattgcactgatgaattgcttatttttataaacttaaaatgtttggataagacactcataagttatccattttttatctaggtagccttgtatgtgtgtgtaagagtgttttaaagcatttccgctcttctgttcttgttatatatcctagtgaaaatgctgactgttgccttatttcagagacagacaatttttattcacaaagtagatgccaggattccccccccaccccggcagtcagtgtctctaaggacagaccatgtagctagattggaagagcataaactttggagcataacagaatggggttcaaatcccagttataggggggtgggggcctgggggagggatagcattaggagaaatacctaatgtaaatgtcgagttgatgggtgcagcaaaccaacatggcacatgtatacctatgtaacaaacctgcatgtt

SEQ ID NO: 62872 - DNA, 1765 bp, Homo sapiens
gaattgacatgccatagggtggcttaattgtactggggttttgcttacatataagtactttctgatttttttcatcaatcagaaaatctttagaaatgtagaaaaataagaattattagatttctgttttctttaacttgcaccttaaaataagtaccttaatatttcatttgtgtgattttataaatgatctgtaacttactagctagaatgattacattttgtctataaggtccatcaaataccattgttttagctgttatcagttagttgtgttacctctgtgattgcagcattagatttgttaatagtcactgttacaaaggaaaatggttttgtttaactaaaacaaatgaacccaagataacagtactgattaaacatattttaaaaccagacacgttgtaagacataatgtaagaaagaccaaaagtagttaggtactgagatttgccttaaaaatatctggtgaaagcataccactttgattgatgaatgatgttgactattaaaaaatatctcttgtactgatgttgggtatatgcatcaaacatatacgtttttagggatttttttccccctaacctttaacaaaagaaatacatgttatagaacattatggaaaagctaaaaggaagaaaattaagataaactataatccttttactcagagataaccattctttgttttttactgcacaccatgattcttcagagataaccattcttaataataacagtctatacttgtgattagtcctggtttcctagaaaacagcacagacaggattagctgctaaggctttgatgggaggtgcagtttgagggcaagaatgaagagaaaagctggtcatagatttctaaagaagagacaggtggtttgcagtcatgttaaataactcacagactttgtggacccaccataccttagaaaggtcagatgatagaggaatggatttggattctgacaaggatttgtttgcaggcacctgtctttcattggtcaaagttttctacatctggcattgatgcctccaagcttttggattgtggtgctctgggaactaacacccggaagtagtcagggagttatagcctcctttccatgttcacaattcaggagtacctgaatgtactcccaaggtagcttgaatctaccagaggtattaggagactgagcttttccattgattggcagccaaggcctgggttgagaaaggtgaatctggggccacatataaactgtgtttacctcagtacgtttttagtctttgtatacatctttttaatatatatttaaataaaaatgggttcatttttaaataaaaatgggttcatttttaaataaaaaatgggttcatcatataacttactggtaatctgttattctccttcaggataaatcttgaaatatctttattaaatattcagcatcctttaaaattgctatatagtgttccactctagcagtaattcttaaaaggaaattcttaaaatttcagttatttatagatggattgtggtttgaaatatttattcatttaatgataaattgtcatcttaaacttttatttagaaatagtttcaaatttacagaaaaatttccccaataagaactgttcagagactactcataaaccctttacctagattcacctgttgttaacattttccccacttgctgtatcatttccactttttacacacctttttccttaaagttatttacaccatggtcctttacctctgactttaatgtgtactt

SEQ ID NO: 62873 - DNA, 1007 bp, Homo sapiens
tacccttttacgtattgaattgcttatatttgaattttgttagtcaaaaagtaccttaaaattatttatatttttgtggttctgtgagactacacatgataatatagggttgattttaaacatgagaacactttaaggatttaaaatgattattttagaacgttagcaatatatgaatctttaaattgttaaacatatatagttaaaatagaattatatatccattgtaatatgatataagagccaggtagtatatttagctattcctattcattttaaactattgggtaagagcaaacggatcaactgtgaaatatctttaaagaaaaaactattagaagtctgtacaaaaattgaatttatttggtgattatagttgttttattggtttcttttgttcactgtttaatttcagatgttaagatgtattagaaaattggattttaaaaatattgagtatttttaaaaaggtaaacagttttaattttattggtttttatgtaaaataacttgtactttttgaaattttccagtgggcagaaatggatctggaaaaagtaactttttttatggtaggtgttgctttttgaattgtaaatatattaagacctgggtatcttagggtagattattaaaatcattaattttctgaggttatgtattcatgaaacccaagaaatactttatatggggttgcagcttagtgtagagggtttagagtatacagatctgaattctgctttatacccagtggctgattagctgtgtgagagtgggcaaaacacgtagcctctcaaatttttcttttcactttaaaaatggagatgtttggatgtttgccctgtctaccttagatggtttgtaagaatggaatgcaatagtatgtatgaaaatgctttttaaacttgaatgtaatatataaatgttataaatgcatattttaaacgtatgtaaatgcagtagaatagttgatagtattgttttggaaaattgttcatctttcttat

SEQ ID NO: 62874 - DNA, 1966 bp, Homo sapiens
gtgagactgctttaagacattattgatattacatatattttaaaaataaattttccatgctggttaaaaaagcatttgttcaagtttcagattctttgtgaacaagacacaatctttctcataagtgtgttactctgctgtgaaatttagcctaacatattaatgccagataaaagcccaatttttatacagtggtttaggagaaaattataggatttgcctatagatggatatgtcctccatataaatgtcttaaaggagacatgatatatatcataagtgttttattctgctgtgaaatttagcctaacatgttaatgccagataaaggcctaatttttatgtgatggttaggagaaaattataggatttgcctataggtgggtatgtcctccatgtacatttctttaaggatgtgatctgcaaaggcttaagaagcaggtttgctgaggagaaagaagagtttgaggttgcagattaggaactttaagatgcagaaccaaaaattaattgggaacatagagaaacaaccattgcaaactaaacaacatacaagttgtttgttgttttagccatatttgtacttagatagtaaacatcattttccagtatgaaaaacagtagagatgttctgcaacttacagcggggttatgtcctaataaacctatcataaactgaaaataccataagtcaaaaatggacattagcctacagttgagcaaaatgatctaacacaaaagtctgttttataataaagtgttgaatctgtcatataatttattgaatactatgctgaaagtaaaaaacagtgattttatggatactcaaattatggtttctactgaatgtagactgctatcacgttgtcattcagccatttgttgaaccatcgtaagttggggaccacctgtatatttacagtaatgtgagttaggatattttattaagtgggtccttttgtaatgcataagcacgatgattgggttttcgtgttcatgtgagtcatgcctccctcaaaccttgttaggacattggcacattaccaatgtgatgtggaaaaaaatatgagtaatggactaaagtaattttaggatagaaaatcatgaaagactacaataaaacgattaatccttctgatttgaatattgtttattaaagactagaaaatgaaattcctcaacatgtcttaacagtgtttctcacacataggaaattgttttgtttagctcttgtctgtcttttccccttgtttagtttgaatttgtagcccagtaatcagaattgatttcctttagaaaaattctttttaggtttttcagattggcattaaaataattaataacctctttggtacagttcttcattgtatttactacatagtttctataatctggaaggtatctggacttggtaccatagtttttgtgtcatagattggtttaaatgtgacacatgttaaatgtgtatatttctataatagatttaaaactgtagaatgtctcaatttttcttaaaaaacagacttttggtaattatcccatgatttattaggatttctttgcagcattaaaatgagactgtaagagaaaagcctcatggtgtattagatattagcaaataggtagagttaaatgtccccagtcttgcagtctaataaagtggtctgtagaatcatatttaaggatatctaactttgacatgtcttgcatagctcttattttttatttagaatcaaaagctatttggttgagaagttttgttgtcctaatctaacgtctctgctgttttggcaagagggatatatactataactctggggatatccccaaagtatgtatccctcttgccaaaagagcagagacgttagattagtgtgtgtgtgtatatatgaatctagcagaaatttttctccattgaatcagacttgttattatgccctagactttaagaatcctttaaaggata

SEQ ID NO: 62875 - DNA, 1763 bp, Homo sapiens
aatggcaaatttctcacttctttcatttttaggaaggtactggtcctcgtgttatttctgcttttgtggagattatttttgataattcagacaaccggttaccagtaagtaactttttttttaaagtaatgttgagaatttaattggtttagctgattttcttcatactttgaaactttttaagcttttataatttgttataattacagtttatatactgattttatcttaaaatgacaatgaatactctgttaacaaatgggaatgtacaaactgttgtgaaaagtgtcttggttaagagtattgagtatttgtagtattatttttagtgagataattgaaattttaaaataaatacttatgggcaaggactttaaaatgaccttatttaaaaagttttctcctttactattaaattaactgtgggcttttacattttttcttagatcgataaagaggaagtttcacttcgaagagttattggtgccaaaaaggatcagtatttcttagacaagaagatggtcacgtaagcatttttcttttttttaaaaaaactgaatatgtacttaaatagagatggggtattgctgtgttggccaggttggtctcgaactcttggcctcaaatgatccacctcggcttcctaaagtgctaggattacagacatgagccaccacgcccagccagcatttttctttttctcaatacggagtcttgctctgtcgcccaggctggagtgcagtggcgcagtctcggctcactgcaacctccacctcccgggttcaagctattctgctgcctcagccttctgagtagctgggattgcaggcagtcaccaccacacccggctactttttgtattcttagtagagacggggtttcaccatgttggcaggctggtctcgaactcttgaccttgtgatctgcctgccttggcctcccaaagtgctgggattagaggcatgagccactgcgcccagcccgcaattttatgatttccttacaaaagagtaaaaagtattcttttacctgcttcatatatgaggaatatttgcttcatcttcaacaagtcaacatatagaggataaacataagaatcagaaagttctgaggatgatacagatggtttaattactgatctttcctccctaatgctatcaaccaaggggctactctactcattgcttaatggtgctttaaaattatttatcggaaagtaatttcattgtttgtcaacaggaaaaatgatgtgatgaacctccttgaaagcgctggtttttctcgaagcaatccttattatattgttaaacaaggaaaggtaaaacaattgtatgtcctttttaagtagaatttgttttctgagtaattcttgagtgatgaatttggtttattgatttgagtggttaagctgaagcaaaaatggccatattcttttacatggccataaagtaccaaataggtccattgcatgttgagatggaagtatttcagcatattaagtggatcttgttttcctagtgactggtattacttactgaggtgaaagtatgggaagacattattggcttatgaatgttgcaataattaagaatattgtaggaattctataaaaatcacatttgaaaaactttctaaaattaatattttgtgttacctaattatttatcacaattaaaatactgaaaagctaacattaccagaaatctgccattttgccacatgttattttccctaatagggattatgtttttacattttttcag

SEQ ID NO: 62876 - DNA, 1064 bp, Homo sapiens
tagccctattcataaaggagagttatgaccgtaacagttgtatttggattttatttggtaaatttcatttaagtaaaggagacatagatatgtaggcatgcgtactatacaaatgacattagccaaatcataatctgtttaaaacttggcatgtcccaaattcaaaagtctgaaatacagaatgctctacaatctgaaacctttcgagtgtggacatgacattcaaaggaaatgcttgttggaacattttggatttcaaatttttggatttgggttgctcatctggtaagtataaatgcaaatattccaaaacttgaaaaaatctaaaatctgtaacacttctggtttctaaccattttgcataagggatacccaaccttcatgtgtattaaaaacctttcaacgtggagttcttcttcttaaacggaggctacagctatgtaatgattatttttctaaaaattttagatcaaccagatggcaacagcaccagattctcagagattaaagctattaagagaagtagctggtactagagtgtatgacgaacgaaaggaagaaagcatctccttaatgaaagaaacaggtaaaataaatgtgattctgccttatttttttgttgcaaattactgtttttgtgacagagtggctccatgatgggaatatagtaggtgtttagtatatgacagcattagataatgctgttattaataaaaattgagaatccataacaccaatgatgttagtagcttttaaaaatattgtggaaacgcacactgactttttttttttttttttttgagatggagtcttgctctgtcacccaggctggagtgcagtggcgcgatctctgcttattgcaacctctgcctcccgggttcaagtgattctcctgcctcagcctccctgagtagctgggattacaggtgcccaccaccatactcagttaatttttgtatttttagtagagacagggtttcaccatgttgtccaggctgatctcgaactcctgacttcagatgatccacctgccttggcctctcaaagtgctgggattactcatg

SEQ ID NO: 62877 - DNA, 1867 bp, Homo sapiens
ctcactccattgcacaggctggagtgcagtggtgagatcacagctcactgcagccttgatctctcaagctcaagtgatcctcccacctcagcctcctatttttgttattttttgaagagatggaatctcagtatgttgcccaggctggttttgaactcctgggttcaaggagtcctcccacctgggcctcccaaagtgctgagtttacaggcatgagcaaccatgtccagccatcgtatgtttttgaccatagtaaacccttttgtaccagaattatggaatgattacacaagggagagttagaggaattgaatattgaaaggacagagtattactaaacattaagtgaaagagaattaatggtgtcacaattctgctattgtacttctaattgccttattttctgtttaatacttttgaataggatatcgaacgccaagttagagaattgaaaacaaaaatttcagctatgaaagaagaaaaagaacagcttagtgctgaaagacaagagcagattaagcagaggactaagttggagcttaaagccaaggatttacaagatgaactagcaggcaatagtgaacaaagggtaagttaaaatgctaaaaatgaaagatgtgaatgttcaggtgagtagcaactgtagaagacagccctttctgtgactggtgtgtgttggaatttttttttaagctttgctacgttagcataatttgtactcaagtaacaacttggtactgtccctttgtttcttacattaaaaaagagtttcatgttacaggtgggttttctcatgaagtttttttcctgagaaaacatttatgctagacctaaattatgcaaaaaatttaaagcagtttgcatttttactttgtttacagaaacgtttattaaaagagaggcagaagctgcttgaaaaaatagaagaaaagcagaaagaactggcagaaacagaacccaaattcaacagtgtgaaagagaaagaagaacgaggaattgctaggtctgagaactttcaccaacactttaactttctacatcatattatgtaaaactaggttgtccgaggagctcaattatatagtagctgctttttacacttaattctttttgtatctttttgaaaaatggctttatgtttctgtgtgcagttgacattattggttgcaattaaacttggttattattctccttttcatcccatttgcttctattttgtgtagattggctcaagctacccaggaaagaacggatctttatgcaaagcagggtcgaggaagccagtttacatcaaaagaagaaagggataagtggattaaaaaggaactcaagtctttagatcaggctattaatgacaagaaaagacagattgctgctatacataaggatttggaagacactgaagcaaataaagagaaaaatctggagcagtataatgtaagaacttctatagctgctttgtaaaaatctttcagaagagataaatgtgtttagttttatctacttcaagttttctttttaaataagtctacatgttgctcttaaaatatatgacagatacttatttagaaaaggcctgcacagtttaatatacatatagttcttttttaaagaatattcatgtcattgagcctttatgtagattaagtatattaaaatgtatgtatgtatttttaatttttttgagatagggtcttgttctgtcacccaatctggagtgcagtggtacaaacacaactcactgcagcctccaccttccaggctcagcgatcctccatccttagcctcctaactgggaccacaggcatgtatcaccaggcccagcaaaatttttatttatttttttgtagagacgaggtcttgccat

SEQ ID NO: 62878 - DNA, 2795 bp, Homo sapiens
acgcctgtaatctcagcactttgggaggccgagacgggcggatcatgaggtcaggagatcgagaccatcctggctaacacggtgaaactccgtctctactaaaaatacaaaaaacaaaaaaaacaaactgaaattggatttttcaacagcatcattgaggtataattcacatacagtaaattgtacatatttagtgtacatcatttttcctagtcaggaaagtggcaaaaataaagtatataatttgatgagttttgacatacgtatacatctgtaaaacaccacacagttaagacaccacacaccacagttaagacaataaacacgtttattacccaaaagcgttttccatacccctttgtaattcctccctcaccttttgtccgcctcccccatccatctgcaaccactgatctgctttctatcagtgtagattagtttcatgaaattgaattttaaatttatttttatttccatagaaactggaccaggatcttaatgaagtcaaagctcgagtagaagaactggacagaaaatattacgaagtaaaaaataagaaagatgaactacaaagtgaaagaaagttagtatagactaaaatgtgcattaatgttttcagtaatgttcgttactagctgttatgtggtctttaagttacaagttaaccggtcaggcttgttttctgtattttgattctaaactgtatactgttaatgcatcctcatatgtgtttaaaattaaagacagtctactttttatttattagctacttgtggagagaagagaatgcagaacagcaagcacttgctgctaaaagagaagatcttgaaaagaagcaacaacttcttagagcagcaacaggaaaggtgggcaggttcttttcatcacctctgtttacactgagtcattgagttaatcgttatgtaataattttttacctttcaaggtgtaggtcatgggttccaagtgataaataggagtccaaattatcttctaaatatgaaatgatagagattaaatagttttattactacacatactattaatagcacttttgatgttcagataaagagcccatttttaacactactgttatggaacagagcctatcatataaggtgttacatgtagttggcatattgtgaggaggtgatgtgtttgttggagaggatgtttagtttaatcactggtatatttttaaaatgtatggtgttgtgggctcattccttaccaggagtgccattgatgatattattttaatatttttcatttctgacaacttacaggccattttaaatggaatagacagcataaacaaagtgctagaccacttccgtcgaaaaggaataaaccagcatgttcaaaatggctatcatggtattgtaatgaataactttgaatgtgaaccagctttctacacatgcgtggaagtcactgctggaaacaggttaaagcttttgcttgatatttagcatttttagaagagggaataagaatagcttaaacaacttttgtagtttttgtacaacatatcttccattatctttttatatctcggttccttaactttctaattaaagaagtagatgctaagtatttgttcctaattatagaagctagaactttcctcttttgggagtttctccctccccgccattggaatttttaaagtagtcttattttccaaaattatttggattatataggaaaaaactgtttgatgcttaagtgtttataacattttaaaagtgcacacctttagtcccagctatgcaggaggctgaggtgggaggattgataagtttgggcaacatagggagaccctgagtaccaataaagatttgtcttactctgtttatatttaggttattttatcacattgttgattcagatgaagtcagcacgaagattttaatggagtttaataaaatgaatcttcctggagaggttacttttctgcctcttaacaagttagatgtcagggatacagcctatcctgaaaccaatgtgagtcattgtgtgataaggtgtatttctcttttataatgttattttttatcacataatctaacacatgctagtgcccaggcactatacactgggattcagtggtgtatgagataaaaatatctgtcttcccatggaccttagtgctgagtgggttttggggagggagacagaagtcacagctatgattggtgtggtgatgcacgcctgtaatcccagctacttgggaggctgaagtgggaggatcatttaaaaagaagagaaaaaagctaagatatgaaacaaatcattgcaaatgtgcagtgttaaaagcgtaagtacaggatactttgagagcatatctgggagtgacataattaaggttagggagttggagaaagattcccaaggaactgtcatgtatagtttaaaagtgtcttgacgtacttaggattaaatgaaaaaaatggctagtaaggtgatagacttcggaagcataacattgcttttgttggtaacaaaagtgcactttaggtggattaaaaatattcttcagacaccattcttagaacagtgtaattgctttgaggtacttgacttcagaatgttgatggtagcatcaactgttttaccatcctctgaagttaaagctgaaaccccatgagaatgatcaataatttaagtggaacattaagaatcttgtaagctatcaaagggtctgactttttctgctatcacatctacaaattgtctttgaagtttgggtaagaaaaattgagtctcaaaaacatgatgtatgaatggaacga

SEQ ID NO: 62879 - DNA, 1640 bp, Homo sapiens
aaaaccctgtctctactaaaaatacaaaaaattagctggacatggtagtaggcacctgtaatcccaggtacttgggaggctgaagcgggaaaatcgcttgaactggggaggcagaggttgcagtgagccaagatcatgccactgtacttcatcctggcaacagagcaagactccatctcaaaaaaaaaaaaaaattttatagaactgggaagtgcaaggaagtgattagcacagtcatggcagtggtcgtttctcgcaggtaaccactgtaggtaactgctttgtgattaggaaaggagcacacccatgacttctggggtgtcagcagtgctctgtttcttgtggttatgttggtgttctattaatttacactgaatacttaactacatttttctatatatgggatatattttcataattttaaaaaccctgttctaacagtttaggagagaggaaatgaaattttatctgacaaaatattttcctatctaatttagatatataaaatatgtaaaattaaaacattttgaggaagtactatttatatttagcccttttatgtgagagatactatcgtaagttttgcatatattaactcatttagtcttcacaactttataaggaaggtatgtattgtctacgattttgtagataaagtaactattatctgaggaagttaagcaacttgtccacagtacacatctgataaatggtgaaacgagtgtttgaatttgggcagtctagcttcagaaccactaaactctttagcactattaggctctactattgaaaaccttgattacaagagcaaaattaccaggatattctagtggaatgagtcttctaactacttcagggaaaacgccaatcgttttgaaatataatggtgtttatggtttatttgtatttcataaagatgtaatttcataattctaagttcttagttaactgtgttgtgatctctctgttgacaaaatttcatttttaggatgctattcctatgatcagcaaactgaggtacaatcccagatttgacaaagctttcaaacatgtgtttggaaagactcttatttgtcgtagcatggaagtttcaacccagctggcccgtgctttcactatggactgtattactttggaaggtttgtaatactaattcttagctttaaacagataaattctaacaaatcatttaaaacatataatctggctgggcgcagtggctcatgcctgtaatcccagcactttgggaggctgaggcgggtggatcacctgaagtcaggagttcaagaccagcctggctaacgaggcgaaaccctgtctccattaaaaatacaaagattagctgggtgtggtggtgtgcacctgtagtcccagctactcaggaggctggggcaggagaattgcttgaacctgggaggcagtggttgcagtgagccgagatcacgccactgcactccagcttgggtgacagagcgagactctgtctcaaaaaacaaagagacatataatctgtataatatgtcagttgagctgtatgcatgtctgattaatatatcttacagtattttggagacattctggttttgagagtattcgaaaaattcatcctttgcctttggccgggcatggtggctcacatc

SEQ ID NO: 62880 - DNA, 1098 bp, Homo sapiens
actggaggttcttttttttttttttttttttttaaagactgcaaattttggctgggcacagtggcttgactctgtaatcctagatacttaagaggctaaagcatgaggatcacttgagggcaggagttcgagaaccgcctgggcacatagcaagacctggtctctacaaaaaaggtgtggtggtgcacacctgtagtcctagccactcaggaggctgaagcaggaggatcacttgaatccaggagtttgaggttgcagtgagctatgaccgcaccactgcactccagcctgagcaacaagagcaagaccctgtctcaaaaaaaaaaaaaaaaaaaatctagcattgaaaagcaaaattttttcagggtggtttaaattactttcaattctcattatctacttaaagcctgtaggttagtttttttgttataagtcaatttatcattgaataaaaaagttgtacagacctattacatatgttttgtttataggtgaccaagtcagccatcggggtgctctaactgggggttattatgacacaaggaagtctcgacttgaattgcaaaaagatgttagaaaagcagaagaagaactaggtgaacttgaagcaaagctcaatgaaaacctgcgcagaaatattgaaaatatctttttgttttgtgcatagtgatagatattgtgggggaagaactgtgttttggttgccatatataatcttttgttttttcacatattaaaaatttcttgtgttttaagttcaagagcttatgtttgtttagcttttgaagactaaaagctattttaatgattctttgcttaagtgttaagtagctaataccatgaagtcacttggaagaaaagaacccatagaacacaaaaataaaggttgtatcaggcaaagaaagaggaaactgagaaggatcagtttgtgaattgtacaagtaaaaccttggtagtttttttttttttcccttcttccctgttgaatttatgtaagcaagagatactgttttaaggaagagagtgggggcggcatcagtaatgttacatattgcttagaagtcaaatatataaggactggcattttattgtacttgt

SEQ ID NO: 62881 - DNA, 3568 bp, Homo sapiens
ggattgcaggcgtgtgcctccacacccagctaatttttgtattttcagtatagacgggtttcaccatgttggccaggctcgtctcgaactcctgacctcgtgatccacccaccttggcctcccaaagtgctggggttacaggcgtgagccactgcgcccggcaactttttgttcttataatatgcctgaagatttttgtatagtttaatcatggaatatgatctgccccaccctgccccacctatactattacatcatatttttcttgttgctagagtcctaattaccaaattaataggcacctaatatttgagttgatatgtctatatatttagctcaatcaaatatagattgttttaaaattttcactataagtaatacagtggctaataccttactaataaatggataatgtcatatagcaacgtagcttacagagtttggaggcaagcttgcatgctatggagtctaccagagagtcattgaaagcagaactgggaactgatttgctttctcaactgagtttggaagatcagaagagagtagatgcactgaatgatgagattcgtcaacttcagcaggtaagtagacagctgactggaaaaagaattcgttagtaattggctattgtgaaaagggcctttcttgctaactagggcaatatgaaagaaaagaactgagaaaatattaaaatgaggcttggacttttaatatacataggagtaaataagattttgtttttctaaaccaatctagctaggttaggattatacaagaaattttcatttccttaaaatttagttaattagcattacttattagttgtaagtattgctatgagtttgagcttgttagccttaccatatttatcttactgcctttacatatttaatgttttgatcaagcattttaattgatttttaaaactgcatagatgtaaactaccaacaccgattctaaaaaatgaaaagcatttaaagaaactgtttttgacagcatgcgttataaaaagggccagccacaaaaatttaacattatgaattgataagagaaaaatgaagaaagtatagggcttttttgaagaatataacatattaaacttcatttcagctcacatgagcacaagtactagagaggacagcaaatgagcaccattcctgtgtgtgaaatgtacatgcttatatagacaactttttcttaattctaggaaaacagacagttgctaaatgaaagaattaaattagaaggtattattactcgagtagagacttatctcaatgagaatctgagaaaacgcttggaccaagtagaacaggtgtgtatgtgtttttttttttttttttaagggctccttggtggccatgacctattgcaagtggttatatcagaggctctgattgaaagcatgggctttggggacagaaagcttagtgtcttgtgggccttgggttggaattctgccacctagtgtgtgattttggacaagtcactatttctaagcctcagtttcttgtgtgaattaagcattatcatacttgttttatataattgctatcctgacacattctaagtactttgttaatattttttcagtggtggttagatgcttagaaattttctagtaattgtgtcttttttttcttccctttaatggatacttctaagtatttgtaattatatgatgtatttatatttttttgttttcttgaatgtttattcagacaatagccatagaaaatgttggcagtcataacatttgaaactaatggaatttgtattttttgttacaggaacttaatgagctgagagagacagaagggggtactgttctcacagccacaacatcagaacttgaagccatcaataaaagagtaaaagacactatggcacgatcagaaggtgaatttttatgtagtaaaattttgtttatatgcatgttttataaaattgtttactacagaatgaaatgtccaaataggcagaagcatatgctaatgattttttgttttccattataaacaatgtatagcaaatggaatttaggaagttgactataaatagtaacttttgttttactgaaatgtttatgacaattttgagaccataaatgattcattttgttgataaaatatgaaatacctgacgaaagtttctcatcacttagttgttagaaaataactatagtttataagcattaacattgaataatgaaaattatatatttgagtgactcatatatacttctaattttgtactgacttaacatggttcataaattttcacagaaaattttaaacacaaaacctaaaacctattttggtaggtttgatcataaaaatctatactcaacatataacactggctttataggtattatagcctaattttgtttccccccatcttagatttggacaattccattgataaaacagaagctggaattaaggagcttcagaagagtatggagcgctggaaaaatatggaaaaagaacatatggatgctataaatcatgatactaaagaactggaaaagatgacaaatcggcaaggcatgctattgaagaagaaagaagagtgtatgaagaaaattcgagaacttggatcacttccccaggaagcatttgaaaagtaccagacactgagcctcaaacaggttggttttaaatttgaagtcttgttacaaattgctcagtatataaatttatttatatgaatacatattttctctttatagttgtttcgaaaacttgagcagtgcaacacagaattaaagaagtacagccatgttaacaaaaaggctttggatcagtttgtaaatttctccgagcagaaagaaaagttaataaagcgtcaagaagagttagataggggttacaaatcaatcatggaactgatgaatgtacttgaacttcggaaatatgaagctattcagttaactttcaaacaggtatgtttcgctttgtagttaaaacatacacacagaggacaaaagcttccagctcttttcagtttgtaaagattttaaagctgttttcctcattaccaggtgaatctaatacatgtgaacaaacctagcatataggtttacagtaacttgaatgttttacacagcccttagaaggatctagtctgttatccttgttcttaagattaaaaaataattggttgcttttaaatattttacttaagtgttatatataattctaagcaaaatttatatttcaatctgcttttgttttaaggtatctaagaacttcagtgaagtattccagaagttagtacctggtggcaaagctactttggtgatgaagaaaggagatgtggagggcagtcagtctcaagatgaaggagaagggagtggtgagagtgagaggggttctggctcacaaagcagtgtcccatcagttgaccagtttactggagttggaattagggtaaaatacctttatattccattttcctcagagcattaccataatagaatttatagtatcttttgcaaatctgattggtgcattatatgcaagttacttttgaaagatggtggtgattctgccctttaggatat

SEQ ID NO: 62882 - DNA, 1148 bp, Homo sapiens
accactgtaaataaaggttttataagtcagtgcttcagaattattttccttcatatgtaaaatataggtgataggccgggcgcaatggctcatgcctgtaatcccagcactttgggaggccaaggcaggtagataaccaggtcaggagtttgagaccaacgtggccagtatggtgaaacccccgtctctactaaaaatacaaaaattagctgggcatgctggcgtgcacctgtcgtcccagctacttgggagtctgaggcagaataattgcttgaacctgggaggcggaggtagcagtgagccaagatggtgccactgcactccagcctgggcaacagagcaagactccatctcaaaaaaaaaaaaaaaaaaaaaaactaaaaattaaaaaatgtagttaaatgtagttgataggctgtatatatttaccctatacaatgtaaacactgatgtaattaacagatttttgtttttaacatttattcttcaggttagtcatattgatgtgatcacagcagagatggccaaagactttgtagaagatgataccacacatggttaattggaaaatactacctactggtttgggagatgtatatagtaatatgattctcatacccaggaactgtaaatttaaacctaaatatttggccaatagttttcagacttaaagcatcatagtccttttatatttgtctttgtattttataagatactctgtaatgtcatgtttgtactgatagtttaagaatttaatttcctgtacaactttttgtaaaatgttctgctcctattttaaatgttttgaaacatgctaaatattctttcctaattattttatcacttatactaccttttttatagcttcaattaaataatcggttttatgactaatatagtgttttatgtggcttttcatttgtcatagtctcttccagtgagaacactaatcagattggatgtaaggcctcattttaacttaatcacctctttaaaagacctgtctccaaatacagttaaatttgaggtattgagggttaggacttcaacatgtgagtttgggaagggaagcacaaaatcagcccctaccatggtatatttatcattgatacattactatcaactaagctcaagattttattcagatt

SEQ ID NO: 62883 - DNA, 1468 bp, Homo sapiens
cgggaccgcccctcccttgagctctctcgccgcgatcccgggcgggtctcgccccgcatggtgctggcagcagccatgagccaggacgcggaccccagcggtccggagcagccggacagagttgcctgcagtgtgcctggtgcccgggcgtccccggcaccctccggcccgcgagggatgcagcagccgccgccgccgccccagccaccgcccccgccccaagccggcctaccccagatcatccaaaagtaagaagggagaagggaacagggaccacgggtgcgcctggggacacgccccgagagccccctttgtggcttcatttcccgtccctgctgaacttcgctcgccccccttgggtttgaagttttctcgtaccccctctgggcagagtcggtgtccttctggctgtttgttaggctggaaagaggggagccaagttctttagggaaaattattttgtttttccttatctcctttctcttctcttcaggaatggtactagatattttgaactaaaatagctcagattggggggaaatggcccagcgactgtatttcatctttctggtcccaagaggacgctggaatggagagtcgtgcgtgagtgtgtgcgcgcgcgtgagggtgtgtaagtaaaatgccaaaaattaaaccacccttcatggtgcccctgaaaccaaccagtggaaagggaggtgacagtttgtaaacaacatgttttactttgccctgaaagtgtagacacttttcaagaaggccttttcgaagagtttagctacgcaaccgttttccattaatgttaccatcttgtgactcgggtgacctgtgcgacttgggtcgtgaattctcaggtcggccttcccaatgcttgagaaggttgggggtggttaataagccccgagaggctctttcagcccgtttgaggaacatacaagtaaaaacagtgatgctttgtattgtttgttcttttgagatttcgtgtgaccgtttaaggcctagaatgttggtttatttgaaggatctctgctctcctaagggtttacccagtttgtaatgaagtcttcaaaactagtttaataagtgtaggaaagtgaatgatgcgcacctctgcgaaactgacaacactaaataaatacacgcaagtacagcaaaatttacccttatggaacacagcagaggttttctgctgctccgctgatgctttgagtcctgtaaatttaataaaacttagtaacagaaagaaccagtgatgggtgtaaatggaagtaaatagcagttaagtatttattgttttgaagactgatttatctaatagaaagaattgtgaaaattcaagtttaacattagaaaacgctggtatcatatttcagaacaaaatggttccctatgttgactggtggaatactgagtctccacttgtgacaactttttgctttaattggatattttatataactttcaacta

SEQ ID NO: 62884 - DNA, 1178 bp, Homo sapiens
taaagtttacttagtgaaaaatccaatttggccaattattaatttggaaacatctgatgtgcttcgtacggagccagtgtcttgcggcttgaaatcaggctgcatatgaagttaattgaaattgcttcggtattgtaattaccctgcacttttctattacttacttttaagtagaagaaaactgggaactttatattcacagaaaagtctttgtagaagggcgtctgattatgaaatactgccaggttgaaaataaatatcattttatggaaatggatcatttaaagtatattttatttgcctcacataataaataatttaccctctaaattcatcccccattttgaaaatcccatctttggaatatctaattttaaaagaaaagactcagcttttcaaagatggccccttctacttgaagggcaggatggagacctcaagaagcgcctcatggctttgcttgctttacattggtgacggatcagtgttcagggaccaggtcccagggctgtgaatgtgcccataggatttgatgtttgcgcactgacgtttcagtctttctttacaaggatgatttggagcttgtgctctccttagtacccactgaaattccgctggaaccagatataatgtcgcaaacgctttgtaggtccatcttcaatgcgccgaaatttgagcaggttattttgaaactgcatttgcataagtccatctgagcaaacatttttatggagttatgaggtgtggtttgcatcagccatctttgagaaaatatagtggagctactgtgctcggctgcaaaacaagttgtctgcctgttgatttggggaattttgtgagctacagctttggatgaaattctcctctggtggaacacatattaaatattattagagaacctctattttttctagttattttagtgaggtcgttatgtaactggtaagaggagaagttttgattgctttcaaaatgatggcgacatcaatcttcttcatgttgcatagtgcgtttgaagattacaaacatttttccacttactgtctatgtttactgatttttattagtaatggcttttattttagatcaaagtcaatgactttggaaaaaccatagtaacaattataataaaaatcagttcctgttcacgttatatttggtgtttagagaactgccgt

SEQ ID NO: 62885 - DNA, 1096 bp, Homo sapiens
atttggatcagtgacataattttaaaagtcagaaaaataaacactaatgtcagtgaacaggaaaaggttttatactgttcttcaatctctaaaaatgtttttggtataagaataattttttggaatgttaaagtaagtactttaacatttactttaacaaactgaaagtagcactttcagcttgggagacagagataataattttcatgtgtctgaattggattgtgttaaacacaggccaacaggagtgtgtttggtgacatcgatggtttcagagtcagagaatgtaaacataggacccacaaacgttttacaggagcacggctgtggctactgcagggactcctgaaccgtgacgcacagtcagttggccgcagagaccagcctggagctcgccctaaaacctctttgcagccttgcagatgtcatagttgtcccaaagctgggcctcatgcttccgtgtagcctcactgaatcaggagaccgagtgtttccagagccaggatgtgggcgctgtggggccagtgctgcatcctcctgcgctggcaatagcagagttgtggagaaactttatttggtatttgaaatgatcaatattttaaccttctgcataaaaagagagagaagtctgtgattaaatcttgatttaaagtcttcaaatatgtacatacatgaggatgaacataagcatatttatttcaacactgtctagaaaagtgaaaattagaaaccacttaaatgtttctcagttggaaacataaaccatgtgtaggtataaggtcatgtactactcagccattagaatgatgctgctattttgcattgattgatatggaaggagaaccatataatattaactaaaaaaattacaaacagcatgtatgcaaagatctcatgtttgtttttgaaaagatgtgtatgagtgtgtgctggtgcctgccagccttaaaaaacatctgaagaacaaatgtaaagaacattaacagtagttctaactctgggtggggcaattagactggtttgtctttttttcttcctttttaatatggtctatttttttaaaattcagtgagcatgtattacttttacaataaaa

SEQ ID NO: 62886 - DNA, 1035 bp, Homo sapiens
ctcctctcaccccatcctgctcacccacccacacgggacttttatgggagtggcagtagactgggtctctcctgggcatctcatgctctgttccttcctgccaaacagaagccaaccatcacattttcttctctgctcttctttgttcaaggttactctttttccccagatccttaatagaggaaaaacccagtacctaccttcctttcatacccagaaacgtcctcttaacaccttcaagctgtggtttaaagatgaaccttttgagatgtaaaagcataactaatatttaaaggaaacaaaacacattttacttcttactcccaagccagttataggaatgcccattattatttctgccaccccaattcccactctgcttcaaatttgtttcaaccaaggatataatttggactgtatttttaaaaagtaaaccttgctttgcggggactatatttgcattcttgcttgcccttgagtgtgctctctcttgctttttcttttcctgaactatttgaaagtaatttgcataactataattttgttatcatagctcaggaaattagtcttatttaatttttttctaataaacactaggtttttaactttcatttgtcagataatctctcatatagctgatttttttttttttgcatttgtttataatgtctttctctttttttgagacagggtctcactctgtcactgaggctggagtacagggtgcaatcacagctcactgcagccttgacctccctggctcaagcaatctcccacctcaaccttccaagtagctggtactgtagacgtgcaccaccacgctctcctaatttttgtattttttgtagagatggggtttcaccatgttgcccaggttggtctcgaactcctggacttgagcaatcctcctgcctcagcctcccaaagtgctgggattacaggcatgagccactgcaccagccatttcttctttttaatctaccaagtatacccacctctttctactttccaatactgaagattacaggctagttg

SEQ ID NO: 62887 - DNA, 1014 bp, Homo sapiens
aaggttcagactgcatggaaggcctttccagatctgccccactcagccctccagctccagaacttcctgtcctctcttggctgccctctttccctctcctcaactagaacattctgaattctgcttagacctcacctcttccagggagctttccccaaccctaagcaggaaggagggctgagtgaccctcttcctgtaattgtctgtggctcccatagtagcatttgtccgtgctctcctcttgcttgtctcccataaagaccatgcaaagtccttgcagtcaaggccactgccactcacctttgctatcctcatcacctagcagagcccctggcacatagtgtgttgaatatctgggaatgaggaacttaactgcaactgaactttcaatctaactgacttggtgatgagaaatactagtcaggatgctctcatgggtgagacctgatgtgacgccaaagcttggttttctccagcttatgttttatttggactgcctgtctgaaagggctagacagacatttatgttcagagaggccatataagaagaatataaatgcggaaagtcataaacttcagctctgctctgggctccactctcaagccactgtgtgaccagaggtagcacttagcttcttagagtccacatgggttaaagggggaccagggtatggggcttgttcaaacagtcaatgagatgacaggtgaacatgccttggtaggaaagcagtactgaatacatgtgtcctcatgtaagccagctttttgtctcatgctgtcatctccagccagaggccagattgtgtgcaggcaatttccaggctgaatttctgagagatttgatccaaataggataaatggtggaaatgaccactaggaacactccttaaaacctgcttgcatcaatgctttcaatgatacatttctgcatctcaaaaaaaagtttctaagccctaagctagcatctgcctatttcaagcaatttctgttcttttttttcttttcttttctttc

SEQ ID NO: 62888 - DNA, 1033 bp, Homo sapiens
tatctgtagattaaaaaggacttaaaatacttatcagcaaaatgtagtatataattcttgtttgggtcctagctcaaaacaaatctaactgtaacatgtatacatgcatgcatatacatatatatgataatctatgatatatatgataactaagatattatatttgaatagtgaggttaaagaattatttattcatgtattatttatttgattatgtgaacattaaaaagaatattatttattagttacttatttatagctgtggtaatggtattttgattatgttaaaatacagaagttggctgggtgttgtggctcatggtcgtccagcactttgggaggccaagatgggcagatcacttgaatccaggggttcgagaccagcctggacaacatggtgaaactgtctctacaaataatacaaaaaattagcccagtgtgatggcacaaagaaagaaagagagagagagagagagagaggggaaggaaggaaggaaggaaagaaagaaagcagttatactctagggttgtatactaaagtatagattaaatatgatatgtctgggattagcttcaaaataatgaaggggggtgcaaaataaacaagattggccatagattgataatttttgaagctgggtggtgagtacatggaaatcattatattattctctctacctttgtataatttgaaagtttccgtaataaaaagttaaacagaacaagacatcagctcagccacttggccagttctgttttcagatgtccttaaatttaatattgggctgtggagccgacagacccttcttaaaaatcacctgggggctgggtgcagtggctcatgcctgtaatctcagcactttgggaggctgaggcaggacgattgcctgaggccaatagtttgagactagcctgggcaatatagccagaccccatgtctacagaaagtttttaaaaaattagctggctgtggtggtacatgcctgtagccccagctactcaggagactgaggtaggaggatcatttgagccc

SEQ ID NO: 62889 - DNA, 1049 bp, Homo sapiens
atagaccgcattcctcccactgtggccttattgggccctttctgttgccaccatcctgggctttggattgagagagatctgggttaggtagcacagcctgttacttaggatgtgtgtggtcttactgttctgtgccacagttgtttcaaccaacctcatttggctgttgtgaggatgacatgagattgtccatatgatgcttaccacagtgcctggcaagaggtgaggtctctgatgttcatttagaaaagaagactgcagtgcattcaccaagatcctaagaatcccaaggctgggccggagcttatgtgtttggacatccctgtgacgtgggtacccccactgaaccccatgatattctccagcactttcttggggaccttgggccaccttgcctaagtttgggatgatcatttagcctgaatgaggaggctcagtgctctaaggatggcattttttctacctggctccattttattttgtcatgtggcttgatgggcatggacagtggggaagatcctgcctcggtgggtgaatgaaaggtaagtagctagatgactagaagccagcttgaactttgccagctttgagattggaaggaaaaggtgaaattgcctgctcttcctgaagcaagcaccacattttctctcctttctaccttgtttgcctcttacagccagaacccagcccccttttcatcactaatctcgtaacacacagggcttcatcctggcagtgtcgatcttttcattagccctttaagaatgactggcaaatgcacttgtttgagtcatttgatcacctgggaagtgtctgggagccatgccttggagtgcctcactgatcacaaagccatccagtgtggcctttgattcctgggcccctggtgtcctgctcactttaccccccatgcatgtgacctgcccactttctggggcttgggtgtgagtgagtggtgcagggaagctaagccagagggagccctgatttacgaactgtccggatttaactgaggctacagcacttttattaatagaacatgctgcatt

SEQ ID NO: 62890 - DNA, 1032 bp, Homo sapiens
ttttcatgatggcattggcgctgccaaagaaagtcactttcccatgccaggagaaaagaccatctctcctgtggctgcctcgaagcccccaggcctagaaacgtctccaatcaggaaacagaagcctccagtggatcatcttcagggatcgctggagaaccacgtgggcatgtacacatacctcctcactgagctgacttacccaaagttattattcacctactgatggacaatgatggttctagtttttctgtcttatcaatactatagtaatggctttcttcatgcatgtcattttggaatattttctcagaatgggattattatttctaagcgtatgaatatttttattgcttttgatatattagccacattgctttacaataaagttgtacctgtttaaaaagttagcagtaacataggaggatattggtctcacaataactaagcggaaccactctgcccagctttgaattccagcttgacacttggcatttaccagctgtgtgaacttctgcaaagtatttaacctacctgtgcctcagttactgcctctttaaagtgggagtgacacagtacccacctcataggtctattattgggaatgagtatttgtatattgctcagaacagtgtctaccaaagtattatgcattgtgcgctcgtgaaacaaacacctctccagctcaagattttttttaaaaaactaatttaatagaagtaaaatgacactgtttaagatatatatatatatgtatatatatcgacatgcttattaaccgtatttacaagaaacactccctttaaatctctttattggtaaagatatcttttaaaatgttaatttacagaagagatccattctggtgtgattattgatattatgtaggaattctttttcagcttttacagagttgctatccctttagggtggagtctcatcaccaaaatatcacctgggacccgaggtgctgaggctcataatcagccacttagctctgaagacttcaaattcaccccagagggacaaact

SEQ ID NO: 62891 - DNA, 1096 bp, Homo sapiens
atgagcagacttgaattacataacctgtagctgcacatttttgtcgtgaccacgcaagctcaataatgtctcccaagtcttgtagatcactttgaagctcactggattaatggtgttgaatctgtttaatccaaataatttgaattgcatcaggaaacctgcatattaacaagctggtaataagtgcaggcgttaagattgatcactgcttaagtcttcaagatcacatacaaggtctggtgtttttgaggctgtcgatgtactatattttttagattctttcttgatttcattctgcactcttgacatttaaaataatttaaatcaataacttcagaattctcccaccggaggatatgcctatttgatgtgattgtgtgtctgtgtgtgtgcacacactagctctgtattattgcctatggaggacatagaaatatatcatatactgtcctcaaggagcttgcaaccaagttgtggggataaggcaaacaaagtcaaaatatctaatacacgttccaaggcaggatgcaattctgtatccatggtacattgctgattgctgatgatgctctaaatgctgactctaaatggtggactgcaatttgtctggaagaagaacaatggatcatctgtgtttgggggagacttcatggaggtgggatttgggggagccttgaagaagtgagcaagttttggataggtggaagtgaacttactggctatacccggaaaagagcaggatgggaataaaggaaaagagagcctgttttggtgaataagtttaatattgaattgtgatagtcaaaaaaataggtaggatgatgggctaggtttgggaggaggctccaaagttaagaagcgaggcttatccttgagatcatggcctttaccacaaccagcaccatcatcattatgagcagctgtgtcttgcattcttataatgtggttctgaggactttacatgtagtatcttatttaatccccaaacaaccttatggaacagataacaattgttatgtccactttatagcagaggaactgggatataaagaagtcaaccaacttccagcgggtaaggtatgtgggcaagcagggg

SEQ ID NO: 62892 - DNA, 1027 bp, Homo sapiens
ggtcttgcctgagccagtgtcactcacagtggaggtccctggaccagcagcatcagcatctacttaggaatgcaaattctcaggccctgttccagagccaatcagtctccttagtgggcccaggaatctgtttttaacaaagcctctggtgattctgatgcctgcggaagcgtgagccacactgggctagagtttctttggccagggaagtgatttaagaattgtacgcatccttatttcctctcctcagtaggaagtcaccatagctggttgcaagagaatcgcattttaaatctttagatgtacatgtccccaaccctactcccccaggacttcttacccaggactcagctagtcccctggcttttttttctctccagatctcatgtttccagattctgtgctcagtcacttcttgggaaatacagatggggttgggagggaggcatcctcccctttgctgattgctggaggggattgagctgtcacgtcagacctctgctgaatgcccactgtgtgcaatgcctgcaccacagtgagcagtgcacagtcctcatccccaggacctcagaaactccaagggtggcagaccttggaagtgatgaaggtggggatgaagtggcactcactgggctggatctaggagcacccagatgggccaagcgcaaccgtgggctggggtggagtaggagggcttcctggaggaagtactgcctgggccatggctgatagggcaagtgagtggcagcagggtaaagagagggagagccaaagggaatttgaggctgaaggagcagcacagcttaaagcacactctggagagggtttcgtccaactctgggggaccttttttgctttttatgttactagatatagtaaagtctgcaactcttacttttacagcttgatgaattctcaaatgtgtgctcatccctgttaccaccacacagaccaaaagactggagatttccagcctcccaaaagggagcccatccacagctccctgccaccaaaggcaacccccatt

SEQ ID NO: 62893 - DNA, 1087 bp, Homo sapiens
ggctgttccccactgctcactcctagccagctgcacttttgttacttgcctggcccacttgggcttggcccatgagttttcaatccctgcctttaaatatggttttgtttcttagtttggggcctcctgcatgactgagggtgcttagtaatttccttggttcactcttcagtgtgtattgagcactaactatgagccaggcccatgccaagagctgggatacagaggtgtgcccaggcagagggattgaggtattgtttgttgtttgccatgcaggcagccagaaatgtggcacagtcctacctgcatgagttcacttctcaccacctccttggatgccacccatgctggttgtttcctggcccctgagcccaccttgtttcatgatcatcacacatccactgtcactatcccttcatttcctccctgtctggtcctcatccttccctcaagcttttgctcaagtctcacctcttccaagaagtcttcactgaccagccctttctcttgtgatgcctccctcccctgattttatcagcgtattccccacaccacaatcccatcaattctcaattatttattccctcacattgaagaaacaggggccttgtttctttttttttttcttttttttttttgagactgagtctcactctgtcgcccgggctggagtgcagtggtgcgatgtcggctcactgcaagctccacctcccggcttcacgccattctcctgcctcagcctcccgagtagctgggactacaggcgcccaccaacacgcccggctaatttttttgtatttttagtagagacggggttttactgtgttagccaggatagtctcgatctcctgacctcatgatccgcccacctcggcctcccaaagtgctgggattacaggcgtgagccaccgcgcccggcccttgtttcttatattagttatcacaggccctatgggcaaagacttcccctatacttcccagcattgctccagcatgccctgcacagttctgagcttatggcagatacccaggacacacaggaggtgggctgggaagggcaggggagcaccggaaaaagaggctgtga

SEQ ID NO: 62894 - DNA, 1035 bp, Homo sapiens
tgggtggctgagaaagactccgtctcaaaaaaacaaaacaaagcaaacaaacaaacaaaaacctctctttgcttctgccttatctgggaggggaaattttcagactcattgcaaaggaaatgtcatttaaatgtgaaaactgatgcacagagctgagtcattttgggatacctgtgtgagccgggggttccattttcctggtgacccttctcaactccgttcccagtggttctttctcaaaattacagattgtgaagaatttttttttttcctcctagtttcttccagcctggagttcacagtggggcttacttctcacctggtcagccaaagcttaactgaaaatctccaagagttcctgtctttagaaacccataaagtccggtcctactccctggtactgattctcctttttttctgaatggtactcgcatcagcctggaccacggggaacatgctgttcccatcatttaccccgtgtatgagccggagatttcactgttagtgttaagttacagtgccttgctggttgggagcttgccttttgaaaagttcaggtccagccctcctttgccttatcttgggaaatgactttctgctaaaataatttcggtttgtacatatgcatgtccatgcacacaccccagctccacaccatccagtgggaaagggagtcagggatttcatggtagctgtcattttgatgaatgtccctgtgtccacccacagaggccgtgacattcctgcctttcccacttgataatctgaaaatctcccaagcctgattgccttgctataggcctgcaacctggaatgctgcataggttctgagtttcaatccccagggtccgcactggccaggatctgtaagagcctgtgggcttgatgctgataaggcagagagctaacgggggattatcagagagggagagtgccagacaaggtgcattcctctggggatagagcagcaggactttgggagctgggacaattgtgtgaagcaggacgtgattgcgtggtcttgtttcagccagc

SEQ ID NO: 62895 - DNA, 1075 bp, Homo sapiens
ctccccaatgtgcccacctcttctttctgttttccagcctctgctgggcaaaagtgggaagttgctctcaagtgttaaacgtgttcactctcaccaagtggaagattttacattagaattcaatcattctgtttacttcctttaaagtcgagagcgtatcagctgagtgtggtggctcacacctgtaatcccaacattttgctaggcctaggtgggaggatcacctgagggcaggagttcaaaagtgagacccccccatctctaccaaacaaacaaacaaacaaacaaatttgctgagtgagatggtacacacctgtagtcccagctagtctggaggctgaggcaggaagattacttgagcccaggagtttggggctgtaatgggctcggatggcgaccgtgcactgcagcccggggcgacacaatgaggccctgtctctaaaaaatacataaatgaagttgaaagcatgtgaagtttatgattggctttgtgatcggaaggatgtgtcatgctttcccctgggtgttgggaaccttctgaaagaactgctgtcggaattcagggtcttctgtgcctgtccacccactagccctcatgggcgtaatgcagagatctcagaagggagagctctggatccagactgcttatgttggaatcatcttccacccacttactcactgtgtgccctttggacagttatttaaccactctgcacctcagtttcttcatctgtaaaatggaaattatggtacataccacatatgattgttagaaggagtcaatgagttaacctttaagtacttaaaatggtatctggcaattagtgagcaccatgtaagtgtttgcttaataaatattaagagtttggggtttggggtgggttttttttcttgtttttttttttgtttttttttttggttggcttaatacctttctaactgaaatttttgttgagataattgtagattcagatgcacttgtaggaaataatttaggccaggtatggtggctcatgcctgcaataaagcctcactttgggaggccaaggcgggtggatcacctgaggtcaggagt

SEQ ID NO: 62896 - DNA, 1178 bp, Homo sapiens
tgagtttttttcattgtttgtttggtttttgcataaagaaatgtttgatatcacatttgtcttgtccgtgtttcttgtgacaggccccagcactagtgtggcaatcctcaactgcaggcttctgaggacagaactgtgtgctgcctgcttcactctctctccaagctccttttgcaatgcaaaataaggtgtttaataaatgatgaggctggtgaaggtggtctgcagtgacagccttcatatttaattcactacaccctcattctttcctattctttagaagtactgttgggaccttcaaatctcataaatattctactgccctcctccccctcctcctccctcctctccagaaaaattccatctgtgcaaatcccattttgttccaagggtgataatcttcagggaaacttatggaatgtgatgggtttactggagttcctgggtgacaggcccccaagaacccccttcagttctgcagagcttactgtagagatgacatcaatgtcccctggccatctggaatgaactgagtgtgaggtggagagagtgtgggctttgaagtgtctcccacctgatttgaatcccacccctgccgttgactggttgtgcgacattgggtctcagttcagatcttgttcacttgtgttctgtagtggatcctggcatctgttgctccatctgcctgccacagtttcccatccctcttcctctggttttgattccttgaggggaattcctcatccacctcacatggtcctactgtggctatcagtcatggaatcacaaagggatcttcctcactcactggagtgggcaggtgacccaaagcgctccattgcactggccccactcactgtgcgagggaggagcctcattctcaagcaaccccagttagcatttctcctgggactagtgcatggagagaaacaatcccttttgcacatgggctgcctagaaagaatgtgagtctggggcttcgggcatctgttctgtttgacatgtggcaatatcctttgagaatgaagaaaaacagacaagcagcctgagagctagggcgggggacagaggcttggccacatggcttccacccttgcatgcagtgggcctggagtcagcaccacccctgacttcccaaggacagaagccagcacttcccctttttgtttcagcaactt

SEQ ID NO: 62897 - DNA, 1052 bp, Homo sapiens
ctccagagctggttcatggtgtctcaattcagttcatccccgtccccaaccctgatatttcttctagtgcagaatcagtgaccccttccctgccctcacccctggcgggggatgtgtaatgttgagaaggaggatgaggtgaaaccacacggtatagagccgggtgtatggctgggaggattgacgatgtggcttccaaatacctacccaaacgggtgtcttttggaggacgacactgcctctggataaatgatctctgggtacacagaggaggcatgcagtgatttgtggttactatgaatagaattgcccatgcagggctagctccttggggttctgtaccctgattgaggtcatggttaatcaggggtgcattctctttcataatccctggggatcttgcctggcatttttgtttagctggagaaatattggcttcgctctggccacaaatttcccacactggcgtggctcggcgctttctggctgccttggagatcctgatgcctgtgactttgcagaatgcccaggaactgctcgctcagctactttcactctcgctctaaagataatcgcctctaaagcaaggtaatggacatgttttatccccagcaattcggtttgcccttctggggtgcttctcaaaagaacagcctcagagatgctgacacgtgacttcagctaaccagcttgtgtgggtgtgatgtttaatcatgcctgtctttttcttatcttttcattatacctgcgaatgtctgttagccacatccattagatgcatttcttctcttttttttgtaaaaatcaaatcaacccctcccttccattggatgaggagataattatcatcattcactgaaggtcgacattctgtcttgaattatttgtctttgggcaagagcttgaaagaagcattgtaattccaacatatcttcttgattaaatctggtttttagaatgtcatagagtgtgataagagggtctcatttgtgtcccaggagaaactgattcgtgcttccttggatgagatgttgagcaaaaggatggtgaga

SEQ ID NO: 62898 - DNA, 1341 bp, Homo sapiens
gagaatatctttatgacctgagaggttaaaaagaattccttagaaaggatccaaaaaacacaactcagaagtgaaaaaaatgataaatttgactaggttaaagtattatgatttataggtgtataatataagattatggcctagaagtatacacataggtgttgcctctggacacagagtgaggggagagaatgggacaggggacatcagctttatccatcatgtgaaaaatgataaaaatgttaacattggttaatcctggttggtggggacacaagggcttgttacacttagaaatatttccatgtttaaaaaatttttaagacaacacaaagcaactaccaacctcagcatgaaaggtggaaactatcgttgtatagggggaaattgccaaacccaaaatcctgattgatcttatcactgccatcagcaagctgcgtccatgggtgaggaccttcctctcaggggctgtgtgctctggaaaacaagagggttggactgattactagcttaggtcctcctcccttgccagcgctcacattttctcttctctctgtggggcaggttacaactgctagaggagcagagaaggaagaacgcgtggggaagagcatcgtcacaagcattaagttctatccaagcatggggaaattgttttcattgcattcaattcttacttacccgacctcttaattcatagatgctgcctgatttcttttaagctctagaccttgctgttttccttgacagggtgaaactgggtgttctgtaatgaaatgtgtgctccctgacaagtggcagagattctgaattttctgggactgactaggagcatcatgctgctgacatcagtgtacctgcttaattgggcttcattattggtctgaaatcatgaggcctttcaggagccaagaaatacacctgggtatggtggggtgatgaaggaagggtgcgatgggtctctaaggaggtaccagtgttttaagcaaggtggtcatttgtgggctggtaatttgaaaatgggagttgtggaattctgctttacctgcagacctgctgaccacttctgcctgagttttctcatctgcgaagtggggcagactagagtgacgtagggcatgctttcctttttgccagcagagagagggctttgaaggtaagaggaaggtagtgtggttttccactggggctacatacttatagctatcactgctgtcaatctaagcagggagtataaccaatgtctccatcatcttaagtaatttgtgtgtgcacagattcttcagaccttacaggatgtctctgtaaaacctgtctgggtgctagatgacaagaaagtct

SEQ ID NO: 62899 - DNA, 1050 bp, Homo sapiens
accatatgtcctgctttagaggagtccacacgcccatacaaaatccagtaataggatgagatatatccaaagtttaaggcaggacatatggttcactctctgtgaggtggcctctttgagaagatgacagtagcactgggacgtgagtttgagactcagtcacatgaagatatgaagcgacactgcccagcagaaccctccacctgccgccgatgatatgtgctgtctagcatgataatcgctagtcacatgtggctgttgagcccttgaaatgtggctaacgcaactgaggagctgtgttttaaatttaatattaataatttaaatttaaatagaaaaatgtggcaaatagctatcctattgaacagtgcagatgaggggaaggacgtttcaggtagggagggcagcttgtgagaaggtactgaggatatgtcaccctgtggatccaacatgagatccctgactggaagctctggtcagtttttaaagagcaaatctggaaaatttaatgatgtttcctgcttctgttttatgggcctctggagaacctacaaaggaataacagttaaccagacaggagttaaaatccctgctcaacaaagaacctatttcctttcctaggaaggactcattccacattggctgactcacaactcttgactggtttcctctgctaatggctgtggccagcctttgtctgtgcaggatgtagccttttcggcgctgagcttgttcgttctgggaacgaatcctgcctttgttctggacttgcatcttctggtaacaagaggctggaacccctaccatggctccttcaaggtgtctctttgtattccacatacaactcctccatcatcctagggggctcagacctcatcttttctggcatagcttttctattttcctccattgcaaagatagagtagtcagccctggttttaaagagaaatcgctgtttagagagaatttcaccttgaattgccactttatgttgaaaggattaagaaagaaaaggaaagaagaaataagagaaaaagaaaaggccccagg

SEQ ID NO: 62900 - DNA, 1095 bp, Homo sapiens
aggctcatgtgaccagcaagatgtcacagaggttataatgataaaaccagacaaatgctgactctccccttccactgggtctgtagaaaaggcctccaaacatctgagttcatcttggcagatgctgtcagggtgcagaagaatgtggataccaggtgtggctggcctcttcatcttgctccatgggtggccaaggccagagaagtccctgtcacctgcaacgcagcctcagaacctcccaagcggcttgtggggtagggagagggggaggtgagaggggcttactaaagaggaggatcacagcaaggaagagacccctcagatcctcgcagagaggctgcagggcttagtggttacaaatgaggcttccagagctaggctgcctaggttcaaatcccaccacctccatttaccagctatgtggcctcatataaggtactaagcttctctaggcctcagtttcccaactgtacaataaggataataatagtatccacctcatggggttgtctagaggactaaatgagctaatacaaaacaaaaatgctaagaacatattgagtactatataaatgttggctgttgtttttattatcatcctacaatgactggggctctctgtcccctcctagctcccaaaatgttagctctctgtcccctcctagctcctcgcagagagctgtcccctaggtctctgtcccctcctagctcctagcaaaatgtttcctgcgttgcttctcaccaggctcaagccagataaactccccatctctaggtgttcggaggaagtggcactcagagcttcgaggaattaattagaatcaacacacaaatcatcagatagcttgtgcttgcccactggtacgtaatttaaaagtacatccatgggaacctcaaaacatctctaaggtggagcaagtgtgaccctgggtattactagacagatttgtgtaaggggaacactgataccaagactcggacaaaatcctatggccagcagacagagccagccttagacagcatgggtttccccccgactcttcacagccaaaatgggttaaaagcgctcgttactcaagaacagccatggttact

SEQ ID NO: 62901 - DNA, 1028 bp, Homo sapiens
cttgagttgtcctttcagtctggaggagacaatgagagaggcactggccctcatgcctgttcactaggcaactggataggccaggagcaggataggcctggaactgccttgggtgtctgctccattgtccaagcacacattagcacaggccaaccacagcaaagtcacatggggcagaaacgtgcctcgctaagagaccaggcagagcacctagcctcagccgtccttgtgataagctcagaggaccagccactctaccctgcttgaaagctcagctgtgtctgcatctttaagtgaacactcacactaatgggaggcaaagattctgcttcttaatagcactcctcctttcgtttctgcagaagggttcagtcctcactagccaggctcagactcaaagtctcctagctgatggagagtccatttgcactttaggaagatgaggagctgctctgggagctgcctgaatccttgctcccctttgggaaagtgcttgacctctggacattgcagagtgggaggtcggaaagaggcacttgggcttcaacaattcagggctgaaccataaaaggaaattcttattgactgtaattgttttcagctcaaatgagacaaatgagggcttttcatggtagaattacccaagtattagcccttgttaggggtgacatcttagactttccccctgtattaccttagcagagtcggccccacatcaaatgtaattagatgtagaagttcagtttaacatagaaaattgtgattatgcaaatggagactatgctattagaatgtgtttcaggttcggaaaattatatccttctcttccacattgggttggcttatggttactaattcttgaccctcccagagattccaggctgattaaggtttgcacaaaacagacagacacacttcctccctccaggagctttgattagggccaaatgttggcttccaaactgtgttccttagaggtgcctttgagactgccaggtgggggtcgtgccagggtgccggaccccaag

SEQ ID NO: 62902 - DNA, 1037 bp, Homo sapiens
gtttatcacagttttgttttgttttgtttttgagacggagtcttgctctgtcaccaggctggagcgcagtggtgcaattttggctcactgcaatctccacctcccaggttcaagcaattctccttccccacctcccgagtagctgggactacaggcacacaccaccatgcctggctactttttttttttttttttttgtattttaatagagacagggtttcgccatattggccaggatggtctcaatatcctgaccttatgatctgcccgcctcagcctcccaaagtgctgggattacaagcgtgaaccaccgtgcctggccagtttatcacagttttatattttattcccctaattgcgcatggagattgagcactttttcatctgtttgttggctgttccatctggatcttctctgatgggctgtttcttttcaggtcatctgcccatgcttttcttttgcattgtgtcttcttattggtttgcaggagttctcttaactggagcacgtagtctatttggatttcttgtaattaatgctgtattagtgtttgaatctaccctcttattttgtgctttctactgttccatttaatagggattttcccgttcactttagctcattccacattgacttagggtccattttgtctaagacccacaggccttaatccaccttcaaggttgaagttagaagacaaaggcttagtggatgtttctggctaggactggcattctgacaagtctccatatgtagatgggcactgtgtcaaccagcttccagagtcctgaatctgctttgcttgcatcattgcctctgaaattcctttactaacagttctccttcaggcagaacctggcttttttttttttttttttcctaataaaagtatattgcttctttcagacaagtaagcatcccaccccattctatatccaaccaaagttcctggtctcctggattcttccctgggggctggaattgaatttctacactaagttcccagtagagctttggtctccaaatgagatgttgt

SEQ ID NO: 62903 - DNA, 1050 bp, Homo sapiens
ccctgagcatagctcccttccaagagaaggcaagctggaaccgagccaaatcagcccagttcttcttcctagttcccaggagcagaatgagtaaaggcacagcgagtggccagtgctgtgcttaggagaagtcctctgcacggaagccagaagggaggaaaaggctttctcctgaaccactctgtgtggttctgtagagttgggagttaagagtgtacacagttacatgcacagtatatctaagacagagactgtgtgtctgtgtgtgggtggggtgggatgggaggtgtgaagattctaaatcctgctccttggctccctcacagatatggcccagaaaggccgcggtctcgtagtccggtgagccggtcactctccccgaggtcccacactcccagcttcacctcctgcagctcttcccacagccctccgggcccctcccgggctgactggggcaatggccgggactcctgggagcactctccctatgccaggagggaggaagagcgagacccggctccctggagggacaacggagatgacaagagggacaggatggacccctgggcacatgatcgcaaacaccacccccggcaactggacaaggctgagttggacgagcgaccagaaggagggaggccccaccgggagaagtacccgagatctgggtctcccaacctgccccactctgtgtccagctacaaaagccgtgaagacggctactaccggaaagagcccaaagccaagtgggacaagtatctgaagcagcagcaggatgcccccgggaggtccaggaggaaagacgaggccaggctgcgggaaagcagacacccccatccggatgactcaggcaaggaagatgggctggggccaaaggtcactagggcccctgagggcgccaaggccaagcagaatgagaaaaataaaaccaagagaactgatagagaccaagaaggagctgatgatagaaaagaaaacacaatggcagagaatgaggtaatgatcaatttcttccccaggtaaggcgaggcaggccctgaaggagaataa

SEQ ID NO: 62904 - DNA, 1044 bp, Homo sapiens
agcaagaaaatacagtgaagaggctggacacagtggctcacgcctgtaattccagcactttgggaggctgaggcaggcagatcgcttgaggtcaggagttcgagaccagcctggccaacatggtgaaaccctgtctctactaaaaatacaaaaaaaaaaaaaaaattagccaggtgtggtggcaggcacctgtaatcccagttacttgggaggctgaggcagcagaattgcttgaacccaggaggcggagattgcggtgagccgagatcatgccattgcactccagcctgggcaacaagagcaaaactccatctcaaaaaaaaaaaaaaaaccaaaacgacaatatggtgaggatgtgatcatttttgcattttggaatgatcattcttgattgccttgggaagaatagattttgggggaaggtacagagcagaagtgggagaccagtttcgaagtggttcggtagcccgggccctgtggtggcagagccctgcttgcaacagttggcgtttcagtctcagtctgtgagctgctgtgggcagctgggggcacccgttgcacccatctgttccacttaagctgctgctctctcctggaagtgatcccacagcaaagggaagctctgaaaggttgtttcctttgcctgcagggtggaagagcaggggtctgcttggtggagggctttcagcccggctagcaagactgtccctgcctctcccaactcgaactgaagggggtccctttactgtgttgatctgggagtgtggctgcaggaactgcttgggaagggtaaggattattcattttgacaagagagggccatggataggtgattcagggagataaaaataaagtcacctgttggtagaagctataatagctaaaaaggtatttgtagttgctttatactcaggctagtgcagtagacttcagcaaagctttcagtggaatcttccacagcaaacactggaaacaaaggactttaggatttgaaccatgtatccctgtccagtaataactggtgaaaccagtcagccctgagct

SEQ ID NO: 62905 - DNA, 1016 bp, Homo sapiens
atgttttctgagaagcaaactcagggcagacttctctgcatttacaggagcccagatggacttggataactaaaattagactgggttatcagcaaaaggagatcaggaggagcctcgtgcctgcacagcagagggccacccaggctgttatttctgtgatgggggcaagagtaggggatacaagaaaggagtggaaggggaaggaacagaggatccttaaagggtacagctgttccccttcttactacctcagacccattttttgctagggtctgacagtgatacaagacttgtttcaggatattctctcactccattggaggtgacgttttgtgcctatgcccggcactgtgacatcatgaaagagagagtttaaaataggctaagccccgtcttctctgccaagtggaacttaagatccatcagggggtttggggggagggagagagagtagcctttaagattctcactgtgaaaataattagggatttgctttacagaaagcctgtagcacaccagaggttgaagtgagagtcaggggcagaaaatacagaggaaaggcttaaaaatgaacatttcaacccagggccctgtgggtggcatgagctgttaggtaactgggaggcttgggattttttccatgtcaagctgacctgagctgttttttacctgcacggatctgagtttccatggaaaccccgccgtgaaatgccttcttgttgctagagaaaccgtgaggcccaggctctgtctagagaaggcaagaataaaggaggagtgaaatcttcacctcactccaatcaagccccttttattttgcggtataggtctcaacatgtgccagtgttagaggctcattaactgacccagtgtttggggttcatatttaataacagcttgacaagcttggggagagaatggcattgcctgttttgctagcctcggtggacgtcagcacaatttttgcccgtcagtaattcctctgcctgcagagatggaatgatactgagatggga

SEQ ID NO: 62906 - DNA, 1069 bp, Homo sapiens
gctttatattttcttgtttgggccaattaagggttgttaaataaattggaaaaaatcctactactttaaagagcgtaaaaacgtggaacatgtcttatctaaactcttaaaacgtgtttgttgctgtcaaatatgacttgagttcctgatcgggttatcattgcctaaagacacaggactattttttttattaagataactttgtttttatcttaataaaagagatgatagtcatttcctgacagttttgtctgacggaatgccttctgtataatagtttaaaataattatttttagtgtttggaaaacagcatttaaaagtttgaacagcagaagtctgttttaagaagcttctgttaacccttgaaaagaatcttcctgtgggatattaaaattttggattgaacttgtgcaaacagtactggatttggaaggtctggattctcatcctggctgttccactaagcagctgtctgtccttggacatatcacctaccctctctgaatctgtttagttgtgtgtaaggtggaatacctacccgaaggtttttctgtaaggtacattaaataatacatgtacaattctttttgaattgtaaagggctttatgaacatcaattataatcatttcgcttattaggttctgcagaaagtattctctcaaaagttatactttcatcaagaatgaaaaagactttgtaatggaactctaaaaaactgaaacacgtatcatatgacattattcctttcctatatgtatttcatgcatggaattaaaacagaatgtagccttttcagccatgaaggatgctgagtgtttagatttgcaaaccatttttgttcatatatttatatgaatctctacatatttttaagatttttttttcatatctaaagttggcgggagttatagtgaaaagtgattataaagattcacatatattaatttattcttaacagaattagagaatgatctcaccattttcttaagttcccaagcaatatgatagcatattagtctgaggattataccatagtaagaagcctataattttaacataaggtccat

SEQ ID NO: 62907 - DNA, 1086 bp, Homo sapiens
ggacttttatgatttgtctgatactgtgaggtttgatatctttggatttgtaggatttgaatataagacaaatatttgttcagtgcataccatctggaggaatttgtaataggtgattcttgcccttttgaagcccagtcaagtgaaagaaatgatatgtaaacagattattaaaatacgtgaaacgttctgttatagaggaaaagtttccatgagtcctatgagggcagggactgttgaaatcttgttaatctacctagcataagatcaattgtatactatgtatctgttaactgagtactgtttggaaagcataaaatagagagtaatagtagagatgattctctgctgtctgaaggatgttgaggagttcgccagttaagatagttttccaggaaagaggagtattgtgtttgagggtagtggattagttgttaaagtgcggtcaaggaagatgaaatgcagtcagtgagaagagattactaacaaggacaccagttacgtggctgtgaaaatagttttggcactctcttagtagtatatcatgatttaaagattctaagaaaactttcattaaagaggagggcactctaactgaattagaacttagcttctagagtcagactgcctttattccactttcagtttggctactccagctgtgtgccctctctcctttgagtatgataggtgtgataatttaatactcaaagggctatttgagtattaaataagataatataactaaagaggctattataatgcctgatacattagtcaataagtattagctgcagctattatatttctaaaaggaaattttaaatttaccccagaatcttaaaccaataatcccatttaaaaacagttgtttaagatctcattttaaacttgatacaaaagtgtgaagtgaatttttatttcaagagaagtctttgaagaaaagtagaatataaatagcttatgataatctaaaatgaatttttccacaaattctcataaaacaatatttatagtaataatagattgtaaggcaggttagttaactcctaataccaatctcagcaatattatgtagtttaatga

SEQ ID NO: 62908 - DNA, 2286 bp, Homo sapiens
ctgtagtcccagccactcgggaggctgagggagaagaatcacttgaacctgggaggtggaggttgcagtgaactgagatcgtgccactgcactccagcctgggcgacagagcgagactctgtctcaaaaaaaaaaaaaaaaaaaaaaaatttgatcatatgctatgtattcaggcagtgtgcaaggtgttagggattcattagtgagcaaaacagatgtggcccccactctggcacttaacttgaaggttaagatgtgggagtgtatgccaggcataacaggtactacataggtttttttttaaaaaaaaattccagcatcttttaggtactgactgtgtacttcagctaatcttcatcatttatgtatttagaaattgtgacctataaaagttatttaactttttttatagctcttttttttttcctttttacagttggtgggccagtttattgctagagctgttggagatggaattttatgtaatacctatattgatagttacaaaggaactgtagattgtgtgcaggctaggtaagtaaatcacttttcctacttagaatttcaaaataggggaaaattctacaggatcctattgaaatgacacttgtgttaatcagacactctgtacatctgtttgtcacttctctatattctccactgttaaaatggagagactattggcatgatataccaggaagaggacagtactataatggaaaagttctggagtttagctaaatcattaattaccttcatgtcaagccactcttctttgggcctcagtttctttatttatgaaacaaaaccattggacagatctttaagttctgttttcaggttctagcattgtgtaatagtttaatattctaataagatggataaccttaagaagagaggcctgatttatagttttattttgtatttatctactgtagaaatcttagtcagaaagtatctttttcactcttgtgatttagtataattaatatgatatttggtataactaaatgtgatatttgggagttatgctatttgatttttcttaacttcttggagacttggactcagccatgtcttagttttcctcaggtctatatattaacttaattttctagggctacttcacatcatagtggaatggtgtccctgggtaggaaggcatggatctaggtgaaagttaattatatgtgaagtgtttcttctcagtgtagatcagttattttgtaatgtgttttgatttttcttgaatgagaaatgaaatagagcatgagaatattaacatgaggatcaacttctttttgctcctttttgttttgaaaaagtgttttgaattttattttgcttttatgttatgtgaaagatttagggcatataggattttgtcagctttatccctaatttagtaaactttaggtatgtccagctatcaaacttaaatttttttctttctctgtagagctgctctggataaggctaccgtgcttctgagtatgtctaaaggtggaaagcgtaaagatagtgtgtggggctctggaggtgggcagcaatctgtcaatcaccttgttaaagaggtaatgattgggtattgtttttaacttaatttatatgtattcctctgagtgaaataaattgtggctactagctggtatttttatggacaaaaattaagttcggtcttacagctgcaattggaaaatgaaataatttttttaatatgtggctttataaccttttattataaattatatgattaaaaaatgagtctgttaaaatggctttcatgaataattataagcaagccatctatgaacttcaaaggaatgcctgaaatctttttcttatagtattatttaataattttcaaatgctgttgaaatgagattttctgtgttttagctattcaataaatacgcttttatatgagcaatttaaaactagatagtcttaaataatgagttatgaattatgagcactagagcagatcagagtgttagatttttgtgaggacattcactacccatatgcatgttttaaaagaaaattgattgtaatcccagcactttgagaggctgaggcgggtggattgcttgaggccaggagtttgagaccagcctggtcaacatggtgaaaccccgtttctactaaaaatacataataattagccaggcatggtggtgcgcacctgtaatcccagctactcgggaggctgaggcaccagtattgcttgaacccaggaggaggaggttgcagtgagctgagatcacaccactgcactccagcatg

SEQ ID NO: 62909 - DNA, 1034 bp, Homo sapiens
agtagggagtcttttccaaaggaattagaggcatgctttttttttttaatggaaaaccctttaaaagctaacacgtaacgaaaaaataccaagtttttaatttttttatatattgactatagtcagaatttgtatctgttttcatgtctttttttttcttcattacaggggcagaaagcgttttgtaagcgaaggagatggaggtcgtcttaaaccagagagctactgaatataagaactcttgcagtcttagatgttataaaaatatatatctgaattgtaagagttgttagcacaagttttttttttttttttttttaagcacttgttttgggtacaaggcatttctgacattttataaacctacatttaaggggaatttttaaaggaaatgttttttcttttttttttgtttttcgagggggcaaggagggacagaaaagtaacctcttcttaagtggaatattctaataagctaccttttgtaagtgccatgtttattatctaatcattccaagttttgcattgatgtctgactgccactcctttctttcaaggacagtgttttttgtagtaaaatcactggtttatacaaagctttatttagggggtaaagttaagctgctaaaaccccatgttggctgctgctgttgagatactgtgctttgggagtaaaaaaagaaagttatttctttgtcttaaagaatttttaaaaaattagtcatgagacttattcatctttccagggaacatactgattggtcttaaaagactagacagttaagtaaaaggtggctggaacatctatttttctacaaaactggaaaaatgaacctggttctagaagaatgtacaccaaaataaaacatgtgaagcagtattgattctttattgggagtacatttttttaggtctcttaaactttaatttcacacagtaaattttgaatctcataaggaagcatatttgaacctagtcaatttaatcttagtgttcccttgaaaactttttttccctacaaaattttaagtgaa

SEQ ID NO: 62910 - DNA, 1640 bp, Homo sapiens
caaattagccgggcttggtggcgggcgcctgtagtcccagctactcgggaggctgaggcaggagaatggcatgaacccgggaggcggagcttgcagtgagccaagatcgcgccactgctctccagcctgggcgacagagcaagactccgtctcaaaaaaaaaaaaaaaggcatgaaaatacgttacactagaataaagtgggttggaaatagaggtccaggaagaaaaaaagatgatataaaacttctaacttaaaaatgatcttctttttattaatggatgatggtagctatcaaattgctgttatgtttagattatattggatatgtttttaaaagactgaggtaacagttatttttaaatatgctggaaattatatcctttataatttaaatttatgataagaaatttaaacatcagtgtatgaagtgatacctagttttccaaaatctctttgggagtatgcaagtagaaaatttgaggaccactaataatacattctccaagttcagaaggacacttcagtgatctagtctggtctcacacccattatttaatttggttatccaactaaatcacaccagggatttttttttttggaggggtggggggaggacggagtctcggtctgtcgcccaggctggagtgcagtggcacgatctcggctcactgcaagctccgcctcccaggttcacgccattctcctgcctcagcctccggagtagctgggactacaggcgcccaccactacgccctgctaattttttgtatttttaatacagacggggtttcaccatgttagccaggatgatctcgatctcctgactttgtgatccgtccgcctggcctcccaaagtgctgggattacaggtgtgagccaccgcgcccagcccccacaccagggatttttaacttgccaaatgtatgtgattgatttgaaggcaataatccatcctagacctgcgttttaactctcactcctaaaacagagtaaaatatttcatgacaaagatttggttttccttcaagtttttcagcattaattttagacatccagctcaaatagctacaacaggtttgcgtaccttgtcatgattttggaatgcactgttcatcaaaactattatctctgggagaaattacaaactttagaatctgtgtaagaaaaggaaacagcagattcttctccatttacctaaaccaaggccttcaaaaaatgatgaattgacactgtattctgtgagcattataagtttggttctattaatgtaagaataatttcattttctgtaatttaatgttttctcttaaggtatgccttgacaatctgcatcattttttaatttggcatagtattccgttctatggatgttccatgatttatttaacctttgatctgctggtgaacatttagtcagcttcatctattgctgaacattttgctattcaacacaatgctttaatgaacactcttatttttacacatttgtgttctttagaaccaattactatgagtcaaaattgtgcatatttagttttagtagatacagtactgcaaaatattcctctaaaaaagcttaacaacagtgctaatttccctataccgtccctacctgtggatactatcagacttttaactt

SEQ ID NO: 62911 - DNA, 1082 bp, Homo sapiens
tcaaacaacttttctctttccttgcacactgttgaaatagctaactaaatatctcaggtgctgagcaaatactttttttaaaaggttaatagctaacatttttaggaccactgtctactactgaattttgaaataggaagggttattagaaaaagacattttgcatgagtaggatgtatcattactaacttaatagtagtgtctgctactggattttcccagagccagtggcatcatccaagttcacccaagaattcccattcttaggcctaggtacatttcagaagctagacaccacacattttattcacatgagcttgaattaattagctaaattgaacacgttgcaacatttttctaccagcagatgccagatagcaaagcagaatagaatctgctgtagtctccgacatatgacatatgatgtcatatgttacttggcatctccagataaacattatcaatccaaattaagcattctgctagcatgtgggcagttgagtaagagtgagtattactactttatgtttgctgaaaaatgcattctttctgggctccccttttcacctttttctcatatttacattcagaaatctagtatgtttttgaaaattcatctgtcagttaaccacaagtcttggataagacaaaagataaaaattttgttattctaccattctcaccaccccctctcagaacccccacactaggcaggttgaatttactttaagggacccaacttaataaatattcatagaagaaaaatactctttacataaagtatcctttacagtccatggccatgattgctcctgactactccttcagttcccagagattgtatttttgcatctcaatgcccattaatgataaaattagacagcttggcatatgttttactgtagttgcaaagtcagatgcctacaatggatgggcaagtaaggtaagaggaaacaataggtggtaggaaggactggagaattccagagcatgtgcttacctaagtgaagcatcacttcccagccctagccaaattttgccatgttgaaatgtgggcttgacgttgccagatttgtcaagtg

SEQ ID NO: 62912 - DNA, 1028 bp, Homo sapiens
atatccattgtttttgtaccatccccctccccccatgcctaggtggaagagtaatgactccaaagcattaacttgcctttctctttatttcttttctttctttttcttttcttccttcctttctttaagcaggcagtttgtgttattgtggaattatggatttacaaacaggtggaataaataccgattcgggagctagaaagaagatgctttgtgtgtgtgtttaagcccttacagttggcagtttgatttttcttgtctgttgctttgtatcgtaatgggggtgatgagaataaaagaggaagcactgttttgcaacctacccaaagaaatattttcgaagtctctggggatgctgaagcaaaattaggttgcagatgtggactgtatagtatttgcctccagcgtgataactaccagcagtgtctaggcttacacctgtgccatttcgtatacttttcttagataccgagtgcgtctagtttctactcaagagggactactatatcaaaagctttttgttacggttttcagaatcctaaggtacatttgtgtaaccaagtgtttttgtaactaaatgcagcaacaccactgaaaaatagttttaattttaaagacctcaatttattagtgtacttactaatctttaccctcatcctccatgctgtggactgtagaactgttactgtgtacttgaagagacttagctattgcatccaatttgtaacattcagtaaggttatatttataatttgaatttatcaagtgttgatgttttgctgtgtgacagtgaaaagaattttaggaataaagtatgcaaatgaccattcgccacatatggaacttagactgagtatgataagccttttgtctttatttggacataaagtatattgtaaactttttatgtaattataaatacacatttgaaaaatagacaaaaataaacacaaaactgaataaaagttttgtctaaggtttgtaactttcaaatgtctgaaatttaatataaagccaacatataaaac

SEQ ID NO: 62913 - DNA, 1042 bp, Homo sapiens
cttctgatgtgggaatcttattttgagattttctttatctgcttgaactgctataataaaataccatagactgggcggcttaagcaacagtatatatatttcttacagttccgaaggctagaaagtccgagattgaggtgccagccgtttctgttcagggcgaatgaagagtctcttacaggtcttcctgctgtatcttcagttggcagaaagtgagagagcaagttctctggtctcctcttacaagggcattaatcccattatgaaaaccccacccttgtgacctcatctaaacctaagtacctcccaaaggtcccatcttcaaataccatcacattggaggttatagcttcagcataagaatttgggaaggacacagttcaggacatagcaggattatattcacaagatagtagttaatacataccagttgggaattgtagggttgtgtttaatgtgttaaattacaaaaataaagtatccctttatgtatattaaaacatataagagctgcctttcaatatcttgagtaacttctgatgggagaaattccttattatccttaaattgagtatggctgcttattatgtttcttttgatcttatatgaggaagattttagctttgtgatattttttaaaatgtaatacagagataatgagattatatttttaaaacccaaattataaaagttctatttaataaaccaaactgtcagaatggtagataaatagttgaacatagaggtcttttaaagtctcagaaatggaccatataaatgtaagaaacgccagttgttttataatcatggcaacttactaaatactgactgatactcaaatataagataccttgagaccacacactcctagtcttgttattgagagcgcatttatttttgttttttttctgacagtttccgatagtttaaatagagtgagtaatggaaaggatttataatgagatagacttagtgaagaaatatgtggctttatatgtacaaaaaagtagtagttaaatttaattaacagtttttagtttaa

SEQ ID NO: 62914 - DNA, 1332 bp, Homo sapiens
atatataagaaaaatattgtacattttatatgttatgtaaatgcttaggcacaatgatattagaaaaaaatgaagaatttattatacattttatgtttcagtatttaagtgttcaggcacaataccagaaagcaatgaagagcaaaagtttgtacatatgtcctcatgaatgtgattgttagaagtgcaaactgatatagacgtgttatatttttgactcggataccaagatcagtatgagtatcagtgatcatcagaaataacaaataactcttaaagaatagtgcaaaaatattgcagtttttgtgtaaaatggaattaggtgctcaaaattataaacaggtatttcacctagttatatatctggtaggtatttgaaggttgtacagtatgcaaggatagttctcatctccagacctggcccattaaatgccagtagcatttctctaaacattgagacaacctaaagtgaacctacaaaattccaaaatactgtagctaaaaatagttagattgtacctttatcatgtttagcatggactgttgcagtggcttccaaattcggctctacatagaatcacctggaaaactctttaaacatacagcttactgttccctaccacagatatttattttgttagcattcttggattaggggttaggatttctaagctcgccagatgattcttgctgaaaatgtctggcaatgattgaacattagggaattcttgctgaaaatgtctggcactgattaaacacgaaattattactgctttttaaattttctgccttccttctgaagtcctgactgtttacagtcattctaaacattgtcaggtaaattttgttaaaatatgactgtaatcatagcctcttctccttcaggaatcctttattggctttttatatttactcttggcagcccctaagagtacactgctggaacattagagttgaaagaatcatgatgtctgcatgataaagtccaaattactaaatttgaataaccagcgtttccaaatttggcagcctacattttttacttcttgtgtccaatttgcataaaaatatagttcctgaaaggaatgatttaaaacctgacactgacttatgacagggcttgggaaactatggcctgatggccaaatccagtttgaggtctgtttttggtaaagttttattgaaacacagccactcttactcatttgcatattgtctacttttatgctaaactgacagaattgagtacctgcagcagaaagcaatctgtcttgcaaagcctcaatatttaaaatctggccctttacagaaaaagtttgctcacccttgact

SEQ ID NO: 62915 - DNA, 1077 bp, Homo sapiens
gagggactgcaatttgttactgtataaataaagttctgttaattgagtcaactctttgattgatgatggcaatatgtgtatagatctcttggataagtccaaacgcattgaattctcttcccggcatttgttgagctctttaatcacctctgcattgctggatttttttctagtcccaggtgctgggtttggccgtttgatcgtattgtcaactgaaaatgccacccctggttgggcagcactggagtccttctttccatctttggcatctttccctttggtcttaggttctttttctttgctctctttcccaaaacctccagaggcttttgcctccttttctctttccttggctgatggtactttgggatctttttctttagagtctttttcttttcctaaactactactcatggtgactcaagcctggacaaaaactacatgaactccttttattttccagtaattgaattcaaagatgaagagacaaagatcctacacaatcaaaaaagtactggcttgaagaagtaatcagcatggagtaacatccatctgttacatgttggatctaaaagcactatgcccatttctgatcattcattccaactggtaaaatagtgctggtcaatcaatgattcattagagttcctgaaatataatatagacagtattaaattactttagataatttatattaaataggctctgaaaaacaatcttattagagtttgccattttcctatgatttcattctcaaatatttatgaacatcctttataggtaaaaatccatttaaaactacacagcttaataaggctggctctaccttcaagaaacttgcaatctaataggaagatgtatgaatgtaagttactttactagaaaattttataagacctaaaaagtggaagaaaccacaacaataagcttaatatttattaagtgctttctatgtactagcattattctgaggaattcacatgtattaatataacacatacaacagccctatgagatacattgttatccccattttatacaaagaaacactaaagcacagaaatatttttaagtaac

SEQ ID NO: 62916 - DNA, 1732 bp, Homo sapiens
tgctttagtgtttctttgtataaaatggggataacaatgtatctcatagggctgttgtatgtgttatattaatacatgtgaattcctcagaataatgctagtacatagaaagcacttaataaatattaagcttattgttgtggtttcttccactttttaggtcttataaaattttctagtaaagtaacttacattcatacatcttcctattagattgcaagtttcttgaaggtagagccagccttattaagctgtgtagttttaaatggatttttacctataaaggatgttcataaatatttgagaatgaaatcataggaaaatggcaaactctaataagattgtttttcagagcctatttaatataaattatctaaagtaatttaatactgtctatattatatttcaggaactctaatgaatcattgattgaccagcactattttaccagttggaatgaatgatcagaaatgggcatagtgcttttagatccaacatgtaacagatggatgttactccatgctgattacttcttcaagccagtacttttttgattgtgtaggatctttgtctcttcatctttgaattcaattactggaaaataaaaggagttcatgtagtttttgtccaggcttgagtcaccatgagtagtagtttaggaaaagaaaaagactctaaagaaaaagatcccaaagtaccatcagccaaggaaagagaaaaggaggcaaaagcctctggaggttttgggaaagagagcaaagaaaaagaacctaagaccaaagggaaagatgccaaagatggaaagaaggactccagtgctgcccaaccaggggtggcattttcagttgacaatacgatcaaacggccaaacccagcacctgggactagaaaaaaatccagcaatgcagaggtgattaaagagctcaacaaatgccgggaagagaattcaatgcgtttggacttatccaagagatctatacacatattgccatcatcaatcaaagagttgactcaattaacagaactttatttatacagtaacaaattgcagtccctcccagcagaggtgggatgtttagtaaatctcatgacactggctctaagtgaaaattcacttaccagtttgcctgactctcttgataacttgaagaagctgcggatgcttgatttacggcataataaactgagagaaattccttcagtggtgtataggctggattctctcaccactctttaccttcgctttaatcgtataactactgtggaaaaggacatcaaaaacttgtcaaaactcagcatgcttagcattcgagagaacaaaattaaacaactacctgctgaaattggtaagaggccttggattattattatttgtagtatttgttatgctaaataattttgagtgctttctcatatcaaaaaatgcctgatacttgcctaaaaacagcttatttctaaattacaacttttttatggtttactttattccattttcagcactgttaatagtacatggcttgaaattgtttcatagacttaaaaagtgagttagaaaatagatgtaattagatctttcccacacaaacctaatctttaactttcattggagaataagtaaatttaaagaagaaaagatgtttgcctaattttcaagttgttgctgtgtttaaagtatctgttgatacaattttattagatatatgaaaactacattttctcattctctgacttt

SEQ ID NO: 62917 - DNA, 1038 bp, Homo sapiens
gaaacatttggaatatagtaatccattgacatcagttttgaaaaattgataaaggtattgcctctgtgggccctttttataagatttgtaaaaattgtcataagaagttgattatgaagctttttaaaggatgttttctttttgtattaaaggcaatttattctgagaaaaataaagattatatttttgttgctttcagcattggtcttataatgagtgataaactttctgatttttaggttttgcagcttttcaaagatatgatattctgtgggtgttttaatattttgtttagctttgaaaaaagatgtggtttaaattttaggtatgacttgttacatttaactcttaactagacaatccaaatattaattaaattttggtttaatttaatgtgtttagaaaatttatgataggttttctcaagtaatatactgtagagtatgacttactcacgagatattaaaatattcccaggaatttctgggtgaaaatgttccattccatgtcttcagataggaatgtggttgttgaatgacttgttttagtgtcatatttagtcaaaatttgacctgcatgttatggctcattgtggaatagaattataggcaattggagaaataaatgctgaatttctacatagaaatataaaagttacttcctgtctttgttcttgttgttttgtgtatgtgttacactcagtcctaaaagtctagctttaattcacaagtctctaaggactttttccatagcaatgctatcaaattacctaggaattaagaatatacatatatgttcttgagcatatagatagcatttttactaaaaagtgaatgtatcttttaaaattggcatattttaagtaattatgtggcttatatttgtggctacctaatcttttgacctttattcctaaattgtaattttaaaaacagccattgaatttgttaatgggctccttcccatcattagtgacattactgaagtttgtgtttttgtaattgctgtacttctgtaaaaatggtaatatcataaatg

SEQ ID NO: 62918 - DNA, 1051 bp, Homo sapiens
cactttttcttctctcttgatagtaggcctgttgttcactcacttacttccactgccattgaggtagtatagaccttcacactatttctcgtgggctaattgcagtagcttcaacctaggctctgtgttttttatttgtctttctcaagtccatccattcaaacctagagaaaacagactttttagaacagtactctgattatcatggtttgcttcaaaactttaaattgtgctttattatctggtcaaaatggtctagattccttaggttgatatttaagaccctagatttctcactttgttcccctcctctccttattgcttattttccctcccaatcccctgggtctcagttcaaatatgcttttttttttcaccccaacttcccccaacagtcagttccaacttcctttccttatgtgttttcttgttgttgtttacagcagttatcacattctgacactttatttccttattttatgattccccactccatgcacactacagtgtaagtttcatgtggatggaaacttgctttgtttcctgcactgctgaatctttcatgtagatggaaacttgtttcatttcctgcactgttgaatctctagtaggtgcacagtaagtttttctttcatgaatgagtcagtgaaatgggtcaccaccttaaagataaagaactttgtgaatggccatgaagatccaaaagaatggctctttaatggtgaaattttataagcaagcagtgaaggacctatttggagcagagactctctagcctccctcaaatcacattatagtctttttacgaattgtaagtttcatgaatacaaacatttagtatattgtagtctgtttcttcagtgcccagtattgtgtctggaaaaagagaatgtacatatcaataattttttgtctgaatgaatgaattaatgcagtaagtgttcctaccaagctcccagctgtggcttctactcctggtgactctgcatcacatttctctccagttctggggcagaggtttgtccttagatctcaaaaggatgtaagaaaa

SEQ ID NO: 62919 - DNA, 1037 bp, Homo sapiens
ttacaggccttagccaccgtgcttggtccagtcatgaatattttagaggcatgattactaaatcatttgaggcctgtgatgatgttatctttctccagaagagtttttgtctgcctctgttgggtacctagtagagaggggatcacttcaatcaattcgtgttcaaggcttgagatgtgtgtggtcccccaagtgattaaaagttttgctgcaggctaactggatgactattttatttccagttcacccttactggtagggtgcagctctagagggtcccagttgaggttgatgactagagtccccacccttggcaggccctagattttgactcttgctggaaaaataacttagccttttagctgcatcttccagttagggctgtgttcttaggacagaattatctccattgttttgcttgtatctgggttcccagcttgtttctgttctggtgcttagtcattacgttgttaactctctgattttggttttggaagatgtttttatttatttatttttttattgggagaatttatttgaattacctaccattacttgaaacaaagcagttgttagggaatttcttagcagggttgagtagattgtcttaggttatacaggacaattatttacagaaaagcaagctgagacatggatgtaataaatagccgttagaatctatgtttccctgatttttggcccatgacactatcgtattactatttgtagtggaaagagattacatattctagttaactggtttatggtttagatgtccctctgaaaggcaagattgtctccaacacataatgaattattctattaatatccaaaataaatattctactaaatgtcctgtataaaataagagaatcagatttctggttcaagataataaggaccaagcacaattatttcatgcttttttttctctttaaaatctattgaaatggccaagatgaacaaggagatgtgaccttaggagaaaaaaaacataggatatttaaactgcatgtttaaaacatgatgaggctgat

SEQ ID NO: 62920 - DNA, 1018 bp, Homo sapiens
aagattatgatcatttaaattagtcttactcgaaagttatactaaattaaactaaagttgctggttatatttgctgaaattgaaagaatctaattttaattcatagccatttgatttcaccatattttaaaaatctgacagcgtaagagaaagcaagctgtcaaagtggagcacagaacaatttgtagacaaagttaagcacttgaaagctaaatgccagtgattggcagtgatcagcctacgtttatatacaggagctcagcaacaatgattttatttcttagtcaagatggctcaacattaaagcaagcttgtgttgatttctaggttgcagtttagtttgtggttaaaaccactcattgagaggggttagagctgaaaccactgcagagggtgaatcacaataaatgccagacttctgatgttttcttctggcgtaaaagagttttgatatttcatccttaatttttttaaccttttttatttagctgagagtaatggactttggcaaaatgtggatgactctttgaatttgccagtggtctcaagtgatagggcctttgcaaatgtgagatttcttcatcagaacagcctattctcatagattacattgttagaaattcaaccccttccgccccagcaaaaagcaaaaaatttagatccaagaaaggtggaggtaccttttaatttaaattactactggttttggtactagataatgtcatgtagcaatttggctacattatttttattttgtaatttttaaattctaggaacctactctggttttaaaagtgagaaacttaagagttatttggttttggatgagaaatttcaagaatctggttctatttactaggcttttgagttgacaaacatttagaatttggttcccctactaacctttgttaccacagaaagttttttagttttcagtgagaataaaaaacatttaaaatattgtatttatctaccatgatactgtaaagggttattgaatgaggcatgtcagttgatg

SEQ ID NO: 62921 - DNA, 1164 bp, Homo sapiens
ctcaggtgatccgcttgcctcgacctcccaaagtgctgggattacaggtgtgagccaccatgcctggcctaacgcagtgatagcaatagtgaatattctcgttcgtatttctaacctctaaattttctggggctttggaaagtcactcaatttttttttttctcctgaggaattgacacgtctcaccagagtgtcatcagaaagacactgatgaagtcactaagtgaagcatccttagttaatttacaaagctttttaaagactaaattaacttgtctttgctaagtggtagttttttattgttgcttttgtactccactttgtgccggttggaatctcacttaattagacccagtaaactcttggcccagtttccaaacactattgtacaaaagtgatgtattagtaaatgagtatagcatacctatggaatagttctaattggaagaattgaagtggtggttacatttttctgcgttatagttgacaacttatggcatagaattatgagtatttttttattatcaatgactgattcttatcttgaaaatgtaaaggctaaaaattagctccaattactcattatgtgtaacttcactcacttgatactttcagcaagaaggaaagatgcagatgattgatgaccaaataaggatcatgaggcataaggagtgccctcttaaggtgtcaaggcttaacttatgctatagactaatgtatgttttctgtaagtattgtagtaatattgcatctaagaaagtaagttgatcatatgacagctttttgaacaatgattaaagcaaaaggagagaaatggacatcaagaggttgtgaaggctgaaaggactcaaaatacttatctccaaaaagttaagtgttgacacaggcttccacttctgtaatttctaacactggaaataactgtttaatttaaaagtaaaggctacatttgacattttaacctggcccatccaagtatctcatagcaacagttgtgatttgaagtcaaaaaagaaattaatcagccacaacaaaatagtatattggatgaaattcttgtcttgttagctttttttgtatcaaaattaacttatttttaacgtatattgtttgcagaattgaatttgagttgaaccatatatgatagcagatgtcattatattc

SEQ ID NO: 62922 - DNA, 1026 bp, Homo sapiens
agcaaaatgcagtgcacttgaagaattaaatttagagaacaataacatttctactttaccagaggtaagaagtggattagagaaaacaagatttgaaatgagtctgcaagataattcaaggaaagctagtaaatctttatagcagggtaaataatttggtgattgagattgtttaaataatgagtatgctgtgaatgtaccaccaccgctgaagtaactccaaacaagaaagaatgggtatatgaacctattaagttttatgattattatttttttaatgtaaagaaaaagggaaaaactaggaagaaagtaagtgtgctgtattctactttagcaccatgtaaatctttctcatttcattttgggaactgacagtaaaggtattaaggaaaaactatatggctggttttaaaattcagctaccccacccagttcagttataaaaagaaagatgataagtgatacagaatgcactatcatcaaaattaatattagcagcaattctcctgtgactcaaattattaccttgtttatgcaataatattaaggcctatttagtatagaacaatcgccagaatctttttttttttttaacacatttttaggttttgttgattctattagaaaaatattttcacttattttgcttagggattaattgggtaagatataatactttttttttttttttttgaggcagagtttagctcttgttgcccaggctggagtgcaatggcgcgatcttggctcggctgcaacctctgcctcctgggttcaagcgattctcctgcctcaccctcccaagtagctgggataaaaggcactaccacgcccggttaattttgtatttttagtagagatgggggtttcaccatgttggccaggctggtctcgagctcctgacctccagtggtccaccctcctcggcctcccaaagtgctgaaattacaggcgtgagccaccacagccagccaatataatactcttcttttaaagttgtctttatcaacattattagtcttttac

SEQ ID NO: 62923 - DNA, 1074 bp, Homo sapiens
ttccagttttccttgctttgaatttaaatagagaaaggacttaaaatttaagcacttacttcctactaggtattgttaacttatttatgtattttatcgcttttagtcttcactatggcccataaaatattattatttaaaaaatgatacactaggttcggaaaaataacttgccaaagtcacaagctatttaaagatagagtcaggattcaaaacagtttatagcctgtacaggatttctcagatgttaatgagcatgcagatcacctgggaatcttgttaaaatgcatattatgattcagtgggagtggggcccaagagtctgcatttctcacgagctcccaggggatgctgatattgctcttccttggcccagactttgaatagcaagagcctattatatataattgattattgattatatacggtcgtatattattttctaattatttcttacctatgtacttctataaatagagcttaatcttctttaccgcagagattctttggtaatacctgaatattttaatactttggttaaatggtgagaggctaaagtagggcaagatggggttatgtgctaagtaaatacttgtttaatgggtacatatatgccctcagaaattttaccatatagaaaagcggtgtattatacagtatcaggaagcataatcatctactgaatttaatagttcctaaaaggaatctttatgttaatcttaataatttagagagaggtatatgactaagactaggtaggattggtcacacagccagtggcagagacagggctcagacctgggactgtctgacactaaagtttctgcaatgtagaagtttcaaattagtcacccatgaggcacctctcacacacagacatgttttccttactccatacagtgttttaaataaattgaagccaaagaataaaaattgggaaaattttctgtttcctcctataaaatctggaagtctacattggttccacatttctgcaaggcaccaaactgctagaactgtgtagtgactgtccctgtagagaagtgtcacagactgccccaaccagtctctgtc

SEQ ID NO: 62924 - DNA, 1055 bp, Homo sapiens
accttgtctcgcaaaaattttttaaaaattagctggcctgtggtaccagctacatggaaggctagggcaggaggatggcttgagcctgggagttcaaggctgcagtgagttatgatggcaccactgcactccagcctaggcaagagagcaagaccctgttccccatccccccaaaaaaggaaatatgaatgtctataaaagtatagttgtagggatatgtattgcagagctatctatttcataggtaccaacttattaatagagatttaattttgttaagtagtttatctttagtggaatactgtggagccattaaaaatcatattttggtctaaaagaacactacgtactagttgaaatattctcattttatcaagtggaagaaagttaaagcatgtaaaaaatctcttcccacccagaatttttgaaagctgtttttaatatgcttaattgtatattaaatatctttatatttatacgtatagctggtttttgccaaaatgtttagagatcagaattatttatgggtgaacgttagtttccttttgcttacccactctacagtgatcgagtttcacctttgtaatgaaattcattgcaaaaggagaaaacaaatggaaaattatcaagttcagtgatttaatttgtactggacaaactttaggcccaaggaaggtaactgaattggccacatagctgatagtattcttcctgtcatgatgaaccatttgaacatagttgtggttctttaaactataatcttaaatgtacaatttttaaatttcatccacacttgctcataaatatggtgtgtatcttttatgatgattctttggaagtatatgataagtaaactaatggaaattcaagatactcatacagttttaacaattgtaaaatttcttgttaatcagtctggttatatgagatttaacagtggtaatggtgttgattctgaacattcattttgtagtaataggcttaaaacacaatggttcaggtgttcattagtttatgcatttgcatgtaagtaacagtagtaaatttttaaaaat

SEQ ID NO: 62925 - DNA, 1050 bp, Homo sapiens
tgatttaatttgctgtctttttaagactgtttttcctcccctactttactgctcagcaccttaagaattcctgagctcattctggtttccttatgggctgtcattagatgcgtcttcttctattgttttcatatctttatttgagcatttatattttattcagtgatttctgcatattgtgaaattgtaaaaacatcatatttatcataggatctttgaaatctccagtgtttctctgtatactgtgtttttctatttccattataatcacataaggaacaaacttccagtttaactcccaaataaaagcctcattactgtataaaaaactttggaggcttagagttttctgttgctgattttttttctttctatatttaaatatcaaaaaggggaataagattttgtttaattaagaattctctttccgaagtgacaggtatatatagaactttgtttttgtgattctaccttggatgcttctttttgtctttgccaggacaatcagttaacatcacttcccttggattttggaacttggaccagtatggtagaattgaatttagccactaatcagctcacaaagatccctgaggatgtgtctggtctcgtttctcttgaggttagtataaatgagcaattagagaacttcagaaccttccatacgtatctcatttaaaaatttcaaatttaaataagcaatttctatttgggtgaatgtcataattagaaatgttagaactcacttaaacatacaaccctaataggataatgaagtgttgacttaggtagtctagattcagtgcttttgaatttctcttgcctactacaagttggtgtctttgagtgccataaagtattaatatctctaaaagaaaagttctgtaaaagcatcttttagaacaatttttttctttattctgtttaaaaactacaccattgtctaccaaaataattatcgattctcagactgtcatttagaatgctttatcatactttttcatcctaattaccgacctgctattttatttactcattgattattgtctt

SEQ ID NO: 62926 - DNA, 1576 bp, Homo sapiens
agtttcttacctgtaaaataaagatgataataggaagttctcacaaggttgttctgaagcttaaataatatcttacatgtaaacaaattgattacatactagctattatttctgttattttctaataaatgccactgtgaaatattctgaattttgaaatttaaaaattggaaacacatgaggcaaatttacacctatatttctagtatatttattcacctgatctcatttaattgcttgagacattttcctagagaatacaagtatcctaagaaaaaatttttaaaggtctacataagtcagtttttggcttactgccatatatgtgataactcttagtgaaaggttcatattaagtaacaaatattttgcacataagaaatttattaatttgagaaaatgttacatctacaacagaaaagtggttatagacattgaatatataataagctcacctttggagttttaaaatatatataagtaaatgttatatatgtgccaaactatcccaaacagaatctctggagatggggcatatgtattttcaaaaacctctccaagcttgaagacctaccataaaggaggaggttctaatttagtttgtatgaagtgtgacctggacatataggagtttaaaaagtcttccaagttgatttgaatatgcagcaaaatttgagatccatggttgtagagttttaaagctaagaaaggagaataaaaggaaatgtgtgttcagtatatgtaatgaccagaacagcatcatgcccagttgaacttttaaaatagcaactaatttttaaaaaaaaattgattttttttttaaacaggtacactggagaacctagaagaactgtatttgaatgacaaccccaacctgcatagccttccctttgagctggcactctgcagcaagctttcaatcatgagtattgagaactgtccactcagtcaccttccacctcagattgttgctggggggccttctttcatcattcagttcttaaagatgcagggtccatatcgtgccatggtctgatataaatctgctggtcccacacactgttcaaaaatagactgccattaatgtttcttatctatatctgtatctatttatgtagatattggtatatggcagatttataaaaattgcattatgtgtttctgctaatagaggaatcatagccatttagaattttttttaaattctgtacaaaaggcttatataagttttctttgctgaatttgatggatgtttttctgttgtgtaatctgatatgccagtttgcttaaaacatttgccaacacattatgaagttattaaatttaagggacagaggtagtatagttagatatactttctcttaggaaaaataatgggcaaaaatttttgttgcaacttttcatatatattttccccttaccaattgttttatccttatagtattgtaggccctgaaagtagaatttttctttaacttattttgagatttgagatttaaattttatgtattgtttacagtcagagtaaatcactggatttcttttgtttgttttgatttgctctgttttattcagt

SEQ ID NO: 62927 - DNA, 1129 bp, Homo sapiens
gatgtgactttattagacaaacccccactcccgccaggggtagacacacgagtatctgctttaggaagatttctgcaacacggcagggtgcaattcaaactctgggttctcctttcctgagcttagaaaccaatttgttcggagataggagaaggctctgttggcagaagacctaagagacgggaggaggcgcctggcgtcagcgggtcgcttctcagccgtgaccacgagcggccagcaggtgtcagtgcgtcctcgctttgccctggcgctcggctcctggacccctccccacctcggtctaagggggcgcggtccagaccccgggtcttgcgtttcccgcagacagcatcgcggctgggaggacacgtagccgcttcttccctaagcggaggtctgaactccggcttgtaccacttccccgtgggtgctgtccattccgccccaggggttccatccgaagccgcgccttcctccctctccaggacccctttctccccagcctccaggagcacctgcggaccgcgtcggctctggcccggagctgggctgctccagacgtaactcacaccggaggttacttccctcgatttgggcggggattcccttccatttttttcttcccttttctcccaagatccagcttcttgggggcactcacgggtgcccgttgcgttctgctccgtcggcccggagctgcatggccaactcccagcaggggccgctcctcccctaccccccacccccgggctccctctttaagtctctagctcaaggtacccgcctctccaaagggctcgtcccgcctgagggcaacgctccccgaggtccagcgctaggcgcgggcgctagactggcggaggggtggtgcgaggggcgggggagggtcggcttcccacgtgggggctgacgccggctgctcagcaacgcttgcttgatcctggggctataaaacgagtccaccgtgagcgcagcggagcagcagcagctccagctcggtgcagaagcccagcagccggcgtgccgccgcccggccactccagcgccttcttccccgccttgcgctcctgccccaactcgcgctgtcgtcggaccccggcccatccagcagcgctcggcgcccaccagg

SEQ ID NO: 62928 - DNA, 1862 bp, Homo sapiens
tagctttgaggaaaaaccatgacttttaacaaatttttatgggttatatgcctaaacccttatgccacatagtggtaaataattatgaaaaatggtctgttcataattggtaggtgccttttgtgagcagggagcataattattggtttattatggtaattatggtgattttttaaatatcatgtaatgttaaaacgttttctaacagtttactgttgcttatctccaagatattatggaattaagaatttttccagatgagtgttacatagattctttgaatttagtataaaagtactgagaattaagtttgtacttccataagcttggattttaaacactgatagtatctcatgagtaatgtgtgttttgggagagggagggatgctgattgatatttcacattgtatgaaataccatgtttgaaactcatagcaataatgctatgctgttgtgatccctctcaagttctgcatttaaaatatattttttctttataggaattgatgtataccatgaagtcattgtcagttgtagtagctctgatgttgaatgagatatcatgttttagcattccattttactgactagggtagaagaacacttttcttggctacatttggaggatacccagggagtcttgggtgttccttatctggggaagcaaacatttcactagtctctttttttcatcctttaaattgtaaattaaggattactcaagctcaccattattcaagattgggactcgcttcccagtcgacactctgccctgcctgtcattgctgcaaagagctgctgctttgccaacctaagcaaagaaaatacggcttctcttgcattattttcccttttggttggtttgttttctagaagtacgttcagatgctttggggaatgcaatgtatgatttgctagctctctcaccacttaactcactgtgaggataaatatgcatgctttttgtaattaactggtgctttgaaaatcttttttaagggagaaaaatctcaaccaaagttatgctcatccagacaagctgacctttgagttaatttcagcacaactcattcttcagtgcctcatgactgaaaacaaaaaacaaaaaaacgaaagcatcttcacaatgaagcttccagatagcaccgttttgctaaaagatacattctcattgttttccaacagtgatggcttccacataaggttaaacaaactaggtgcttgtaaataatttattacagtttactctatcgcatttctgtaacatgaaatgcatgcccttcttcaggggaagactgtggtcaagttaaaaaaaaaaaacaatattaaacaacatgaaactgcagtctgtttttgaaaatgagaatgtcctaagtgattcagaagagaggagggaagttgtgcactctgaaaatgcatgaaaaacaaaggcaaaaactagtgggaaatgtgtagaactgttaactgagatggcttcgagtcttccttctggaatctgttaaatttcacaaagtcatgagggtaaatggagaaaatatttctgggattacaatgaatgtaagcccaaattgtggaattgccagtaacctggatggggaaaagcatttcccatagcactccatgtaatatgagtgctctgtgagatgttcatcagtgttttatagaaatggtgttgctgggaaaccaagtttgcacctggaaacttacaatgcactttagcgcagtaagggcttggcatccggtagtgaaaaactgtctaacccagcattgcccaaactattttgacaccaggacctttttctcctttgggatacttatgaacctctcactaatgtcctgtggagaacattttgggaaacact

SEQ ID NO: 62929 - DNA, 1048 bp, Homo sapiens
aggtagagacacgtccattaatgagtccagaaatgcaacagatgaatccctacgaaggaggttgattgcaaatctggctgagcatattctattcagtaagtagaataccagactctttaattctacaatttagattcatcatggtatggtgcaaactatacagattttggaatctgctgaggttagtttccacttctattaattcacaggtggtgataggtaagttattagaaagaaggtgataccgtgaggatttgagataattggagttaaacatcttatacagtgtctggtaattagtaggtgttcatgtggtagttgttgtactttttaaaaatagttattattaaaatgatttgttgcctctgttgctcattaatgtgttttatttgaactacttgaactaatttgtggtacaacgtctagatttatagttgcatgtccatttctcctttgaccccatgagtttttgtaatgcagcaaatatgagtggccttgtataaagctttgccttagccgtggagaatacaaaatgaataattaatggttctgaactcaatgagcttatgttcttgtcagtgggatggttatacacaaataattaaagtgaacctagagaggagaggagtgtgagttcactgcaggaccagtcttctttaagttccaagctgtacaattgtgtactgttgtggaggctgctttaaaatcccaaggcagcacagtggttctttggtgctcagcctagttgtgatttctttcttgctgctctctgggccaggaccctgatgatactctccgcaccccctgccaatgctactggggaggtcttcctccctcaccttgctcctcccattctggaggcccctattcctgcttgactttgggtcagaggattctttctcaagcacatttgattatgtctctatcctgcttaaaatctggatacaaaaaataataccttattgttaaaaagtttgaaaataaagatgaaatagacagcaaaaacccattacccaaataaccagtggtgttgctgtgtagtctctaa

SEQ ID NO: 62930 - DNA, 1020 bp, Homo sapiens
caaaatgggccagaaaacaaagtaaccatggcaaactaggtctttagtattgtcagaacaggcacactccacataggaggagatgttttgttctgtgaaatgtcaagctgctatataacaagatttgtctacgtcaaacacagatgaaagtcccagcaacattgacttggcatgtcatcttttaaatcaaaagagacatggtttaagtcaaaagattgaggaagctatttcaacagcaaaaagatactgccttccttgaatgagattacctgaaggctggatttgaagagcctaggagagttgggcaaactggacagaagtttgaattgagagaccaaggcttgagttttgcaaataacatgcatttttccgttgtctctgctgtacatgaggtagagtcaaatagaacaaactgagctgacgctgacctttatttttttttttaaagacccacagggaatttctccaatatgacctggccgcatggctcccttcctgaagacagacctggctgtggattttataatgagctctgtgaaactcagtctgcttttacgggtaagtatggctgtttggagaacgtagcagggaaagactttctatagtagggtctctgtatggcaggcagcactattgacattttgggccaggtaatttttgtgtatggggaggctggcatttcaagccatgcatccctgtatattataagatgtttagcggcacccctggcctctacccacagatgcctatagcagccctctagtcggaatgagaaatgtctccagacatggccaaatatcccctaggaggcaacatcacctttttcccctgtggagaatcactgctctaagggaaactggctcctgagatttgagtctcaggaacttcacctctagggaggttgaaagagtctggggaggggagtgtgccccagtggttaggagcccagccctggaattagatggatcatgcctggagaaccaccctaaggagaacacacagtaaatgttttgtaaacac

SEQ ID NO: 62931 - DNA, 1047 bp, Homo sapiens
ctaatttttgtattttcagtagagatggggtttcgccatgttggccaggctggtttctaactcctgacttcaggtgatccacccacctcagactcccagagttctgggattacaggtgtgagtcactgcgcccggccttaactttattttttaagactctgcctctgatatagaatactaatcacctacacattggagctatagattcaattctacctttcagaccaccaaaaaaaggctgatatctcagaaggtaccaagccccggtggtagagtccctttccagtgcttattccctgagggtctccggtggtagagtccctttccagtgcttattccctgagggtctccggtggtagagtccctttccagtgcttattccctgagggtctccagtggtagagtccctttccagtgcttactccctgagggtctttgagattcaccttaggaccctcagggagtgggcattgggaaggaagtacttaggaattaagcagcacctgagacttaacctgtggccttacttcctaaaatacactcagctccattcatctgtctctcccaccccattggtctcattcatcagtcttacccaacataaaattgagggcaaacccccagcccacctcaggggagctatgctggatgctcagacccacaaaaagaggtctctgttttggttcaccttccccaagagagtcgagagaaggaaagtgagccccatgcatgccccacatccttccttcccgttgctcctcctgacacagggtctgaaggcatgaccgagaccaggagggagacagcatgatgtgcccgtggaactcagccggcccttgattctaagtcgcttaaagaaagtcgggggtcaggatgcccccttggcctctgtcacaccctcacaagacccccttgctgaataacaccccctcgatggtccccttaccctgcgagggggccgcatctctcagtgcttctagtgaatgggggcttcccggctctgagttcttcctgccacacgagtccctgtccttcttccctcgctcg

SEQ ID NO: 62932 - DNA, 1108 bp, Homo sapiens
tcagccttacttaaaataagtttgggaacatccatttacaagaataaatggcatctcagcttttaaagctaagtcaaggaagtagtggtattaggctgaagaacacactaagtggcttagaagccctcacgtctaagccagaaggaggttgttataagtagacaagtagaagggcaggaaaatgtatagagaggatctagtcaaactgctaagaggaattcaggtcttgccaaaaggaattattcagaaagagagttactaggaattcggaggcaagtaagtggacttctagactaagagatgggaaaaaaaggaaggaaagcagggaagagatacccactctgattaaagagatataaaaatgaatgaggaggctgtgtacagaaaacattagtacttttgcttccaattgaaacagctgcatgaaagccttagaagtaacgtctcagactaactttccctgaagcatggctttgtcagagtggaagccacttgctcccccagggtgtgtgtcttgggtggtctaacattgagatcatttgtactaacattaatcactaatgatagctaccatttattaaatgcttactccatgccaggcacattaactcatcttcccagctattatcatttgtattgtactaagaattatgaaggactgagacagcttggttaagctcactcagcaagtggtagagctgatgaatgtctaagaaagtatactgggggctgggcacagtggctcatgcctgtaatcccagcagtttgggaggcagaggttggcagatcacttgagctcaagagttcaagaccagcctgggcaacatggcaaaactccatctctataaaaaatataaaaaaattagctatgggtggtggcatgagcctgtagtcccagctatttgggagactgaggtggaagaatggcttgagcccaggaggtggaggttgcagtgagcttagatcgtgccactgcactccagcctgggcaacagagccagaccctgaagaaagaaagacagaaggagagagagagagagagagagaaagaaagagaaggtgggaggaaggaaagaaggaaagaaagaaagaaaaggaaagaaagaaa

SEQ ID NO: 62933 - DNA, 1041 bp, Homo sapiens
cctttatgcaagagacaggaacccaggtactctgctctatcagacacctacaaaaaagagagatggggtgagagagagagagaagaggtcaagaccaaaaactgaccaatatcgtatcctgtagttcagaatactatgttagaaagaatctgtctaaaaacatggactcaacttacctgtttgtaagatagccatctgtagggctggtttggttttctatatcccaagcagggcccattgtctaaaaacataatattaaaagaaaatcaactccagttgcaaattctctggaccaaggaagctaaaaggagattaagaaggggcaagacacaaagggtaagtccaacaaggatttgagcttctattatatgtccaggaaattcaaagtcagaaagcactgagtcctcaaaaatgaagagtcctataaactatagttgaaacatttaggaaatgctacacaaaacaggagtggttcagtgttgaatatgtaacctccatgataatgtagacattcagagaaagccatccatatggggttagcccacaaaacatgaccaagtgaaagcctacaagtaaacacaaacagcctgtattgaacaatcttggattgaacttccctacaataaaaactatgctcataaagatataaaaaagttaaaatatgaatcatcaatctcatcacccaaataccattattaacactgatatattatcccatggcccttttgcatagtttgacagttatgttcattccccatgtatagaatgaatataatactttgataccttgcttcctctcccaatctgacctaagtattttcatgtcattatctcttctctgtagtggtttcaatggccagtcgatgaagggttctattatagttgactttatttcatcgtgggtatttagattgttttcaagcttgacactttaaattacgctaaatattttcaaattgatccttttaaatttagaccatttccttagaatagagcccctaaaatataataagggaagggaataggggctcagaacagtca

SEQ ID NO: 62934 - DNA, 1047 bp, Homo sapiens
ggctatcttacaaacaggtaagttgagtccatgtttttagacagattctttctaacatagtattctgaactacaggatacgatattggtcagtttttggtcttgacctcttctctctctctctcaccccatctctcttttttgtaggtgtctgatagagcagagtacctgggttcctgtctcttgcataaaggttataaatcatcaccagaccagtttgtcggcatctttgctcagaataggccagaggtaactatgttgaagttaactaaaggaaatgagtcagggttaagtttaaaaacttcaaatgctattccccgtccagcattccaacacttgttaatgccttaccaaagctattgttaaaattttctaatgcttattctacttgaaagagttaccactcagaacctatttaatttctggttaagtgtctggcactctcacctaggtgtttggacttctcttttttctcagcctatcatgtgttttttgaagtcagtctgattgttacatgaggaaaataaggaagctaggagggaccgccaaataagatcttgaagatattgtggaaagtatgtattagtattagaactgaaacttgcaatttgtaattgaactagtaaattcagccattcattgctactgagtctggccatagctatctttccacagtgagttggaagcagattttagacagtaagatgacagaatcaagcttatctccaagttttggttaagtcattaggcacattatccccagaggaagtctttttatgcttcaaacgctccctagaaatgcagcatatgatacatataacatacaaaatctgtgttaactgtctgtgttatcagcaaggcttccagtcgacagaagccattagtagttaagttttgggggagttaagttctatgtggatcttgttgaaagttcacaaactgtaagtcccatttctaatgctaatacaaatataaaaatattcaccaacatttttaggtgaatctgcatactccattcttgtcacagtcagcctcaatagaaaaaggt

SEQ ID NO: 62935 - DNA, 1058 bp, Homo sapiens
agaaacaaaaatgtcattaagaaaatgataaggaagagaaaatgtatatactattcattaggtggaagtggatcattataaaggtcttcatctgagtcatctttaccttgagtgggttgaggaggagggagaagagaggttggtcttgctgtctcagacctggcagaggtggaagaggtagaggagatggaaagagaggcaggaaatataggcaccctcaatgtaacttttattgaaaaaaaaaatccacaagcagacccttacagttcaaacccatgtgttcaaggagcaactgtatattagtctgctagaactgccataatctaatacacagaccatgtggcttaaacaacagaaatttattttctcacagttctggagtctaggaatccaaggtcagagtgtcagcaggtttagcttctcccgaggcctctctccttgacttgtagacagccactttttcattttgtcttcacacggccttttctctgtgcacatgtatccctcatgaccgttcttcttcatagaaggaagggattaggaccccacacttaaaacttcatttaaccttaattacttatttaaaagccctatctcatatactgtcacattggggattagggtttcaacatgaatttgggttgggccggaggaggggtgacagggagacaggattcagtccataacatctacattgatatttaaggcccatcactagcagattcctacctacctttccagttttatttcctgtagtcttcaagcttgctaatgtgtatccacacaatgatgttatgctgtctgtattagttcgttatcacactgttacgaagaaatacctgagactgggtaatttataaaggaaagaggtttaattgactcacagttctgcagtgctggggaggcctcaagaaacttacaatcatggcggaagggaaagcaaacatgtccttcttcacatggtggcaggaaagaaaagaatgagagcaaagggggtggaaagccccttatgaaatcagatcacatgagaactcactcactgtcacgagaacaatgta

SEQ ID NO: 62936 - DNA, 1009 bp, Homo sapiens
tatacaataactatctctgaaaaataaaaaatgtacaacaacaacaacatatgaacaaaaaccataacaaccaccaaatctactaattgcgtagcatggtaagaaactgctggaattgttatcagttctgctagaacactgcctgccctgtcaccagagcccatttagcatctgctgagagtcctaagagtgaaaggaagagttaaaatcttggaggtggttggggaggtgggggagggttccaaagcatgtgaagaatggccatgcattacttcctcacggatcccagcccgaggaatcatcacatactatattgcctgggttcaaatagcttcaacggctccctgaagcaatcagacactctaagaattgggtgagaaatatacaagatgaggttgagacatcttgtgccagaaaccaaggaagctatcagaggctacaggggtattgtcaaaaggacacatgagcaacttgatgaggtttcccaactgccacgatggggcagttagaagatcaagaagaaagactaacaatttgggaggctgaggtagggtgatcacttgaggtcaggagttcgagaccagcctggccaatatggtgaaaccccatctctactaaaaaatattaaaaaattagctgggtgtggtagtgcacgcctataatcccagctctcaggaggctgaggcaagagaatcacttgaacccaggaggcggaggttgcagtgagctgagatcgtgccattgcactccagcctgggtgacagagtgggactctgtctcaaaaaaaaaaaaaaaaaaaaagaatcactgaaattaaaaaaaaatctgaaaattatgaattcctaaaaatacaaagagaaaatctcattggctacttttgaagattgctgaggcacaaatccattcttctgaagattgataaataaaaagaatcaaatattcaccaggttttatggaagaatctcagctaatgaatgcaagaggaagacagaattacagaaatcaccat

SEQ ID NO: 62937 - DNA, 1021 bp, Homo sapiens
gattacaggcatgagccaccgccccctccaagttcaaggttttaagacactaagtggtctcgaacccttagagaccttgctttcctcgtgtcttgaccatagcacgtggccagctcacactttatcttgagtaagtctaaaagctcttctttggtttcccaggtgtatgaagcttatggtcaaacagaatgcacaggtggctgtacatttacattacctggggactggacatcaggtaagtcctccatctgctgggcaggaggtgccatggttgggagaaaggttctaactgaactaggactttggagtttagataacttcagttctctggactaatgtggcaaatgcaaaattcaagttttgggtccaggcctgcctatcttggctagtctgcattggtgccaggtgatttttcagtcttcctcttctagagtcaattcataaatatcttagaaatgtgcctggaattatcaccatgcaagagtttctcagctaattcagcacggtatgttctaggtcacgttggggtgcccctggcttgcaattacgtgaagctggaagatgtggctgacatgaactactttacagtgaataatgaaggagaggtgggtaggtcatgccctgtggtcagacagtcatggtggggaggtttatatcagaaagagcaaataattgtaagcaaacttggatttggcccctttgagattgttagcaaagaattaagcattctgaacttcactttcctatcccctatagtggagacttagatctggtgctcttcacagtgtagtggaagccatcaaatgatttaaggggagcaggtgtttcataaactgcccacgctgggaggagcagcctttgctattgtcaccgccttgtatgtctgctgtgcaggtctgcatcaagggtacaaacgtgttcaaaggatacctgaaggaccctgagaagacacaggaagccctggacagtgatggctggcttcacacaggagacattggtcgctggctcccggtaggtatat

SEQ ID NO: 62938 - DNA, 1052 bp, Homo sapiens
gttaggagctgtctttaaccacattagtccctattcgggatcatcaaatttgggaaatacctgttcctagcttgttatgaacatttaaaaatcttatttttttccccttcaaactgtgcttataatagatagcaaagtggggaataaaagtctaactacaagcttattaatttgaagtaataggacttactgctttcagtaatgtcactgtcatccatcagactatttcacctcaatttcattttctccctcaggtgtttcaagaataaggggttggttccctagaaaatgtgtggaaaagtgtccctgtgatgctgaaacagatcaagccccagagggggagaagaaaaatagatagctgctgttaaaacaaaattatcctttaagtctgcttaattacttgaaaattgtacatattactaaagaattatgcaatgagcctactctggttaagatgttcttttcctcaaaggtgccctagtgccatgatttaaatatttttattaccattttgaaatggagaagccattctgcatatgcctttgaattcctgcccctctttaccacctcttcctccccctcaaaggaaaaacatttcatccaagtaagttaacggcattttctgtaggattttcttatgcactgcacactctggacctcacctgcagatacagttccccccttgccaggagcatctgcatgtggtacttctcttttccctcagttgatatttcttatatgatattctagatactatagaactcaatttgtcagattcagtataacctcagattttgttacctgtcttttaaaaatgcagattttgtcaaatcaaataaagatcaatggatgttgggtataatcagtttttacttaaagcatttttctttttgctgactaaaaaggttcatcttagttccttatggaaaaactgctctgctgccctgtggacaactggcatcttaaaacgtggcttaagacatgacacacttgcttcaagatattaaccctattaatgggatattgcggtcatagtgatggcagcggatggc

SEQ ID NO: 62939 - DNA, 1053 bp, Homo sapiens
cttttatgacttctttttttgttttctggcgacggagtctcgctctgttgcccaggctggagtgcagtggcacaatcttggctcgctgcaacctccacttcctgggttcaagtgattctcctgccttagcctcccaagtagctgggattacaaggtgtatgccaccatgcccagctaagttttgtatttttagtagagacaggctttcaccatgttggccaggctggtctcaaactcctcacctcaagtaatccacccgccttggcctcccaaagtgctgggattacaggcgtgagccactgcacctggcggacttctttttatctacttctccagcctaatttcctacccttctctaccctgtctcacacttgatactaaattactcatagtttgtacatcttatgcttctgtatccttgcacatgttgttccctctgcctagaatgctcttccctctctttttgcctgatttcttgcttctcaagacttagttaaggtattgtttctcccaaggacccttcctggatactccctagacttggctaagtactttttgtttcctttgttcccttttcccatagcatctaccacaccccttcatcaccttttaacacacaatattgatagaatcctaacttcattgagtgtttctgttaggcaaagacatgtcttagtcattttataaattctcttatatttaccagtttttctttgtaaatagcctagaactcttttctttgaaattcagtccattttgaagactctgaagctgtgtttataaaaaagaaaatgaaattattctttactttctggggaggatggatttatataacttaatagattcatatgcattatagcttaataattattttagtaaatagttaactttaatatcactcaacaaataattgcaacattttccataaaacattgtcccctgataatcaaatatttcaaagtatcatttctaataagcataataaatatattgacattagattaacatttttttgtttgtttttgtggatgaccaaggctgcttataaaccgc

SEQ ID NO: 62940 - DNA, 1317 bp, Homo sapiens
ttatcgtctactagcctgggaccaaattctttgaaaaattttccccaatgcctctaatttagaatcatattagaaataaactaagatcctataatataaaagcctatatatgtggaatcagtcatatctaggaaaatcaaataatagaataaagactgaatacattcattatttttaaggcaagtgaaatattgaggttgactgaaatgagtcactgttacttctcataaatagattaatcgtaaatttaaagttagttaaaaatagtgataaaagattttaatagcaaattataagtaagcactgattaaatggattatatcaatgttttattaaaccttgctctgaaaatagtacttatgacataaagtttgattaacatactagattcagatttgattatggatgggtgtaatcattgttacggagaggtaccgtggtgcagtagttaagaacaaggactttggagtcagacggatgacatggtaattgtggtacttaacctctgttatccttggtatctttgtctatggaatggagtaataaaagctatctcagagaattatgaatatgataatcttaaaggaaccaaggtcgcattattaaattttactatcatttaatttccagatgaaaataattctcagaaacaaaacttctattgagtcatggattgaagagaaggtaaattttaataattgtttcttcaatattaaaaaagtatattaataaaggactggtaaagtcctgaatattaataaagtctgttattagaccggattaacgaaaagtgcctaaaagtgaaaacatggctgccaaatggctaccgtaagtcatttgcatgccacataaaaggtgaatataggaaacatttttgttcattctgtaactcccacagaaaggtgcttctcatacaccctgagtggtcgcagaggcctaagccacacgtcaaaccatctgtttgttgtctcttagactagaggagaaagcagcccatttggaaaggagcttccaccctaccaaactgccatcaggtttttctcagtgttttagacattcaatgaagctcctaacattttgcttgtcacagacctcacaatgtccaatacttcatactgtccattgtgattctagcatgaaacacaaatctgactaccctgctctgtgtttaaaacttctcagagcctcaccattcctgtggcaggggttgaaacccaaatacctgcagggtctgggcagataacgtccatgaaggggagcaagcctgtataccaaagaattgcctggcagaccaagctgattgttgccacaggggaa

SEQ ID NO: 62941 - DNA, 1947 bp, Homo sapiens
ggaagttacatgtgtctatttgagcccattaaccccactggaggtctataagggatttgttgagtctctattgtaggtcacttgggtcactgcacttacaaactagaagaaaaccaggaaccatgctcatttctttataatgagcattataaagagaccctctttcagtgggtctcctgacttctttaaacaaatacttgtagctgacatcttttcctcagaagctgttagaaagcctgccctttcctgtgctgtttagaatttaaaaggagtcacttaattgtttaaaagctcataaagatttttctttctgttccatgaagtataattctctcgtagctcatggacatgctggattcctatttgcttgatcttttgaagaccaaagttatttaaagtagacaggattttctgcctcatgttttatgtaaatttttcttgttagatgtgtgatgaagatggaccatcactgtccttggatcaacaactgttgtggttaccaaaatcatgcttcgttcacactgtttctccttttagcaccactgggttgtatccatgctgctttcatttttgtgatgactatgtacacacagctttatcatcgggtaagtgaaaatgaaaatgttttgttataaaatcatccatgcaagattaaatggtagttatcaacatttaagaggttccttttggaaatatgctttctgtgatttagttggggaaatagaactttgttttactggtatatgggttcctttttagaaagcattaaaacttaaattttaagatgaggaaagagtatttgttctgaaaacttacatgctgtagttgaaggtgataaatattttagtactgtatatgtaatttgttagacttcaaacttaatagttatggaaagaatagaagaaaaaaagacaacactagtgcttcctactttcatcccattcatgtggcaagttgtagttctttgttcatttctgattctagtgccctggaaggtggctcatggagcagatgcataccataaaatataaacagattaaaccagcaagagatcaagttgatttatgggcaagtagtcatgagataaagttcaagggacacaaacctccctaaacaggccttgaaagtaaacgagagacacacctgatgggactgccaaactggagagtctgtcctttggggaggggacagcccatatttgatctgctagcttgtggtgtttggaaattctagcccagaaaaatctgaaaatctggatttttatgtgaaatctcttgatttttaaatgttggcacctaattctgaatgttgaaacattatgcaggccaggcagcacacatctgtggccatatttggcctgcattttatcagttcttcatcaccatttgtaaaacatgagggaagaaacaactgaatcctaggcagcacttgtcactgtggaagaatactgcgatgtagaatagcaagagaagagaaaagacatagttctggtttagattagtgtctagtgttgtttatgtatgttaatgttggtaaggtctccttgacactttctgaggaaacaacaacaacaaaaagtaacatttgagaaaactaagaatgatatcctgcacatcggtccgagctcattactatattaattaaaaatagctggcccagctcagtggctcacgcctgtaatcctagcactttgggaggctgaggcggtgtgggtcacaaggtcaggagttcaagaccagcctggccaatctggtgacacctgtctctactaaaaatataaaaaataagccgggtgtgatggcacatgcctgtagtcccagctactcgggaggctgaggcaggagaattgcttgaacctgggaggtggaggttgcagtgagtcgagatcgtgccactgcactccagcctgggcgacagagtgagactccgtctcaaataaataaataa

SEQ ID NO: 62942 - DNA, 1050 bp, Homo sapiens
cagtttgcatgccattcaaacttgtaccatattttggataagtcaaaagtagttctttttgacatttgacaagatatgcatcccaaagtgtagtgcacttgtgagatgctgttgtgtaggtgtttattgtagttaacaagtatggtatgcaataaaggttttgttttgttttgttttaactgaactttcccattttgttttctttaggttgggtttcagaccaagacactggattctcctagttaagataaagagctttgggtgcctgacagtgaaaatggtgtaatctgcgttaacagttcacagcttgaaggcatgacaattaaagaacacacatggacttgtggcacatggaaatgtgcgcacagaaaaaggaaatctataattcttttaaagtaggaaggcattcttccttgccaaaatgggtacattctgttcggttatcaagtttgaaaatctacaagaattaaagagactgtgtcactggggtcccatcatagcccttggtgttatagcaatatgttctaccatggccatgattgactctgtgttgtggtattggcccttacatacaactggaggaagtgtgaatttcatcatgttgataaattggactgtcatgattctttataattacttcaatgccatgtttgtcggtccgggctttgtccctctggggtggaaaccggtaagaaagattctgtaagacaatgaactttaatgataatcgtatatttggtttttgccttatctactaaccaataataccaaacacagcctactgtttgtcctcacagagactaagtatattactctaatcactgatcatttaggctcggagactttatttcatatctgtttgaacacattgatccaaaatagcattttccaaagcaattttattgaatatttgctctgcattaaaaaaaagatggaggtggggtggaggtgggataggttcatggtcaaaagtttaggaaacatcacatgtcatacacagtgaggtttggctgtagtaccttttttcatgtaatacattaacatccctta

SEQ ID NO: 62943 - DNA, 1033 bp, Homo sapiens
tacttctctcatggggttgttaggtagattaaatttatataacatatttaaagtcacttttggtgttgttagttgctgtattagcattagtatttttcataccccccacccccatttcttgtttctcatccttcttggggatttattgtataacccagtttcatgtaaaacttggtacaagataatttttcacacttaaaaatttcacatctcccatctggaaatgtttttgtttttgtgtttccttttgtgttttagcacatcttattttctatgctagactgtcaactatgtgaaggtgggagctgtgtctgatttccttggcgtttacttattaggggctcaggaaaataagtgaatgagcaggtgaatataaatatgatcttttgtaactatggtttgtacaatgttgattcggggactatctttctctacagattagagtagttagttacagaaaagggttttacatttttgtttagttttgttagggaaattgaaccatcatctggctgctagacttgtccctaccctagctccaggatataaagtgtagaaaggtggatgtgctcattaatctgcggattggtgggcacttcacttgcccacttgtcctggtactagcaataatttctcccggacctaagttgtcattcctctttccctttccctacttcccccaaaacttatgtgtttataagtaattttcttcccttatttctttgtttttcttcccctcacctattttctgttaatagggatatttgcttgaagccaggatctctgaacttataccccactcatctcctgaagtccccagttagttctggaggagatggatgatgtcttaaagaggtttatgagtccaagtaagggaacaagaggagagaaccaaggtagtatataccaccaagctctgctgcctcagagatttttgtgtcgaaagtggctgatggcctcatctcttcatgatacatcacctcgcctcttctcttcagttctgcttttctccactgccggagatcgtcttgat

SEQ ID NO: 62944 - DNA, 1488 bp, Homo sapiens
atcgcccaggctggagtgcagtggcacgatctcggctcactgcaacctctacctccccagttcaagcaattctcctgtctcagcctcccgagtagctgggactacaggcacccgccaccacacccagctaatgtttgtatttttagtagagacgggatttcaccttgttggtcaggctagtctcaaactcctgacctcaggtgatctacctgcctcggcctcccgaagtgctgggattacaggggtgagccactgcgcctggcctggtttttattttttaatggcaactacaagtaagccacttctgctatcttgtatagtgcttgctgtatcttcttcatcacttgcaatcatcgttactagagttaattttaatctagcaattatcaagtaagagacactgttctaagtacattataagaattgcctcatttagttttcacagctgctctgtgaaaaagacactattttgtaagtgagaaaactaaggcacagagacattaagaaacctgttccagattccaggactaataagtagtagagcctatgatgtcaacgtaagagtctggcttcaaagcctatgcctaaaccattatagtatttctgcattgctgctgattaaactcttctgtgttgtatccaaagtgttatctgatagcaggttgttaaaaaaaaaaaaagcgccttgctgtgatttcattaagctatatgtaatttagcatattactgtatccatttaatgccatataaatgtggttataaagtatcgggagttaggatgaaggtaaagatcacatgttggttggtatgtgattttcctaattacaaaacacctgccagaataaatatcaccaaataaggcttggctgatgtttcatggattacccatgggaaataatagcttactttatcttcccatagttgtggaggttaatggtcagaagacaagacccggttggattgaatgatgggctattccaagtatattgaaatcaaattattaataacgtttgggttaatgtgtatcttttattttgttttattttatttttgagatggagtcttgctctctcacctagactggaaggagtgcagtggtgcaatctcagctcactgcaacctctgcctcccaggttcaagctattctcctgcctcagccttctgagtagctgggattacaggtgcccaccaccacgcccagctaatttggtatttttggtagagatggggtttcgccatgttgcccaagctgttctcaaactcctgacctcaagtgatccacccaccttggcctcccaaagtgttgggatgatgggcgtgagccacggcgcctggccaaatgtatatgttttaacaaagcatgtacttgagcacagtgtgtgtcacttggcaagtactcagaattgttgaactaaagaaaaattaagtgtaaaagtagtttcagtgttatttgatcattcagcaccctgaacctggtgcctcaactac

SEQ ID NO: 62945 - DNA, 1151 bp, Homo sapiens
aggtggatcacatcaataactctgatgccttttagactgggctcctattaattaaaaaaaattaaaactcattatgggcccaaattgataaaataaatatatatgcctaagtatgtgccctgtactagggtaacattttctccaactgctttgtgaaaggctagtttttctcagtaaaaatatgaaatatagtgagaaaattggattaagaacttgacaactcaaatttatactgagaaaattctacctgaagttaaagtttcaatataaatgatgaaagcaaaataacatgtttataaagattgttttagcttgcttacctcatttttaatggaactcttttctgaagatttttcttatgggttctagaaaaacaaagggtatgaatttgctagggctgtgacaacaaagtaccacagactgggtggcttaaacaacagaaatttgttttctcacaattctggaaactgaagttggagttcaaggtgttggcaggtgtggttccttttgaggcctctctccttgatctttagatggcttctccccatgtcttcatatgtcttccctcttcacgtttccatgtccctatttcctcatataagacatcagtcgtattgaattaaggcccacacgaatgacatcattgtaatgtaatcacctctttgaagaccctatctctggacagtcacattctcagtatgggaatcaagacttcagcatatgaatttagaagagacacaattcagttcataatgtttaggtcagttttaatcttttattcttaatttttttttcagaaattaaattatttctgtggcttataagtcagctaacccaacctttagtcttttttgtttctcaaagagtacaatactgggcaaagtcctttaggtatttggaaattgtatacttggataagtgttcctttctgggctatattttctattataaagaaaaatggaaccaacaactatgaaactaaaaatttattctctaggccagggatgtccaattttttagcttacctgggccacattggaagaagaattgtcttgggctacacataaaatatcctaacactgatgatagctgatgagctaaaaaaaaaaatagcaaaaaacctcataatattttaggaaagtttattaatt

SEQ ID NO: 62946 - DNA, 1007 bp, Homo sapiens
tccaatattctgcaaatatatggccagaaactgtgttatcaagactagtggaatctccgtttaatttccctgggaaaagtactgcatagtttaaaagacaaaccttttccttggctttccctttgagtcactctcatttttcatgtatggtatactattacttggaaagaaaagtagctaattgatttttaaatgaaatgccttttatgaacgtacttgctagtcactctcctggtagaatatcaaacattaaagaagaaacagtgatgctgtggtagtgatgttgctgaagggaacagaggccttaaggtgatggctcagtatggtagtgatgtccacatgttcattgtcctcttaaggcttacttacgttctagaattcttgaaactcacaatttaataccacaaactgaactagaagatttcatactttggccctagggttacaaaagtatttgaataaagtgtgtcaattttgtgctttgccaaactgaagtaaggtagcaatttgaaatgacacatcatgattccagtgtctcatttcttttttcataagtcttcagttgctttcataccattcttattggctttacccagttccacatttgtgagatgtggaacaaaatttaaaatgggttaggcacttttgacttagcatatagcttttaggtgagtttagctggtggtggtaaagactgagccagatctgatctctagggtgaagatttttaaactgtgtaatagtggttgagttttgctatgtcaactattttaagctttcttatacaagaagttaaattgggactagaatagattttgccagagacttttctgatgatttcaagtcctcataaacctagcagagaatggaccatgtgtacaaatagtctcattttttgcttatattgttttgtttgactttgtgtcctttagttcccaaaactggatgaactatgttttaggagtaaaaacaaataacaactgtgcagtcaaattgtgcttttggct

SEQ ID NO: 62947 - DNA, 1032 bp, Homo sapiens
agctttttcttccatatgggttgcagtgccattttattttatttttatttttctccttgaatctttaatgttattgttttaaataaaaaatttaaagttggcaaaatccagtattttacatttattctgtatcaaactattttaaaagttaatttcctttcagtgtaaagttaggtgttagttggggaaaacagagaagccgcgactgaataatgtttctgcttaggtggcaaaatgagtactttaaattttcaattaagcttaacaagaaaacaaatcctcagtctttgatagcatacggactgtctctttggcctaccttaagccaatgccaatggaatgtcttcatatgaagttttgttttcaaatttgcagtctaactgctttggaaataggtatattaactccctggtaagaagggaaatatggttataaaagtcttgtatatgtatgttgtttctgcatttagtaggagacactatatatgtccattttttttcttcaccctgtgaagtcttgtaaggctgattttaacttaattttgtacaagaattgtcaagaaattgctagtaatctgtaatcagagaaaaagaagtaaggatgtgatggataaataggattctgttatggccagcatcttcattgatcttagcagaattgctctttgcctccccagtgtctgtattttctcttggcagtgagccgagtgaatttggaacagaaagaaagagagagaaaatctgcttggttccaaatgatgatagctgtgcattggtgtggggaaaataacgtacaacttgatagtacaattactagaggatttcttgtatcttgtttagggggaaaattgaagttccttttgtggctagattggaaaatttctagcttaacataacccgtaacttatgatatcagtttgaatgatcatcatatcaagggatagaatttttaattaggaaattacttttaaaaactatttctgaatagtagtcaggaagacttagaaaaaaatactatcctgtgtcttaaaca

SEQ ID NO: 62948 - DNA, 1035 bp, Homo sapiens
catacttccaatttaatttaaacatgttccttattgcttcatcctgcattctccaatgtttgtactatcaggtactaaaccttatattgccttttagtttactttgtttaattagtgttgttgctccaactacattatatgctattttagagcaggaactgtgatatagcatgctatgtaagagcatataaattctaagtaaatatttctgaatgaatagatgaataaggttatcaaatctaatattctagaaaaattgaaataattgtccaactagctattctctgtattaagtgaagagtaccaagtcgaactatcattataatgcagagctttcctaagtctgactaaaatgcctctgttattcttggttaagatagaggattttgctatccatatcagccagaaccagacccaaaggtattatttaataatattattgagctgatcagtggcttgagcaagaattagaaacctatattatttgattctgtattcagcgttacttccagtgtaccactttgtcttctataatttgcacttcttgtagtggtctgactttttaaaagtcatgcaggactctggcttcctctaatttctctggtcttcatttctttttggttcaatatttgtggaatattatgtttggaggaatgggtaaccaatactctaggaatgtctatgtattttgggtcccaagagctaagtataccatgaaaggaagcactgttggggaatgcaagcctcagtagtcctagaaactacagtattatatcttatgtattaacaaagttttttttaattaaaggaaaaaaagatgatagtaaactctttgatgtcatccttttattttattctcgtgttttggaactttggcctcttagctcgcagtttcctcatctgtacaatgaagtgcttagactagaccagtagttcttaaactcaagcaacatcagaatcactgggagtgcttgttaatacacaggttgctgggtctaccctggagtttctgattctgaaggcccaggtggggcc

SEQ ID NO: 62949 - DNA, 1037 bp, Homo sapiens
ttccaagggttatcatatttagatgaacaattttcttagaaatgctgttgcttcaagtggtaggtgctctattcaggtagcctgtcactttaataaatgtcttccctcctaagtgtctctacctaaattattctattttcaccactgggactgaaatgttttccagtagagttttatctaaacagaaagggggcgggagggttggtaccatcaatcattcatctgctagatgtcagcaaaggcttaaatgaagaaataaccaggctttgggaaaagttgccttatctagtctgtatcctgtacaaatatttcaacattaggtaaggggagatatggcatttaataagtatatataaggaaaaattagagtatttaacttctttttacattgtattgcttgcaatactatgatagatatcatacctctgaaacttttttgctaaagtcacacgtgacccctgtttctgaggtctttctccagcttttatcttacttgtcatctatgtagaacttgattccctccctccttcttgaaactagcttccttgattccatactctcttggtctctccctgggtctctgttctgaatctccattggattctctttttctgctttcatcttaatgtttgcattttcatgtcattgttgttttgacttgtcatctctttattttctctggttaattttatgtatgcccatggctttcaccaatgtctatagattaacgacttcaaaattatatctctagcctagactttcacattgcattctccaccattttttcaattgtccatttcacatgtcccagtcctacagacattaaactacagtcttccaacttgaattcattaaacttattatcttttctccaaaacctgttcttcttcctgcatttcttcttcccgcatttattatgctggttaacgcatatgttggttattctaattaatgtgccatctacacagttacccatatgagaaaccttgaagacatttcatacttgtttctttgccttaccctcacccccactacgt

SEQ ID NO: 62950 - DNA, 1009 bp, Homo sapiens
atagtatttgctatctattatactataatctgtaacagggatgttgtttgtgtgattaaggactctactcacccacccccaaaaaagagagaagaatgactgagctgattatgtttgtttttggaaagatgtcacctcctccactatttggatgttatcagcttgagttcagacatgtgaacacgttcagatttgacttgggatttcagcttccctgattgaaatgtgagaatagctaaaggaaaaaaaaaatagcacatcaaacataaaagggtgatgtgataaaggggctttactcataatagattaaataatgtgaggatgagagaaaaaatattttcttctgtttttaaagtgagatttagattgctcatacctcttgaaaatgagtgaatcataattttatttcctatctactgcaaaaaacactatcttttttgcaaaaaagtgaatgcgtagttcccatgtcagttctttaaacagctatagatctttccctcatttgaaactactgcctaatgcagaggaaatagaaaggaagggggtgtgcctgtctaactcagactcctttatcgtaatggatgttgtagttctatgatagggatcccttttttttcaaacgtgttcacttctcttaatggacattttatatgcctaaaacatttgccttgcgtacatataagtatgatttttatgcctaaagaaaactgttccacaaaaatagattgagttcatattttctgaatttttcaaattatattcctgtcaccttaaagtgattatgcagagatttcccctggacttgtataaatcaaacttacaaattctgaaagtgcttggagaacctgaagtttacatgtaaggaactgtcacttcaataaatagagtatgataaattatagtcatgagaatatgtactgttagattattacttgtgtgaagttttccatctaaaatttgattgaggtgtaaaagttcaaagagaccacactgaacgttttggatattt

SEQ ID NO: 62951 - DNA, 2016 bp, Homo sapiens
ttttttcagcccacaaaggaacagattacctcttgtatcaaattctgcattgggggaaaaaaaatctttgtttcagaaaagatgttgattatcataactcaacatggtggcattgcacactctcatgttgcctatgatggagctagtaactcgagaaaatacgaaatcacgacttacagtccagtctacgcattgttaattttcagaaataggccatcttttgtttacttgaatgaataactcccggcctaagcaaagaaaaaaaaaaaaaagaaaaaagataaagatgaaaaaccctcccattacctagcttggctacaaatccgatgtagagcttgaatgcagccatgcagcacaaacaagatagaacgttttttgtttggaacctattgaaaaaacaaatgggtagcatttttaaacactcattgattatggcagggtggcatgccccaaatggtctctattgctgaagagtagttttaaactttggccctttaagtatcatagtcaaccaaagaatagtgcccccagaaagaaaagatcgctggccgatcaattcccagatcgtctctttctgagaattaatgtttgcctttttctcccatgatgttgggatagcaaagagaaagattccgatatatgataggccaggtattttagcttaaaattttgcttcttctggggaagaattataacttttcatgtgaaatgaaaagatgatttacttgtatgtaactggatggttgctgagtgtgttaattaaaaataaagaaagcttcttattttgaaacgatgataataaaggtttcattttcactgaatgtactgtgagacattacatgataacttatgtaccctttttataaagattcttaacagtttttaaaatcttattctttggtactcaaaatacttttcatataacaaatgaaataacagaataagctggaatgcatactgccttccttgaattcgggacaaaaacagcgttaagcattgagatatccgggctatagtaaacatgatacttacagagacttatagtgaacaattcaggcacatttctcccaaagcaatagtttaatttattgacctgcatatgtcaagtgttataacagatgttacagatatttggatgtttaaaaattatcagtcgtagacctgaattgctgaggatgcaaatttcagacctagaatgtggtttagtctgttacaacataggtttcagtttctagtcattgcagaaactgtggtcgtcatctcacttatacagtgatatttgtagtttagaataatgtcaaacacacacacacccacacgtacacacaatgagccagatatatggttatatattttagttcctaaagagttaaacagcttgttttatctgttatatttaaggtaaatagaaaaatgttctaaataagagaattaaaatgttatcataggataatttactaagaagtaaggagtgattttttatttgactttagtgaaaacaaaactgcaatataaatgaagtaagagctcattgccagtttacaatatgaagaaaattgaaaactgaagaaatcattcaaaaattaaaatgaaaacatgccacatgattgtggtagcctcttaagcaaaataaaaatgtagaaattgactcttacatacacagaagttcatatgatcgtgaatttttgatactatgatctaaataagtattatctctcctggcatactttattttctattaaaataacattacttccaaatgcagtcttattactagagtgggtacaagtataacattaactaacataatagtttgttgttttaaatacttactggaaccaaagcatgagctattaatcattttcatttgtaggtaaaatctgaaatcagttgtcaagattccaaatagggaaacatcctgaaaacttgtatatacaaaacctcttcaatggtacattcttagaagagaggaacagtaaacttgttttctttctttataatatagacttctatgaa

SEQ ID NO: 62952 - DNA, 1021 bp, Homo sapiens
tgaccagataccaaaactgatttgagaagggaagatattaacgtatgcagatacatgtatgcatgtacacacacacgcacacacacacagatacatacatttatatatttctaagtatctaggtatatatatatatatatatatatatatctgtatcagtttttatccattcatagccatgattagattataaatctgtttggcaacctgaatagatctaatgtatgatcattatggttacaaaaaaaatcaacaacaaccatctcaatggaggaaagaaagtttagaagctgaggatttgaagaaaatcctctaatttccccatcagataaatataaaagaggtatatataattactgtaaatttagttcacagtctaaagcactgtgtgttaaaatatcaacatcaatctacatagtgccatatatttaggaacaaatgcacaatattgtacatctatgtaaatggagaaacatgtgtctcttgtttcttagtgttgcctccagttgtctgaaaagtagaagtgctgtttagtattctgtcttagtagcatatgctgttctatatagcatcttgctgcacatccaaaattatggatcattttcttacaaataaagttcctgttttaaaatttctatctgcaagaatcaaaggagcaaatggatctttgaaatgattgcattttataaaaaataaatacaaatagggaacgtagatctatgcaagtatctcatatatccatctctgctgaaacagcaaagatccagttgggtatggtcttcgtacttttctcagtattttgaagtaagattcattgtggccacatacaacacgagtctccttttaaaaacacgaagtggatggtccatacgtgattgctggaaatctgtctatggtagtggttcctataatggaaaatttgctaaaaattaactgtaatgggttgcgaacccccccaccccatgttagggcatacgaaggcattttttttttaaggcaaaaaaaagaacattgtagacgg

SEQ ID NO: 62953 - DNA, 1069 bp, Homo sapiens
ctataaaagaaagttaatgtagaaaatagaatggagtagagtagaatagaatgcacattatagggtcttcttaataaataatgaaatccatcttctaaaattcttgaatcatttttgacatcttattttgtcatataggcagtcattgtctcttctggaactcagcagagggacacatgtccataatgtgcttggtttgagaaaaggcacatgattattcctaagtgctgttcacaccctgatatgcacggagtttaataccagtcaggtttctttgatggatcctttcttatttgagaatattgatgaagctacaagttaattgacagaacactacactggttgcatgaaccattggcttgatccagtgtggcattgcttttaagttcttgtcctagaatctgtgaataaaaagcagctctttttttttgttgttgttactattaatagtcagatatgacttttagctatggacatatccattttgtttgaggtcagggacttaatactcaaaattctgggtcatctgccctttattctgaaatgatgattcttcttttctctgaagtaaatatcccagaattacaataggcacaaaactaatgggagctgtattattaacaaagaaacaggctgaaagagaaattgtacaagggcagaaatgcaaggctcactctctgcttttaatacgtaaacaggtagcttaagaccctcccaactgtcccaccggtactgtagatgggcccccgtgcacctggcagtgcatctctggaactgtgagagtttgtctacactcagcagcctcacatccttgaatcacgatctgtaccacttgatgaccttgctcccccatccctcaccagcaagccttacaagttgtcaccccttctctcagtagtcactgcaggccacctcgccctgacttcccaggtggccactgatctctccacgacagggagctaacattctgtgagccttcctgccacgaagaagaggtgctcgagccttcacccagggccctgcgtgtcctgatgactgaacatatgtagaaataacacaatgtttattg

SEQ ID NO: 62954 - DNA, 2019 bp, Homo sapiens
taatgttcaatactctgtgcagatctgttgatgattaggacctgttcatttgaaaccaacaaaccaaccaaccaacaaacaaaatctgtcctaagaaggctacacaaatttaagagatgcacgagtttttctcactagtgttagcataagacttttacagacatccaaatttttcatgtaggtgagtcaaagggattgactggagtgactttgttactgtaaaaagagaccttttaaaaaaaaaaaaaccattgactctaaaaggtaagcatgaagatggaccaagtatcttattgcctcactgatactgcctgccagctgtgaattttcttactacaatgaatcccctcatttttattgctgtgtgcaaggtacagtgtttcatttttcttcctacttgggcttcctgtagaatgcacaccccatatagttctttaaattcatactgttgtgagaacaagtacgtctttctcttctctcttttgttaactgtaaaccttgtggagcaacagttctttcgtgccctctgtaagttgctggcctctgctcaaattaaacactgtaagattatcagcaggttacaaaggtgtagtgtatctctctcttctgcatttttgtataaggttgtcttgatctgaaaaatgctaacaaattcaaatgaactaatcgtctcacatccaccccttgtaaattgggactttgtgtcttctacataaaaagtagggagaacacacgtgcaatttctgttctcctttgaggatttaaaaaaagttactcatataaaatgcacagaaattattttttcatccaagtgccaagtcaggtcacctctctttcacctgcagtgaagcaaaatggaatgtgcctggagctttgctacgagacagactcaggttcaaatcttggtcctgccacttaataactgtaagaccttagacaagttccttagcctttctgagtcttagttttcaaatgtataaaaatccttgcagatcttctatatggaggttgtcctgagagataaatgtgataaactatataaaacatccaacacagtggtgatccataaatgttagtttccatttgtactaatttgcatagtaacgctagctgctgtaacaaataaaccccagtcgccccagtggcttgattcagtgacgtttatttctcactcttgaaactgtgtaatgcaagtgtccaagtgggcagacagccctttcaggtagttattcagaaatctaggcttcagctgtcttttggctctgccctgccctggggctttggtgtcctttacctttagccagcagctaggcaaagaaagtggagaaggtatacccacttttgaagctccgcattaattctacctgtgttccactgtcaagaacagttgaatggtgctacttagatgcagggggactgggaagtacagttccaactgaatgaccactttctaatacaactttatactaagaaagagggagaacaatataggtgggttggagggcagtttatctatctctgcaaagtatttatttcttgcctacttcactgcctcatacatcatcagttaagaccctagctattaacagtacaatgggcagaagtgaaaggatagatgacttacaggccaggtcagtggttgtgatcttctagtttttgtggcaaatgagactttatttctctcttttccatattaatagatacattaaggagtccgatatcatctgctttcttttctactagacatttatctttattcacttttcaaatttatattccttaggtctgtaacaaaaaataattctgctgtgtgtgtttttatctaagtggtgacaatagttgtaagtctgcaaatgtatatatgtcatttctaaagcatatgctaaaagtacacttacactgcagactgtcacagcccagaggaacttaaggaaacttaacataatgcaagttctggatggaatcctggaacagaaaaaggacattgtgcaaaaaccaaggacatatgaataaagttat

SEQ ID NO: 62955 - DNA, 1168 bp, Homo sapiens
agtgtattatgataataatagaaatggtaacataagaataatgagattatagattttttccctattctgaattttctaacatgttactatttaattttacaattaaaaaagaattttctctatatttaaagtgcctaaaatctattcttgaaaaattatttcacatcatagtttttcaaatatatatgcatacacacacaacatacacagagatacagagtgcgagtggggagagattccatatgtcaatatcatgaagaagccaaatgctggtaaaacataatttttacttacgtttgtttctccttatttaactgcctgaattatgtagtagtaggatttatgtctaaggttcaatatctctggaaattctacagtaacagactttaaaaactctttctatgtatgcttttaacttccttggcctattcctttggattattctggcttcataatggtgatttcctggtttctctaaacacagttgtacccatttcagcaatatttatatgtgaaagaaagtggaaattagaatccagatttgttgacccttgagatcttatattgaccttagtaggtgttaactttttagatcaataaagagctgttattgacctcaaagaaaagtcaatatctgcttgttaatttgcagcttagaaatgttatacattttgttcttcattattaccctacttatttcagccttttaaaaaaatgtctctactgtttccgctagagatcatcatgtctagatcaacattttagttttggtgtttaaggagataatcattggacatggtggtcatttatcagtgctccattttagtttcttataaaattgcaactgtctgagattcatactatacagaaaagtgaaatatatttaattgtacttgatttactgttgttattaatgtttgagaaacaattttaagtaatctatagctcatggcaagaatattctgacatgtatatatgagaaatgaaaaggaagttaaattggaaacaagtggtctgaaaagagattaataatgttttgcttttctgtgtataaatggaaataatctgtgtagattgaggtttcgcatacacttttcatgtggataaacatttaaagcttttaggtaaggacttcttatgtgagtctgaatcgtagaagcctatgatt

SEQ ID NO: 62956 - DNA, 1059 bp, Homo sapiens
tagaaatgtcattttggaatgtgtttaaaattgcctcattttatgcaggtgattataatacttaaggtatattgcagtttgaaaacagcattactgaataattttaaggaccatttatatatggtgggaggaacaaattatatatatatattcacacttggacaattgttatcatttcaaaacatttctccactactggagatttttctgtaaagcttgctttctccagtgagcccatctttctctttagataactgcatatgaaaggtgggatcaaaatgcccactgtgtattttactctcaccctggcatgtgtaaaggaggacttcttctccagggctccaccatgtagatgaagaagcacctggtgttttaataactttatttacacctcaactcttgaatttaacctttacatagcaattagaaacagataagaacaaagatattgttcttgaatgaggtagaaaaggcgtggtttgaaagggcttcctacaagtaaaattgaagaagaaaatacgcatgcacgtgtgtctgtagccacccacccctcaactcctgttcatgtgtgtttcctggacttgcattcttcattcccccaaaatcaaggcacatttagtgaatgtctagtctgagcaagtcagtgtctctaagtaccagaatggtggagacagagaaatcacagtgtatggcagtgtcaggactgggcttcatcccaaggaagtgaaaatccagtagtatttacagtagaaattattaaaagaatctgtttcctaatgggcagaggatcctgtcgtcctttaatttttttaaaaaaaagtcatgccctttaataaataatcatgtaaaagggaaaaacctctgattttagaagttactttttatttctttacagggagctgggaaaagacagcttattgattcagtgtgcataaatacttatcatagacttactgtgtagccattactttaggcaattcatccagctaaatagcctctaatgctatcatgaatgaagactatagaggtttatcaagatgaaaatagcccattaagaat

SEQ ID NO: 62957 - DNA, 1090 bp, Homo sapiens
taccatcctctccaaataattcatttaaaggaataggaaaaaaatgtgtaaattgacctaagcaatattaatgatgattgactgcaagtttttctttctttaagtgatttcagattttggatgaacatataacacatgttggttatactgatgtgcactgattccgttgtaaagagcagagatacttctaaattttgcccaagtacagattggcaacattgctccatttaattgtttcatacataataatgaatgctttactttgtatatctggaaaataaacctgactaataaatataggctgtcaaagtataattctgtagggcttcagcttgagacctcatcatctcgtcagtattgagaaaaaggtagagcgatggtgtagggggaaaacctggccttttgttctttacatctgaagtttgctcactgcaggcctccttcccacttcaaatgcaacaacagaaaggaggccttcctcttcttccctcaccctacatgcaccccccagtgctgccatcccgcacagccacgtttccacagtggattatctctttatcagctattcttcccttcactccatccattttccactaaccaatcaggcagccctcttaggaaagactggtgcttacttcaataaaatgttaattctgtacacacagagccacacagccattctagatgttgcttgtaacagaaaagcattcatgtaccccagacatggagaatacctgtattgggtgtcttatgagaaaaaattgggggaaataaagttatgatgggtagtagttactgaaatggaaaaggtattctattctttatagtgctgaccagccagagtggccacacacgtgtgtggggatgtacccatggttacctaaaaacatgcatcctgcttttaaggcatctgagatagtaaaagctagtttgtcacttgtagttctaactgacccagacaggagtaattgcagtgctgactctggtccattgagtgtatgatcttgaaaggccttctgactctagaaagattagggtgagcgatgtttagtaatgggtgtactttaacatataaagattttctattcag

SEQ ID NO: 62958 - DNA, 1066 bp, Homo sapiens
agttaagactgcaaacaaagactataacccacatagtactaagttcaacttgcagaccaccttcatccttgatggactttgtatgcaaaacaaagaattttgtgaatttttttagagtcattcattcatcatataaaaaaaatttttaagtagcctttcagtgctgtaaccttatcgcatacttggcaatagaccaaatgttcttcccataggtcctctcagtagacttgttttccagtcctgatgtttcattgactgtgtttacattgaccattcgacttgcgagcctaaacaaagagacattaacacgcttgaggaaatgcaaacagaaaatagtgtcattgacaattgttgaaggccaacaatgaaagactgtctctaatggtcttaatttattaacgtcaaattagcaccaatatatttttacacaattaagttgagaaagtactgaagtagaaactactggcaaatttaattttaatttgttccatggggttattcttaaggtatacatatctctgttttaaagcagaatgattccttgatgtggactggctattctacatgagaatatctgtgagtagtttttggacaaaaacatttcttttcatggcaaggtatagcatattacttcagttctcaaatttaatattttagctttgtaaattgacagtgcatttaaatatggtttttaaacattagacatcataaagtttattttaaaaacctaaggtgattaaaatatctactaaaatgttgaaaattgtaaaatctcagtagttaatgaagtatgagtggaaaaatttcaatttcaccctgaaaatagtttttttttttttttaattgacaaatctgaccttgagggagagaaaaaataaatgcaaccacaacttgcatggaatgaaaaaagcttttggaattaaatcatttggcagtgactgaaaaataaacatcggagtggcttttgttttaattttgttcagcgcgttgttgatttctttataacaaaagcaatagaaagaaaagatgaagtaatagtgaaccaaacagaaataattttccgtgt

SEQ ID NO: 62959 - DNA, 1020 bp, Homo sapiens
aataggaacctagaagaacctgtgctttgaaactttacatgcctatctgcaaagtctgtttttctctagagaaatgtcttttctatgcaaagtgtgcattcagtaccaccaattccctgcattttggtgctcagaccctcaaagacataattaaggggatttcttctttaaaagcctactgtgtggcatctcatacaattatatggcccttgctttttgttggtcttttttcaaatataacatgcagtgttgccaggaacaccatcatattaaaatataaaattaccttttgtgaaaaatggagtcagggcatacatctgggaatccaacaaactctaaactggctgtgtacaaaatttttttttttaagtttggaaactgatagctgcctgaaggttgcatatttaaagtcattttccctgcttccttcattttccccctgtggcaaagcaaagcagcacttcttatggggaaaaaaaaattgaaagaaagaaaagaaaacctaatattggcattctagtagtaaaataatggtaaagattgagcctggattttgtaatactttggatattggaatatcctaatttccagttggaaaaattagtatcaaatgtattttagatgaaaagttcagtgaatgctgacccatattttgagatataaacaaaaaacaattaaaagatagctattttaatgaaggaaaatataatatttaaataaagtgtttagacttcaaagtagagtgttgctcacgtaatagccagaatacctctgtgcatacatctcggaagaggctaaaatgccagatgtatttttgtgctaattttctcaccagcttctggagccagtagaggaattcagcacataatatctcatagaaggtatccctctcagcattttcccacgttcctccttctgattcattgctgaaagcagagataagagagttaacaaataactagactaataataaccataataacaaacatttattgagtggttactgtgtgcctggcacca

SEQ ID NO: 62960 - DNA, 1055 bp, Homo sapiens
aactttggaaagaattagcatattgacatagagtacataaacagtattccaaaactgtaatatagcattctagcataaaaagtgttgggtgtttcggacagacagaagctgaatcagaaatcaacattatctagccttaaagattgcagttacttctgataaaaccacttgggcttcctcagaggtcaaggatgtgcctgcaaacccatgtgctcatcagactgttggagtcaagtcctctgtttgtatacagtgtataaatggtaatatgggtaaacactgccctctcaaaccacataattacgtcgattgctgaaaaaacccagaaatgtaccaaaatatcacagggaagctatttctaacacgactttgctctttatggctaagtggcataaagagtggctttttttttttccttctaaattatgtgttcttgtttcaagcattgagatgatgcaaaacagatttttgtggcaacattctttttcgcagccaaaaaagcattcaaggaagctctgtactcctccttggttgctatttattctggaccttttgtattatccgtgtaaactcatttcattttaaaataagaactaaccttctttgggttgtttttcagcactgctaatagtgccaataaaatagctaattatggtgcgaagtgggcgtttttaaatgattcgttaaaactgagaaggaataagtgaacattacaggtgcaaaagagaacctttttccttagttttcctgcaatcctctgtataaagcctattttcaacagagacccactagtttttcaactggataaaataaaggataattttgacattgcatgtgacctgtaatctcaaaagcaagtaatactttctcagtcttccttatctctttttgtcctctcttcatcctttcctcttctttctttgttcctgctgcctctctgtgtaccccgctgcctcctctagccgatctccttagaaacaattgtggttaacaaagtcggaagtcaaaacagttactctcatagccatggtaaaaaagaccaaagtaaacaaatt

SEQ ID NO: 62961 - DNA, 1054 bp, Homo sapiens
tgctcaaaaaaaataaaagcagttttatctagcttcgttcttcagagtaacatgagactagcacttgaagatccaagaccattctgagtcagttttcttgcagtaaactcttgggcaccttgatttttggctgtcttcagcttaacccctttcacttgtaagtctctaattatctaaagcgtatggttgtgttttcacttatgcaggtagtttatgtaccatttattgaaagacctcttcctttccttctgaaccattgttttccttctgttcagtctccaaatgtacctttctctcctctttagcctttgactgacatttctgtgaagcattttgtgatgtgcatttagaacactacgtaaaaataaactgcattgtgttatttaaatatttagaggcctttgtagccttgcaggctatttttaaaatgacctttaaaaccatttgcaaagaagacaaaagtaatggggggaaagcataaccttttaatgtttccttcattagtggcgttccctaccttggatgcattgccttgctttgatagttcataatgtaggatacatcaaagacccaaataatggagaacaatggggaccaatttttttaaagctgattttgcattattgctgctgccattaggtgtcagatggaaaagatccctttcttttaaataagctggactcatgattgattttctacgtgtggtagacccccttggtaatgctggtgtgtaaagaaagacctgctatgcattcatatgtgaattgggcttatccggtttcctacgactttgcttttgtacagcaagtttatttttgagaggagagagtcaatctgcgttatatctgactcaataataacaagaaaccaagttgcagtaagagtctgctctattccttccttcattcagtcaatcctccgttcaccatttctccaaaacataccagtccgtctttgactgtattttgagggtctggacccagaacaggaagagtcaaccttccagaaacttctctgataaagaaaaatgagagacagaggtccagggccactg

SEQ ID NO: 62962 - DNA, 1078 bp, Homo sapiens
taaatattgaagttcaataaaaactggttggcatatctgctatgcctaaacaattttgctaatattaagaaggttctcggctaaaattctgactcatcaattatttactttttttttttttaatttaaatgactatttctatggggaatcttttgtaaatgtgtctggtctaattaatttggtgccaaccaggcaccaatgccttgtcgactctctttatttactgtggtatgcagtcacttttcttagttgttccgtgcctcatcctaggaagtaggtttgtcctgtttgctttcataagcatgactggccagtaaaacccttgacctttaaattaatgggtaatacgaattcatctcattccatcatgaaacaaagattctctgtatcagatattactatttattagtaagacaaggggatgggggatgccatgtgctctgaggtatcactattagttaatgagaatggtccacattttatccttcttaggagtaatttttctgaagggcattgggaaattaaataaacacatctgaaattggatttagattttgatagagcagaatgattacaactagggtcccttagtagcctggggttattcaaatacagataaagacaatacatttccataaattctgaagaaaacatgtggctggagtatgagccatatttttctgagtgctggggttgatggccattaaaaatgagaagaactgaaacatgcaggcattagttcctcacatgacagttgctctaaatcaccatttatagaatgcactttttaatgtgagcatttctaaagttaacatgagcaatagaaatgtcaaaagtgaaaattaaatcattaattctaacatattcctttcctaattaagaataattacagcaggggctagattttattcaccctttgacctcaaccttgcttgctcagtgcctgggacttactgtttattgagcgaatgaaaaaattttttttatcaaatcttttgcttaggcaggtccacaaatggcagggggcatacccgggatattgctgaaaatgagcaattgatatgcaagagttagacaa

SEQ ID NO: 62963 - DNA, 1161 bp, Homo sapiens
ttagttaaagaagggaattacaggtaaccctcatttgtacctgtgccatgcgtggtcttgagtcttaagaagcaatttttctttaggccttgtgagggtacaagagcatcaggcatctggcattatcaaatgttgaagtacttcttcacaacgtgttgtttactcatgcccttgtcacctaaggtggcgcttttatttttttaagaatagaatgagaccttactacacttgagggggagaaagtgtagacagcagcggttaatatttggttcactcttttgtggcttaccataagtttatgggaaaaagaaagagaccgcccatggcttcatcatgcctggtggttggctcaccaacttagtctcttataagaaattatctttaaaaggggattctccaaaaaaataaaagaagaagctttgaagggggtttgttttctgtacctagataactatacattatccaagagagctcctgtatattttaatggacaggtagacactgagacagttgggcatcttgaaggacttgtggagattttatgggcctggtcagttgtgaagtcaggttagattttatgggcctggtgagtttgtgaaatcaggttaatccaagaggctattgtcagatactggtcacaaggcacagttatgaaagaaattacaacactgaaaatcttgtgagatctgtgacagcaaggctctcagcagaaagcaaggtcagtttcacagatgagaatagggacacaaaatgtgccgttatttttttttcttttttcataagcacaccaccagcataggaaagtagcttttaaatagaatcatattgatggatcaatccaaggaaagggatggagtacacagataatggaattcagatttcccaaatatgtggcaaatggatcattgttgaaattattagctgaaaaaaaacctaaaaatccataagtatctaacatttgtattggcaatgggttaaggatttccaataagactgtggcagtccatgatattgactttctggaagatatatattagcattaaatgtgaagttattgaacatcttaaaggaaaaattatttgcaagaataaactgtcacagtagtttagcaagggcaaggtttttctgagatactatagatggagagatttccatctggaa

SEQ ID NO: 62964 - DNA, 1062 bp, Homo sapiens
gacataattgaaagggtgtccagcatggagaacatggctgtccatgtggttcgggaaggtctcgacccctgggttgtatttttaactttgaaattgttcagcaacaatctggttctcccagggcttttaaaactctcctctaaagtatttctggcaacagtctggaaatcctggtgacaggtaaaagcacactatgtttttaagcctggtaagtaactttgtgtaatattaacagtgtgtgttgttcctttcacttaattattattggactttagtagaatttgcatcttattgttggaccgtaaatctctttggggtattattgttactgatcattgaagctatttgatccaacaagcatttattctttatttatgtgcaatacattgtactaggcactgtggatctatgaagaggaaagacacactgcctgctctggagggatgtacacagtttagcggaaagaatggctctgggaaaggcttgcttatgagtctgacagctacaacagaggtggaaactacttataggcctataagagaggaagaaacagattcaagtggggagaactggtaggacttgtggcgggggccagtttttaactagaaattttgaactggctgggcgcggtggctcacgtctgtaatcccaaaactttgggaggccgaggcgggtggatgacctgaagtcaggagttcgagaccagcctgaccaacaaggtgaaaccccgtctctactaaaatacaaaaataagctgggcatggtggtgggcgcctgtaatctcagctacttgggaggctgaggcaggagaatcgcttgaacccaggaggcagaggttgcagtgaactgagatcatgccattgcactccagcctgggcaataagaccgaaactccatctcaaaaaaaaaaaaagaaaagaaaagaaaaaagaaattttgaaccatggccaagagataggagaattcagagatacttagcaaaagtgagtgtccagaggcatgaagtgccttagaattggtgttaggtgagcaatgcggcattccagaccgggactattggca

SEQ ID NO: 62965 - DNA, 1381 bp, Homo sapiens
tatttaagaactgacatggggtgactagatgttttaacatttaagagctctagaacaggctgaaaacactaacatccaagtgtttacctatgaattgatattggaatacaagaaactaacttacattgaaaaggtatatacagaatatggaaatttttataaaaaacaaaagccagcttagtctaatagtttgtttttgcttttaaaagaaaagtttgtttgaaatcttcattgactctcagctgctggttccagaaactacacatattcccaatatggcttatgccagttttctgctttgaagactaaaaaatagaccagaagacaaaatatgatttcatgattctgtgcctcccttgtgacagtagaaaagtaatttaactcctttgtgcagcttttcttcaccagtaaattaggaataatcatgtcttccaccttctgttggggactttgaagagtaatgattcaagggccatttggagttaaaatagaaatatgaaattatttttctttacccaaagacttaagttcatggaatatgagaatatctcttaaatcatttttatttttaaatgcccatttaaaaattcagcattttaaatctatttactttgtgtttatattgcaaaaatagaacacagatgctaaagatgtcatattaggacatctttaatagcaatatctatcaatgccattaaaatattatctatctatgaagcataaagtcccactgttctaagagtaaaacatgggtgtttaaaaaatatgcagaaactacccaatttatcagaaacaatcgcagtcagtttttgaatctgactaaaatcttattttgcccatagcttgcctcctctcccactcctcctgctcccacctctcatggaggaagagtggaccagctcacatggggatcaggcattccacagcctggaggtgggtaaggaggatctcaacaatctgggaaaaaaaacaaacaacaacaacaacaaaaaaaaaccccactagcttctatagataaatattgatgtggatcaggttgttgtactttgtaagtaatttatgtgcctttattaactgctgaaatgatatagacttgtaccatataaaagggttccaatgttgattcccaatagaaaaatacagctaaagcattttaatattggcctatcatttggcagctgttgaattaggcagttgttttatttaaagtgaatcagtattcttttgtgtataagagaggagtagccctgagggtagtcgaatgcaaaatacagggctcagtccagaaacagatcttggcgtcattcattgtctgggctccagaaagacgttgatggatgctgtggtttagtatccaaattactctatttatatctcagtt

SEQ ID NO: 62966 - DNA, 1089 bp, Homo sapiens
ttgcttttacaaaccacatttggccccatatcaatccgttgtgtagaccacatcaagtttccagtccacagcccaactcctgcacttgcgcttgtctttgaacacaaatgggccgcagaaagaggaactgttgggctttgtgagtgaccggaaacagggtaccattgagcagaaattgaactgatcgcaccgtgttaagtcaggaagattctcaacccagaccactctttgagcaccaagttaacatgtattgcatttaaaatgtaataaatgcagtattcataaacttatatgtgtcttgtgccttttgtgtcagcagggtttctgtaggcctctatttacatcaaataaacttcaaatattccagaatgtagaccgcatctggttcatttttgaagtgtccctctaggaacatttctaaaatagtagattgttccaatttttttcctaatgagaaaaatccatgtgttctgtgattattaataataatggcttcaaataaattattgactggttgcaatggaatgcactttcgagcagctgaggaactccgcacaaaatgtctgagttgtattcctctgatccccccctctccatcagttctatgggttatcagccaacccaagcacagttgctgacgggttagtaagagaaagatgggacagatgtgaaggattcatggttcaaaattatagtaacatttaataaaaatttaaaagcagttgctgattcttctgtttttgatttatgaatttgggggcttaaaaaatgttgtattcatagcattcagtatatcagcacatatatacgtatacactcatagtatacagggtagtgtgtgtgtgtgtgtgtgtatgtgcatgctaaatgattaccatttgtgaggcattgtatggagggaaatgaatgagactgattccctgctatggggaagtttgttacagtctaatggggagacaggcatgaccccagttagtcattctttaataactaggccgagcatagggagaagaccaaaacaccaagccttggggtctgtgccataatagtggtacagataatgaattgagtccagaggagggaaaaatg

SEQ ID NO: 62967 - DNA, 1837 bp, Homo sapiens
aaaaccttagtcatgacagagaaaagatacagcgagcacgtgaaagagtaagtacaattgatacagttttttcacatattcagtaaatgaagacataaatgaaaggcattgggacataaacaatagcaattaggtagatatatgtgtgtaaggtgaaagagggtataaggtctgtggaaaggaaaaggaagagggtgagatggagcaaatagcagctgactctatgtccccattccagaatgttcccaggtaggtattttatttacttcttatagaggagaaggtcactgagggagattttggagtatgttcatcttttagagtgaaaactatagaattattggtggtcatctttcctcacttcattttatttttgtttatatgtttttaggactttgcacattcataagctggagatgaattaccaaatgtatatgaaactttttcagcctgtgctttgcttttatgtccagttctagtatccagcttaaagctcccaagattacctctcacgtgtcattctccaaatttaagaattttccaagtttgtgtagctgtcagaatgtatttatttttgtgtatttgaacatttttattgtttggattttctatcatgaaataaattgtcgcttgccatgcactttagaaataatctaattgcatgaacttctgttttgttttgtttcttcttgtagcttcgggaaacagatgctaatttgggaaaaagctccaggattctgacagggatgttgcgaaggtaagagcaaggtagggacatatctttctctctgtgtgtttttttaaaatactatgttttcattcaattgcaatggggcatattacatgcttttgagcttctgctcttagtaccctgtgcaggacccatttgaaataacagagcactgatgttaactcttgtttggacagggacacatactaacacagattagagagaaggcttgagctaggggggtaacctcaagctatggaaaaaattagggttagacatgaagtattttttcatagcctgaggaaggccccatgggcagcagcaggctgattttattttctatttcgatggccttcttcttatggagggaatgcagacctaccattttcaggagcacatttgccattagctttgctctctgttgccttgttttcatttctttaagtgacgctgtttggggaaacatttccgttttatgtatatacttaaagatgatttataaaacgtcaagattatctgaataatatgtgctaagaaacaaatgttcatgttttatatgtgtaactctaccttgattgatggaaaatatgctaaatagtatgagaaaatagatgaatgaatgtaggtaatgttcttataagtacattcagcacgaaattatttcacattcagaatctaccacataaaaatatcatctagcacgactgtcagtttggaactgtggatagaaaagtgaacgagaaacattgagaatggcctctggaatggcttaactggaatttttaagaaggaaatctttatagttgatactatagagacaaccatctaaaaataactaaagtcttgtctgatcacatatccatatacaatagtttgctaaaagtatgtttgccgtgttacagacttattgcataagaaccaatcaaatgtctagtggtttggtcttcaaggctgataacattttctaagcagcctgaccagtagcaagcctaaagttcctgggacatttccagccaaggctagtataatgtgacatttcccctcatttccttgaacccgactcccaactcagaatcataagccatcaaattctgtgattaagagtac

SEQ ID NO: 62968 - DNA, 1648 bp, Homo sapiens
tgcatttatatttttacttctctatctctttttcttttctctgttctctcattcctctttctcagcacattttacttactggtgataaactcgggccctgacctgaaattagtgtagcaaaatctcaatgtctaaactgttcttcagcttttaatcaagtgcttattctttcagaataaagtgattgaatttcctatagattctttggacttaacagatttaggatctgagctagaataatgctacaaagagaatttttaaaaatcttggttctttttgtgtgcataagtttatttctgtacagttgactcattgcctttgtcctacgacctcttcaaggccagcatgggtaacgtttttaccaaaccaaagaatagctttggagttgcttatatgtttctctttaataacatgcttgtgcctttaaacatagatttttgctctagtgtcagacacttgaatgcaacaccttatctgtcaatgataactctaccagctgcattctttgagccttaagtgcatatgtgaccctcaatcatgtattgtacatcttatctgattttatccttaacagttctgtgaaggaggcatcactatcccccttttacaggtgaggcaaactgtgcttagtgaagttaagtaaactatccagattcacatattgtagaaaggaacagaattaggatgtgaacttagtttgctcttttgacacactacacaaggttcccaaaggccagtttgtgaatcagaaccagttttcactagtggtaaaatgagaagagtaagaacaaacagttgagtttttgttatgccaacttttattgtgagacactattatagttccatttcttctgtgaaataattggtggcagtaaataatttccttaaactaggttcattgttacagtaaatagaaaaataaatacttgtaagtattaaacattggcaatcatatgtcagtcctcccactgtcccatgcccccctctcatttcactgaccaggaaattcaaaatccatactatgctatgccttttaataaccaaaaaaactgctacttatgcactctctgataggtaggtagcagccacagtcctagacatttgttatacgttatcttctttcactttctatgataactctataagatggatactgttactcccattttaagaaataagggaaccacgggtaaatatcatcagggtctacataagtcatctgcctccaggggctggttttcctactgtaccaactatttgtccttctatgaagacccagtttcctcacagatggtcagacagcccttctgggtgtgcagacagttgttcctgaaagcaatgaacaaaccctaccagattccaccattgagggtgggctgaaggcgctcagctgcagctactgtatgccacaggagtcccaagtgagtgtgttcttaaggagtcctttcgaattgttgtattgctaagcatagactgtgtggcattaaccagaaccgagaaataacaacaccgtgcagcagaagaatctataatctcccttacctccggaatttgacaagtgtcattgttaggaaattttatttctatatctaactttgtcatctgagtcttatccttgctggagcaaacagttccagtcttgtttaat

SEQ ID NO: 62969 - DNA, 1062 bp, Homo sapiens
tacgaaaacaaacagcaccttagtttcctgtgcaattatagtttacctaggaaaaagctattccactgcccacctatcttccaatggcttaatgattttgtgatgaggggaaaaaaaaaaaaacacctgtcaaccatttaattcccaaatcagttaaagatgtccgaatcaggtcccccaatgctttcctgaaaccacactccctgtctcaagccatagggcagtggttcctatcctggagtgggcttcatggagtcttgaatctctgaagttttctaaaaatgtatgtgcatatgtgtgtatatgcatctttctggggcttttccattacatttccttaaaaggttcaaaagagtctacaaccaactccaaaaaaaagttgagaaaatgagatattgttaaagaactgtgtccagtttcgtagctaaataccatttaattactttgatactctggcttacttaaaatgcattgacctacaaggaacacttattttgaatttgtccacaaagttcaacaagacactgaaaactcaaggatgccatccttgggaaatcagatcatttgtcaaaagtacgtccttaaagacaatcagaacaattacatttatatgggaccttatggtttgtaagacacagtcacatatattatttttttaagttattcttcgtaagaactctgaattcatattgtcattattatcttgtggtatagatagttgagacctacagaagttgagtcttgcccaagttcatgccacaaagatagagcagaacttggaccagaaccctggttttagccacagaaatcatgttcttagcagcattctggcggtaacaccatcagcctcttcttcaacatcaaatgtttaatgtctactgggtaaaagggcatatggagattcccttaagaatccaatgttagtcactggagattcaacaaattcaaaactctactcctaggtagcttaatatctaattgggagcttttgttgtgacattttaagaaacaacaatacatagtaacttgtgctacatagtaagtgagagatcattgctctag

SEQ ID NO: 62970 - DNA, 2643 bp, Homo sapiens
ggccgtaatatttttagatcctacccttcttaggaatctatagatgtggaaccattgtcttctggcatttcgtgtttcagaatagcagaaaaatagaccaatttatgatactctggagtgacatgttgtaggttttctttgtttagttttggttttttaaatctttggaattgaacagagtctagatatttctatatatgatgactttcactcattttgcatggatcacagaactttaaatctgcaaattcaagtcttccctctacctaccagaagcggttttttaaaaatcatgtcttggattattgcttccatttcaaattttctggtgtcaggatcatccatgattctcacactagacctctgtatctcttatgtttgtcatgttttaaaaataatttttttctcttctttttcttctcatttatctccaacaccattaactcccctctctagcattgtttctagtctgtgctgctggttatgtgagtattaatgctgctgttgcattactggtttccttgaaatcttttctttatcctattgcctcatctcttatctccttgaagtctcgctggttcttaccttaccgttttctgccctggctttataaagctttaccttcttactgtttttattaaggacaccaaagtattttcaaaaacattttttggtttctttagttcataagtttcagaatcgcattctttctcagaatctttaggatgttgttgtttttttccccccttgttctgtagtattgatttttcccatcaacctcatgttattttgagttttttatttagttacttttcaaaacgacttcttgaatctgcaaatggagagctgcttgatatgctcgcctctgtcccaattccctttgtctgtggactgtctttattggaaagaaatgagacttcttccttctcccactccttgactctgttgggaaaaatgtccaccccttatgtgtacaactgtcatatccttcccaagcttaccctgccaccaccacaaaaaaacacactatttatgaagaccacagttcccagaattcagtgcatgatgccataccttctctatagctacctaatactgatttattgttttcctgggaactctggtttccttactgcatatggaacagaaacaagatggggaatgtggagaaaaggaaaagaagacagcagtccaaatacctcctgagttacgatacttataagagagattgcatcttgatttctggttgttacaaaccatgcactttctatctagtagaagactatgtggcaggtgaaccacttctttcatttttcagcacagttcattttttgtagcagtagaaaatcctaggctctggcagtttgtgatgtaagttttggtggtgtaaattttcatcatcttctattttcttcattcaaatgtaatggacactttgataggggcagcattaggatccatggagaggcaccattgtaaactggaagctgagtgatttttaaaattgccctagataagggggccatacaaactatttctatagccctacccttgggcctgtctgcctgggtggtcctgttttaactgttggtatttaattattgatgatttactgacacaaggcatggaagccttagggaaaatgaattccgacgtgctagtttctttagatgaatcttctttgaggtttaagtgtccttctaagtggtatagtgaggcaggatttcgggggccatttcaaatactgcctcgcaaagtcagccacggtgtaagtgcctactatatgctctggacagaatgaaccttattaaagggcctagttctttcatagttttcatgtaacccattgatgtctttcttttcacacgttatttcctcttgaacatcactggtttcgtggtgtttttctaaggcttctgaaaggtactacaaactatgtatatagacaggattgaactccaccagaaggtggaatttttctttaggggcactgtgccatcaaaactgagctggtgcccaaatgcctccctttagagcttgctgccttgatcatgcagctgagctgtcttctcagatgctctgtgggcaccgctgtaacctgttccctcagctctgctgagtgtggcataatcagattccttgctgagaatcggtgaatggaggggtagaggggagccagggctagatcctggaggactttaggaagctgcagatcagatcagagagcctggataggcaaggatgaaatcaaacttcaccacatcaacaaaacaggcctaggcatactacaacttttttttttttttttttttttttttttttttgagacggagttttgctctgtctcccaggccggagtgcagtggcgcgatctcagctcactgcaagctccacctcccgggttcacgccattctcctgcctcagcctcccgagtagctgggactataggctcccaccaccacgcccggctaattttttgtatttttagtagagatggggtttcaccttgttagccaggatggtctcgatctcctgacctcgtgatctgcccgcctcggcctcccaaagtgcagggattacaggtgtgagccactgcgcccggcaactttttttttaagcaacaattttgctttaataggact

SEQ ID NO: 62971 - DNA, 1011 bp, Homo sapiens
ctgtagagttggatgtttgttggtatgcatatgcagctgtgttgccttgctccaccaccacacatcaagatatagaacagttccctcactccagaagtttcctcctacccctttgcattcaaatctctttccccaccctgccacagagagccactgatctgcttcctgacattagagttttgccttttctaaaatttcatgtaaatggaattatacagtgtgtcatcttttgtatatgacttctttcatttgcatagagcttttgaaattaatccatgtagttgcatatgtcagtatttcattccttttaattgctgagtaatattccagagtgggggtatactacaatttatctattcaccagtagatgaatgtgtaagttgcttccagtttggggctattttaaataacgctgctgtgaatatttgtgtatatatctttttgcagacataggttttcgtttctcttggtaaatacttaggagtaggattgatgggtcatatggtaagtatatgtttaattttataagaacctatccgattgttcccaaagacactgaaccattttgcagtcccataaacatggatgagagttccggttgctctccatcattgctcttaaagcatccaaacactcagaacccattaaagggccacatggcctccagctcaccccagttcctatttgacctattttcctcatttacattacccacctgtaacctgtaggtttgtgacctgtgccattgagcaactttatgctccatagcatatagcagggtgtgacagttaagagcagggtctatggagattctcggttggaatctccatcttgccatttataagctgtcactttggacttctctctgaattcgcttcttcatcggtaaaatgctaaaaacaccttatttattagctggctagttgtaaaaatgaaaaatatagagcatgtgaagcatccatcacaggactgggcctgtagaaaatgtacaatagatggtacctgttagta

SEQ ID NO: 62972 - DNA, 1014 bp, Homo sapiens
accctagagtgtagattaaaataactaatgcacatatatgtctccctatctgtgcagaaatgctttaaagttaattacagacggtataacagttgatttctggggttccatccaaacttaagattctacaattctacaaatgaagggtcctagtaaatgtacttgtttctcctcattcttctgtctgctctttctggaagcctctgaattccccaggccatgtcagtgtctttcccctccctgcaccttcatggaagcacacacttctttcatggcatcttacttcaggcccagaaacatgcactgaggattccagcctttgtaaaatggcatctcttttgatttacccacactgacctaccttatttcccagatgtcaatgatttgagtagtaccatcactgtttttattgtggggaggtggggagggcatacctacctgcctaacacctatattatttttcctttaaattggcacaatttcttcttctttagctttatcgcacagagtattgcccatggttttaatgtgctagctatgcattttttcacacgttaaaatagatgcataactaaatacctgaaataaaatgttaaaagtaagtaatcatctgcgtgttgcctaaaatcagctctcgtttctccagtggtctgcacacatcacagtgggaaccactgctgcactggccttggcgggttccttgcccatctccccaccagacagtgagtccctggaggacagggacgagctttcatctctgcctcaccgtgtcagtaaatctggtgccttgtgcataatatgcattcaataaatgtttgatgaatgaatgtctctctcacgagcacaagtgaaataccacagcaaacacaaatatctgctattttctctcactttgattcccaacctctgataaactcttaagcactcaaacatagaatcaaaacataaataagtaccaaacatgtgtaagtgaagtgcagcccatttttctacctcttaaaacttttttcttaa

SEQ ID NO: 62973 - DNA, 1010 bp, Homo sapiens
tgaaaccccgtctctactaaaaatacaaaaattagccaggcatggtggcaggcatctgtaatcccagctactcaggaggctgaggcaggagaatcacttgaacctggggggcaaaggttgcaataagctgagatcacaccacttcactccagcccgggtgacagagtgagactctgtctcctaaataaataaataaataaatagcaaatgttccaaagtaaaccagttgactgaaaggtataaattcatcttccatttgttggatgccctttaaattatgtgggaaatggaacacatgaaattttttttgagctttgtctttctattaatttccaaaagtgaaaagttcaagtttagagaaacatttatcttaccatagtacctaccttgaactttgctgcatagtatatactgtttttatttctgatcgaagcatttgcatttaattacttaaagcatttaaaaagttcaatatttctaatttgagggttaattctactagcattagtaagaaacattgggtataaggaaaagggcatatgtatttacataaataaaaagcatctaattaagccttcaaatgacatttttttttaagggtaaggtataaagattaaaaaaaaaggcttggtttatttgcattgattttgctttttcccataattgctgaggttattatgttcataaaaagggaagcagtgctaataacttcaggaggcaattgctcagtgtcagcctgggacattgtgactgttctctagcttactttaaatacacatatttgcttttgcaaatatggcgccagttgattatggatagttccttcttacactggaatctctgggaggctcattccaggaaaggtacaaagctcaaggcagtggaaatgcacgttgcagatgcactgcgtgcccagtggacaagcactgtcctcagcttgcccacacccaagcagccctggagtggacacacccagggctgtgaaatcaagaaaacttacaccttcagga

SEQ ID NO: 62974 - DNA, 1028 bp, Homo sapiens
ttaggggggctcttcattctgttttgtcctgaaaacagaattgctcatacaaatatctggcaacatccaaacacaggtgcagatttggaatgtataaagcctcgtgttggtttctttgtattttcactgcatttccctatgttgaggctcaagatcaaatgattgtattttaatgtagtatttgccaaatttccaaacctctaagcacgaaatcctcagccttcatttcttcatttgcttggaaatctaggtagcactgagccaaaagcagaagttatgaagtgagattatacttgattaggaacaaaaaaagtcctacattcagaaatgcagatgtgcacagcagtcctaggggaatgttggtatttgatctctgagtcttaaaggttcatgttcccaaggttaagaaatgcagagagccaacttttattagtaactaatgctgaaattactctggagattctagaagtattacattacaaatcactcagctttagaaatcctacatctagtgagttacaaatatcactgtatgagagaaaggggcagtaagtgaagggtgtcattcataaacttaatttctactcttgcagcatgatcatgggtatactgtgtgagagttttcatttcagtgagaaaggaaaagggaacatacgaagtccatgagtcaggaccccaactgaaagaagcaggaagcaaaggcctccttgtgtaggtggactttgggtagggctgtggggtgcagcagtccaacctgggctgcaatatcttcctccttttctaatactatctaacttcgtgacctggggcaagttccttatttattgagcaagccttccattttggtgaaagctaaagcctgggtattcataaaatgatatccttcaacaaacatggcacctacagccttctatgaaaaagatacagatagcagacatttcacttcaaggggagaaccttaatagcaccaaattcagtattaaaaccaggattcgtttaaagcattactatgtcacatagtgccctga

SEQ ID NO: 62975 - DNA, 1054 bp, Homo sapiens
catgatgtgcaccgtgttcatggttctcttagaattgtcatcagcgttgcaggttataagttatatggataaaattaaaaccaaaacttacccatcacatttgagcccaaatatttcctcttttaagttgtacccctaactttgaaatcagggttaaaccacaggcttattttttcttatagtcattttttttaatatttgggttcaatcatacctggtaatttggtatgtaacgatggggtaggcttgagaatattcaagaacaaattgcaccatgttattcagttctccctaatcttacaaaatatgaaaaaccacaaattactgaattttaatacttcctgaatcttccagcaaaaaggaggaagatagcacctaaatgaataatctaaacactgaaaaagggatgggaggagagagagaatcccaagcattaaaccatattggcctaccaattattatgattgttttcaaaatcacagttttacagaaaaaaaattgtttttatggtgccaggtttgtggagtcctctttgttaaaaccttagtaaatgaagttatgaaactgagactagtttattctggaagcttcttagttgggggataagacagctggatgaactgggaggacagtaaacggtggaggtggaaaccttcttgttcataaaaatactgtttttcatatgttaaaaaaaaaactttatctcacgcttttcatcaagagctgtaatcagtgagcctgtgtacttccttttccctgccagatagttgttcctggctggaagacattttatgatatttatttgatgacacacacctgctgagtggatgaaaagcaactgttcctggggatgacctacttcaagggcgcagtcagcttctgaggccttcagcaggttatcctgaaatcattttagttcaccttgatatcacctgttgaacatatctaagactggtgtattcgcagacttgttgtaggcacagttgctaaccccagggaagagatttcggagtcagtaactactttgtcagtgtattgagactgggaagacacg

SEQ ID NO: 62976 - DNA, 1048 bp, Homo sapiens
ggctcaccgcaacctccgcgtcccaggttcaagcgattctcctgcctcagctttccgagtagttgggattacaggcatgcgccaccacaccctgctagttttgtatttttagtagagacggggtttctccatgttggtcaggctggtctcaaactcccaacctcaggtgatctgcccgtctcagcctcccaaagtgctgcgattacaggcgtgagccacgacacccagcccaattgtagaacatttttatcaccgcaaaaagaaatctggtatccattaatagtcactcccactttcctgccagcccctgacatccactagtatacttcctgtctctatagatttgcctattctagatatttcttataaatggaatcatactatatgtggtattttgcgtctggcttctttcacttagcataatgtttcaaatcttcttattgacaaataatattccattgtatggatacataaattttatttgtccatttatcaattgatgaacatttgggttgtttctactttttgaatattatgaacaatgctgtcatggacatttatgtacaagtttttgtgtgaacatacactttcatttctccttgctgcctacttaggagtagaattgctgggtcatgtggtaactttgcatagcttttgaaaaactgccaaactattttctaaagtggctgcactgtttcccagtcccaccagcaatgaataagtgttccaatttcttcacctcttcaccagcacttgcttttgtgcatcttttatattatagtttttcaagtagcagtgaggaactatctcatggtggctttggtttgcatttccctaatgtctagatgttgaacattttttcatgtgcttattggccatttgtatttcttctttggagaaatgtctgattctattgagtttttaaaaattcttttgcctcacctcaggcatgtggttagcagaaccattagaaacaaatatatcttcctaaagggagggattttcaaacaaatgtatacgttgaagatgttctttttaccatggtagt

SEQ ID NO: 62977 - DNA, 1121 bp, Homo sapiens
ctgtctttaaacgttctttaatctattacagatcgccctcctgtttttattacatttatttgttgaagaaattgtcctgtaaaaatttttgtcctgtagattatcgtcctgtaaaaatgttcattttatgtatttgaatattgcatctccatggtgccatttaacatgtttatatttcctctgtactttctgtaaattaatacttagatcaaatgacttaatgagatgcaaattcaactgtatcacatcaggaggcacataacatctgtttgcattacatttattgagatcaagattgatcagtgggttcaggtgtggtcagcctttcatccattatgaagttctctatcaacctgttaacataatagttttagcaaccactgatgatcactgccaacattcattagggattacaacatggtaatgttcacttctgtcattcagtttgcatttactagctattattctatcatatagaaaagcttactatcatcaactatttggttactctgaaatacagttcatatcagaaaagcagcataaatgcctctgtttattaaatagttttcagattattgaatggcaccagcaacctgcaaaagtgatcaatgatgcttgcttgtttgttttgagcatcaatataaacccttggacttttatctattttataggtgtccatccattactctttgatcggtgagatccccttcaagttgcctcttttgccttttaacatgattccactagtcttttctgtcaggataagatgccataggctcctggcccaaacctggaagcaactatttttacaaggaatcctgattcctttccttaggaaatagtatataaagacttcagtctagacaccaagggtagatttcccctgaaatggttatgtttatgttggagtggtaacgcagtcttccttggtatctcatcgtcctgctgtccgtaggcatctggttccacctggatgctccctccccacacagtcttataatggccagtgctccctgtgattccacctccttctccaaccagatcctgctgcttctctcaatgccttcatcctctccttctaaatcagataccccagctcatctctgggcttctaagacacc

SEQ ID NO: 62978 - DNA, 1050 bp, Homo sapiens
ttccatctccttggctttttaactctctcctcttttctctctttccctttccacttttcttgtcagcagtttattcaaccaccgtataataaatccagtaagtgatcataaaaataccaatcccaattgcaaaaatggcagcacagcctcagcttggaaaaaaaatttggaaaaacaaactgaaatcatcaaagactaaagaccagatactaaaaagatgggatttgctgtgagatatattttataataaaaattctgctataaagaagcatctttttatttttttccttgatagtctgaatagtttatacctgatgccaagaaattatatataattagtctgggtaatatataatttccatttgattatatatattaaagtgattaaggaacttcagtttttcactagtaaatatctgccttctttgttgcattctgggtctgtaatgactgtttatatcaagggtagcactcgttcagaactgaagggagcaaaagttggaatgctttcaccaagcttggttgcctgatgtctatgaatctgggagataacatgaagttagctacattttgggaaaaactgaagggagatttcagtccaatttcttgaaaccaccatgtagttttgcatgacttcccgtgaataaactccataaggccaggcccggtggctcacgtctgtaatcccaagactttgggaggccaaggcaggtggatcacctgaggtcaggagttaagaccagcctgcccaacatggcgaaaccccatctctactaaaaatacaaaaaaattagccaggcatggtggcaggcacctgtaatcccagctactcaggaggctgaggcaggagaatcgcttgaacctggaaggtggaggttgcagtgagccgagatcgtgccactacactccagcctgggcaacaagagtgaaactccatctcaaaaaaaaaaaaaaaactgcataaaacagcatacatgagaaggcatattttaggaagattactcagttaagtatatgacatcaccaatatttttaatattgcatagaatg

SEQ ID NO: 62979 - DNA, 1005 bp, Homo sapiens
gcttatccctaatactctgcagagtcatccctcatttattttttaatgaaatttgacaaaatatgtacactaagtctcctgtagaatggccataatttgtgcttaggaatgcataattttatcaggatctctgtaattagatattgtgcaatagaataaaaagcaaatactgtgtgtcccatggcaacctcggcctttagtatctcactatctttgagataacaaaggtttccacagacacacgtaccacatgggatttttaagtagacatccaggaagagaacgaaagttcccctgttggttttcccctatttttaagtgtgagtgtatgaatgtgtgttttgttctcttccttttatattgcctcctggatttgggttgttttcctttatctgtccggactgtaaatgtggatatgaaggttcatagtcctgtagaataacgtcagtgcttgagctagtgtttggtgtgaagtacctatcttttgaagggagagaaaagaattacgactgtggtaagatttaagaggacagaattaagattatgtaagggttgaagaaaggtttgctgggaatgtggtgtgtgttttagcagagaccccaatgacctgccagggcacgtagagagagcaggctacttgagggcagggagtagaccaccgccatttctgtgacctcacatctggcatggccaggcacacagtaggtactcaataattaactccctgctgtttccctaatcatgtagaggaaagcaacaatgttcagtaattaactgtttaaaaaaaaaaaaaaaaaaaaaagccctgcaagctgcatctttgcttctagaccaagagacagctgcccacatctcatggggatgcagttaggacataatttaaaatatcatccatttcttctaaaatgtgtagtttctttggaggcaattgtagccacttttgtaaataggaccaataaaggggataaaattgtccatcactccactgaaataaggaaatagagc

SEQ ID NO: 62980 - DNA, 1043 bp, Homo sapiens
gaaactatggattgttttctgtattgaactatcacactacagtattagtgtttggggaagaaagaattctgctgcctggttggtgttctgctatttactaccttaaaattcatcccattggggttacagtggcttggcagtctcttttgggtatagtgtagacttatttttggtacttcagctcacttacatggacttgttttttaccaatgccctttttttttgtatgatagaggtctataatttgtggactccgaagctacattttacaaatcaataagaaagacatgaagcctgaaaaacggttttttttccctgatttgtatgtgtatcttacataaaatttcttctaaattaaattagatttaattatacattggaaaaaaattacctttaaaaggatcagagtttataaaatagatgtagccctgaggcaatggtgttatatgaacattctacctgtaacatatacagatttgcgatgttatcagctattagactcaacaacttatttttgaaaaaataatcctttgccaggtttatacacataagagaaacagccaagaaactttactcttttaaatataataataataataataataatacaacctggagtttcataatcagaaagaacagatgtccccaagacacttttgtcaactctagaaagggattaagtttgtcttttattttttgtttttttcccaaaattactatcctcagagagggagaaagtatgcaaatcctagaaagagtttattctccttaaaaagagagaattttccctccagggttattgtttgctcttgagacaaaacctgtaattactattatctgatagtggatagcatggcgtgcgctatttgcaaagaattttttccatcattgttttcattggccattcggagatataatttggtgatgaaaattagctattttcccctggtaagggaaaagagactatgcaagagcaaaaatagacttttttccccagacttctgttctgcccacccagagttgaagtcgccaggagcagagta

SEQ ID NO: 62981 - DNA, 1538 bp, Homo sapiens
ctgttcagtgctcccaggaagtttcttcttaactgctgcttttctatctacaaaagtaaaagttcattgtagaaattctggaaaattctgaaaaccacaaagaaaaagttcacgacacagtaattctcacctgtacacacagtgtactgttaaaactttgatgatataaagctgttaatattttttaagcattcacactaattctgcagataccaagagctgcaagaaatcacctaacatggaagaactgaggctttcaaacctcattcttaaggacaaaggccacatcgtctctgtctttatgccctggcagctggccaggcacccagcatgcaggggggcacagagtgtctgcagcatccacaaacttggggtttccgaggaaagggaaggcaacaaactagaatcggtctaggaaagaggaaaagaattagtacttctctcaaatggagactataaaatatattcctcaatgatgacatttttctgaaaatgtcaaaaatgtgttcataagatgatttggggactggggctcaaaggtttccaaggctgttcagaagataggtttgcttagctgggcgcggtggctcatgcctgtaatcccagcactttgggaggctaaggtaggcaggagttgaggccaggagttcaaaaccagcatggccaacagggcgaaaccctgtctatactaaaagtacaaaaattagccgggcatggtggcacacgcctgtaatcccagctacctcaggaggctgaggcacgagaatcattggaactcaggcggtggaggttgcagcgagccgagattgtgccactgcactccagcctgggtgacagagcgagactgtctcaaaaaaaaaagaaagaaagaaagaaagaaaagtatgcttcaaattctgtgacatatctgccacccatagcagaaagatgcccgcttgggaaagcagaccccagcagatgctctttgggaagaggccattatctgccagggtgggggccacactatccaccttcagtacttgattcctggtggagagtgggttaatgaagaatagtggagaagtaggagtgcttggtatccaggtccttataacttaccagggtctgcacgtggaccaaatgtccctgcacggagcagcgcccataaacagattacagaacagccattcgttaatcccaaaacagttttctgtcagttaattagaaaattcatcttattttgcctccaggccctgtagccttattgcatttgcacatatttcaaaatgtttcaagtactgaccagataacattaatgaatatattagataggcaaacgcttttaaacaaaaaataataaacatacttgtgtgtatatatataaaaaatgttaatttcgtctggagccaaacaggtaattttcccctcagcattttttcagtcagctaagacaggttggcctaggagtgcagtcagcctgtctgcagtctctggcttgacttgcataccagggtcagaaacagacagcgagatgatctgattggcccaagtccagagca

SEQ ID NO: 62982 - DNA, 1108 bp, Homo sapiens
cacgtagctgagattacaggcgcccgccaccacacccagctaatttttgtatttttggtagaggcaggatttcaccattttggccaggctggttttgaacttctggcctcaagtgatctgcccacctcggcctcccaaagtgctgagattacaggcatgagccacctcacctggtgtgtttttccttttaagcattacatttatgtttaatttattgaaaaatatttattgagcaccaattacatgctaaacactgctaggtgctggggaaatattggtgagcaaaagggacacagtttctgcccttagtatagtgggggaaacagacattaatcaaataatcgcacaaatttgaaagtaattgtgatgactgttatgaaggagagcttcatggtgcagtggaactagatgataagtaagtggttctcaaactttagcaggcaccagaatcccctggagggattgttaaaacaaagcccagatgtctgggccctaccccagagtttctgtgtctaacctatctctctgtgatgctaacgacgccagtccagagaccacacctggagaagctgtggtctagagattttaccttgacaggagtccaaggcaggttgatgaaaaagtgagacatgagctgaggtatgaaggcattacctagatgcttctgtcacagaaaagagcttatgcaagagccctgtggtggaagtgggcagaggacaagagacagaattaggccagtgtgtctggagaagcaagagaaaggagagagtggtatgaggtcagggccagacctataggtgtagtagcacgtgctaaggaatgttaaggccttttgacaaggttaagcataaaaggagacattaggcaataaagaaggcgttccgtggaaagaaacacaagtcaaagtttaaaactgactacaagcaatgcaacaagtgtggaaattatacataaataaggttaagttcaacagatggtagccagtactttcaaagataaaaataattattatggagttactttaaatttttgtttataaactttgctaaattcagttaagagctgtgtataaacttaagttccaatataattttagatttgttagtta

SEQ ID NO: 62983 - DNA, 1013 bp, Homo sapiens
tacgtctcagtcttttcaaaatgctgatcagattatgctttcagttgttaattggtgctgtttagcacatatttcatcatcagtctcactgactcaaaagcctgtgatgcactcttgttccttgcctcgcctggctctgttacaggcatctgcagtaattgtcgcacactcggtgaagtggaagcacagggctggggctgaggctgccttttgccgtggctgtgttaaggaagccagtgttatttgatataaagtgctgcggacagaccaggagtaagcggattatttcagacagcgttaggaggtaaccggaggaagattagctcgacatgaggcagatatcataagcaaattagaaaacctccccaattagtacaagaaacccagatttgtgctgtttgtgatcctttgctgaaaggcaaagtgtcgatgttatgggctctggccttgattcaagttgaaatgttggcatttcctatcagtgcatgttagcatctgaggctgtatactggcctaataaatgaagtaaattcccgttctcctgcactgctaagtattccccattccaaggttctatacattgggtaatgttttacttggccctggaataatctctagggcatattataatgtttctatactgggaatattcaacatgactccaatgtaccacacttaatctctcttttgtttgtttgtcttgtggaacatgtatcatgctgaagtcataaaaatgaagtgtgcaaaatgccagatgctacaaacgcaattagatacttaaaaatagcttccttggtggcactgcttgaactctgaactgggccttgtttttacaaacagggtggcgcttttctgctatgctcctgattgtgtgctccgataggaggcacggctctgcttctaaggccatcaggcaaaccatcagattgttctagaatcagactaggtgctgatgttttacgacatcattgcagttgcaggcatgaggtttttctctccaggtgcactgtgta

SEQ ID NO: 62984 - DNA, 1018 bp, Homo sapiens
gtttgtttgttttctcacctttttagtgcctgtgtatgaacctgtcttggtcccaaaaggaattagagcatttacctaaatatatgcaacacaataagattgaatatttacaaaagaagtaacggggaggctagtacacaaactgtggaatcgcctatacatttgtaagaggtggcccacagatttctctctgagcgttctggcagctgacttggagagggcaattgtttcagctacgtgagtcagtatctgtgagatagaaactcagccttttcccctgctctgatgagagagaacactttgtcgtgggacctcttcgcagggacacacactgtgcaggttagtaaacaccaggctccaaagcttccttccagggagcacagtgagccctgcagggcgctctgaccatcctcctttcctcaggctggcggtgttaggtcagtgcggctgtgaaccaaagcaatgctgtgcaggtgggaccctcagggggctctgctgctccagggtcgacttcagagcctccagcaggagaggtggaccccagttcactaggctcctcagccaacactgtctctcagttgggctttcaacacgtcttccacaggagagaatttcaggttgttccctttgctgaggacctggagtggaaacaccttattattggtacttaggggccatcgtgttgtctagtaactaattagggggtcagatatcaccctcatctgtgaaaattaaggccagggagcttgaagggagtgtccccaaagaatgacagagtgaaaggtcgctgtctctttgcaagacacaggctgccttttgacttagtctgtatgaagatccctcctaattcatgggtgattttcctactcattgctgccaaatacaggacctgagagagtgatcaaaggccacactactccttggcaactagttttctttatcttcatcaaatccacaaatacggttcttggtgcccatcctcaagggtgctgggttctcatatgtttactgccatttt

SEQ ID NO: 62985 - DNA, 1046 bp, Homo sapiens
tgacatatgtcactggctgctttacactacgagaacaaagttgagtagttgtgacagactgcgtagtccccaaagcctaaaatgtttagttatgggttaaattgcagcctctcaccttaatttatatgtcgaagtactaacctctggtacctcagaatatgactttatttggaaataatgtctttgcaaatgcaattagttaagatgaggtacgggaatagggtgggctcctaaaccaatgtgaccggtgtccttattaaaaggagaaacttgaacacaggcactcacacagagataccaccttgtgaaaacaaaggcagagatgagggaatgcatctacaagctaagggaccccaaagatagctgacaacccaccagaagctgggagagaggcatggatcagactctctcactgctctctcagggaaccaaccctgccgacaccttgaccttggacttctggcctccagaactgggagacaataactttctgttgttgaagccgcccagtctgtgggactttgttatgccggccctagcacactaatatactgactatctggccctctgcagacagagcgtgctgattcctgttgagctaagtattaagaaaaatttagaaacagggcgaagcgactccagtcctcactcaggacctaatctagatatgccagggctcagggagtggatgtggctcctcagttccttgctggagaaagtgctcatctccctgcccatcaaaactcatccccactgtgtcccagtccctcaggtctctcggatgactgactacacctaaattgatgttagccagtgggggctactaatggctgatgatggcttggtagattggcccagagatagcatctagttttcttccctttttttttattattttatttttgagacggagtctcactctgtcacccagggtggagtgcagtggcaagatcttggctcactgcaacttccacctcccgggttcaagcgattctcctgcctcagactcccgaggagctgggactacaggcacacgccaccacacc

SEQ ID NO: 62986 - DNA, 1108 bp, Homo sapiens
tcattcctccttgcaatccccatgactgcattagcaaaggagccccgctgaggctgagtagggctgacacttgcctgcaggtgggcaggtccccatcagcactggccctacttccaggactggcctaggagaggccagggataggaatggggactgtttagatcggggccgacttggaggattttttcctcctgcttattaaatgttaaaggtttgacttggcaggcaatcaggagcccaaaatatcataaaagggaaaaaagttgccgagtggctaagaggtgcaccacgggagtgtcactgggcccgccggcgaggtgaattgctaagcagagagcagtgaacggggaggaaatggagcagcagacattttcaaaggcttctctccccttcttctcctctctctgtcccccatgcggaaaggggaaaatagaagtagaatccagattggggcgcgtggctgatttggtcctcctcccgcaccatcctcccccagacagcagagaaactttgatgtctgggtgcatggcattcagggacagaggagcctgggcatcccagcaaatgcagccgcatgttccgcctctggacggcctctctgaactcctttgtgaggggagatgaagcccacagagctggaaagagcagcgttttgaaatgaggaagtgtggatcggcattccttgagctcagtgctagccaccttggcgatggggtgagccaaccaggagctcagatttataaaacttttgagctttgtgggccctagggggccactgtggcctacctgctgattttcagatggggaaatgggggctcagagaggggacaagatttgcttaatggcacctagcaaattggtaacaggtccaggagtagattccatgccttcagcctctggtgagacgtctttcctctgcaccaggaagtggaacttcaaacagcaccaggggttggaacttttgtttcaaatcctctctgcctcatccccacccactgcccagcaactcaaggctgggtctttcgccccctcaggctcagaagggctgtggcccagccacagagccagggggcctcctcagtagtattggccttcacactcttggtgc

SEQ ID NO: 62987 - DNA, 1021 bp, Homo sapiens
aggagttcgagaccagcctggccaacatggtgaaaccttatctcctctaaaaatactaaaattagctagacatggtggcacctgcctacaatcccagctacacaggaggctaaggcagtagaatcacttgaacttgggaggcagcggttgcagtgagccgagatcatgccactgtactccagcctgggccacagagcaagactccatctcaaaaaaaaaaaaaaaaaaaaaggaagtcctgctatttgtgctggcaggctgaagacccagaaaagccagtgctacagtttcagtccaagtctgaaggtctgagaattaggagagccaatggtttaagtcccagaccaggaagactgatgtctcaacaaaaagagtcaggcagagactgaattcaaccttcttgctcatttttgttctggtcacgtcctcaatggattggatgaggtccacccactttggggagtggaatctgctttcctgggtccaccagttcaaatgctcatctcttctgcaaacacccttgcaggcacatccagaggtaatgtttaaccagatatctgggcatcctgagcccagtcaagttgacacatagaatagccatcagagctgtcttgtgtaggtaggaaaggtaagaaagggagggacttttagaagagggccagttcaaacccaacccctttctgaccacaggagaggtaagccatgaagaatgaagcatgatgctggccctttgtgatctctgggggtgtgttgtggaaggagtagacaccaaagatcacaaagtgtcattttgtactgacaaagattactattattattattattattatttatttattcattgtttttgagatggagtctggctctgttgcccaggctggagtgcagtggcacaatctcagctcactgcaacctccacctcccaagttcaagtgattatcttgcttcagcctcccaagtagctgggattacaggcacccactaccatacctggctaatttttgtatttttagtagagacg

SEQ ID NO: 62988 - DNA, 1034 bp, Homo sapiens
atgctctgtgtagatcttggcagttaacagaaccctttgatttttaagtaagagtgagtcctgcgtgtgcagagaaggctccaataggctggggacggtacctttaggttcatgccttcccccagcgctggatcggaaggattggactgaaactttaaacattttgagcaatacctagaatatgtataatttataagccacacaccgttggctgtcaaataggcgattgatctgactcggatcttgttaattatcttccacatacattacgccttaacagatcttcagtatactgtgtatcaatattaataagattataaaacactattgataattaggaacagaaagagaccaggcctttgattctggctgttacaaatgcccctgcctctctccagattagaaagcggcccctttccatttaataatatcagatgagaacatctatgtcctaaagtgggttattaggagacagctaagatttgcaccaggatgcaaggggctatttgaaaatgaatatgagagcagcgctgatgtgcgagagatttgtgtttcttatccacaggaggcctgatggggtgggtggggcttaagagggagctgtgcccactttgatcagccaaattcctcattttctttgtccaggcaaatcagatcaatttggttttgcaggatattcaccaggctggcattttatcttgatttcctcaattggatgaaaggtgcccctttgggaagacagagaaaggggctggtgagatgcaaggcggatttcaagcctgtctcattttggatggcattttattttctatttttcctctttggaaaagcctcgtctttcatgtttttgttgggttcacaaactcattaacatcaaacaggcagatctgccactaactaggaaaacgcaagcaatttcgcatataaatagaaagccttgaagctcggggctggggccaggccttcttcctgggggtctctcacctggctgaggagggggcagaggaggaggaggaggaggggagggagcaaaa

SEQ ID NO: 62989 - DNA, 1067 bp, Homo sapiens
ccctcgcccagaatcccgggctcgcacacactccgcgcaggccgctccccctgcacactcctccctccgtctccccccggcttccccgcccctctcttcctccttctttccctcctccctctcccggcgcccgaaaggatcattgttagccgcccccgccccgcccaccccggctgtttatttatgcacacgtcactgggccggccccgccctccggcatctcattaaggcagtgtgttcctctcgccctgtcaataatctccgctcccagactactccgttcctccggatttcgatccccctttttctatctgtcaatcagcgccgcctttgaactgaaaagctctcagtctaacttcaactcactcaaatccgagcggcacgagcacctcctgtatcttcggcttccccccccctttgctctttatatctgacttcttgttgttgttggtgttttttttttttttaccccccttttttatttattatttttttgcacattgatcggatccttgggaacgagagaaaaaagaaacccaaactcacgcgtgcagaagatctccccccccttcccctcccctcctccctcttttcccctccccaggagaaaaagacccccaagcagaaaaaagttcaccttggactcgtctttttcttgcaatattttttgggggggcaaaactttttgggggtgattttttttggcttttcttcctccttcatttttcttccaaaattgctgctggtgggtgaaaaaaaaatgccgcagctgaacggcggtggaggggatgacctaggcgccaacgacgaactgatttccttcaaagacgagggcgaacaggaggagaagagctccgaaaactcctcggcagagagggatttagctgatgtcaaatcgtctctagtcaatgaatcagaaacgaatcaaaacagctcctccgattccgaggtaggaaaagcccctcgggctggtggggttttttatctgtttcctgggcttggcaaatgttgctgaaaggggagaaatcggggctgggggcggcggcggggcccggcgggcggcgtgt

SEQ ID NO: 62990 - DNA, 1022 bp, Homo sapiens
tgcaggggccgcgctctgggcttgcagctgtaggggaagcacagttcgcttactttgtatttttcttgggagcttgtggggcatcttaaacgggaccgttcggctcagaatcgcagtgttcgcctaccaataaaccggaccaagcaacattccaaagaatccctgagaatttctgcctctcctcccctcccccttccgatggaaacctccctggtattattttaaaatccacttaaccatctgaatattgagctttgatggcgggcttgctagctttcttgactctttttaaactcgctgtctgatactggcaatcttgccatcccttctcaaacttgagcagttgtgttgtcttgtaattagcaaacagggaaattgctaaaggcaaataaatgatttcccggtgagaaaaggaaggctcccaatgatcggtcccttttgtgggcattataggaatagacggcgtctagttattttaattgtggacatagcgggtggcctggtgctgtgacatcagattgagtctcagaacacatttctgaactcagtaggcagttttagtacttacatgtcaaacaccagcagacatctttgtgtacactgccccttcgtccttcctccctgttacctgggttagattatgtgctccaaaattaaagttatttatttaggctggtcagcagagcagtggaaatgaggatggtaggctgttgtgtgtcattcctgacgtcttcaatcagaaggccagcttgcaatccagatttgatacagctgcgggaggaatggaggaatgcataggcaagatagcgggcttcccatactcttctgaaatccttagtgttttatagggtgtgtttttaatggcaaggtgtaaagacaaatttcgctgtatgctttattattttccctttgctccttggtggcggtgatttttgctacattttctgttacttatggtgtacctgtaagcagctgcatcctttaaaaagcaaactctctggaaccctgatttctgctttttt

SEQ ID NO: 62991 - DNA, 2014 bp, Homo sapiens
tctgtgtctgattgagaaagagttttttgaggaaaacaatcctcgttcttgctaggagttcttcaccttgattttaattttactgatagggatttcatttagagtcattgctggaagttggtcagctttctgtttcttagcaagctgtgaaaaagttaccggaaggtttccaggggcttgcagatcaagaatgctgttctgtttgccgtgctggatcgctgcagttctgcacgccattgaaaaaaatatttgctttagaaaactagcattttaatagttgcaccagaggctgtgcttttaaagattacagtagaagtctttccaggtttcgaatgcctccttacatcccacgaggtgcccctggctgtgtgcaaaaagtgcctagatttctcggtggagaaatcctggtgcaacttctcttacacacgtgcagtgggtaaactagaaggtatctaagaggattttacattttgtcagatgtttcacaacaggcccccctgaatcacattaaaaatgcactgtagagaaaggacagctgcaaatttttgtgtggacgcgtgtttctggaccatgactaaaactccgaggacctttcccccagctgtctggaagttatgtggaagttggtttattggcagttaagtatgagacaacctggatttagcaaatgctctctcctgcacaggaagtagatgacattatattgggggaagggaggagatttcaggcaaggagtgatttacctttttttttttttttttttttttaaatgctggagttgccaaataaataagcactttccagggaagtaagtgtaagctttttagtcttggtgagtggcattagataatatctttgactgcatttataattcttttgaggtgacacattttaaagtttggaaaaggaggctgaaccaaattcttgagggtcttattttcaaaggggtgtgtgatgtgggcatctgagtttcttctgggagtgaatattggcaactatgtaagtaaatcttcaactctgacttataattgagcacatttgtgaaggaaatggttaattttacaaccaaaggcaaactcgcacctcgacaggtctgctgaaagaaatgtgccccagtctttttgctggcaagcgcaccaccaggtcataaatccacaggctttatttacagcccataacacttatgaatgttaagatatttgacgccacgttggccttataatattcaaggtccgcagacattggcagtagctcagatttctctcactaattataagcaatgagatggggggaggtggtggtatcctaatgcaaatgctgccctcccttctccgctgacccccacctctacaatcttgagtttactgagacagacgccaccactcctttggcagctgacttgtacgtttcctctaggctattgttatacacatttataaagagcactttcaggaatggaaattcagtgggggctctgcacagatgcctttttcaaaagcaaagttgctctaggtgtttgcatcttttcccttttcttttctccctttttcctttctttctcttttcttaattccccccaacacccccaccttttttttttttttttttttttttttgagattacattgcctatattgtgcattttccccaggaatacttaaagaaacctggtatgggagacggctctttaatttatatgatgttcccctgagtggaagggaaaatgtacacattacatagtacactagttaaactagttaacgtgagagtttttaaaaaagtgagatgaggtgaagagagttgactaaaagaatataataggtgaggggaaaaaaaatccaggtttacactggggatgggagggctgcttatttgtgaaaaatgtactggtatctgcgggaggaggcacagaaaagtagccagaggagacagaataaatgcctaagaaagataagaaaagtataatacaagagaacaaagatttgggtttgggggaattgaaattggagattgg

SEQ ID NO: 62992 - DNA, 1050 bp, Homo sapiens
aatggcatgcagaaacttactagccctcagggatagatatgaatccctaaacagctcattacaaagaaggggctgtgggatctttgaacgggttatcagccgaggtgttctttgcttttcccaagataggttttttctccttaggcacatctgatttcgggctagtaattcgacctgttatattttattctttttgtcatgcagtagccccaaccaggtcggtctacggaggaaggaatggccaggagtggcatcagccctgaaggagttaaaattgctccctaaagtttggcatcatgaaaataaatttgaggcctggtaggcattagcagggcacagcacatttacagagcttaattagtacgcactgtaattgttcatggtctgccagaagaagtaatgttcaggaaaagtggagtccctctcttgcagtcttcagcttgaaaccgataaatcacttgcatatttgtgtagtgattcaaatggagctaagacctctcccatcccaacatgtggtaaattgtaaagtcaatgaattgcagatgtaggctacagtgagattctctaagaaaatgcagaatgaatgggaaagagtgacgctataaatatttactgagaagataactagattccttcgtgctgggccaattatgatgtactaaaatatattagtaaaatgcttaaaaaattgagaggatttgtgtgggtctttgggtgggttggtttgttttggaaagtgaaataaaaggcactatgttgttgtcgtgtcagttttattaagcctgaatcacaatggcatacccagggaaggacacatgaaacccacattaatgcaaattaattcgttatgagttgcagcactgcgactgctaagtggagtaatgatggggcatcattttaagagttttagtgtagcaacttttaatgaaaaatgctgtgttaggaacatgtctcagcacttcagcccacgtgtttttctatatgctagaaatatgttttgtacaagagcaggaaacttgattcactttattttttcccccagacagttta

SEQ ID NO: 62993 - DNA, 2728 bp, Homo sapiens
tcaaaagttcttatgtgattttttccacttttatttattttttaaaactgtgtggactgaattgtttttcttccagggagcaagatacaaattatctggatctgaaactcgcagcctaaattacactttgtgctagtaacacagacgtgttctggtagtagtaatagcacaggagtagtaacggtagtttattataatactacagatccatttttggaaatgcagttgatttgcctgttgcaaggaggggaaatggacatcaatttcacagggtcatctgattcctcattagtagttcctatttggcaaattaaaatgcattttcagataattgttgagatccttcagtgattattgtattgtttataaagtaaatcagcagatggtgtttgttttcccaattgatgggatcccaagattagcaagtattacttgggaagatgagaattgggtgaacaatcttgctcttcctatttcgggatacctgcttcattgatgggtggtctctaggacttcagagggaaaggctgaggatagacttagaccttggggagggtctgagccaatcagtgacttacattcactcagttgccatctaataggtggtcctcccttagaaaattggcggctttctggcagtgtttggccctctctttggggaagtgtggattactagagtgcaggcgacagagatggcctgggatggacagcttagtcatcatgaaagaatgtgtaaggcatcgggtggcccctgaattctgtctgacacatttgttttcccagaaatagaattgcattggagagttggggcccagttattagaaatatggggatggggtgcttgtacttgttgcagtcttgtggcttctcataatcttttctctcctaatccttcctcttgcctacatgttgcaattctgatgactttttgcagcgcacagttcatttttcttcagcatcccgctcagcacactggcttcctttatgtcttaatgggcatccgtctttccttttcatgtcattgattctcactcgtggcccccatcttccctgtatgcttattgaataggtgcttaaaaaacaaaaacaaaaacaaaaacaaaaaaactttaccttagattgttatgatcatcttatccatagcaacaaatgaaagtacacaggtcttgattgaatgccaaggctgcagttcaatctaggaaggtttgtctgctattcataaactgcttaagatgttttcttgtagtttgtgacataagcagaacgctttgatttggtttctttctacagctccattttcagtccggcagcacacattactctgcgtacaaaacgattgaacaccagattgcagttcaggtaggaaacgcaagagattctgaagcttgaattgtctatatgtaggtctcttgtgtgttttattctccgccccttcccccaactgagataatgatgatgatgatgatgatgatgatggtggtggtggtggtggtgatggtggtggtggtggtgatggtggtggtggtgatggtggtggtggtggtggtgggggggggttgaatcactgggggagaaggggagcaaaggagagagaagcaggagaaatgctgctgaaatgatttagagatatggaaagaaagagaaggctgtgcttattgttaagagtttcttgaccgggcataatgggcacacagaccccagcttgactactgtttttctttgcttagggagggatcttgaattgggagtaaaacggggtggcacaatgtgaatgggaaggcttaaggggagaggtgggagaggaggccgtgcaacagccagagggttgtttctggtggatcaaaatcatgttaagtggtgctaagaatatctctttggacctgatcatcctgaaatgttgatttctcttggacctgtctatgtatgacactaaatgtgctggaagggaaaggcgacagatcccagcttctgatgagtgtcctgtttcctgctcacgtagtacttccattctcttaaatccgaaggctaaacaaatcatggactaatatagactcggagctgaactgatgccagcagaatgcagtagaggagggagagcagactaatacgattttcgtctgtctgcctggccttgctgggatggatgtacctcatggtgtaactaatggtaccaaaacttcttgagtgttctggcttaaccctttgaagggattctcttgaaaccgtttgctgtagtgttgaggtctagctggagagccttctttttttgtgagttgatgttggtttgttagatcatttgtgttattccatgacttcttttctgggcaagagcccttgcagataacttgtctgtgtgtgtgtatatgtgtgtgtgtgtgtgtgtgtgtgtgtgtgtgtgtgtgtgtgtgtgtggtcttaggtagctgcagccacaatgcatctttgtagctctgtcatctcagttctgcatcttccttgataagacttccagatagctgtttgccccaggtaaacggaattattccgccagtgaaaagcatgagtcagcagacatttttatttggtgcattcctagtgtttctgtactcattttcaggccacagcaacttattttaaaaatatttgaggctgggtgaggtggctcatgcctgtaatcccagcactttgggaggctgaggcgggcggatcacttgaggtcaggagttcgagaccagcctggccaacatgg

SEQ ID NO: 62994 - DNA, 1031 bp, Homo sapiens
cctattcctgttggttgctgtttgcatttctcttatgtcactgaaaattttttgctgggtccttgttacatttgactagaatataagcacttctgaagggctaagattgtgtcttactcagagattgtgttttactcatatttatatccctgtagcaccatgcactaatttcctgggacatcgtaggtgtacaactaggggtgtgaatgtgtttgaatatctaattgtgggcagaaaggaaacagtatataagtgagattggggtaggtgtatattagaggtaacaaagtgtgcttttagaatttttaaataacagccccttttataatatgaaagaccaaaaataatttgtttttgtgctcagccaggtagtttgagatgagtgttcgaccactttgtcaacttggtgttcttttccacgtatcttagattttgattccagctctccatcagtgcgtgaatttgcactgctgtcttagagactatggcatcatccaaacagtggtaactatggttggactggtgtctatttctatgaccatcttctgattttcagaatgcttagaggttagttggcttttaaaagcaatattaccttttttttttttttttaaatgtcaggcagcattacctgtcagatcataatattttcatacactttgacaattgtcattcattcctgcaggggacttcaaaacaaattttaaacaagatgttttcctaattgtggatggatgagcctgcacagacagattcattcttttctctttccaaacctcgtgcctcccagatttttgaggttgagatgaagcaccagaataaatagctttggttgcaaaccagaaatcttccaaggcttgaaaatggatgtgtgtgatagtagcccattctaggggtactggaagattcttctcactagggctttggtgaggctgccctgtagggaagaagtcttgtgtcaacagtttttaagttgattcagtaagcattgttgatgattgaaattgaagaattgtgaagacaattcatct

SEQ ID NO: 62995 - DNA, 1653 bp, Homo sapiens
agtgccatgggcagccgctacttcacttgaaagctttggagtttctatattcaaatcaaagtcacccagaagcaaagatgaaggggacagtgtgatcttcaaagacgagggagtaaagaagtagtggggaatattttcctgggtaattctgcacccccgctcccacctttacagaaacactaagagccttagccacttcctctttcttggtggttatgtgggtactcaggctctggtcaagtcattggctgtttatggagcaggagacagatgacttgggaaagcaacatgaaaatgtcttgggttggttttgagcttgcatggggggagtgagtcagtagatgtttctcgggttctctctcttcctctcttgcctttcctcctttctttgagcttgtttcgctctgagagtacaggcttggcacccacttacccaagaactgattagttcctaaaagaagcagtgagttgattgcttacagagatgatgtaagctttgctctggggtacatcaacttggatttctcatgctttatcttataaagcctaaattaacagctggtttggtttgagttctctgggatctgactaagggattagagtccattctcaagtgagtcaatctagtttaatttatttcaggtctatcaaaaaagatcaatcaaagctcttttgaaagtaaagctataatcggtctgcacacttataagtcactgttgttgcacttggtgtttctctctggtggaaaaatgctcaggctgtggttaagaggatgtattagagcattttctgtgtacctccctttcttgcagcctccacacctccctgggaagattttgaggaagtgtcatgtttgagaaccccacttaagtgggagctgcactcacctccgtctcctttttctctgggcatactggatccctgttttggaagtttctagttcagtataattttaatacctggacctgaacaagtccagcctgttttatgtcactgtttttgctcctgggctttttcttgcagatattggtgggtgaagacatgcattgaattctttccagaatgtctgctgtgaagaattactcatgtcatttgcaaggcttaagctgaagcattcgctgctatggtcgatctaggcttttgtgggcactggaaacgacaacccgagttgttcatttcttttgtttctattttaaaaatacttaccgagcatcttctggtagctaagaactattcgagatacacttgatgtgccaagagaaacatcaagataaaggaggtagttaagagcttgactgtagagttagacctgtctttgaatcctagctttgctactttgtgactttatatgacctgcagcaaataaatctcagtttccttgtctgtaaaataggcatagtaaaactgtctccctccaaggattgttgtgataatgaaatgaaatgatactgtatcttttgctttttaaataagccacttctggggagcttccaggaagcagaagttttttttttttttttttcccccaaatgcattcaaaataaacaaatctccttttactaccataacggtgtatgtgaatgtcctggcggatgctctcaagagcgtcaacaatgtgggaaagagaagcaaacaccaggttcttctcaggtg

SEQ ID NO: 62996 - DNA, 1898 bp, Homo sapiens
tttatctttcttccacttgactaaatgagaatagtgtgggtcactctctacctgcctcccatctgtggttccttttggagataggccgagtgggccactcaccctttaattttctcttagtttcctttctgtacaccagtttgaaccttagtattatcactaatgcaaatatgagcctaggctcaatttttccagttatgaaatggggctggcattattccgtgatgtgcatgttaagagaggggaaagctcacatttttgaggtcctcttgtggttctatcttgtgtaggaactcacgctttgtttattcagcaatcattcctccagaaataaccttaatagcaacaagaaaaaagaataggtgttttttgagctctatctgccagtttctctatatatggacattatatattgcaacataacactcacaatgcctttaaacatcatccccgttatacagataagaaaacagaatttcaaagaaggtaggggacttgcccagggatacatagctagcaagtggcagcgctggattgagtctgggccttgtctgaggctcgggtcctgtcatgctctgcggttgctatgttgacatgcaaagggagaggcagctgctgggagtctaggtgggtttctctttgagaatgctaacgtgaaccctcaaggtgaatcagaatccttttgcaagtgaataatcagatgtaggttcctgtgtctccctgtaaaatgaaagcctcttttttccaaggtccagtatagacctgaagctgggttactctggaatttccctctctggctggagtgactgaggccttgcacgtgacattggtgaggactcgcagcctcaggtctggcttcccttagcaacccccctttcctgtctctgcctctggagttcaccattaaaaaaaaaaaaagaaaaaaagccaaaacactttataaagttacatgctgggtttcttctatgtcctagaaactgtcttaattcatcttcccctttactcttatatgagcaggaagaaaaaaaaattgctagtcaatgctaataattatggcatgtaatgtaattggaagtgtttcactgacatgctcatgagagtttgcggcttcatcttcaggctgggatgtagcactagacttgccttgagtgtctgcacaagcctttgatgcaggtagaccatattataaataggcgcgttgctatggtgaggatggcagtccttgcttgctgtgggtaaccttttctaccttctcggacactgttttaaaacacagcagcgtgatagcatttcatttaatttggaccaaggtggggtagatgaaatgttgagatttagatctaaaatgttgttgtggtgtttcagggggttctggctcacctagtactatggaagattttgcagattgggcttcctcatgatttatttagaaatagattttctaatagatggggtgaggggagggtggtgggcagaaggctgggctttcttctcttccccctcctcctttcattgagcgcttctgcgaatgtgttggctttgatgccccaggagctcatacagtgaaatggaagttcaggttggcacgttgcagaaatgattattcctggtagtacgtttcccattactgttaataatataaagacaattgcctgcctctcaggactcctgcacgtggctacagtcatttcttcatggaattagacacatagcagtggggaccaggagtgttttattagtgattgtcctcctgcaagtttccagggtatctcagcttagacacatgaattattttttcctgttgcttggagggtatacttttaattatattcattcaataacagagcagttcaggtttgtaaaatattttttctcccccaaccttttccccagcatac

SEQ ID NO: 62997 - DNA, 1063 bp, Homo sapiens
tgagtattactcccttgagtattgccattgagtttagtcctgtgagtattgctgctactgcgccttggcaatggttttcaaactttgcaacacatcagaatcacttgggaaacctttaaaattctaacgcccaggtcacatcccattccaactagatcagaacatctggggaatgcgagccatgcaccagtagttataaaacctgcccaggtgattccaaagtgtgggaacctttgagaagcactgctttaggggttggaatagtcctggctgaattttaatcagggaagactgactgctccgtttatgaaacgtaggagagtggagcagggttgagaaaccatcgggatagtgttcttactttgttacgtgagcaatatttgttgagtctctgtggtgggttctaggggttcagaggacagcagtgtgctgctaggatggtggtctgaactagtggaaaggcactcaaaggaagaaagacagaattctaagaggagaggaattttaggaaggagatacccaggacttttgaattacaggtaatttgatcagaacccaaaactgaaatgtctctgctctgtgatgaaagggtttgctggcattgagtaaggagctgcaggaaggcctttaacttgtctccaggtctcttaacagctttgtcatttacatacaagcacctgcctggctaaaccattcatttctgtagcttccttctggatctgtctagggaatatttgctttgcatattttggggttatcttaagtgtttgaaggaaccaaaatatttttcttaaaaataacactcaaatgtagttcacatgattaattttgactgatttgtgagaatcagtaagtgctgactgactgaggcgccccacacatccggcttccttctgttactctacgcgtgttgctgaaacttaacgaacccatgtggggtcttctcgcctggtgcagtccggcccagtattcatactgaggtttgcagtgggagaaaggaaggtatttatttgtaggtcaccaagcagggcaaatccagcagctcacgcttaagacctgacct

SEQ ID NO: 62998 - DNA, 1028 bp, Homo sapiens
cctgtctcgcatttgctgtctatgtagactcactaaagcaagttaattcattgctctttgaccgccaagtctttcgttgtcttttgttgttgtggaatgggggaaagaaatacagaatggggaggagaacctaattagaaaaatcaagccttgagagctcccagccatggagaaagaaagggattttttagaagttgtgattttaatatctgctgcaatctgatgattcatggatttaaaataacccttccaggtcaccaggaccctgttacttgctggctttgtacctctcaaaggtcatttgttggcttcgtctcttaacaatttccatggtagacctaaaatttctggctgtgaaatcccctgtgtagtgggaagaagaaatagcaaatcttagctgccttggacctgatataattatttgtcttcatttacatggtttatccttcaaggttgaataaatgatgtgggagctagtcaaggggctttaggtatgtgatttcatgcctacttttttttaggtagagaaactgaggtcacagggtactagagaatggactctaagattcaggtttctgaattgcctgtggttttgttgactcaactgctcttctgttgttttttagccacatgccttgaaacagtcctctttcccatgtttcttcatcagcaccattaacccaaggtatactgtcctctcttatctttcacaaggtcttggagttcccatgcctttgtaagcatccctccccgagattcagcaccaaccaaaatcacatttggaaaaattgcttgtttcccaagaagctttggaggatatgattttgtatagaacgggttcacaggttttctgttcattcttctatggtggagtgtgtgtgtatgtgactctgtcttctctccattcctctttttttttttttttttttgagatggaatttcgcttttgtggcccaggcttgagtgcaatggcgtgatctcggctcactgcaacctccacctcctgggttcaagcgattctcctgtct

SEQ ID NO: 62999 - DNA, 1029 bp, Homo sapiens
aattcctgctgcttaatgtctccaggaaggaaaaaaattttcctctaggctgtaatagtacctaatttcctttttcttctctttatttatttattttccctattaataagcaccaattgtagaagatgaaggaagctgggaaacccatcacttttggagaaggttaatagcttcctttagaaaatcctgacataatacttatttccccaaaaggcacttcatcagcctgaatgccagttaagattcaaggaatgggcttggatttgtgtgtacccagcggttctgtggcatcaagttgcactgggaaggagagtttggggctgtcactgtggagtccctgcaagtcagcaggaccagggctgtcttcctgcaccatctggatttggttagctctctctgggcagtggggccgagtctcatttcctccaacaataatgttatataggcaatgatcctgggctgccctaacataattgaaaattatgtgtattgtaggcttggagtgctgaaatgtgggctcataaaaatatgtggtgcaggtagcctatggagattggatgtggcacacaatgaagcttttatgtaaagtaagaattataagtctccatgttaatattgtattatgagtatgacagttcttgggtgggtcctcagggcaggtctgtcaccttcaacaaagcccgagtttcctaattctacagagctggtatttggatgtaatcaaatcggttttgcaggtggccaaagatgaaaacttgtccaccaatccagctctccccactgagggatagcatgggatgtagatgggtttgactccatttggcatttttgttcacgggtttttatgagatggagaggtgagtgttggtgggtgtccattttggttggcctcaaggaaatgactctattgagtggttttgaccaatgcagctcatatagttatgtggtaagtgagaatgggaagaagttgggatgagatggggcagtttagattcccagagccctctggcctgggttacagatggagac

SEQ ID NO: 63000 - DNA, 1046 bp, Homo sapiens
catactccccaacaaattcatggacttcttaacaactcagagacattagccacaagttccaagacacccccaccccccagcctccccagtcctattttcgcattcatataactaaactctttttctttcttggtggagttttgaaatttatatttttaattctttgctcccttttttcctcttacaaaatgagtgccaagcagctaagttgtgctgagtggtagagtttgagtcagtcttggctggtaagctgtggggttaggagccgctccctggataccacctctggtgtctttgctatacaaagactttcatttagcctcctttgtatccagcaaaaaaagattcagtacccaaaatggtggtattttggtatagtatgtatcttacaaaacggcaaaagacttcaaaagttcctacaattttatcttgggggtttccttttgaagtcgatgtagaattttaccttggggtggattttttgtacttcttggtctggtgtgttttgttgtgtaatgagcatggaggtgtgggataagaaagcagactgaatcccgaggaacaaagcctgccagactgtggtggtgtacttttcttgttgttattgcttaaatgctgcaagagagtggaaaactcttacgaaataatgcacgatgggtagaacttcagagaaaatctctgccgtctaccctgtgcattttcgaggaagctcagagggcatgctgaacctttgctttttgtttctgaagagttcaggggaacctacccataattaattttttaaaacactacctagagagcaccctcttggttattaaacacatgcgctgtttcgatgggatgtttgacctggattgtggatgcttgctgggacgtggcatgtgttgggaggctctgtgctgcctgctgagcaccagcaaagccacagtggcccctacctctgtgggaggccctgtgccaggtgccctcaaagagtagggggcccatgagggtatgaccagggggacctgatttcggctgagaagttggcggggattacaggcctg

SEQ ID NO: 63001 - DNA, 1025 bp, Homo sapiens
tagatggagatgcttcactgagtggggagtattggaggaggagcaggtttggggtggaagcgttgtccttttagagagattgtatttgccattgattgattcattcattgtttctgcaaatatttagtgtgggaaaaagcatgctagacaccaagagagagtggagtcaatgaagaacgataacagcaacaaagactgtagcgcttcctatgcgaggcttgttccagttgcttcagaggctgtgttacccctgttctagagaggaggaactaggcccagggaggtggggatttgcccagtcgtgggagtcaggatgtgaaacaaggcaccctggctccagagcacaccgtcctctcaaccactgcagagaagctgggaaagagacaaataagtgggtgcttagagcacaatgtgtgtggtgtgccaagagcagctgggagccctgggacccccagggaaccccagccccacctgggcatggtgggcatggctggaggaggcctgctggctttgctggagagtgggacatgcatcaaggtggccagagactgggcttctgggtgtcgtgctgtgactgctgcaaagggctcattgacatatggtggggagggccagcgtattttctgcgggcaggacatttgggggatatggggtgtgaccctgtactatctaaaatcttttacttctggattatctccactttctctactgcatatatactttgtttttatttattttattcatttatctatgactcagccagactctctaaaagagttgacttgtgtttcctagcagccactgagtcagaactttcccatttcgcagtcagggctgtggtcagggtgtctgtgttgtctaaggatataaagcaagccttcgggcactaccaaaacattattttataaggagaactatgagtacctaataggaagaaccaggcaatcaggttatcttttggtgaggaagaagtggtagatgggatcattggtgctttgaagggagtgggtggtgtagactccaaa

SEQ ID NO: 63002 - DNA, 1034 bp, Homo sapiens
ccccaggacaaaaggtagaaaagaacaaagtgttaaaaaatttcttgatacatagccacagattattttcctgaaagttctcaacatttataactacgagcagtatgtaagagagttatggttggaatgattttaatgtctctggggaatttaacaacaaaaaaactttaggcttctttggagagagacatgcccttaactccaccccgccctagaacagagacccagcccatccaagtcagcctccccaggtcctccaccttcaaaacaggcaaacgaaatcatttcttgaataattggtaggcttcaaggtcagatgtttattttagataattcacagcataaatttatatgttttaggtaccttagcccctgaatatactcagttcatttaggactattttagaggtcttgagtttactcttataacctcacatttttttgtgaatttttagttctattatctttgttttcatggcatattattgggcaaagatactatttattcgatgctatgtgtgagctgggtcaggattatgaccctgagttatgtttctgggaaaatgtacccacttgtcaaagatgccgttggctcctgtgattaaggtcagcccacaatgaatgtggggagggctggcagcctctcaaatcagctcttgaccatttctcaagctggggcctgttgtgcttgggggaagagtctttggcagctcagctcggggctagcgtttcctgacatttgtttcgctgaatgttaacaaggttactggaaaaaagggttctctcctaaaataggtttagggaagcactgggatatgcgaagtgaatgagtttctttagggcaggatcttgactctgcagggggcttggaggccttccctagagtggggcttcctaacactgcagagctcttcccaggacgaggggcaagattgggacctactttggaaggttgtttttgtttcggcacctgctctgtttacgaagcgtgggagcctgttttaaattaatgtgcgcctacttagagctacact

SEQ ID NO: 63003 - DNA, 1027 bp, Homo sapiens
ctctctctcctcccacaatggtgcttcgttaattaagcagaaaacccatctctggttagggactggagttgatttcgtttggaatgagtgtgacttcatcatgacctgaaagtgttcagaaccatcttggttagcacaagggcgtggacgtgtgtctactttctacctgatgggatagcatgtttaatttggggttatgacactgaatggtttgccagtaacttgctaatccaaccttatacattccagctcacagtggagcgtgtctaattgccacagcagcatttatgtggaacgtggttgcacaaaagctccagaaagtcaggctgagggctcctatctctcctcaatcttggtttacgatgtctgtttctgaggaatcctgggatggggccactggctctttaagagagagcccgatttggaaatctaggacttgattgttgattatgggcaatagatacattttaagaatgatgttgtaggctgtatgaagtcatttgatgattgttttgttaatggcttgcaggtcagattttcatctttttaaattaattatcatagaaggagaaaacaactggatttcagaattgtcccttgaggtgtactggaaactaaggcgtgagggactcataggggtctggcttggaaagtgtattgctatgtccagtttacacataaggatgtgcaaatccagcaggttagctgagctgcccaggaatatccaggcaagaatgaccatattctgataattactcaggcctctgcctcatctccgctgcccccccgccccctgactctcttctgagtgccagattcagcctccatttgaatgccaaatagacaggaaattagcatgcccagaatccacgtctttagtgcactctctccccagctccaaacctgttactgcttgtgttcaacatctcagtaaagctcaacaacatcgacccattacttaggcctcaaaccttgggtggcatcgtcgattgctcttttctttcataccccacattcaacccatcag

SEQ ID NO: 63004 - DNA, 1044 bp, Homo sapiens
tagtctttctaggccagattatttagtttttgccatctaggtaaaattcggtccaattaagcgtccattaagtgttttaatataagctggagaaggagttgaacctggaggtcagggctctgtggtctattacagtccccctggggtctctagcccaagggagactccagggtcttaataaatgactgggggtttcattttgaggcctttactaccaaagactgaataatacattgggcatgatggttttgtcctaaacattaacagccacaaaaggtagagagtgtgtctgtttatagatacacatgtatcatgaataattagttggggactgtgcatcaggtctctcattttacattcgaggaagcaatgcacggaatgaattctggacctgcgaactctgaatttcaattctctgtctcctacttttactggagtgcttgcaaacagtacagtgtttttgttgtgaagttataccgtgcctgtaatctctctgcgggtggccctcctaagccctacttcaagaaatagctctaagctcatgacacccgccccacccgatgcctacatatgtcttatatccttggagtagtgtttggggttgcaaatttgactttagggagacatactctctgatgataggctaatgcttatatttactgataaacttcctttttgacggtcatgggcttcgggggccacccaaccaaactgtgtggctgcttttatgttgggccaaaagacaggctccttgtgtcctcccagtttcttaaacaatgaagtcatggcattttacagtgctggtgaatggattgagattgtggtggccctggaatgtggcactgctctggctggagggaagatgagagtgagggatggagaggagaggagagcgggagatgggaacctggtggacacaggagggagtgtgagttctgagggccaaaggaaacttgacaccggatgggacattaatctgattctgttatctgaggctgtcaccagtcctccctgtcctcctggcatgcttctgttgaaaccccc

SEQ ID NO: 63005 - DNA, 1018 bp, Homo sapiens
tgagtgacattatttcatacaaaattctcatctctggaggcctttgtatttttaggggttttgtttttcaaatgctttttacctctttctatacttgttcatttttaaatgtttcctggcagagcaattagtattttctggcttactaggtgctattcgattgcattagcgtttgaatattacccagctagttgtggagtggggcagtaagctcataaagaagcaagataatggaatacacaaatattactacgactttatgggtggcataccttgattcttgatccacgtggctgtgttcagatctggttagcacacattgacatcaggggctgagccaccagtgagagtcaaacccagcagccctgtcagtctaccttctctcttgacttgatccagcctcataacttcactttccgcaggagaaacacacctcttgaggtcctctgtcacaaataggcagtgtttctggagaaagccaggaggcagattttagtgctgttcagcatctgtggtctctactttctggatctggtgcattatggagaccatgaaatgacatgaaatagctcagtgctgccagtggcggtgacagggacactagaggtgaaggagggcccttggggcaattccagcaggtgggtggtggctgaaggtccttgtcttctttctgcagagactggccacctgcttcattctttcaagaagcaccaaatccctacttcagtactttgcccactcgtcatgtcaggagcatgaaactcacgaggccttcatttacttttatcctgtaacaccttcaatttttcccacatcctcccttgattcgtggatggacaactatggaggccaatctggctgaggtgaggactgcttgagtctaaattcctctctcctcaaacccaattcaaactggcctgagcaaaatgaatgtattgatccataactgaaaagtccagaatgatcaggcatcaggcatggttgcatccaggggcccatgtattagaaccatctcctt

SEQ ID NO: 63006 - DNA, 1033 bp, Homo sapiens
tcattgtcccttctctttctttccatgtaattcagccagattcgaaccctttagatcccttcctctagggaattaaggttggtagaccagctgagtaaatgtgactcagaaagtcaatatccacctgggcagggatgagtcatttctttctagttagctattcatgtacattttaaagctcgccacacaaagtcattacattgaggctattaacatgtttaatagtgacaataatagggtgtgacccatggcatataaccgcattcagataagaagaaagagttttcttttttcttcttcctgtaattgctcagtcaataccattttcacggaaatacttgcaaacaaacttttaaaaagttcattgtccaaagccttccctgattccttgtttccttcctcttcaggggttctataaacttttcctgatcagtggccggggattagcgagatggtgcactctgtcctgattttgtggttgacctacccttttgctggtgttgagcctgtttttattgcattttttggggtgtgtgtgcgcgtgcacgcgcatgtgtgttttttcaggagggggcacattattgctgctacttgcttattaacctctcaatctagaaatttcagggaagaagagacttccgctaaatttgccaagctagacacataaacagggagttagccattttggtgagaggaaatgaaacttttcttgggtttattagaccacatcctatgtggcttattttatgtctgatttctaaaaagcatgtcatcacggtcaaagttttatttttgcttgttagtcatttgaaacaaatatagatattgcttcatttcctgggtactgtatttttcagtacgtggtatgtatggaaaatttgggtttacacaatgaagtgcactagaagggaagtatttgctaatttagaactctctacattataactttggattagcaagcattcggctaactaaacattttcatttatctcctacccctgattatataaagaagcagatgagacaaccaaag

SEQ ID NO: 63007 - DNA, 1455 bp, Homo sapiens
aatcccagcactttgggaggccgaggcagatggatcacaaggtcaggagttcgagaccatcctggccaatgtggtgaaacccccgtctctactaaaaatacaaaaattagccaggcatggtggcgggagcctgtagtcccagctactcaggaggctgaggcaggagaatcgcttgaacctgggaggcagtggttgcagtgagctgagatcgcgccactgcactccagcctgggcaacaaagtgagactctgtctcaaaacaaaacaaaaaacaaaaaaaatgtattttaaaatatattatgatcattgactttttcttttggtctcctgttctacgaattgtaatataaattcgtattattgccaccacgtaggacacagaacagctccatcgccctgtacatgtcctgttgctgcctttgtgtagtcactggagatgtgggttttatttttattattttctccatttgatagatagtgccgacttgattcacttcatccattccagggccaatttttcactgttgattgtcaggggctctgctctgctgtttctccagccctctccagtgaaagagatgtaactgcagtgccatagttgtcagcttgttagttattggcaagtcttggttggattttctattcttcattgtgggctgtccttgcctgtacacctagcatgctctggaaccctttgtggatttatgagaattcaagctaattccaacagtggccaaagaaaaaaatagccagggaaatatgttattgctaaccatataggcctcagagtgaaaacggcttttggagtattctgctttgaattatttattttagtctttctcagatgtcaggacagatttttaagatttgggcataatgtttaaaatgaagatggtatgtctgtagattttattgacccaacttggtccccccaggctgtcctcacctgccccacgacttagatgaaaccaggaatggcaagaggagagcatccaagccgcctgcaccagccctcagtgcatccccacccaggctctggaacaagctgctacatgcacgggaagaccagagctgccgtcttcctggctgttgttcagagcttatgctttcttagggaaaagtacaatgtagggctatgtgtgtggtggggatcttctgtgtgtgcttgtcctccccctgggaaatgatgagaggtgacccccgagctcccagctcagtgtcacactcgagtgaacagtagatgatgcttctgccgtgcgttttgctggggaaggtaacagccatcgcacacatgtaaattcttgtgtaatccaattcctgtctttgtaattacttggagacttgccatcgcagccaattgagaagtgggagcagtgaccctgggcagaaagcagaaattggagaggaggggaggggcggggaggtggcatccagaacacagttgtagctctcctgg

SEQ ID NO: 63008 - DNA, 1083 bp, Homo sapiens
catagatttttgttttgttttgttttgtgtgtgtggttttgttttttaaataattagaaacagttctacaattgttaccacccacagtaaaaaattgcttggatcccgcgaagtaagaaagaaaaaaaaataggccatttggtagaatgattaacagggggctttaaagaggaaagtctgctttggagggtgagctttggatgtacagatgctgggaccctcgtgtttttcaagtcccccatttgcctgcattgagaatcaaatgtgaatggtggttgccagtgataggaggggttacaatgcgtgagatggctctgggaggaaactcacattttttcgtacttattaatggtatgtcttttgtgcgagtgggtgtgagtactgagagcatcaagtgtatatttgcacagtgtgtggtccttgctgctgtgttccactccccatgatggtgggctacactaggaggagaagcaagccttagcacagcttgacagtttccattatatggacagagtcactgaggcaggagcaagccaggcctttttccaggtcaagggagctgggtcagtgtagctgggactcttggtttcttagcactgtgctctgactatcaaagctacgcccccacttttgtgggaataaaatcggtgcccttgcatataagttgttcgcttcactcccagccccctcctgagaattaggatgggccaggatctgagttcagtgcctttggtccagtaagatgtgctattcattggcgatccttcccccatagtttcaagactgtaagtggtcacatgggcaaagagatgatttcctaatcctcgtgggagcttgaaggatttgcctttgttaaaggaggaacatcacgctggaggggtgtctgtctatgtgtcccacttaaaccacactgcttttgacttctcctctgtgatgattcccaggcagcctcctcttgccatcctgacttgtttaaatttatgggttgttggcaagcaattttttgatgctattcttctcatagccagaggccaagatcccttgtggagcagtgcctgaatttaatagatgtcatctggacac

SEQ ID NO: 63009 - DNA, 1090 bp, Homo sapiens
aatgttcctaacacactgctttcttgaaagaaaatcattaatcttctcaaatgcaagtgtaaagttgatccattttagctttcttgtccataaattgttgattattggttttgaaggaaaacgcagtatgagtgtggtttgaattttaacactgaaatcatagatgtacaacatgttcattgcagtcaaatcacaagcagagagaacccatttgaaacaatatttaaaacattcctgtcggggcattatttaatgggaatgataagtttcagattttaggttttagaaagttgaggttggctgtacatcaaatctacgatttaactgctttgaaagaacgcctttgcttgtcttcagggggaaacaaataacttaggggacatcagttcattctctaacagtctttcatccctaagtataacaaattgtttcttttattaatgtggtactcgcactatggaagcagttctttggggaaaataatcaggaagatatgctttgcttctcctagatgctacaacctgaaatatgttgctaccttccttgaagggattttctctctctctctctctctctctctctctctctctctctctctctctctctctctctctctctctctccctctctctctctctctctctctcttctccccccaacaaatatagctaacgtaatagaaattacagaacaggatacaatgagatttctttcccttctctcacagcacgttttggttggctaggagaaggcaaggtattggaatatgattatccctatttaaggaaaaaaagaatgatataatttgtcatcttaccagttctcggcattctttgtggtgcgcgcttagtcaatgccgggaaacggcggtctgacagctaatagatatctctgccctcaattgtttagacattttttgtcttttgtgacattgaagaaaagacaaggaagggaatggaagcaactaaaaaatgtcaaaagatcaaaaaatcaatgggccgcaggaatgcaatctgtttaccggggtgtagctgctgtttctgctccgccacaagtccgaggcggttgtctggggcaggcaccgaagttg

SEQ ID NO: 63010 - DNA, 1047 bp, Homo sapiens
tcgacgttatcaggcgctgtcattcgttccttcctattttcgggctgctaattgatgtttttgatgtcagcaagaaaattgaagaaaatgtcatgtgtgaaccagtgcggaagttaataagattgacttcgttgacagaatttacaatgagagcagagaccgcataatgggaccgctgcgaattcgtgtgctctctttggagtcaaaattgacacctcacgctaggccagtggtcgataggagagatggaacatttgggaaagttcctaatctcatttttccccccttaccttttggtctccgatggtgatttagtttcaccggcagctgtttatccagggggctattgctgcggaccacgccaggcccttagttcagactcctggtgccaccaacaatgcttattttttatgctgttttgagtttgaaagcaaaagagtcttaaaaaggttagattaagatgtgtcttaaggaaagatatactaatatcggtcagggtcattgcagatgcttaggttatgtgcaataaagccgaaacacaaatccctccctgaataaagaaaccatgttggcactaagatcagtccttgaacataacagaaggttataacttgcaagcaaaaaataataaagttcttggccacatgtctccacccccaaaagaaacattttagccatggtgtcccttaaggtgtttttttttttaaaaaaacttatcgaaggtttcaatataatagactaattttccagttatgtggcaaagtttattggatttgtgtgtataattatggattggattagttgagtttggttcagtgcatctgattatcttctggcctttagggaaatgcgctaaaaccctaatatgtccactacccccaagcggtctctttttgaaggcgccgcacaaaatgtggtctctaccagcgcttggcctccaaggatcttcagtgagagacattattcttggaatatccaattaattccacgggcagtgatcagttagcgcttcttcttcctttctcgccatttgaaatgctaacacaa

SEQ ID NO: 63011 - DNA, 1048 bp, Homo sapiens
taagaaatcgccgtatatatctatgtatgcatatatgtataatatagttataagtgatataactctgcaggacatagatatagatgttgagatgatttgggtgaattcaaatatgttggttatgccaggtaagctgcaaatttttaagcttaattccttttaattagtcttctgcctatgttgtagagaaagttctgtgttttaatgatctcgtaaaacgttttctgctactgggctgattgcgcagttcgttaagcttctgttagtttaatttctgataaaacttccatttcaactttgcggcaccctaaatgagaccatcttggctccgaaggagtctagcgggcactctttccgaatggcgatttgggatctgctgcatgtatcagaggctttcgttgagttgtgttgtttcctgtgtgtttatgacagaaagatgtcatcgttaaaggaaacttaagagtttctgtaaatgtaatggttcatcctgaataaagtgagagagacagtgcttggaatctggggaataagggtggaaagagctgagctgatgaaggtgtttcttgtcaaatttgtataggaattatttactgtgctgtctttcctgagccgctacagtaaaagtgaagacatggaaaattatcccagatgggacgaatcgctcgttctctgttctttttttaaaaagaaaagatttcagaaaaaaaaaaaagtcgtctttttctttagaacagtatgaataaaatctggacagctgtcgaaaaagatatgccgtctgcatttttttttaatttctagccaccaccataactaaatagcttgaatagtacctcttttcttttttttccccttcatacataatgatctctacttcattaaaagcgtattaatctggttcccagtctcttgggagacaccttaagatgatgatattgtgggttttttccccccgaattgtttaaaaaaaaattctagcagatttggtccctgtcagtcagaaataattgtgttcttaatcttgtccctgatggatgactcggagttcagc

SEQ ID NO: 63012 - DNA, 1062 bp, Homo sapiens
attttccaggttcgaatgttcctctattcctccatcccaacacctccagcccacccaccacctctcaccccccagcccttccatcctccttttgaggatagagaaaaggtctttaagaagagctgagcttggtcctctagacccttcatgtttggcagtctgtttggtgtgttaccagctgggtggttatagtatagaaagggccaccccaagaaaggccaaggacttgaagtgatcgagttagttctaggtatttgcatgtgtgtgagagaatttggatgaaaactgactgcacgtttctcctctccctgcttgctctgttcagtcatttcccagcaagaagaattttaatgcctgtgtgaatccatgagaaactatgagtcggcaaaatttcacagacggcagggagaatcatctctcttcctcttcttgctgtctaaatggatttgattccagagagggagagggagagaaataaaagccagctattgataatttacaatacaaataagcagcacccttcctaggaggctctcagggattggagacgctctaactctgcagcctgcgggggtaggttctgcagcagcccggccagaggatgcaggctgtgtactgcggctggcagggtgggctttgcttttctgcatctcacaggcagatctcttttctcttaccaccttgtttctccaagtaaaactcgaaccctgtgaaaccttctgtcttttatttattatttccaacaggcagtgctgtagctatcgatagaagtcttgtccagggaaacaatccaccattagctgggagcaaggccttagacagaaaggagcaacattcaactaaggaagaccccggccacggtgatgcatgggtcctggctagctgcgaggggagaggggcacgggccagggtaaaatgctctgaggaagcccacccatttggggccacgggaggaagtcatgactgctgtttttattctgtgtatatataagaggtttgcaggatgcaaaagcaagtgttggcctgctgggttgggatgggactgtccatgcaggcctaggc

SEQ ID NO: 63013 - DNA, 1019 bp, Homo sapiens
cgtgcctcctggaggtggggccttggggtaggaggtccccacaacatgtggaaacgcagtaggcatgggagattgaagtctccacttctgactcacctgctaatgggaaaagtgcagactcttgggctccataatggggtaggggttgagaaggtattttaaaagccaggcttagtggggaaataaaaactaaagcagacccacccagagagctgtcttacaactatctattattttcacatggactggggggagtatgggatgggcagagttgagtgcatcttagaaaatccaggtgagaggctgtggccaagggaacccacgggcccggtgctctgaagccctgggctgctggaaccggcttgacggtgtctttctctgttctcctccccacagtctaacaaagtgccagtggtgcagcaccctcaccatgtccaccccctcacgcctcttatcacgtacagcaatgaacacttcacgccgggaaacccacctccacacttaccagccgacgtagaccccaaaacaggtaggctgtgggctacggagccaaggtagagtgctggtcctggggttctgggggaacctttgaggcctccacaggaaccccaggggtggagcagtaggggactttgggggaacggtggtgggggggcccctgttgcttttctgggtgttgaaaaggaagctctttggggtggttgaggcctggtgtggcagtggttttccactccctttggagaagttcatttgcagtgttaaagatctctttatggcttccagtacccctgaaggggctgtcttgggaacctggctatgagtcctcagtatgtttcaggagtggcttttaactctaagagcctcaggcagacatggatgcaggaatcatattgaaggcatttcttgggttcctcctcagcttcctgggaagatgagacagcatggctttccaagcctcggctccctcactggctaagaggctccagtcactacttgacaatgacttgttggtatagcct

SEQ ID NO: 63014 - DNA, 1017 bp, Homo sapiens
tttttcccataacagttgtttaagcagtgatgacagtgatttagagttgaactaactgtgcaaattgaatatgcagtatttctttaaaagagactggttaaaaaaaaaaatggaaggaattcagtaataaacctccttaatctaatggcatttttttcattgctcccactaagttttctcacgcaagcatgcatccgcagtatgattattttttcctttgcttttttttattttagttttttctttcttttgcttttctgctcataatttgcaagtccactagcattttactgactgtgcctgcttaaatgctgctatgagcttctaactaactcctaacagctcattcacacagcctgtttacctttatcttttcctctcttaataattaatgaaaatagatttaaaaaaaagacgaacgttccaaaagctgcaatatcccagtaccacaacccttttctttctttatttctttctattttgtttcgttttgttctgtttttatttgtaatttttttctttttttaaactattgtattctgagaagaaaaaagcatgttacaaacttaattccctccttcgctttattttcttctttaagaaaaaaaattgagagaaaaaagggaaagcagaactaaaagaggaaaaatatttaagagttattccatgtctaacttccctttgtcagctcgaaccaaatctgagagacagtccttaaagaagggatactgcagctttatttgcaacagctaatttcaaaagttgaataagaatgtgacttttacttttttttttttaattaaagaaagttaaaaaacgaaagtcaatattttgcaattagtaaccaggtcattgatttattcccttttttatttttatttttttcttatttgtatctttctcttccccccccccccccctctttctctctctctctctctccctttctcccacgttctcctcctctgctcgcttctctcttgaactcattcagacctgagcgctcctaagaaatgc

SEQ ID NO: 63015 - DNA, 1051 bp, Homo sapiens
ttagctgacattgttttacagtgctgaaaaagaagcgtggcattgaacggcatgcaccagctaaagggctgcaagcagtgagtcatgcagtctcagactgcagcgtccctaggcctgcagaattaacaaaatatatgtgtgtatatatgtagcattggttccaaaaggaatcagaacagcccagaagtgtccaaattaagcacccatgttccacctgcaggtctccatccagcctgcattctcagggaaagtgtaggtacttccttcttggtggagggataccgactagctcctgtctcatttcctttctttaatgaccacctttggttaaatgtgttgtttctttgttctgatacaagcagtctttgaatttggaatattacaatggtaggtatttcaacaccctaaacacgcttccctgtttgtagtgcctccctcgtcacgtgtccctccccttcatgactttgccatgtgctccgtgtttagacgttagatcagatgtgcatcccattacgtgcatgcccacgagtctcctgtgtctcttccccccttctctgatgccaatacgagagatcggtgaagtgcctcgtgttgaccccagcacacattagaggagagagggcctgagagtattccctgagagggagccacacagacagccctctgcctgtggaatgagggatttgggggcgagttgaacacccggcaggagaggaactccccaggcattctgtgagatggtagtgttcacagcgctgacagatgtccctttgacacagtcctggggtcttctctgcacaacagaaaggagttttgtgacaaagttgatggaggaggttaggtatttaattaggactagccagggagggcagggactctgttaagcagtgaatttgtcaaaattttacttgtaccaggtgggaagataactagctgtggaagcctgttctgagatgccctgccatggccaatgactggttaaccacaagggtcactaaaagagagggtttctcatgatctgtagaaatgtacaactgacactattgtgtgc

SEQ ID NO: 63016 - DNA, 1037 bp, Homo sapiens
gatgaagcctaggttgggggtgctaagagtatgggttaccttcccccttttactcaacttttccttttaacgtggctatggccacccctggcttaatgctaaaactcataggacaaaatgtacttaaaaaaaaaaaaaaaggaaaaaaagaaaagcagttgccaaccgaggcattttctgactcgtcagaaatgtgtgtgcgtgccagctgccctgtgctcagccaccttaggagacccattgctctgtcgccatagtcttcatgtcccgtgttccagatacccctctcattcctatgatctggaaacttccacgtcatgagggtgggaggggtgaggaaggtaccagaatgctcctagccaatcagggcttctagcttgccacacaaggtttctagtttcatttgacatttgtggacattttaacaagattctgttttgagcccaccaagttgcttttcccatcttttcactctgccctaatatagcatggaatgctgcttggtgctgttcccttgtcttcctggttgttctccctgcttctttctttctccctttcctttcctctctctgtttttctctgttgctttctcagttttgcttatgccctccccctccccacctcctttccttctcccatttttaaaatgcatggacatcttagttttttgagcatgttttgatctgcaggctaaggtggtttaaaactctgagaggcttaattatttatcttggtttctgggatggaagcagaacccatagtctatttactctctcccagggagaaaaaggaaccttgccaaattgagggtgagagggggtggtgcttgctcccctagagttccttctgacccagaaggaacagacagaccctgaggccactagcccccatgaatctcagcctctgggaggcagggaggactgagcatgctcccttacacccctcccctccttccctgccttcctgccatcttgctgagtccaaaccccaagcacagaggggcatgatcagacagctctggggcacagactgagagg

SEQ ID NO: 63017 - DNA, 1161 bp, Homo sapiens
aagggcaccatgaatgcagtgccgttactttttttttttttttctgtgtgaaacaactcttattgtgatgttacttgttattgtttaaatgtacagaaacaaagggtaaaaatgtgttaatataccttgttccatggtgttgttcttttggggggaggggacgctactcaacacttaatagaatcacaacgctgttgggccagtagtatttattgctttagagattgcttgtcgtacctgtatgtcgtccctttttaaatatgttttcctttttcttgaaactgtataaagtttttttcccccttagcataagcatcttatatataacaactcatttgtacaaggtttttaagtttatatataaaatgtgtatatatatttttgtttcccctttttgacttttttttttctgtatgaaacccagatgtcaccaaatggacattaatagttgcattaaggatcagtagcattaacaaaagttgctttaaaagccattatgtaaaacaagacttgaaaatgagtgagggaattttagcgacactgtctgagcagcagtgggaaccatcttcgtttcccctttgaactcccagtgggatgccctaccctgcgcccttaggacccggactgaccgtgtacaaaactttacgtgccaaaattctcagtgaatttagctttctccctctttttgatgctgtaatttttgttcatcatgttttgctgtgatgttacataggtagatttgtatgtagttttaatgtcacctataacaaaatgtgtttggtagcagattgtccagaaagcattttaaatgaagaggtataaacccttaagggccaaaattctgtatattagattactcttaaacgaaaaaccagctgccgcttttatgtacacatattacatacgagtaggcagcagactttaaaaataaaaaaaacctaggcatgttgatgttgcaaaatgctgtataaagctgaaacctgttcattcagtgccattgtagttgacatgaagcgattgtaaaactgtctccgatttttctctggtttattaaaatgctaactataacattttttgtgaatactttgaatgtttcctaacagttgtgatgttactgttccgttttatgctcttattccaagttcatttttaatggtttgg

SEQ ID NO: 63018 - DNA, 1031 bp, Homo sapiens
cttatatgtgctcaaaataatataaagctgtgtgtatattttaaggtaacatacacatttttgtcaagatagttgcaaaaaatgtaataatatttcactcttccgaaccctttttgagtatctgacttcagcaagttgtctacaagtgaaagaaacgggaatcatttaataatcattttgtaagtcagtttaagaacagactaatacacaggactccagctcagcaaagccttttgatgtacttcccagaaattattaaaataaatggtgtgttgtaaatactgacatttcaaagtcgtttctttaaatgtacccagtggaatctacatccatagtgattttataaccacctttatccattaaaagaatacatgaacagctctcctgtaacagctagaacttttatgtcttttttcccttcaaacttggttttttcattctcttttcctccacattttcttctgatgtaatagatttagttgcttgaaagtcttattgatcacaccacatcatatacctatgtaacatatacatgtatgcatatgtgtatccatataaattttaagacagttttctagatatcatgagtattaaaagaaagttctcctagactaagttactgtttcagctttaatgaattcacaattgatctgaaaaataaatgttaatatatcattaatattattaaattgtcattcatcaaaataattattaaatagaaattgcattgaagtttcaacttataatggaatgaaggggctcttaataagttagtttctaaagaaatggacaaataatacttattgctggaataagaaagaatttgatattacctctttttcctatttttcatttttagagataagatgcactgagaaatcatgaataaatacatgagatggtaggagttttgttacagtcatgtcacttaattctttgaattccttctgagttctggaccaaaaaatgacaacttgattaggtctttccttaattatgttggaagaattggcaattatctaacttacaaa

SEQ ID NO: 63019 - DNA, 1054 bp, Homo sapiens
aggcacagttctaggtatcaggacacagcagtgaacagcacgtacatttctgttcccaactgcatagaatgatgtctgctttgatatttaggcttgccgagggaccgagcttgatgatggcatccaggccgactcggggcccatcaatgacacagatgctaatcctcgatacaagatcccagtggaagctgacttcctcttcgcctattccacggttccaggtatcatgtccattgtctgccaagcatacttcagtccattccatcatcaaaacacagatttggggactgtattcgtttcctcttgctgcagtaatacattactacaaacacagtggcttaaaatacacaaatgtattatcttgcagttctggaggtcagaattccaaaataggttggcagggctacgttccttttggaggctcaagggaaaatccatttcccagcctttacgtggcatgttagaaccacctgcattccttggctgtggccccttccttcatcttcaaagccagcaactttgcatctctctgacccttctgtcgtttaccgtgctctctttctgaccacagctgagaaaggacacctgtgattagatggaacccacctggatgctccaggatcatctccccatgtcagtccgatacccttaaccacatctgcaaagtcctttcttccacataaggtttcatgttcataggttccagggttagggcgtggacatctttgggcaccattattctgcctaccacagaaatgcattcacttttctctccaggaaagctgaattctctcatttgttattattattattgttttagtagttataaggacaaacatttctgtagtactttgcaatatagagtatctttcatgtgttttttctcatatacaataataccgtaagtatttaggaaaggtgttattcctgtcctgattttacaggtaaaataaaagaatttttagtttggatgaatctaagtgatatgcctaaggtcaggtagagatttcagtgcacagtagagctgtgagtcagccaaggttcctttacacgg

SEQ ID NO: 63020 - DNA, 1208 bp, Homo sapiens
ttaatttcaggaaaatgtattgattcaacagggaagaaactttctggtgctgtcttttgttctctgaattttcagagactttttttataatgttattcatttggtgactgtgtaactttctcttaagattaattttctctttgtatgtctgttaccttgttaatagacttaatacatgcaacagaagtgacttctggagaaagctcatggctgtgtccactgcaattggtggtaacagtggtagagtcatgtttgcacttggcaaaaagaatcccaatgtttgacaaaacacagccaaggggatatttactgctctttattgcagaatgtgggtattgagtgtgatttgaatgatttttcattggcttagggcagattttcatgcaaaagttctcatatgagttagaggagaaaaagcttaatgattctgatatgtatccatcaggatccagtctggaaaacagaaaccattctaggtgtttcaacagagggagtttaatacaggaaattgacttacatagatgataaaagagaagccaaacagcaagaagctgttaccacacccagggctatgaggataatgggaagaggtttggtttcctgtgtccagtagtgggatcatccagaggagctggaaccatggtgggggctgcctagtgggagttaggaccaccaatggattgtggaaaatggagccatgacaagaacaaagccactgactgagatggagtgagctgagacagataagagaataccttggtctcacctatcctgccctcacatcttccaccagcaccttactgcccaggcctatctggaagccacctcaccaaggaccttggaagagcaagggacagtgaggcaggagaagaacaagaaatggatgtaagcctggcccataatgtgaacataagtaatcactaatgctcaacaatttatccattcaatcatttattcattgggttgtcagatagtctatgtatgtgtaaaacaatctgttttggctttatgtgcaaaatctgttatagctttaaaatatatctggaactttttagattattccaagccttattttgagtaaatatttgttacttttagttctataagtgaggaagagtttatggcaaagatttttggcactttgttttcaagatggtgttatcttttgaattcttgataaatgactgtttttttctgcctaatagtaa

SEQ ID NO: 63021 - DNA, 1033 bp, Homo sapiens
gtttgcctcatgtggtagcctgaggataggccatccagggacccagcctccttcagtccttcatctgtaaggtcccaggtggctccaccacctctgtgttccaaacagcaagacggaggaagaaggagaagggcagttcttgataaggacacaactcagcaatttcccatctcttctgctcacatctttttggccagaccttagtcacataagcacacctagctgcaagagaaacttgaaatgtaatttctattctgggcagctacatgccgagcgaaaattctcttactgtggaagaggaggagaacactatccggaaccaactgattttctgccaaaagaacattttacacagaggaaagattgaaggcaaaggccccgaggaaagaaagtacttgacttgttaaagagaaaaaactgcccctggaggcattgcagatgtggctgctgtgtcacatttgtgtcattaggtagcagcgattagagaggctatgtctatgctcagcgttctgtcccatgaacatttgaatgtttaatagtctgactctcctgttttgtggacttggcatctgttttccttcaccggtatctgggagagtgggtgggccttatgagtgggctttctgaccctcgcgctgggctgggctggccactaggggtctgaagggacagtgggaaggtagagggtgccttcaccaggagcagccttcattagtgagttttaagagcctgtgagaggatggatcaggtctggtgtgtgctggttcatgctgcacaccgtgtcaggatcacgaaggaaaggactggggaagggtttgctggtgtctcagttaatagcaataacggcagccactattgtgttcttgattctgtgccaagcattcttgttatttaaaaaaagagagagagagaagtccaggtcactgaacagaggttaaagaaggggagagtgggaggatcttaaatcaggtagcagataggactgaacaatgcagagattttaaaaccaggctaaggaatttccatgagagag

SEQ ID NO: 63022 - DNA, 1053 bp, Homo sapiens
gtggaactttctagtgagaggtcacagcgtcaaaaaaagagatgtagaaagtcaaattcactgcaggaaggagcgtgtcagaagagatcagatcaccttattaatacagaatctgaagcagtcaatttaagtaaagtcaaagtcttcacaaaatcagctcatggtgggctgcaaaggggcaacaagaaaatcccagagtcatctaatgtaggaggatcaagaaaaaagacatgtccattctataagaaaatacctggtaagttgaaatgtcaatactcgatatatcaacaaagacaacgtttttgaactttgtgtttattgcccattgtgtgtgtgtgtgtgtatgagacaattttttgtatgtgtttcctttgcttttgtgatacttcatgagcctctaacgtagatatggtttttgcctatttgattttttttgctccattcaattcatcaagtttctattaaacatgccctctatgtaagtgactatactagttaggtggatattacgggctatagaaagattagtaagagaggaatagggattcagcttaatatgaaaggaggaaaggcatctctgtaaataactataataaaaggcagcctctaagtgcttgtgagaaatacaaagtactaaatagtttcaaagatgggaaatgtcacaggttttacatatcatagtaaatgccaaaaattttaaaaccgtattagaacttagtttctctgccctttcatatactttggttgctgccaaaatatacttggttgctgaaagatttttaaagtgctttattgatgttctagatctataatttgttcaatgtatttatgtaaagaatagcatttatatacttcataacatcagtggtgtttttaataattattttgattaattttctgtacttcatttatttatttaaagacagagtctcgctctgtcgcctaggctggagtgcagtggcgcgatctcagctcactgcaagctccacctcccgagttcatgccattctcctgcctcagcctcccaagtagctgggactacaggcacccgcc

SEQ ID NO: 63023 - DNA, 1031 bp, Homo sapiens
aggtagttatatagtaagtacactgttataaacaagcaggccatcaactgggatttggggaatgttttttattttctagtcttgtttgtatttacagggagtgtattttattcccatgagatttgacctctgtgactcataactaaaaaaacatataataaaatattcaggctttgtgtttaacacagtatgattttctcctggacccgattattgaggacagaatgctagaaatgactgttttcttggtttctttagcagtaaactataatcaggaagtcataaacataactttatttgaaaaactgtatgctttgttcatttcttagaagacttacatgtttataggagacagtgcagtgtaatggatagattcacagagacctggaattagatccttgttatttccattttgttggttgtgtgattttgagcaagttacttgacctcaaagccttatatttctcacttgcaaaactgaactattatttacctttcaggattattatttgtattgaaagtaatatatgtaaaattcttaattcacagaaaagcttactaaatgttagcagctttttattgtattcattgtaattattgttattgtaaaataaattttattaagcctggtaagtatctagcacggtgactaagatgtagtcattctttctataccccctgatctaagccactcttgactatttacagaaaagtcacagaagacagattaataaatattttgcaagtaggatatgaaatatacattaattagtctgaagttttgtatgatcacttgatctggtatataattaatattttaacaaaatggataattaagaggtcactgtaccctgaaacctcattagtttggactaattggcccaaatactagtttgatctgcagatttttttttctagaattttgttatgattgagtaacaacagttattgttgttaatcattagctgttactgtttacttcttcctcccaagtttggctttcagttgctaaaagctattctaaatacctg

SEQ ID NO: 63024 - DNA, 1105 bp, Homo sapiens
taatattgaatgacatgaactgcagtggaatgcaaaatataacagatactctttctttgaccctgcttcattaaaaaatgatttattacagctaatgtttttcaaagcacactaggaaatccatttttatggtattacaaattctaaagatgtaggagattatacttattggctttagaagtttgaaaaattaatcaaattttttttgtctactttctaaaaaaagaacatgggagtaaatgaaattaattaaaagtatcatttaattaggttcaagtgaattgaagcactaatcttggagtggataaaaaaaagagatagggtcaccgatcctgtgttagtaaagatgagaatagactatatacgtgtgaaagtaaaggatattctgaaacttaactttaaaggggaagtgatagagaaatcttcagtgcaactgaaacttcagatgcttttgaattgtaatacattgtatgttaaaattaccagtcaaatgatttatcaagaactcaaatatttctactagctaaatcctgttattaaaaatttatctgtatggatttaagaaatatggatatcttatctcctaggttttagatgccagtgtttcttgttcaagacatcacgtttattgaacatgttgttatgtgcagggtactctgctaactgctgaggaaatatgtaacaaaattgaataaaaaacattatggaacctaaggaaaggaataagtcactttgcctagaaacattggaaaagatttctcagagaaggagacaattgagctagaacttgaaaaataagcaggagtgcagctgaaaatgaaagtggggcagaagggacactcctggctgaggaagcttcaggtaaacaagcatggaatcacagaggagtaggattcttgctccaagaacaggtaaataatttagtgtggcaagattgtaagagttcatggtaaaagtaaaaggagacaaaggtaggttaggttaggagcacattgtgaaatgcattgtatagcgttcttaatagtttagacttttccttctgtgaggatacagagattgaagtttgtttttgatttgtttttttagtagacggatgacatttgtg

SEQ ID NO: 63025 - DNA, 1012 bp, Homo sapiens
actttagatccaaagatacaaacaggttaaaattgaaaggatggaaaaggatattgtatgcaaattgtaactaaaagagagctgggatggctatgctagtatcagacaaaatggactttagatctaaaaaggttacaagagacaaagaaggacattatatactaataaaaagcccaagctgagcacagatttcacctgtaatcccagctactcaggaggctgaggcaggaagatcacttgaggccaggagttggagaccagcctgagtaacatagcaagacctcatttattaaaaaataaattaatacatagatgatatgattataatgataaaatgattataaacaggcacttaataacagacaaaatatatgaacaaaaattgacagaattgaggggagaaatagacaattctacaatagtagttggagaattatacccaatatatacaggacactctccccaacaagataacactacccaacaacaacaggattgcgtatgggacattttccaggatagaccattagttatgccacaagttaatttcaatagattttttttaaagataaatattaaagtatcttttctgatcacagatgaagttagaaaacaataaccaaaggaaaattggaaaattcacaaatttgtggaaatcaaacagcacactcttaaataaccagtggaccaaagaagaaaacacataggtaattattagaaaatacttagagacgaatgaaaacacaatgtaacaaaacttatggcacatggtgaaaacagggctaaggaagaaatttatggttataaatgcttatattaaaaaacaagaaataacttaaatctaaggtgtaatatcttagaattttacaccttaagaatctagaaaaagaaaaacacagtaaacccaaagctaaccgaaggaaggaaataaagattcaagcagggagaaacaaaatagataatagaaaagatcaatttgggtacaaccaaccaaaagttggttctctaaaag

SEQ ID NO: 63026 - DNA, 1043 bp, Homo sapiens
agtcttctttcagtggagtcaacccaaggtgctcttaatttcctcagccatgtgttgtgacagcacatttgggatgttgccaaccagagaagcttagaaataaccaaggcttttattgggggctggtcatgtaggcagcttctgcctgctgtcatgtttcaaaagttcagattctcagaaggaaagcaggtattcagtataagctgtattgtttgtacaaacattttaggcaaagtgagccactcatcagttctaggaatggtgaaaaccctcccgaaatctaagctcccagaagccaggcaagagccaatcttgtttgcacaccttttaaaggatagcagtcagggctactatgttaactctttctgcacacactttatattttctttattcagtagtttgtctatttattctatgttcttaaataaagtactatgaaaacattgccaatttatggcacattttcagatgtttagtgtggacaacagcctgatatcagtgtttgattggctttcaaatttgcttctcatttatttcccaatttagtgttcagcgattttgatcctttcatttttatgtttccattgttcttagtataaaaacgaaaattttccctctccagcatcttttccacacccttctcatccttcctcaaggctgttctagcctccctggctttccttcagttcctaagtatcattgttcctcttgctttaacaccttgacacagtgttccctctgcctggaatcatcgtctcatcctttttgtctagtgaagccatggttgtcttctggatctcagaatgtctccattacaggtttttgtttttgtttttgtttttgtttttttagcatctttcgaaatgcctcaaatagtctcaatccttgcatttaactaggtttttacattgcctgtgattaaactacacgttctactatagtatatacaattgtaattgagtgcatttagaagtatacgtctctcaataagacttttgaagctttaaaaatatgtattttaaaaagtggttttattactaata

SEQ ID NO: 63027 - DNA, 1148 bp, Homo sapiens
gaacaaatatctaaaattagaatccaagaaaactttctggaaagaaaagaaaccttgaatctacatattgaaagggcctaccaggtaccgggggtgattgacccagaacagtccaagaagtatcctagtaaaattattatactttaaacattgaaaaacaaagaacgtaacttacaaagacatgtaagttagactggccatgcttttcacaaataacgtacaaagcaaggcaacagtagagtgacatttcaggaatcttaatgagtgtaaaccataaaccaaagagattatatccaaccatttgtccttcaagaatcaatcaaggttaaagaaaaacagtttgaatgtcccaaaactcagagaatactgtgcacatgtgccctttctggtgaatctactatagggagagctagagaaccatgggtgagtagggaaactgctaatggatggatggagattttatacatgtagagctaacaccaaaactaagatgtagagttttggtatattagtcatagtttgatcagagaagcacaactgggtataataatgagagaactaatagagaattcattataggtagttgaccttatgttattgtggagctacatggctaactagtatatgtgaggctgttgcttttgtgtgctcctgcaacctacctaagtttactaacttttcacagtcttcaagcagaggtgtgtgtgcgtatgttcttgtgctttggtttggaattaaagttgtaattactggcaaattatatctcctgatggcaggtcaggcagttgagaaggaaagatggatataaagtagcagagaacaagggcaaaccagaaagaacgtgcaaacatgaactagaacttgcaaggataaactgaaacccatgtaagctttagtttagatgatgaagtggagcaaaacactcatctggcccagaaattagagacgcggaaggaggagatctacaacccttatattcttattgctttcatttgccttgcatatctttttctacccctttacttttagtctttctgattcacattttcttagatgtatcttttatgtaaagaacttatccaaatctttttcttttaataatgagttaagcccattggtacttattcatatgactggtaatgtacaag

SEQ ID NO: 63028 - DNA, 1002 bp, Homo sapiens
tcatgtgtgtttttatgtagtaatcaagattgttatgagatttaaatttgttagttttttatgtgtgttaaaatgcagttgaagatcccagcgtagttctacttttcgtttttttttaatctatggacttttaatatttgtgatccaaaacctaatgtgtagatgatgatattcaaacttaaatatttaataatgtttaacatataattttttcctttcagatggtcttcttattattggtgttcactcggctaagtttccaaatgaaaaagtcctggataacattaagagtgctgttcttcgatacaacatcacccaccctatggttaatgatgcagatgccagcctttggcaagaactagaagtttcctgctggccaactctagtcatacttggacctcgtggaaacatgttgttttctttgattggagagggacacaaagataaattatttttatatacttcaattgctttaaagtattacaaagacagggggcagatcagagataataaaattggaataaaactctataaagattctttgccaccttcaccattgctatttcctggcaaagtaacagtagaccaagttactgatagattggtaatagcagacactggacatcatagaattttggtcgtttggaagaatggacaaattcaatatagcattggaggtaaaacttgcttctgattacgatagataacgtgttttacagtaaaaaaatagttcaaggtaaatataaaagttgaaatgtctaaatgaaaactaattatagaaaagtgatatacattgacttaatttcctaataaaaattttttgttaattaatatgatgtctgaattaacctcttctcactccctcataaaacaaacaaaaacactgaaaaagctccaggtcaaaaagaggaaatagttcagcttttaggtatatttgtatattctatctttttttttttttttaaactgctgtacttactgtttcttatgaaaacatacgtt

SEQ ID NO: 63029 - DNA, 1070 bp, Homo sapiens
ggatggctggttggcttgctcactattggattagtgcttggcacatgtaagttttaatgtgtgtcaattactagctgagcacaactgaaatatgtgcatttaatttttagaaacatgtattttgctacattgtgttttaaaatttcattttaaaatttttgtttagttaagatgaggtcaatgccagatctgctggaggcatgatgggagatggggataagaggggaaaagtagaggaatggacaggtgggatatgaaagggactgattatgtgcatttgaataagaagttcattctataattgattggccttttttcataataaaactttgtactgcacatacactctaaatgttctattgactattgaaaatctttacacagcaaaagacaaaagcaaaagtaacattcattgcataaaaccatcctttgaatttctatagattgacctagaagctgagaaggtgagcactgtagctggtattggaattcaaggtacagataaagaaggtggagcaaaaggagaacaacaacccattagttccccttgggatgtagtttttggaacatcaggtatgtgaacttttgatattaaatgtaaaggtaaattttacttcatgtaagatttaaaaatattcttgaggtggtcatttggattccattactagttattttattttatacttttatacctatgcctcagagtttgttaattgtgtaaaaacaaagctagcagtaatatagatatatatatactagagtatgtattatatatattacatattttatctataagatagactatgtgttactctaaagaattatatattagatgcaccctccaattaatgtagttctgaatttcttatactgaaaggattatagtatcagaacttcaaaaggttattcatgaacagtaatcagtaataataaaaataaatttattcataaataaggaacttatagtgtcattatatactctagtttgaaaaagaaatcaaagaggcagctgcttttgctttagatttaaaaaatttatattaaagtatgataacttctttaaactttta

SEQ ID NO: 63030 - DNA, 1068 bp, Homo sapiens
tgcctgaagaacttcttatgacacaggtctgctggcagtgatttttcttgcctttattctggtctgaaaaagtatctagctttcatttttgaaagttatttttattgcgtatgtgaatctggattaacatttttttcttttactattttaaagatattactccattgtcttttgacttacatagttttccacaagacacctgttttaatattatctcttgttctttatatgtaaagtgtatttttttctctggttgctttcaagattttatctttggttttcagcagtttgatatatctaagaattatcctgcttggagttcttgaatctgtggtttgatgttcattattgtcaagaaattctcactcattatctcttcagatatttttttctgcccctttctgtctttctctttctgggacttcagttactcatgttagatttcttcttaatattatattcaataactcttgcatattgtgttctttttattcattcttcttattttttctttttgtactagtaatttctaccaatttatcttcagtcattaattctttcttcagctgtgtctagtcaactgatgagcctgttgtattagtccattctcatactgctataaagatactacctgagactaggtagtttataaagaaaggaggtttaattaactcacagttccacatggctggggaggcctcaggaaacttgaaatcacagcagaagatgaggaggaaacaaggcacatcttacttagcaggcagccaagagagagtaccaagggggaagtgccagacagttactaagcaaccagatctcgtaagaactcattcactatcatgagaacagcaagagggaaactacccccatgatccaatcactttccaccaggtccctccctcgacttgtggggattacaattcagattacaattcgagatgagatttgggtgggaacacggccaaaccatatcatttgtagaaggaatttttcatctctaatattatgcctttttaatatagcatttgtatttcttacagattcatctctgctgaaattccttatcta

SEQ ID NO: 63031 - DNA, 1688 bp, Homo sapiens
cttctctgtgacctcactgtacctggtgtatagttacatcactgcactaagttttcctgccccaacccgctgccccttcctctttctctctcttctctccttttgattgtttttatttttagccatttcctcctactagtctcttaaaggaaaggatcctctcccattcatttttctgtcccttgtacctagcacagtatttggtacctaagaggagctcagtaacggtttgaggataaatgaataaaagccgttaaccggaaaggctgtcacgtagccatggaaaatgatcattgcaagttaccgttattaatagaaagctgcttttatatagatccttcaaaatagcagatattccaaatagtgtgtatgtttgtgcatgttgctttggacacacttatgtaatgttttaagacatttaatcgtttagcaaatatttatgctaggcaatagggatgaaatatgctcactatgttaaggatacaatgaaaagatgtggttgtcatcagtgaacttacagaggaagaatcagatcagcaaacaattaaaagttagtgtgtgcaaaaggaatcgctgcaaattgaaattgttcggctgggtgcggtgggtcacgcctgtaatcccagcactttggggggccgaggcaggcagatcacaaggtcagtagttcgagaccagaatgacaatatggtgaaaccccgtctctactaaaaatagaaaaagttagctgggcgtggtggcgcttgcctgtaatcccagctactcaggaggctgtggcaggagaatcgcttgaacccaggaggcggaaggttgcagtgagctgagattgtgccactgcactccagccaggacgacagagtgagactccgtttaaaaaaaaaaaaattgaaattgttccttatataagtaagaggaagacgcaacatcagtaagatttgagttgtcaaggagggcttcttggaagaggcaactaaacagtgacctgataagagtataggagttagggagagtggaaagttttccaggcaagaattggcactagtgatgtcagtagaagccagatcacactgtgccttgtgagtacttttagggatctgaatattctacaagcctttttagaaaggtttaagctgggaagtgacatgattagatttgtgtttttgaaagaacattggcagcactcagagtggaacaagactagagacagagataagagataccactgaggagcctattgctgttatccaggcaagagatgatagtagcctgaacagtgagattaccaataagattttacatgaggcataattataaacagcagagaagtaacagaagttgccagaatatgctgttctgggtgatggctgttttaggcatagatgattcagagctgcctgaatttcctcataagtagagttgtcactctccttcttaataggaaattggcactaggaccacactgacctgtgttttaattttaaggatgtattatctttattaccgatcttcaggtagtaatgacccttagcattttaaaagttattgtttctccctactcttttctttatttaattaaggaaactcctttttaaagtattaagactccttgtagactcctttcaattaatttgttcagcatattagttattacatatattgtacttgctatgtttatatgtttcttgaat

SEQ ID NO: 63032 - DNA, 1928 bp, Homo sapiens
atttactttatgttgcagactcctacaatcacaaggtgagtcgtgacagaattatataatatcttgctttttgtgtgtggcatttaaaatgctgaaagatctgtgagcctcctacaactgccactctaaaatatagaaaggagtaacagtctttgacaactataacccagcctgttctgctcttttcttggtcctttctttgccaagaggttatgatggtattctgaactagggaaagcacagaaccagttccaatggcaatagccaacagttgtgaattgcaacccatcaaagctgcttagtaacatattcagtatatcaagagaaggcaagtagcagggaaatttatatgtcatctaacaaatgaacgtttttgagctgttgcatagttacagtgcttgttagtaaataattttgttttcagcatttccatttttgtctattaaattgtcttaagttttattgcatttttactttttacaaaaatcagtggataataaatgttcatgcagtacttcatgatgtgagaccataaatttaatataattgagacataactgtcaatcattaagtttaacaaaggtagcaaattctcaggcaatgctagatgctcaggaagacaaagtcagttcagttgtgaaagtgtgtcccattgtgaagaaaaacaattcaataaaaaaaaattttttttaattccagaaataacttcatcaaagattgcttccagaagacaagatggagctaaggattttacatagtctttagttcttagaatagaatatctccccttagactgcaatttgaatgtttggcttttcaagaaaatatggaaataactattccttttgtgagacttattgagaatattaatggcaatcagaaattagcttgcttgataccatactcttccatacaacaaacatgagattgatcttcagttatataagtttttgttctttcttttttagattaaagttgtggatccaaaaacaaaaaactgtacaacattagcaggaactggagacacaaataatgttaccagttccagttttacagagtcaacttttaatgaaccaggaggcttgtgtattggagagaatggagaattattatatgtagcagacaccaataatcatcaaattaaagtgatggatttagaaactaaaatggtatctgtggtaagtaattttaaaatataagttaaagaatgtggttttaagaatgatactaagatcctcacagcactgacagaggcatttttggttagaccatctccaggagagtattaagtggatgcttctgttgtattctttgacaaagagaccagcaggactgctttaaggatatccttttattcttaaaataaaagttccatctgtgctgagagtttgagaaaaatactggaaattggagataatctaatgaaccttcaagaaaaaaaaaaggagaggactcagatctgtttttaagtgtacagacatactgacatacactacatacacctgctctgtgggttgggttatttagcttattgtttttgtttttttttttttttcagtgatctttagattaacatgtaacctttgtttgcctgtgatgaatccattaccaaataatctaacaaaagctttagaagccactttctcaagacatcgaaaataagattgtggaagaaacttaaatgagttatagtcagtttttaaagatatggacgtggtttcttatagaattttcaaggggaaatgtctattataaactaactcttgatgtatgacatttacctgaaaaaaatgcaacagtttttttctgaaaaactggtaatttgcacggtatatttttaaaagaaacatagattactattgcaacataaatgtcatttctcttcacgtagatctctgatataagatgaataacatcttcttatagtt

SEQ ID NO: 63033 - DNA, 1139 bp, Homo sapiens
gtaattacctcataaaccttttctctccacaagcaatcaaaaaaatgaaatgttctgtaataaaagggtgtataacatactctcttttatgagaataggccttagttattttattttatttttgagacgtagtctggctctgtagcccaggctgggagggcagtggcgcgatcttggctcactgcaacctctacctcctgggttcaagagattttcctgcctcagcctcccaagtagctgggattacaggcgtacaccaccatgcccagctaatttttttgtgtttttagtagagacagggtttcaccatgtcagtcaggctggtcccaaactcctggcctcaggtgatccgcctgcctctgtctcccaaagtgctgggattacaggtgtgagccaccttgccctactggccttagttaatttttaatctcatttgacttattatgtttctcatttctagatggacaggatgagaatattttggcccaatcattttctgtttaaggacttaaacaatttcacactctaaatgaagtatatacaattttaatttactaatttagaaatatctgagtttatttttcaatataatatacaaacacagtgtttgttatacatgttcatgtacagtgaaaatgcaaaggcattttttagactctattccccttcatttgtctagacagttttaggttagccttagcttatacttttcttgactttcaaaatacagttttattgaacattcttattcttacccactgccagtctgcattgttttttacattaaaagtattatttatagtagactaatatgattttgaataaaatcacacttaagcaatatagataggttcctagaatttatgacgaggataaacctctcacataagaggaagcactagaaagtttatttttaaaacttgttgatccatattctataaggactaatgcatattttttatcttttgcttttcttgttggataaattattatgtccagtgatagtttaaaaagaacaagattttagtgtaagtcacctcacttgaaatgccagtaatgtggtattacacacattttatataatacctggaatctttgccctaaattattctgctggtttgtcgctatttttttcctct

SEQ ID NO: 63034 - DNA, 1147 bp, Homo sapiens
gctaacaaaccctggcccctttacatatgagctctggaggttcgcctggctgcctcaggcttgcagaaggctgccccaatcacagagcctgggtaaggtggaacaggaggcagccccactcggcttttctgattgcatcccacctgtttctgagtgtgttggtttggtttaattcttttcaagggttggagttggaaagtgaaaaccctagacacttgctgtggaatgtttgcctggttgtattggtgtgtccctcttcttcactggcatgtcgctttcaagtgtaccaaaggacattttgttctgttgaaagccacaggaccaaaaggaaaatattgcaactatttgcaaacatacttccctacctgtacaagcagccatatactaaaaagcactaaacaagcacaaatgaacactaaatagccttataccaaaaagcattcttgtaactgtcagggcatggtatgaattccttcctctttaagcagcaacttaccacaggcttggtggctttaagtaatatagcattaagcaaatggtcagttattttttaatgttgaaaacttccaagtgtgaataatacggacatagtttactaccttttgcttttaatatacctggttatctatttccatttgaaataaaatgaaaggagacctcaaactgatgctgagaagtagacaaaatcagctctcagacttaactctccccaattaaaatagtttttttttcccttcccatttttttgtttttaagagatagggtcttgctgtgttgcccaggctagagtgcagcagtgacatgatcatagctcactgcagcctggaactcctgggctcaggatccttctgcttcggcctcctgagtagctaagaccacaggtgtgtgccaccacacctggctaatttttttaaaattttttgtagagatggggacttgctatgttgcccagactggtctcgaactcctggcctcaagccaccaacctctcaaattgctagaattacaagcatgagccaccacacctggcctgttattccttctttatctaatgtgtgctaagcttgtgaaaaatatatgttgaggtaaatagggcaaaacattagttgataaattatgctaattaatgggaaaaatagacatgttc

SEQ ID NO: 63035 - DNA, 4592 bp, Homo sapiens
ctgaaagctttgatgaaatttgtttttgtatggtgcaatatgacagcctgtcattgaatctaaacaacttaatttgcttgtattcataagaagtgttgaacattacaagggcttttataaaaaaccctttgttcatatttcttccctttaaaatatgtaatgtcaaaaatgactcaccttttaaaaattatgcatgaaaacaggtggtaaacattcagtaatacgctatttctccaacatcaagacaactaaaacaaatgataaaaatgtttatttttacactccagcatatcgggtgagttttagggatgtgtatgaatatttaaatcttttaatttcagttttaatgaaagctgaacttaataggaaagctagctcttggtaactagcaatgatcaggcattgtttgcctctgtcaggttttcttatctgttttaggtacattttttcagattctgattgtttgagttaatggttgaatttttaaagtttttagttacttaaaatatgattttaaattacatattaatttagaaaattcctgtgtttacttatattttaaattgtgaaatggatccaatcattagaacagagagaatagttctttgaaactgaaatactttagttttactgaccttgtgtaaagataatatgaagaaccagcttccaaaagaaaccagcatatggcactataaactatttcatttgagcaccattctttaccatggatatattaattatgtattatagtggagtgatcatacagttcccccaaatgtgatgtttcagtgtatttatttaaaacataaagtagaccaggtgcagtagctcacgcctgtaatcccagcactttgggaagccaaggcaggaggattacctgaggccaggagtttaagaccagccttggcaacatagcgagacccccatctctacaaagaaattttaaaagattatccaggcatggtggtgcatgcctatggttccagctactcgggaggctgaagcggtagaatcacttgagcacaggaggtcaaggctgcaggtgagccatgatcgtgtcactgcactccagcctaggcaacagagcaagaccctgtctcttaaaacaaaaaacctcacacatacctaaaataagtatatatctgtaaccaaaggaacttaattttagagccaaatttttctatcttgttggattttttacagtgtttaagatagacacttaagtgttgccgtagtatcaatatttctgtcattgaattttttctcaccccttattatttctcacttacaatttctgagcatgatttttcataattcattatcttcagatcattactataataagataccgtggctcttatgcagatattgcagcaagccttgtttggtttggatttttgcatccctttttctcccattaagggaattaagttttgggatgatggattaaaagcctgtaaagaattgtttgggctctaaaagttgggctcatggtggcaatatccttttaatgtgttttaacattttttaatcaacatcgtttaaaaataatttactaaggattagattatttaatgaatgtctttttttctatatattgaattagatgttatcccaaaaaaaatatcttttcacttcaaaatgaaaatatatgttcaaagatgttttatttttagaatagttataaaaagtattagtcttaacataatgtgtcttgttctttttaccaataataatttatcaaaataagagggaaagtgcaatcaaatctgaattattttactatttgtttctagacacactacttaacactcctaaagactactttgagtaggcaacataactaaatttttctagtttcttatgatacaggttcataaactacaatatttggatttttttccccaaggcacaaaatgtataatggagaccaaatagtgatctgatccatagtatcctatgcctatacactttaaaatgtatatacattttagacaaaaatgcacactccagtattaatatttgtgctaccatctacttggagaagtttaatgagaaaattttagaagaaaagtattacaaacaatattttgactctattacctgttttgccttatacattttagaaactggaaattttttaaagaaaatgctttagttttcttctgttcttcactgtctacagtgtgcttttgtatatggatcaggactgagcaaagtaattacatgtatcagagatacttatctctatactaattcacagacagctcctgatgtaaggatttagagggccttctgccctctgaatatatggtgaggagaatggggtatctggaaaaggaaaatgatctggataaatctgagacctggggggaagtttgttttatatgttcattattggttgttacatatcaaggctgttttggttatgtatcaatattgtggtttatttgagctggaagtgattttttctgtgtatgtatatgtatacacttcaataggttttaattttgaagtgaatatttgccatgactccattttccccataccacttcagactttagcctgtttagttttaaggactgaaaatggtaggtttgggcagaagaatgaatttgaactttgatggggtttttttgtttttactttctatcttcataaccatttaaagcgatttagcttgaaattaaattttatcaggctaccaacatgttatttatttatttaataaacacatttattgaaaacctatactattgtattggcaccatacagggtattgtatttatactagtgagcagaccagggcatttccatcctcatggagttcatggtctaatgaaaatagctggggccgggtgtggtggctcacccctgtaatcccagcactttgggaggctgaggtgggaggattgtttgagcccaggagtttgagaccagccagggcaacatggcaaaaccccatgtgtacaaaagattaaaaaattagccagatgcagtggcacatggctggggtcccagctacccaggaggctgagttgggaggatcatctgagcctgggaggttgaagcttgcagtgagctatgattgccactgtactctatactccagcctgggtgacagagtgaaaccctgtctcaaaaaaaaaagaggaaagaaaatagctaggagacaatcagagcagatcttgggcttctgtggctcatctcagccctttataactggcctgagaagagggtttatctacttgtgcaagtggcccagaaatctcactcgtacatgaggctttggaacatccttgcaaaggtacgctgaaagcaaattgctgttttcctggtggttctgcacgtttcctaacttttatcatagtttgattttcattatttaagaaaaaataaaaaatccaaagaccataagatggcattagattttttaccattaaattattaatgcctatttggtgctcataaagattaatcatgtcacgcatgtttccaatctttcttttgcagtatattattttctaaaaattgttacatgcaaatttaaaccaagatttatcagtaaaagaaaaaaatagaatccttaataatgtaaatgttgttatatatgctaccctggtgaaaatatttttataaatcatgttgtcatttatgctttatgtagcctatttttcaataacctttttttaaaagcaattttttttgacaccaagattgttgatttttaattaacaccagttggtggcactagaaacctgaaatttttcaaagatgaacaaagaaaaattgaaaaggtaatctaaacatggagaatttttaggaaaataaatgaaaaatataattgtatattagagatgtatttttcttctggaatggaattctttttctaaaatgcaaatcgctatccattttgactgcaatgatgaaacttgtttatcttccagaggacatatatatatgtgtgtgtgtgtgtattgtacagatacctttaatttgattacactgtttcttgtaaatatgtttctgtataaaatgaaacttttcaagaggattctatgtatatattgtacttattaaataggtaatgcctatttaccaacttgtagtttgatggcatctttatttgtttatatgcaccatttgctaaacagactgattcttcagactgttggcaagactgattcaaatagcttcaatttcctttttttaactagactgggaatttttgctttctatagttgtctttattctatcaatatgattggaagtcagtgaacaatagtaagcagattaagttgaatgctgggttgtattttaaatttttgtttaaattattgacagcaaaacttagcctgtgtattaattggttttcacactgctgtaaagaactgccccagactgggtaattataaaggaaagaggtttaattgattcacagttctgcgttgctggggaggcctcaggaaacttacaatcatggtggaagaggaaacaggcatatcttacatggtggcaggtgagagagagaagagggaggaagaacttgcagacacttataaaaccatcagatcttgtgagaacttactacc

SEQ ID NO: 63036 - DNA, 1051 bp, Homo sapiens
cttttgcagattccattttttttaattctacaagtacacaactgatactatcattttgttttgcagaataattcaaagttatattttacgagaagaatcaggcacactttcttcagaggcatctgattttaacaaagttcatttaagtagacggggtggcatcatggcatctttatatacatcccatccagctgacaatggattaacattggagctctctttggaaatcaaccgaaaattacaggctgttttggaggatacgttactaaaaaatattactttgaaggtatttgtgtttctcattcacacaccaaccagtaaacatggcaaaatgatgcctgtttcacagtctgatctagcaatcagctgggctgtttctgtaatgcaaggcagtcattttacccaaagatgaagtttcgtgattttctctttttaaaaagtatagttttttatattaggaaagatgaaaaatagcaaaaattaattttgtatttgacagacactaagatgtcattaaatttgcattggatgggctttgacatataattagttttgattgctaaaataattttttaagattatgacatttctgatttatttttcagctttattttattttttgcagttaatattttatttttgctgtgggtgggccttgaaaattagtagttagtttaaaaataattttaaaatcagtaatagtaagtaatcattttatgcattaaaaattgctgtagcttcagtagaaagtttgagtgttactttgaaatggacaggagtactttactgaaaacagctgtgtgtcactagtttatctgacatagcatttaggactaaccactctttcatttccaaaatttaggcaaaaaatagttcaaactgaattgttttatttattatacttttgtttttctcttccctttcccctcaccccaattattaaaggaaaatctacaaacacttggaacagaaatagaacgtcttattaaacaccagcatgaactagaacagaggacaaagaaaacctaaaacaagcctcttgctcagtaaa

SEQ ID NO: 63037 - DNA, 2169 bp, Homo sapiens
gagaacttttccaacaaataaaaaccctagaaaatgtcagaagaatgaagagtgcaaggaaatgtataactttaggttaataacctaataacttaggttaataattttaggtatactatgtatttcacaattaataaacttaattgcaatgctttcttttcaaagtataaaactttaacccatttcctatttagaaaaaaagtgcagcttgctgccagcgctcatttaattttacataaacacactcgaggatgaaacaaatctgactgattttcagtggaagataaaataaaaaaactgttcttggagttatttctaaacagaacttgtctcttatcctaacgtaacagaaatgtatatgatgctacattaggattagagacgagtattctcagggcaaacgggaaatgggttaaaaattgtcacactttttttgttttctttccactaggagtcagaagaaattaaatcaaatgagcttgatgcaaagcttagagtcacaaaaggagaacttgaaaaacaaatgcaagaaaaatctgaccagctagaggtgagtagttttgctctttatatatcctaagttgcataataaatacagaaagagaaatagtgagaacttattgctatctacttttaaggccttttggaaggaacaggcaataaatcttagatatagtttagcacattatgatttgttgtttcttttaaacttttttaaagatgcatcatgccaaaataaaggaactagaagatctgaagagaacatttaaggagggtatggatgagttaagaacactgagaacaaaggtaattcagtctttagtcatgaatccagaggaagggtaaatatcttaaattttgaattcattctgatttttaaagtggtggggaaaggacattaatatagaaatgttccataataaaggaactcagtagagtagaggagcaatttcctagcaacttcttttgttgaaaggaaaatgtcttccatgttagtccctttgaagtgtttgccaaacattactatttcacagcacatttgctgtgtctatagcttatccttgggcttctcatctaaaggcagtctcatcaacgaatcaattggaaagatagttggaccttagaactgtgtcagaaaataacaggaaggctatatttttcctggatatatttaatagatggatagttttaatggccaataatctgttaagtcctcttcgtgtttatagtctttattgtaagattagtatgtcttctaatatgaatatgaatgtgtatcattcatttatttagaagtagtcctttaaccaccctgaatttgaggtcacttaataattttaaattgtttttcatacaccttcttatttgttcttcttgccagttttttgaggtagaggagatatattctttttcaggtgaggagatggtgattcagtaaaaagtgaaatgacatgctaaaactcccatgactgaatcataagaaatctgagactaaaagctaggattgtaaacttcgcattatattttcttcacgttaatggtgctttagaatttttagattattcatatgtaaccactatacaaaatagtttataaagaacaagaatacatggtttgtaacttggttgtgatcatttgataggtgaaatgtctagaagatgaacgattaagaacagaagatgaattatcaaaatataaggaaattattaatcgccaaaaagctgaaattcagaatttattggacaaggtgaaaactgcagatcagctacaggagcagcttcaaaggtacaaaatgagcaacttctgtttgtattaataagcaagcttttaaattttatttcaagattttctaaatgcagttattgcattaaacaaaaaattttacaattttactagctgaaatttttaaatattttctctttatctgaacttctttggattatcttttgagttctgtcatggcttctaaaaatcaaagtttatattccttaaacattggtagtggcaatttataagacagaataggttgagtctcttatccattccttagctttcaaattctgttacttatgcacagtgtttactttttcttctaaaaggtaaatcttgctctagatcttcgcacgtgtgtagcttaagatccggagctgacattattccttggctcct

SEQ ID NO: 63038 - DNA, 1286 bp, Homo sapiens
agtctcgctctttcagattagaatgagttttaagagcaaatgcaataacagttaatgaggcatgaagcttagtttagtgacctgcaagttagtttggacctgaatatttggtgattatgaaaaagaaatgtcctcacattatttacatattaaatggggtgggatgttaaattttactattcatagtttgcaacacccaaatttgccctgttctttaagcattttttgatatgcaaaatttaaataacactgagaaattggacgggggagaatgtgtaagtttccaaatttgaatgtaaactctagaaattttaaaaaatcaatgatgctaagattttatactcaaaaaatatacattcttatttaaatataatataaagattttaagaataagttgccttaacttttttataaatatgactccattggtattgtgcctagtgaatataattttattaaaaagctaatataagtaattataaaggctgatacctgatgccgtaattttaagcactaactgagctgatattagaggtaataaaaatctgaagatgatagaatgtgaagtaaaagaacaactctgaattgtgacttaagaagtgtaagtttatgaaaatatcagtttccaggttttcacaaacagtcttaatgatattggttaaaatcataatcgtggattaccgcattaaatagttctaaatcagtagaactgctaataacccttggttatattgtattctctgatatagcattatcagagaaaactgtaggaggaatagtctctgttgacagtggtcaaaggtagattagagaatagtgggtttccctcaagtctgaagctgacctactaatcagcacatgtgtgagggaactgccaaggcagagaaagaattttcagaaaggaggaggatgacagtctctggagctcaacacggctaagccatctaaattttctctttactttgagttacagaatgaggaattgaaattccaaattcataaaaacagtaatgattctcaactacctgagttgcttcaagatcagaacatcatacttggtcatgtctgatatctgtggtactttcctcatcttcatccagagtgctaagagacaggctcctgaaacctgttagaatactagcacttaggaacaaaagaactgttacagatctgtgtaagagatcttaatggcagctttgagctcagatgaaaccaggtagtctgtaaataggttagagaggtgatttaaggctgacttctgtaaggttacatggtgcagattgcta

SEQ ID NO: 63039 - DNA, 2046 bp, Homo sapiens
ttatggggatgattggagaatgccagactacaactgaaattaattaatgaagttgtttgactgaaatgaaggaggaaagacagactttgcagtggccctactgcttgtagctagccagcttgggttagctgtcctagtcctttttcttttttctcaaggacaggcttttaaaggaattgttagtgataaaatttgtggtgttagttattccacatcacagagtgtgtgcaagtttgtatggggttttggtttaaagtggtttttaattttgatgtttcaatttcttagatgtaaaacgaagatcaggagcagatttgaagaattacaaagtgaattggtgccagtcagcatgtcagagacagaccacatagcctctacttcctctgataaaaatgttgggaaaacacctgaattaaaggaagactcatgcaacttgttttctggcaatgaaagcagcaaattagaaaatgagtccaaactattgtcattaaacactgataaaactttatgtcaacctaatgagcataataatcgaattgaagcccaggaaaattatattccagatcatggtggaggtgaggattcttgtgccaaaacagacacaggctcagaaaattctgaacaaatagctaattttcctagtggaaattttgctaaacatatttcaaaaacaaatgaaacagaacagaaagtaacacaaatattggtggaattaaggtcatctacatttccagaatcagctaatgaaaagacttattcagaaagcccctatgatacagactgcaccaagaaatttatttcaaaaataaagagcgtttcagcatcagaggatttgttggaagaaatagaatctgagctcttatctacggagtttgcagaacatcgagtaccaaatggaatgaataagggagaacatgcattagttctgtttgaaaagtgtgtgcaagataaatatttgcagcaggaacatatcataaaaaagtaagttttttatacctttaggttattttttttccctcacaggcacagggattcgagataaaattctttaaaggaaaataccattttgttcatttttacttgcacattagaatcatgcacatagtagttgaacaataaatgtatagttgctgaatgtgtgagcaaatgtcgagtttttcagatatctgagttcaatatgttaaatagtgtaaatgtattaacgtgctagaaatttttatagacaactcaaaatttttcacttttgaaagaatgtagaagtatattgtcaaaactaagagaaactcaaaaggaaataacaagtcataaaattccacaactttttcttaaaatctgcattctaaattcattggtttaaaacattaaaatttagagaacagaataattgattatcgttcagtaaataataatacagttttggatatgtgaagttctgttttcatgatagtttaaaatttaccatcttaaccatttttatgtgtacgtttcagtagtgttattatatattcacactgttggacaaccaatctgcagaactttttcactttgcaaatctgaaacactgtattcgttaaacaacactatttccacttgccctcagtccctggcaaccaccattctactttctgttgctgagtttgactactcatgatacctcatgtaggtgaaatcatatacttttcatttcatgactggcttatttcatttagcctaatgtcctcatttatccatgttgtaacatgtcagaatttcatttctttttaaggctcaataatattgcattgtatgtatataccacattttgtttattcatccattaatggacatctgggttccttctgctttttggctgttgttaataatgctactgtgaacttgggtttgcaagtatctcttcaagactccaaggcccttcttgatattacccccaaacaaatgcctgctgttgctattcatatccttactgtaatactatattatgtgaataaactgtatgcttttgtacttgaaccatcagtgctgctgctattcttgcattttataggg

SEQ ID NO: 63040 - DNA, 1022 bp, Homo sapiens
gccacaatttcaaattctcttttattgctttatgtccctgactcatgcaggccaaagggtgaggaggagtaatagccaacaagagcgtcctgcagaaagaaacaggctgcgtgggtccggaggagcttgaaaggaagaacccgaccaaagggcaggagacccggctctccaggtcgcggaggcgtgggtgcccagccaggcggagtgcggggcggggcctctcgggccgcaaggtggggcctcctgggccgggaggtgggaggtgagctccgccagcccagcccactgcagacaggttacccaggacctcaaggtgtgctgcgtcaccccgcccgcgctgcgctgattggttcctccagggagcccccgccccctcagctgtaaccgggccggcttcagtgtcgccgccatctttgttgatgtgtcagctccgcaggggtttggggaaacggccgctgagtgaggcgtcggctgtgtttctcaccgcggtcttttcctcccactcttggctggttggaccccgctatggaaaagttggcccctgagccagagctccagcagccttgttagggcgtggcctgaggcttggataagtggggtaagtgtctgaggggtactcggggcacaccggtgagtcgcggtggcggtgcggtggggctgccagccttccgctccttcctgcacgttccgtggcgggggcgagggcgagtgcgaggtggaggtcgaggtcgagcgggctccccgcctggctcctttgagggcgcggaggaaggggagggctggggaacgggtttcaagccctttcctctccctgccttcctccttcggttccgggaccttggaggtggcaaagaggggtcagcgggggtcgtgggggctgtgcctcgagagcgtctgaattcgagcccattgcctgggctgcgtgtgaactgcagccaagccctacctgctcgagaatctttcctagactcaatcgcctatttcgtttttcgtctcaagttgactgtatgtgggtgttttat

SEQ ID NO: 63041 - DNA, 1050 bp, Homo sapiens
ggctcccgctagcacgcccagctaattttttgtatttttagtagagacagggtttcaccatgttggccaggctggtctcaaactcctgacctgagagtgattcgcccgcctcagcctcccaaagtgctgggattacaggcgtgagccactacgccctgccaagttagggctttttagctcacattttcttagtttgtttttcttccttcttgggtattccaccagtaattaatagggctgcaaaattctgttccagtaggacagtgtttctgatgactgtttactcctgtaaaagcttgtgtgtgtggtttatttagattaacaagagaaccaagaaattttgctttcagcattttacttcctcattgcctaatcacctgtgtttgtattatctttttgatcctttactttgctcctgtactgattgctttaggagtagatataattcattgtctcttactcattcatccagaggtgattgctagagtaacagtgccgtggttggacacatcctatcacataagcacactggaatcatccttaaatctaccttcttacctcccatcctttgccctaattggttgccaagtctttattgattcttcttcccaagtatcccttgtatatgtcttttttctttctttccctactaccattttcttagctcaggaatcctcatcattcatggacaattgaaacaattttccaatgtcatagtttatctccctatctgcattcttagagtacttgcctatgtgatatgcctaagaacacacatcttggtgggacagctctgatgaaaagctttcagttctttgtcatttagagaaggaaaccaaacagaggtctagtggtagtcatggttgaaaccgtaggttctggtgcaatagagtgaggaagaatgaggaagatgaagctggggcctgcaacatggagtgaggagctataatgggaaaggtgggaacagaatgggaaaaaccttgccagagcaacagagggtacatgcttccaggagggggagtcatcagtaatatcagatgctatgaaggt

SEQ ID NO: 63042 - DNA, 1043 bp, Homo sapiens
ggttctgttactctctgccgaagagaggcccggtggcctcatggaaggggagacgcagtaatccttcagtaaattcatcacttggttagtggagtctggttgactcatgcttgccaggtgttttaaaactagtcttgctattgaatgcttcatgtattgattgagaccttgtgattcacatgatcaggatatgttctctgtactaatgagctaactctactggagagacaaggcatgtaaactaatgattacagcgtaagacataattactatagtaagctattaatattacattttaggagttgaaggcttctgataagcaaaattagtaaacattgttctataagcttgatatctattaaagaaaaatctataaatgaccatctctaagttgaggaagaaaggtttttatttacatctacagtggaaaaatcatttgagattgagtctctccctttttcagaggatgatcagtggtaccgtgcctctgttttggcttacgcttctgaagaatctgtactggtcggatatgtagattatggaaactttgaaatccttagtttgatgagactttgtcccataatcccaaagttgttggaattgccaatgcaagctataaagtgtgtactagcaggtatgaaatttttatagcctccatattctttaaaaattctacagatgaagaaacatgaaaagatacacgaaatagggaaaagctgcttctcaaaacaacatcatgatcagatgcttaaaagttactataaatgtcatttatcccaaagaaatcagagatttctttccatgtcaattagttggcttcattcaaacgtaccataatttagaaagaatatcctatctcagagggcattacatttgcagcatatccaagatcttttcctcaggctgtgttgcaagatatagttatatcccaaaatacttccttaggctacattcccacaggtggaacaggtcagtaagtctccttcttttcatgtttgtgatacatattgtacattttcttccagaaagggttgacctagttt

SEQ ID NO: 63043 - DNA, 1035 bp, Homo sapiens
cgggccagcagggcttggtcatcttatggcttccaccttgaggtccaaggtcaccatttctcagccagcaggaagggggagaggggaagtggaaggtaagcagcttccagctgcatgagtttgaaattgatcacgtccgtcagatagaacttagacacgtggccaccctagctgccaggaagtctgggaaatgtggtctggcaggcactcatcttcctgctaatattctaggaaagtgctgttctgtggctaaaaggaagacatagagggtgtattctgcagtgaacagagcaccctggctgaccttggtcctacccaacctggcagtccctgggtcccgtcgaggggctctgactggcacatccactgctgaagcccctctgcttgctcctgcagggtgccggacacaagccctggacctcgtcttcatgttggacacctctgcctcagtagggcccgagaattttgctcagatgcagagctttgtgagaagctgtgccctccagtttgaggtgaaccctgacgtgacacaggtcggcctggtggtgtatggcagccaggtgcagactgccttcgggctggacaccaaacccacccgggctgcgatgctgcgggccattagccaggccccctacctaggtggggtgggctcagccggcaccgccctgctgcacatctatgacaaagtgatgaccgtccagaggggtgcccggcctggtgtccccaaagctgtggtggtgctcacaggcgggagaggcgcagaggatgcagccgttcctgcccagaagctgaggaacaatggcatctctgtcttggtcgtgggcgtggggcctgtcctaagtgagggtctgcggaggcttgcaggtccccgggattccctgatccacgtggcagcttacgccgacctgcggtaccaccaggacgtgctcattgagtggctgtgtggaggtgagtgggggaatccacaccctcagggctgcccccatggcaggccctcagcctgagccttcacatacatcatgacgaggatggcag

SEQ ID NO: 63044 - DNA, 1050 bp, Homo sapiens
agaatatccacaagcttcctaagggtctaaagatcccacattcacactgacttgggcagtgacagagcccagagcaaacagggccaggccagcccaaatccagtgacctcctcttcaccttcttaaaagagacaggagaatcacttgaacccgggaggtggaggttgtggtgagccaagatcgcgccattgtactccagcctgggcaacaagagcaagattctgcctcaaaaaaaaaaaaaaaaaagtctgccatgtgtatggcacgtctgagcaatggactctccatgagtctgtaggagagctgggtcttactaacctagccaagtggtatgcagcaccaaccatgagctaccggggcaaagggagacatgactctagtagccttgcacctctactgggcttacttagggtaggggtcttcgggtctaacccatgcctggccggcctggtgggtatggtgttctccattgtagaagccaagcagccagtcaacctctgcaaacccagcccgtgcatgaatgagggcagctgcgtcctgcagaatgggagctaccgctgcaagtgtcgggatggctgggagggcccccactgcgagaaccgtgagtggagctcttgctctgtatgtgtgagccagggatggtattgcgagtcctgccaagtcccacaaactcagctgaaggcaggttctaaaacattcgttcagtggaagaaattattcagtcgtttacccacgaaacatttagtgagtacctcctgcatcccaggcattgttctcagtgcaggaacatagcagtaaacaaatgaataaaacctctgccctcatggagcttccattctaatgggaagacagacaataagcaaataatacaacatgtggtgtggtagacggtgctaagcaccccggagaaagtcatgacaactaggagggaggccacagttaggagcacagtagatccagggtacagggatgtagacggaggcagggatgggtaaatgcggtggtgggagctgctggaagctctttttggggtgctatttgctcagtaaa

SEQ ID NO: 63045 - DNA, 1096 bp, Homo sapiens
gctctcctcctataaccacagcccaaagctgtcacacctgcctctgccccagactgtaccccagtcaactctgcaaccacactcaagaacaggcctctctcggtcgtggtcacaggcaaaggcactgtactccagaaagccaaggtaagcagtcactcccagcctcccttggggccagcagaaatgtcactaaggtaggggcccatcttctgacccaggtggtgctttgtggcttttggcaccagctctgagcaagggctcggcactcaccaaggagtggccatggctttgccatgccttcagctcagtctctggcactgaccaaccagaaaggtgtctgcacttggttcgagcatccttccctgtgagcttggggatgcttcagttcttgccctccacacagctatgggtagattccaggaggccagctgcagctcagggacagattatgactgagttttcaaaccaaaaagtcagtcagtgactccacaggacttctaccattaaaactaaagaaacagactcacataggtggtttgaattgcccaaagttgcccacccaactactggcaaaattctcagcaagttgtgaatgaggaatccatgctatgatgcggtttctccctgatggctagtcaaaaaagtatcattaatcatttactcatttactcatttgtacactaaagaacatgcctagggctgcctttgcttttggcaaattctgctccttattcctatcctccttacctgctggagatatttggaggtcccacaacaatggctaaccaataaatccatgcaagcatctgaacctccactcccttgttgctgtgagagacatcacttataggcactcgctgttgtgccacagtctcaaaatctctgaataggcactctaagcagtgatgaacacacagggtttgaaacatttatcacctctgtgcctaaaatagtttttctcacattttttctatgtatatcaaggttgctacagtggataactaactatctttttggtggggggtgggtgctggtatttgaatggtaccctaggaatgggagaagaaaggagcaagttagaaaacaagcttcatct

SEQ ID NO: 63046 - DNA, 1044 bp, Homo sapiens
tgggcctctttaacagatccatgttaccagcactggcctctgtggtgggctaaatattgggcccctaatgatatccatgacctaacccctcaaatctgtgaatatgctacttgacgtggcaaagggacttcacagatgtgatttaatgaggagattatcctggtttgtgcaggtgagcacagtgtaatcacagtggctcttataagcggggaggtaggagggtaagagtcagggagataagatgctaccatgttggctttggggatggaggaagggaccatgagccgaggaacacaggtggcttctggaatctggaaaaggtgaagaagtagattctttcctagagcctccaggagccctgtggccccctctcagattctgatctccagaactgtagattaacgagttcgtgttgctttatgtcactaagtttggtaatttgttaccacagcaataagaaactgagacatcctctcacagctctgactgcatcacagcgtagctgtctgtgtcgccatttagctgcaagctccaaggacaggctttgtgtggagctcacatttccagggcccagcacaatatccaataaatatttgttgactaaatgagtaaatgaaagcaaagcaaatctatccacttactttgtacatgaaagaatcccatggctgaattataagaaaaataaattagtggcctggattaagagtaaagagaagtccactaaaaatccaggtatctggcaggtcctatctagccaaaatactggaacagatgggattttaaaaagcatctcctctacttatctagcttacataatacactcacaacactgagaacccaaacaattcttcccccaaatggcctccatgaaaccaactcctagggtttactgcatgaatgagctgttctgaaacctggaccccagcaacttgcccaccatccagaacccttggcacctcctgctttcctcgtgatcactctgctccagaccagcatgagctccccgtctgcatgggcagcctttcatttgtgtcactctagagg

SEQ ID NO: 63047 - DNA, 1023 bp, Homo sapiens
aggacatgaaggatgcctgtacttactgggggtaggggtaggaaaattgcctgagatccctgcattgtggtcccgtgtccttcccaccaggtaaagccaaggaaggaaaggagctttttgatccctgacctacccagagtcttccaagtgcttccttccatgaggcatgaatgcttcatcccccactgttcagactgtctgaggtctgtgtttagctgtaggaaataaatactgttcgaaagttgcagggtgtggcttcgtgcagattgggttcatatcaggcttggacattgcaaccatgagcaattacttactctttctgaacctcagtttcttaatctgaaaagggttgatagctttttccttggggatttgtagggttggagtgaaattttgcccttagagagcttggcagtaggttcagcacatggtcagagccccgtagtgctagccagtggtggtgaaacaaggcattgggctgtatgtgccatgggtctgccatgtttatttctgatgcctacagcctttgcttttagtaatgctgccattaggttctatgtggggcaggggaagctgaatcatgaaggagagctgtttcctctttctgaccccatcagtgtggaaaacgtactagtcttttatcacctgagcttcagtttcccccatctgtaataatcaccactttcctcacaatgcagaatgctgggaagatcaatgaaaaactatgcataaaagtgttttgaaaactggaaatcactgaacagatgtgtaagatgactctccaccattgcatcaggaattgcaattccaggctgagggaagcctgcagtgctaccatagctattgctaatttgctcctgactaatgatcagttctagagtatttatggccagaaggcagactcccctggccatggagacccagggttgggtggaattgtgtttgggattggctgacgagatgaacaattagatacaggatcacttggacagggaagtgaaggctcagtaagggattcagtca

SEQ ID NO: 63048 - DNA, 2234 bp, Homo sapiens
ttccctgcatcttctcaacgttccaaggacctgggatggagttgtctccaatgtaataaatcacctctctgtgtcccatcaccagtcagtgttattattataatccccattaatactctgccagctcttttatctgatgggaagggctcctcacctggcccaaccaggtaagggatactgatgtcacaagcattaaagatgggctcctctcccgtcctcctgccttgttcttcagaatgactctgtataaactatagagcaacgctcaaggccatttgtgtggccatcaggactgacagcagctcttttttttttttcttcttcccagcgccacttagcccctgaagtgtttcgggaaatctttggaatgtccatacaggagtttgacaggttacctctttggagacgcaacgacatgaagaaaaaagcaaaactcttctaagtcccactcgtgaatggcaattagagaaaggactgacagtggcggtgccccataggatgtcatattgaggcccaaacttgattggagaatttgcaaactaccgtcgctcagcaacaccaaaaagagaaagtctggttaaaacaccatgagtcaaatgtcgggccagccaacagtaacacttgccaagaagcatggcgtagaaatttctatgttccgaaacacagagtagtgtccacatgtgagcttttcacattaccttatgtatacaacaggagctgcgttgttttcttctttttcttttcctttatctgttgtccaacaacagtgctgactgtccggataagagctggcaagtgcccttaggatgccgcatgggaaaaatcggttatcataatttcaaagtataaatatatttattaagtagcgctgcggctaagaaggaagagtgaggggtctgtccatggggtggcagtgatttcacacccgcctttcttgaatggcttcgtgttactcagccgtgccctggcaggaatggaactccatcagggaacagggcagctctgtttgaatggggtgaaaaacagcaaaattaattcttagcaagctccttgttctctactgttcaccgggacctggctggcaaatgacttagctattagtatatttaaaaactgttcaaaagcaaaagagaaggaacaggaatgaaaggaaaccttcccttaactctttctgcttcccatagcaggtctggttcctgctccccgcctaggacaggagctgtctggagctccacctttgcaaagaaaggaaaaacacaaattgcccccagattggcccagtggcatgccattaggtgattttgcataggggccatatcattcatggccaaaaaaaaccaaaaagcaaaaaacaaaaacaagtcccatgtcctactgactctagttcttccagtcgttatcctctgctgtctctctggcatcctatgaatcagatcaagcccatgctgttgttggtttttaaggtttctttcaataataggctaaggaaagacatgtttttctcttttaaatctctgcaactccaaagtagactccttcgaacgtatttaatttggccttttcagctttcttcttgcccagctctgtcgaattcatgggtgtgtgtgcacatgttggtttcactcacccagagtaattttgtgagcatgcatgtgctttttaatttctgcttgaatgtttgtcctgctgtgttgcagcttctaaagacattgtcaccgagtgtgtgtgactcaaagatcaagagtgaggctaaactgcgaccccaacatcacttccttcatggaaaggtgttggcgctgatgtagctcatggaaggatcagactgggaaccacagaggaaggatgaggtgggatgtggaggtcagagcatctcacgagagtccctcaggctctgcaacactagattcgaatatgagcctagggtttccccaacacgtgcgtgcatatgaaaccacatcatgattcccgacgtgagttagatgagggagagtttgtgtaactccacacccaggagggtaagccactttattatcatgctttggggctgtgcttaagaatttaagctctgttttaaagccgaagaagaaaacatttgaatttaccttcatatgccactaagaacaaaagctctgaagttcttcctgctggcaccaaatattaggattacaagctgtctctctgacaccagtggtaaaaaagcaagtagaatagtttctgagtctgtgttgcagcct

SEQ ID NO: 63049 - DNA, 2537 bp, Homo sapiens
aagaacatggtttatagggcgaatatgttgggaatttcaatataatatagtctgtgaatggttccttgcttttccatggtctttcccttatgatattttcttttcctttccttttcagattaccaggtatggaacactttgtctttcttgaattggccacaccgatagaacagccatgttccaacccagactgctggctccaaggcaacagtttctgttgagaagatgcttgttgtggttgatctctctagtcattactctatagccgtgaagagcagacatgcctggtgcctgggtcaagctgtccctgcaggccttggggacactgcatgaaccaggccaggtgtagggggtctctcttgctttggccttggagagtcctctctggggtggaagtggaccagcatcaagggtctgctcatatacagtttttcttcttttaattataatctctcagtactttaggccacccttttcctgcgcgttctcaaatgaaaagacactgatgtcttagccaataggagagagcagtttgccctcatgacattcctttctcactagaacctcaatcttgttaaaaaaagaaagaaagaaatgtgatggagaataagaaaagaagaaaaatgcatagaaaatcatgattaaagataagaaactaacaataatagacttgggcatcttttaaatgtactatatgctttcattcatggagcctaattcaggaatttgtccataaccatcaagccaagatctctccccaacttgattgcaaaagagctgtattcctgttcctatacagcaaggatctcattttgaaaaatacatggtcatttagatgacacaaataaaatagtggttaggattggagacccaacagggaattgggagcccaagagtactcccttcagtttcctagactatttcatgcctcacctggaactggcatttctgttgcagacactcccagatggccacatgcctgcaatgagaatggaccgaggagtgtctatgcccaacatgttggaaccaaaggcaagtgcagctgttctttttcctctcatatgggaatggcgtaaccctaaacagatttgatgttctatcttttcatcattctcaaagtgttgtaggctggtgtgttcaggtgagccatgtcatgaatatgcaccttgccattctgctgttttgcccacatcaggtcagcaggttaaacccttactgggcatgatgctgtgtgtttacagtgaggtgccagtccctctctgcctatgaccaaggtattcccttggcctctgccatgtgcattacagagcatatccggtgctgagtggagtggctgcagactcaccatgtaggtgaggcaaccctgtttcaccattgaaagccctgcatttcaagaacctcagtcctgggtacactggggtgactggccaccctagctccagagcaccctgtaccttcagagttgtccaagggctcatgctccctggtgaccataaccagggcttatttcaatatggcagttgccagagcactgcttctgggcctgcctggccccatagattcatgagctagtcatgggacaagattgttaaccccagcacaaatgcaccctgccctataacagcatcctataaaaggtaacacattggctgggcacagtggcttacgcctgtaatccaagcactttggaaggccaaggcgggtagatggcttgagttcaggaatttaagaccagcctgagcaacatggcaaaatcccatctctactaaaacttaaaaaaaattgcttggcatgacgacatgtgcctatagtcccagctactcgggagggtaagataggagggtcacctgggcctgataggttgaggctacagtgagctgtgatcacaccactgcatccagcctgggcaacagagcaagccctgtctacaaacaaaaaaagaaaaacaaaaacaaaaaacacgtgcctgtaatttccattatcttctaatgtttaccttcatcccaatacatagtaagttagtgttctgccactcaacaaagcccccctaaggctcagtgctacctgagacactggtggaaagttgagaatgtctaagattctgtccctgtcccctggaaactggagcttccactggccttgcagaaggaagacccatcactcgaattctgtcatgacagtctcttggaagctctatcttgggagtactagcgtttaggtggattctgcttgttaataaaatggactgtggtgttctagaagaggtgttttctttcttctcagatatttccatatgaaatgctcatggtgaccaacagagggcgaaacaaaatcctcagagaggtggacagaaccaggctggaggtaaaacaaaaccgaaaaatccagtcccaactgcagatccctatgcactcccccaactctcccctaagcaatgttttatttcttcagtgaaaacaaaaaaaaattataaagatcaccctcatgtcataggtagaactaagaaataactttggagaaaaaaaatatccaggttt

SEQ ID NO: 63050 - DNA, 1037 bp, Homo sapiens
cagcccaggcaccagaccccagcgagacaccaaagattgagacggaccactggcctggtcccccctcatttgctgtcgtaggtatgcaactgtcacggctaagtcaaagggacaaactgctaggagagctcaagatgacatgcttaaaaacatgaaagaaaatgtatcctattatgaagattttaaagaaaagtatgaccaagaggtagcatagtgaaaagaactaacgtggtattaacttgttgtacaaaacgcttaaaagttacaaaaacacatccaccagagtcttgttctaaccaaacccactgggatccagaactggtctaaaaccaatggtttgcatggactctcagagttaatactgcagaatcagtaactctgttgaacatagttgagtgaaagccttatggcaagaacattgttctatataattagagtctagtgggtgaatttaccgaatgtttgtagaagcatgacttctttcagttaaatttgttttagactatttctgggttgtagttataattcttaacaaccaatcttaacactgaagcactttcatttttcttgtaagatcatgttgtccatcatgcaaaagggctattgcagagtagtaggtgttctgaaatattacttctgtgaagttatgtgattttacatctaccattttcatgaattctgtgctaaaatgtcatatttcagctgtttcattctttgctccatgctttccaattatgtctgtgtctttactatattatcagtagtgaacctactcggcctaaaaagaagtattagcaaacccagaagctaatactgaaaatttagcgagtcagctttacaaagacacgatcttatcacatttctgttaacaacctaaaaggccttcaattttccaaaatgtcctaatcttcattgtgctatttttaataagttatttttggaatatctttcacaagcaatacaagtggattttaaatcaattgatacttatagaaagagtttaaggaaaaatctacctcctaagttcattattcaca

SEQ ID NO: 63051 - DNA, 1068 bp, Homo sapiens
cagcatgtgacccaggcctggggcctcactgagctgaggacgcctgcatggttgtaaagctgagatgcacggcacagactgtttctctccttcactggcttccccattcattttccataacatccattgttggttgggtgtatttttatttctgtcctccaaacttccttgtagcctcattctatcttagtatatctttgggccatttggacaaccttatgcctagagatttggaaaaaccattttcgctttgtttcgggcttcgtttgtaaagtgtctgctaagtttctcttgcttcccctttgaaatactgctagacatgacattctgtgtccatgaagtataaattggatttctgagcaggagggttacatatattaagtttctttgaaaggaatctttcctcttttgctataaatatgagttgccatgatgtaaatatatatttgacacttgctgaaggaaaccgtaactcttattgacgctttagacaagaaccggcaatcttaaaactgtcacaaaattctggatgctgccaacttatcttaaggttccctcaagatgttcatttatatttggggatgtaagcactctgagtccagaaagctaggcagtgctccaacaggtccccacagcagaatcgcacacccccatctctattcgcttgtcttagaattagtcactcgggctctcatggtgccaaaaagaagaatgaaagtggagatgggcatttaaatgtgttaagtacagtgagagtcctgtgagtgaatgctcccctgaggtctaaaaaattagcttactaggctaacaggaaaggaggtaaaaatgaaggccaagaaatagaaatagaaacataaatagaaatatagtagcttgtcactacaatagatgagaacactaacaacttagggtagcccaatctgaggacttaaaggaacaaaatagctatgagtgtgatatatatatatatatgtactattgtattatgtgcgcacacacacacacacacacacagagtagttttgttttttgttttgaggcagaatctcactttgttgccccagctgg

SEQ ID NO: 63052 - DNA, 1017 bp, Homo sapiens
tgctcctgctgaatggggggagggcaggggctacaaagtgcttcccagcactgtccttctaggcgacccatgtgcatggtggatcataatggaaagtaaatggaaaatgtcatttatctacttactcaaccggcagagctctggtaagtgtttttaatggttagtatttgaagaataataagacctgtaatggaaacggaagaggatgtcttcaattaatttttgttctgtgactgtgccttctgaatggtaggacagatggacaaaatcaaggcataggggaaaaatagctgaaaggtatttagagggcttttcaaagagatttcatgaagaaaacaaaaagatgtgctttttaaagcatttggctacttatttgtaattaaatgccatgttttatctctcctgttgaactgctagtcttctaatgaggcatctctttgttatttgtgtgtgtgtgtgtggaaagtaaaaatcgttgttgaaatcaaacgtaaagacatgaaagtgtgctggggagataactatagagtaaatggaccccttcatcatgacagactgaatgagaacagccatatcaacaagaaggttcttaccgaaggctcctttcttccttttgccaaaataaggtttcacctacttgcctcatcttactggcaaaatactctgagcgatcactaccatatataattctgtatctatctaccttgcctgctttcttcatctcacctcaccccacctccatgccaaagatggcatcagaagatgccaaagatagcatcaaaaggaagaactgaatttctccaactgcactttcgagttggtttttctgcaaggaaaaggtgcttaaatgaaagtaaataaattgtacctgcttttagtatgttagccataagtccttgctgtttcctttattctgtagaagtgagcttacctttggtgataaatatttgaaattgtatgcatttataacatagaccagagagtaatttttttttactgtaactctcataaagaatt

SEQ ID NO: 63053 - DNA, 1344 bp, Homo sapiens
tagtgtacttggaatgcatgtatttttttccccaaacttaagcctggagaatttctttctcaaaaatttctgaaacttgttttctaagtgcatagcatagatcagaagcagacgaaatatgtaggcttatgtatgttcatggtgaggtacactgtatgtacctgtcttcggaaaaacatttacatttaaacctcactacagagaacacccctcagaattagtgacacatctgctttgtgcagtgtttttatgacatatttctccaaagcctgaggtggtaggtgtctgcatttttttaacgaataggactattcatatgtgtttaatgtcagttactacagtcccccagcactggttatttaagtgcattttattttctcctgctagtcagtatgttccttgaggacaaggattctgtctcattaatcttgggtccccacagcttctctagaatctagcataatgcataggaactgctcagttaacactaaatgaatgaatctttagggagacgcagcgttttgtttttgtttttcctttttttttgagatagtctgactgtgtcacccaggccgtagtgcagtggtgcaatctcggctcactgcagcctctgcctcccagttcaaacgattctcatgcttcagcctcccaagtagctgggattacaggtgcgcaccaccacgcccggctaatttttgtatttttagtagagatggggtttcaccatgttggccaggctggtctcaaactcccaacctcaggtgatccacccacctcagcctcccaaagtgccaggattataggcattagccaccatggccagccagaaatgcagttttattacttataagtatagataagaacaaaagtgctttgcagttctcaagcatgtattccctgaaatgtcatctttctctattcattactgtcagccaatatttgcatctactattggttaaatatatatggtagatgagttagaaacagtctttgccggccgggcgcggtggctcatgcctgtaatcccagcactttggtaggctgaggcgggcagatcataaggtcaggagatcaatcaagatcatcctggctaacacagtgaaaccccttctctactaaaaatacaaaaaatcagtcgggcttggtggcccatgcctatagtcccagctactcaggaggctgaggcaggagaattgcttgaacccaggaggcagaggtagcagtaagccaagatcacgccactgcacttcagcctgggcgacagagcgagactctgtctcaaaaaaaaaaaaaaaaaaaagaaaagaaacagtctttgtcctaaaggagtttacagtctggtga

SEQ ID NO: 63054 - DNA, 1519 bp, Homo sapiens
atgcagaagctgggaaaggatgatttgaatgctggaattcctgaaccaataaggctgctgctagtagaaaaacaggggccccaagggagctgattttgaggggaagatgataattttggttccggatgctttgagtcatcatgatttcctgatggagataattagcaggtattcggtattgcaaatctttgatttgggagggaagtttaagtttaagagatttagaagctatgtgtgtgactatgttgtgggtactgatgagatccctaaaacagaaggggaacagttttagtaggaaccaaagtgttaaagccacagttcctcatcacctaggaaatttttctaaaatgcacattccttggctccacctccagatattcaacaggtccggatgggacccaggaatctgcatttttatcaagccccacagaagaccaggataccaacaatcttgagtcttactttgagaaacattgattgaaggacagagtgctatactaacatccttcctcttgctgttcttatttgagacgcctctcccaacaatattactagtattttaaattgaatgaaatgttttactttcataaagagtatgatatgccattggttttttttttttttttttgaggtggagtcttgctctgttgcccaggctggagtgcagtggcatgatctcggctcactgcaacctctgcctcccagattcaagtgattattctgcctcagcctccctggtagctgggattgcaggcacatgccaccacgcccagctaatttttgtatttttagtagagacagggtttaccatgttggccaggctggtctcgaactcctgacctcaagtgatccgcctgcctcagcctctcaaagtgctgggatgtgagccactgcacccggccaatatgccattgattttgttggaaattggcaaattgtttggagtattcattgagtcccatagagttgtttgcttttaataaatatgttctgtgaactcaatttctcaagaagattggtctaacctatacttttaacagcaataaaagtgatttataattagtataatataactttggaagtagaaccctgaattcattcagcctttaatatgtttctatgatgataggccctgggagaagttagtttatggtgaattttaacctacttgtgtaatctgatttctgctcttatgttcaaatggaaagcaagatacttttgccttgaagctaacaatttgctaatttgcttcagttaagagtctttttgtgttttggtatgtggattgggggagggagcaccagcatttcaagcaaatcttatttctatcctaaagacactggtaaaaatgtcccctgagtagtttcttgggttctctttttttaaatttttttgagacagggtcttgctctgtgcccaggctggagtgcagtggcatgatcacagctcaccacagcttcaacctcccaggctcaagcaatattcctgcctcactcagcctcccaaggcctaggaccat

SEQ ID NO: 63055 - DNA, 2513 bp, Homo sapiens
ccacaccataaataacatctttcatgtaactgggggaacagaactactgtgtacatttcaccaaaaaagactcagttccacccagccacaagaggataaaaagcctttttaaacgcagtattgctgtaaactggacagaaccattaagaacctattgagtggacattcttggtgaaatgttgtataatgttgttttcattggctttatcataatggttctatatatacaattgcacattgttgaatccaggatacaatcaaaggaacttcaggaaataagcatttctaatgactgtgaaaagctgcaatatttccaatgtcatgactttgatgatatttctgttatattaatgtccttttaggtagcaaggcattttgacattctctgggactcaaatgcttgtattcttttggattaataagtagcaaaaaaaaatcactaattttataactttttaaggtcagaattcttatcaaacaaaatatgaaaactgtaaatgagaaaaaaatacaattcagaaaccattgaatgaattaattataggcgataaaaatgtgtagagcaccattaactttcttcagcttttttaagaataacaatttaatatgataaattcttgattaatataatatatctatatttttaaagaaatgttcttttactcttttgtgcacatagccatgttagtgattttcttcatgtgtgggtcccagtttatttaaactgtgtcgttttcgcagcagtgttcaatttgctcaccattggtagtgtttgctaaaattgtatttttttaagctaagtaacatgtactgggttgagaacctttttcccccctctccctctcagaaaattgctttataaaattgctttataatttgattttcttactgaaacgcatggtggtgtctaggtggggaactgactgataacccttggcagcaatcaaagtgccagtggctcctcgatgtttacatttttttctattttgttcagtcttttgttttaaatgattctaaagagattaaagaaaacagagttttaaatgtcctatttacatgttaaaggatttggggaaattgggtatgtatgtgaatgggtgtacatgtaggaacctgtagttcagcaaagctgcgctgggcacagcatgcttgtacttgattgacaaaatcgtgtttgccagtccactttctatttttcctttaagtgatgctgatcactcaaataatgcttttaagctattgtttgtttttatttgacatgttaagccgcagcactttcttcttcatctttccatttactgatatttgggggaacaggctatcaaaggttccggcttgaagggaactgtcactaccccctctaggaagttattttatgtagcatgtttgcatatacgcattgtgtggcatgtgcatagaggcttgttttacacctatctgctcattttgttgtgttagcttttctggtttatttcatagtttgttcttgctatttattaagaacagaatatcaaaagattatgaatagcctcagctctagaatgcttaccactgttaaaacaacaaaaagactaaacctctaatttcatgcaaatctttgttagcttattctaagaaatttattaagtaaaacaaagaaaaaacagaagtgggagatagttattttgtgcgtaattttctttaaatcattttgaatgatgtgaaggcattcagtttgctgtatttttttaatcacttcatacaaggaaaacttcgacatttacatttctagatgtagtaacagtctactttgatatatgagtatttaaactaaggcattaagagatattagatatttcttaatgttttcatagtgctcaataggtgtagtagcaatgatattacctctgaaaccaaatactcttttatccttgattccactatgggaccttataactagtccatgaaaccaagctcagaaaagctttaactcttatatttgtgtatatgtatgctgcttctgaaaatataatttttctaagttgttgtaatgactttaatttgtaatcagctaaggcttaagatttcatttgtttctaagtttctgtttttcatcccttcttttttcttttatatttagttcagacctagagccagtagaagctctcacagtgagttcaatttgttagtgaaacattgtactgcatcaccagtttttcttaccttctgttgacagctgaatatttctgttactcagtacttgcaaaaacagtaactaaaatgcactatgctgagtggaaagcaccgtcataacaattgattgccatagcaagttccaaagtgaatttcagccttgcttcacatttgtatcaataaatatgcacattttttaaaactttctaacaatatagtctttggatttgtttttagttatgagccgcattctttacttgatagaactcagatttgtcttagcctattgccatatagtactcaccttataactatgtaactttctcgtaatgtatctgttt

SEQ ID NO: 63056 - DNA, 1060 bp, Homo sapiens
acttatttatacgttttcaaatatttatttaagtgcctacaacatgtgaggcatttgggaatgtctcagttaacgtggtacataagttccttgctctaatagagctcacatttggatgtcttctaattctgaacctgaatgtaagagcacaatacaatcaatgaagcagtgagcccaggaagccatggatcttcacaagcctcaggaaaagtcaacatttaaaattttctatttaaagtccaagggcacagcaagctcttggtctatatgggaaggccatggactacaattcccacaagtccgtgcgacctctccgttctgcgcagcttcgcggtatgaggaagagggtcctgtcaggcgcactcttgttgcatcatcagcgtgcacctccacgatgaaacaggtctgggctacaaaagtatggccgcttctgaggcggcggtggtgtcttcgccgtctttgaaaacagacacatcccctgtccttgaaactgcaggaacggtcgcagcaatggctgcgaccccgtcagcaagggctgcagccgcggtggttgcggccgcggccaggaccggatccgaagccagggtctccaaggccgctttggctaccaagctgctgtccttgagcggcgtgttcgccgtgcacaagcccaaagggcccacttcagccgagctgctgaatcggttgaaggagaagctgctggcaggtactgcagcccgggtggggaccaggctgaggcggtcgctgcgagaggggaagcacattaggctttttgcgacgctcgtgattcaagagacaaaaggaggggaaagggagactgaccattgaattagctctggacaggaatctcgggcatctcgggcttggacttgccctggcacgaactcttgtagcctacttggcagttgtagttctcaacgggaggaaaaaaatcccgtacttacacaataaaaccctgcccttgggcgtgcagacctgttttctgtaatctgatcgatccctcaggaggcttttgttgggttcatgtggatgaaccccaaaaggaagtactggttctgca

SEQ ID NO: 63057 - DNA, 1041 bp, Homo sapiens
gacattctcattatcctcgatttctatattgcttgtgattggcctattttgtatttatgttagttaggctagggctttccaaatgtcattgtaattggctgtcagaattgcttgggaagtttttgtttttgtttttgtttttgagatggagtttcgctgttgttgcccaggctggagtgcaatggcaagatctcggctcactgcaaccttcccctcctgggttcaagtgattctcctgcctcagcctcccaagtagctgggattacaggcatgcaccaccatgcccagctaattttgtatttttggtagagacggggtttctccatgttggtcaggctgggctcgaactcccgacctcaggtgatctgcccgcctcagcctcccaaaatgctgggattacaggcatgagccaccactcccggccttgggaaggttcttaaagatacctacattctaatgccatgtttgacaaccatgatcagtggttgtgtcctctaataccattccttgtctttctttgcattgattcctattatgctacaatctctactgtttgtctgttgggatccttcaaagccctaagtgtaccagaattttatagctagaaaataataaaaatccacgaatacttagttcagtggggtgaaccaaattccccactttatatagtagaggcagtacgtctgcaagttagaaggaggtatatttgggcacaaagggaagatagtatatttatggggccttcttactccaaggggtgtcaagttgaaaatgtaaagagttccccaaaaggtttctgttaatttatgagtgagagatccatgatggattgcaagtgacagatcaagggtttgaaactgaggtctggccttagaagtttatgtcaaagcagacaaccatacccttctaagtatggtgatgtcataattagggaatgacgccagggtgttccagagaccatggttctgactcagtagagtggtaattttgttgggaggccgagccacccagcatatccttttggccatttaatctggcttc

SEQ ID NO: 63058 - DNA, 1034 bp, Homo sapiens
tactcgcaatgttaggtagctggagatagcagcaaagaccatggaagagattcagaaatggaaattgaggacttttaaaagtatctttctatataaaaattaacttcttttcatgattctctatctaacagcccaccactaccaagaatttactagatttttgcgggttagcttggatatttacccaccttttaaaaatgccgtttttctcttagagaatgaattctactgtcttgatagctgattttggaatactctttctttataatttagggaatgtccattttaaaatcttttctttgctagtaatgaggtcatagtctcttaacatgtaaagtttgtataatactttttgtttgttttgaaaatgccatccccttttcctcccaagtttatgaagatcctacttcatttgtcttggtgatcaccttttttcatccccatttctctcatagaagctggaatgccttctccagaatggaccaagaggaaaaagcagactttgaaaattgggcatggagggactctagacagcgcagcccgaggagttctgggtaagagatatgaaaggcagttaagtgtccactgtcacttaatatcagaaagaaacactggttgagaacagatagattgactaaagccttctatttttcagtcattttggaatgtttcagatctactggatatatatagtgccatcttttaaagaagcccttaaatggtacaaggcctacaaggctgttagaaatagctacttttatgtgtggatgggactttgaaaaaaggtttctctctgtgcagaaaagagttaacatagcaggcctgaaattactatctttagaaaggcttgcttggacagcttgcccttggttggtatctgggaacttggattttgggagtgttcccacccttctctgtctgataaggctggttggctgtgcctcagatgttctgagaacaccagctttccttctaggaatctggaattttgttccactgctaaggcagagggtgcctgagtgatcatcctgtca

SEQ ID NO: 63059 - DNA, 1028 bp, Homo sapiens
ttttagaacatgcttctcttctctctgttgtgttccctatacatccttcaaaggcctaatacaaactccgaaatgcttgaatgaagcattctccggcctctttagccgtttaggatgctcccacctttgccctgctttggcagcggttctctctctgttcatttgacacttaatcatatactatcatattgttatttagcattattcactcattaggcaacatttcttgagcactgtgatttttctgtattttattttcctgatgagattataagctgtttcagagttaggaaatgtgtcacaggtttctttgtttttccattggaagtattcctcttgggattatgtgcatagtagttgttcaagaaaaattgattggagatttatttgaatggaatcaagtcgcattgaatctttcctgtttgcctcatcagcagcagtatctacaagttctgtcatttgaagagtattatgctcttcagaggattactgaggacagactgtttttgatcttagaccttgaactatatgacttagaaggacaatacagatgagtgtcatagaggttttgaggaggttggaatagactttatgaatgagttggggcttgagctgggcttcaaaggattgactttgaatactttaataaggagttggtgctgtaggcactgggaccctactaaggattgtttggggggctttgtaatgtgaaaaatagggtttcagaaatggttatgaagtggtatgaattggaagaggaagggataggatgtagaaccgtcaggtttgcagggatgtaggctggttgcagtgaggagaaagcctaggtgagttaaggtggcagagggaatggaaaggaaggggggtctgttcttagaccatttggtttgaatcttaactctaccaggtactggttgtgagatgctggacaaagttcttagtctcttattcctgtttcctcatctatcaacaggggtaattatactatcttttaaagtttttttttttttttttttgagacagagttt

SEQ ID NO: 63060 - DNA, 1569 bp, Homo sapiens
gggtcttgaactcgtgacctcaggtgatccgcccgcctcaacctcccaaaatgctgggattacaggcgtgagccaacacacctggccttttaaagttgttataaggattaaatgggataatgaaaggagagcatttagagtagaatctgatacatggtaaactcactgaatggtatttgctgtaaatattggagatattttttctagtttgccaatcagtagtccttgtttactcttataattctgaattgtggtgattgtattgtgttcttatgcacagttatatctgttgatgacaaatatttctatacttacaaaaatgtggcttcttaacaaaaagagaagtgactaaatcctctcaccctcaccaagtgaaatgtgttgacgtatgaataatgtttgaaatttaagagaaaggtaggccattgttgtactttgggctctgtaaatacattcttcagccttcattttaccttgtattctttgtgttagactgatttgttatgtttctcttttcttgattgtatatactgctgggtgctaatcatctttaaatggttcattagctgtgataatggcttttgctttgtttaataatgaattctgtcaaaagactttatcatacccacttgaacatggttaattgtgccgtgtgtttttcactggtgcccatataaaattccagtgcgtcctttgagattgttctaaggcttcattgtctaattggctgggttaaggtttctactgagtttaatactttgagaatggggagaaaggtcttctcttgtcccttctttagaatttcttagttgcatgacaagttcaactgtttggagtaataggagccctaacattttgctaaatatctgttctttcccacttcacattacctaagctgggaaattatgaccaaaaaatatagctattttaaaaacctagttttcagaacagagtgtcataatatttctttctttgatttgtagttgttggaattggaagcggaacaaaaatgttgaccagtatgttgtcagggtccaaggtaagaatactgaaatagttctatttttctttaatgttcttaatgatctacatgtattgggtttttatcaaataaaaaataaactgagtaaactgcatgaatgggtatcattcctgagtattaattatgtctataaacatatctgagattgaaaatatcgagactgaaaattggaaattcttaattgaaaaaccaattagacttaaagaaacaatgctacagtgctcatcatttaacaaaattatatttagacttttaaaacatcatatttcttagatgattgggacttagaggtcataaactctagtgacagacttttttaaaccttggaatttttatagaaacaataccattttgtaaactgtgccctttgagcaaaaatatgctttgttcaatggttataaatgtttattaaagaaaagagtagggcctctttaagatgataaagtatgttcatatatgagagtaaccttgaatagatccaaaagcacttttccaggcacttgatagaagagagaaggggttatttg

SEQ ID NO: 63061 - DNA, 1027 bp, Homo sapiens
gtagcattttaaaacaaatctctgatattatcagccattttaattctcagtgtgtttctttgggctaagaagattggaaattgtttatcgcattgttgcttacttgataggagtttttgaataaagatttattgtgattgcctctttttctatagtgatgttttaagtgttcagaattattcttccaaataacctccttgcaaaagcatgtatggctaggatttaggttattttccctagtaaacgagaaacaaagcagagatactctgttagatttcatctgtcttgccattaaaaaaaaatatattacctgtcagctgttgaaataaatgtaccaggtttagtactttaaaacttgtcatgtttttgtgctttcggactatgtaaaaagaggacagagggcaagctatttctctggaagtaaaccagaactcactggggcccaccttaagtttcctactatcccttctttcactaccgtaaggaagaatagataaattaaatggtctcctagcaactctcacagtgcttatgctgtttataatgcagcaattgcagttttctaagtcagttcacctgcatcattatgtcaccaatttgtggactgtttttttgtttagtgttatctcttagtcataggcaagccagcatttggcccccttatatttttgtgttgattatccttattacgtactgcatattgccccagtagtgaggccaacctttttattgttcataatagcttcattttttctgttaacatttatatgtagcttagtatcttgctcaattaatcaagcaacataatgaaaagaaaaattactgattgatttcaaggcttttcaaaaacagatgttgaaatattcttggaattattattattaataaataatagcagaccctcacttaactgaaagccagctataaccttcaaccagaagactttaagattaaggaggcatagggcaataggaggacgtcagagacttccagaggatactaaagtatttataagtacttatgtaat

SEQ ID NO: 63062 - DNA, 1058 bp, Homo sapiens
gatgtatttatttttaaaccagtaccacactgtcttgattattgtagctttgtaagtctttaaattaagaagtgttagccctccaacttgttctttttcaaagttgcttttgccattcttggtcctttgcatttccatatgaatttttgaatcagcttgtcaatttttatgcacacacacactcaaaatctactggcagtttgagattgttttgaagctatagatcaattttggaagaattgacatctaaacaatatcaagccttctgacccatgaaataagatatctctcttcatttatttaggtcttttatagccatatttttgtagttttcagtatcagatctttacatcctttgtttatgaaatctctgagtacctcaaattctgaagtttcaatttctaatagttcattggtggtatatagaaatggagttgatttttgtatattgatcttgtgtttttcaaccttgctaaactcacttatttgttctagttgtgttttgcatagattttatattaggatggctctaaaatagactttttttccaggtctagattagctctgcttctaaagcatgacttttctggggtgtctatcaaatgacttgtgcattcaacaaagtttcttcattctggatggttgaaattaaaacatcccccagccttgtaagagctttggtagtatttctttagttaattttgtagagaccctgtatgtatgtatgtacagcttagaatttagtcagagtatcaagggtgccttcatagacatttctttgtctgtgtattttcctcaaattccagctgccactacttcctcagattctgatctctgttcagtgagatcactgtgctttgacgttcccctctctgtcccacagttaagaaagcacctccagacaaaaacaagtgatcatgagacttgctttgtttgtttctttttcctcagggtttacagtgcttgctgcctgttgtctgtctaaaaactgttgcttaataattttgtccagtttaacagctgtttatggtggcaagatttgtctagtcacagttact

SEQ ID NO: 63063 - DNA, 1086 bp, Homo sapiens
tgttaactattgcaattttatcaacagtgacatttccttcagcaagtgccagcatggtgacagcattggctgtctagatctggaaatcttacatttgtatgactaaggtgccgctagtaataatgtcttaatgttgctgtagactaaaattttttcatagaaaaatcctcatctgtatcatgagatacatctgtttgagaaacagtatgaacagatcagccatctgaggtctgccttgttggagctgctaggtgctagagaaattcttttgagtgttatagctcttctgtctgtttgagtctagtagattctagtcttttgtttgtgtttagcttttaagggtcaaggtcatactgaggttaaaactgtcttgttgggttgatattaaaatctggacatagtattccatgctgacttttaattctggtattggaagaataattcaaagcatacttgtttttatttaatattgttcaaataaattcaaatttaatacacatataccagaataaaaagtttagataaattttctacaaaatggtaaaaccactgaaatttcttaccattggctgtgaactaaacagattatagaatatttctgtgatttagtttattactaaataggaaatatgtatgaagacatctttgagtatgaaaattctaaatttcagtatatcatagattttagtttttaaaattatagaactgtattttttgtctttttttttttttttaaatatggaacacggtcaggtacagtggctcacacctgtaatcccagcactttgggaggctgaggcaggaggatcacctgaggtcaggagtttgagaccagcctgaccaacatggtgaaacccagcctctactaaaaaatacaaaaagtaggcatgtgtggttgtgcacgcctgtaatcccagctgcttgggaggctgagacactagaatcgcttgaacccaggaggcagaggttgcagtgagccaagatcacaccactgcactccagcctgggcaacagattgagacctgtctcaaaaaaaaaaaaaatagataaataaaaataaaatatggaacacttcactaatttgca

SEQ ID NO: 63064 - DNA, 1145 bp, Homo sapiens
catgagggctgcgccctacgacctaattacctcccagaagaccctacctcctaatatcaacaccttgggggttaggatttcagcatataaatttggaggtttggcattcagatcataataccatgtagccatattttcgtgcacattaccatttcaagcaaattgcctcttttgaaaaaaatggctgaattggttataggatatgtcagggtaagtttctgactttttttttagaatttagtatttattttgtatttaaaatcttgagtttttttcaggaacattgaaatatctctgaggagacgctttttaatgattttgcctcaaatgtaaaaatttaaaaattttagcaagatctgcataaacgttattttggatcattgttaaatttatttatatttatgtataagaattgttttaatattttctgtgattattgcaaggattttgttttctagtaaaattttatcacgaaaagctaagatacgctaagtaggttatttgcttattagcttcttagaaatgttttggtaacttatataaaaatgaatattatagtagagattgtttcaaggaaatatagctgagagtattatgaccagagtctactaaattccttgtgccttttaacacagaatgaggactagtaaggacaagacatgaatacattgtctctagaaagatgattaaagaataaaattggtaacactgcatattgtgtgccagaatgaggttatatcagccttagaaatatttagaaactctatccatgacagcattatggagtagattagaattaaaaattcattcattttttagaaggattttcattgtgaagcactgccagtcatccttcctttccatgctaaatctgaaattatcatctcccaatccttccaaatccctctcaattcttgctctcctttccttccatttctccttctctcatctcacaagctattctgcattaaagaaagatggacaaagactttcgactttgatgaagagaggtgaagtcgtagaagcaaaacctgccaggccagtgactgtatacagtatctcccttcaaaaattccagccaccatttttcacattaggtaagatggagaaatttgaaatcatttgtatttacgtgtatttttaat

SEQ ID NO: 63065 - DNA, 2348 bp, Homo sapiens
tggtatgccttgccagttaatttaaaatgtgttcatgagtttgtgctgtttgctttctccacactctgacttttcagtctcacaaacacatatgctactggatgaataatttatgttttagtgcataaatattttatcactcaattgtttgcatagtgcatttttacatttgtttagggacatcatttctatgtaaagtggatttcataggaggttagcaatttactatgtcactgttaacattccagatgttgaatgtggaggaggtttttatatcagaagcttggtcagtgacattggaaaaggtaagcataaaaatgaattatgaattatcatttagagaataatactccttttcaattggaagagggaattttccgtttttcttatttctgagtactggccttaggaactgaactcttgctgccttcagctttaaaagcattgtaggtttctggcttgcaattatcagcctcagcagctgcagtgaaatgtttgtaatgggaaagaagagaaagagagaacagaaaacgaagacaggaataatgaacgtagggccaacatcttttcaagtacaaaagattttaactcaaactagggatcaaaaaaaaaaaaagatttaaccttctaaaagttattttcaaatttttttaaactggaagccgtagtcttataaacagccagaaggtttcggttctggctgtgccatttactggcagttgtcgcactggacaggtcatatgatctcatctgtaaagtgcggctaatctttactccatggggttggctgcatgagttaaataacaaaaatgtgtgcaagttctttgttgattttaaagcagcttataaggtggattattaagtattattttgctacttaatcatttctttatctgaggcctcttggttcttatattggattattatacttttgggtggttttgagagatttcaattgagtacggtcatttgaacaattacagactatgaaatactgaatcgtttatcttctggattttttttctaccttttgttgccatagaactatcttcctgtgccaatgtgctagagctgacccgaaccaaacagggaccatttacgctagaagaacatgcccttcctgaagacaaatggacaattgatgacattgcacagtctcttgagcattgctcatctcttttcccagcagagttggcacttaaaaaatcaaaacctgagtctaatgaacaggttttgagctgtgaatatataactctaaatgagccaaagagagaagatgatgtaattaagacgtgttgagattggcctgggaatatcatcattttctagttgacatttgaatcctgtgtgcagatgcagaatgacaagctgcattcaaaagacaaacaatatgtcttttttttttttgcatgaagaaaaatgtctatcatttacagtttcaatagcacataatttattttctatgcattataaatggccttgcagttggctcagttgtttgttgtgttgtgaaatgttttaggattttttgtattgtgaaaatatgaatatgattggattcagaaaaattaactttctgaatttgatctgtcttcagtcttgtgaaaaagttgaacaaatttcctaatcaaagaaaaaagtatgagctccatgtttctttagtttcacaaaaatgaccataatttagtgttatttttactttatttaggcttcctggtggcttcattttattgaaattctttaaattgtttaaagtggccattattgatctctttcttctgttttggagagtttattattaaaaacatttctttgataaaatggccatcatctagtaatacctgtgtttgtttagatcttggaaatgaataagctttgataatatttgtaaatgaaccaaattattactgctaccactaacaggttgtaaatagaagactaatacttaattaaagtcaccttcctaccattagagcagaagacagctcctatagttttgtattttggcagctatgagatattttcatggtaatgtcaacatggtcaagcactttgtaccaagttattaagtaacataatttttaaaatttaaagaatgtgtcttcaactaaaaactttattctttagcatttatttatatttctctgtagggtgttccctgtgacattgtctctttagtttgctctttcaagagatacttacagatgttgagatggctgccctgcatttccagctaatctcttctgctctaaatatttaaaaacagttcttctcaaacattttcattcagatagctttctgaaagttccctatccctctttaccataattttttaaatgtagccacat

SEQ ID NO: 63066 - DNA, 1052 bp, Homo sapiens
tcaccacatatcccatactctattgttattgttggctttattgcctgtttttcctgtgaattttaaccttcccaaaagcaggaatcttatctcagtatatcacagagaatcactaagtatctatagaggaaaggaaggagagaaggaaagaagaaaaggaagaaggaaaggagggaagaaaggaagaaggaaaggagggaagaaaggaaggaaggaaggagggaaggcaagagggcaggaagacagaaaagaaggaaggaagaaggaaggaagggagggaggaaggaaagaagggagggagggagggacggataggagggcagaaactctggaaaggagcttgtcttactcctaagcttggtaaagatcagtcttgcaaggggcttgactagaaaacactggcttatctcactgaaccatattcccaatgtcattgactcctttcccctggggagtaattcaaccatgtgttcactgtatggatcagagttgatgatgaatattctcttgcctcagtctcttttggccagagttccttggcttccagcctgctccttgcttgttttgaacgaataatatatgactttccttcttaactggcaaatgctgaactgtggcctctcttaaccctcaagtctcccgataaaaagcaaaatattagattcgctgaccagcgctactccttaccccggctgatttcacatgaagagctatatatggggtggtaacataggtttaaggatggatgtgcatataactcctggataccgttcctgaaaatatactattggggattatttctttggttgaagagtcccttcactaccacatgtcagtccccttacctataaaatgggaaccttagggttgttataaggattaaatgagttaatgtgtataatgtgcttagcacagtacctgccactcaatgctattattgttgttgttgttattattattggtagtagtagtagcagtagttgttgtatgaagatgcatgatttcctgggaaaggtagcacattaaggcaggatcagtcatgagttacctca

SEQ ID NO: 63067 - DNA, 1058 bp, Homo sapiens
tatatactgccctaatagcactatttttccttcttagtattgtcaaaaatgaggtgtttaattataattttgatagttatttaaacaaaatttttaagagattgaggtataattgtcaaacagcacaatttaaaatgtacaatttatttaaattatacaatttgataagttttgtcatatgtatttgcatctgaaactgtcaccacaatcaaaatcatgaaaataccaatcacgctagaaagtttccatgtgtttcctttgtaaaccctcccttttctagttgccaattcctgtcccagggcaactattgatctgctttctctcactatagatttgttggtattttctagaactttttgtaaatagaatcatacattatatacttcttttttgtctggcttctttcacacagcgtgtttattttgagattcattcatggtgtgttagtagtttattctactgccgaatagtgttccagtgtctggatacaccataatttgtttatccattcaactgctgatggacatttggattgtttcaaatttttggctgttccttataaagctgctacgaagtttcatgtggaaggctttttatctttgtatggtcatatgctttcctttctcttggggaaataacctgagaatggctggatcatatgggtagatatatgtgtaactgttaaagaaaccgacaaactgttttccaaagtagttgtatcatttatgttcccaccagcagtgagtcagtgttctatctagttaatttcacatccataccaatacttggtatggttagtcttttaaatttttgtgattctaataagtgaatggtatattattgggttttagtttgcatttcccgaattactaatgatattgagtatcttctcatgtgcttacttgccatccgtatatcttctgtaataggcatttattcaaaccttttgcatgttaaaaaaattttcttactgatttttgtgagttctttacattttctggattactagcttcttatgaggtatatcatttgcatatattttctaccagtctgcggct

SEQ ID NO: 63068 - DNA, 1050 bp, Homo sapiens
tttgtccatttttgctttggttgtctgtgcttgtgggttattcctcaagaaatctttgcccagtccaatatcctggagagtttccccaatgttttcttgtagtagtttcatatgcttaactacctgttattatgctagacattttatttgaaaattattgatagaaataatttaaggcccaggataatgttatctttctttagagagtaccatgtatcttctgttaggagacttggcatattggcagttctggcagcaccataagccgattttaagacttgggagttttctgctgctcagatgactcatagctaacctacagttgaggtaaaggctggttaacttctggtacaccactattttaatagcaagtcattatgtcccaagtcaaagtgccctgttgtttctttgaacccctatgttttgtgggttattgcttccaacttttgtcctcctctccccttgaggctactaaatgcactctcaaccttttggcagtctcttctaaataagcaaatctctcagaacaaaagcatctctgaatgcctgcctcctcttaaagaatttgcaacttctggatcttggctttgtacattttatcattttgttacttgtaagattttaaaattgtcctttaactttttaagttgtcttcagtggagagtttttctgaattactgcacttagtattaatattattggaagtgaaaaatcagggcaagttatttaacttgttacttaaaatgtgcttcagacttctcatctgtaatatggagttattaattatttactatcttataggttttttgagatttttaaatgaggcaacacattgtgtttatagtggtacctgacatgtagaaaatgcttaagttattattacatttatttgagaatataggaatttgttgctcttcaaagattttccaagcatgaattagccactttattacaaaagtaatttgcagggattatgaaagatttgcaaatgacattaacattgactgacatttctgtcaaccctgatttaggtaaattaaagtttttccc

SEQ ID NO: 63069 - DNA, 1153 bp, Homo sapiens
acctaaaaatcccctatgctctgcctattcattctttcctctccctacccctgccaaccactgatctttttactgtctccacaattttgccttttcccaaatatcatatggttgtaatcatacagtatgtagctttttatgattggcctttttgacttgacaagatatgtttaagtttcctccatgtctttttatggcttgatagctaattccttttcagcactgaataatattccattatatggatgtaccacagtttgtttatccattcacctactgaaggacatcttggttgcttctgtaaaatttgtttaaattttagtaagtcacctgagggaaaaaggcaactttgaaaagaactgatctcttaaaatggcttccaaacattgggatagaagagcaatttttataacacatgaaaagcaagatataagaaattgaattcatgttcatgtgtaaagaacacaatagaacagtaattttcaaagtactctgttttatataacttttaaaaaatctgaggaggctgaggcaggagaatcacttgaacccaggaggtggaggttgtgagccaagatcgcaccattgcactccagcctgggcaacaagaatgaaaatccatctcaaaaaaaaatctgaatgatgggaggtctttggttgaaagcaacagaaacaatctggcttacttgagcagaaaagtcagttattggaaagtatgcagagacagagactgctgtctcctagcattcattatagaattctcattgtaatagaattctcatttagctcagcacatggccttccatctacataccaaatttctcatgctgccttgcagctagtatggctatgttactgtattagtctgttttatgctgttgataaagacatacccaagactgggcaatttacaaaagaaagagatttaatggacttacaattccacatggctgggggggcctcacaatcatggcacaaggtggaaggcatgtctcacatggcagcagacaagataagagagcttgtacagggaagctccccctttttaaaaccatcagatcttgtgagtcttatttgctatcatgagaatagcaagggaaagacctgcccccatgattcagttacctcctactgggtcccgcccaaaacacat

SEQ ID NO: 63070 - DNA, 1022 bp, Homo sapiens
ctttagagttaatgctgaaatgagttatgacttcgggggactgttgggaaggcatcattggttttgaaatgtgaggacatgagatttgggaggggccagtggcagaatgatatggtttggctgtgtccccacccaaatctcatcttgaattcccatgtgttttgggcgggacccagtaggaggtaactgaatcatgggggcaggtctttcccttgctattctcatgatagcaaataagactcacaagatctgatggttttaaaaagggggagcttccctgtacaagctctcttatcttgtctgctgccatgtgagacatgccttccaccttgtgccatgattgtgaggcccccccagccatgtggaattgtaagtccattaaatctctttcttttgtaaattgcccagtcttgggtatgtctttatcaacagcataaaacagactaatacagtaacatagccatactagctgcaaggcagcatgagaaatttggtatgtagatggaaggccatgtgctgagctaaatgagaattctattacaatgagaattctataatgaatgctaggagacagcagtctctgtctctgcatactttccaataactgacttttctgctcaagtaagccagattgtttctgttgctttcaaccaaagacctcccatcattcagatttttttttgagatggattttcattcttgttgcccaggctggagtgcaatggtgcgatcttggctcacaacctccacctcctgggttcaagtgattctcctgcctcagcctcctcagattttttaaaagttatataaaacagagtactttgaaaattactgttctattgtgttctttacacatgaacatgaattcaatttcttatatcttgcttttcatgtgttataaaaattgctcttctatcccaatgtttggaagccattttaagagatcagttcttttcaaagttgcctttttccctcaggtgacttactaaaatttaaacaaattttacagaagcaaccaagat

SEQ ID NO: 63071 - DNA, 1029 bp, Homo sapiens
ttcccagaagaaactggattgttaataagaagtggaagatatggtgggaataaagatttttagagcaagaggggtaaatgtagcttgttgtaatcattccagatatagtcttatgatttagtatgtactgaatctgaagttctccaataaaagtcaaaacaagatttcaatgcaagtgttctctcttctaacaccattttaaaaatttgattttgttacagtatccaaagtattctacacatgttctagacccataaaatcaatctccaaaggccaggtattaacttttgtctattttaaatatccacaactattctgacaatctgttaattttataagacaatgaattgtgtgagtggtaatcattatactagatctgttccaagaatacttggctcttacagtttcggtcaatgatgctattgtggcatggaaacaaattgccctcttgtttaaagatcaatggtttccaatttactctttttgggctgcagaaggcttaaaacaaagttttacaaggaatctcaatatgtaaaatattgcaaagtgatgacactatggttgaggcagaaaaggaagagtcacttatcttccatcctaccccaacccatctccttatataacccttgcaccacacattttgaaaactcctggtattatcaaaatatgtatgcttagaaaagactaacttcaaaaattttaaagaccagatttttgaataatcgtaactgtcaaaatcatatttcaaaaacatctaaaataataaattataaaataatgaaagcatgtatgtcaaaatttcttctaggtacaaaagttaaactgcccattttattagactggtgcatgtataatgctcacagaatatgtaaatagttgcctaatatataaatattaatcacaaattcaatttttttattaataaaatgtactgaacctcattgcaaacagaagattttactaaatcaaactattacaaaatgtctacttactaaaaaggaaactgctactgtattatcagccagtcaa

SEQ ID NO: 63072 - DNA, 1032 bp, Homo sapiens
attaaaagtactctagagaagtaataacatttctacatgaagcatacttctatgtgcaatgacagctatggacatactgagttcatgtattcacaaatcagtctcactagcaaatagacactaccacaaaaataaccacttttactctcggacaacaattaaaaaaaaaagacattttggataaaaatccagcttaaaaaacagcaagaatctgaaaataaatacttactttaggaccatttgaaaagaactgtagttaaaagtatatccaccaatcacccacataaatttcccgtgtaaaactgctttatgtgaagcccgacctacagaaggactgaagggtttaacgtttggcagaatccagtaagactcagtagagggaacattcaaagaacaatcaggacctattaaaaaaaaaatgaaacaacacactagattaaacaaagccctcagattatagaaatacaacatatggattaagagaatttaagaattcaatgtttatcatattaacaaatatatacataaattatctgaaatataacttacaagaataatactcacagaaaatgtaatgcttagaggcgaaaaaagtcatatactcacaatcggacttggatgttcaaataaatttcacaattttaaagaattatttaaataatataaaatgtcagatttattttagtatgctacaagagtattaaaatagaaaacaatgtactcaaatatcagttctgtcagggaagtatgtttacctctttcatcatcaagcctccatctacacaaatggatataataatctaccaccaagggttataataaatatttatttttttaaaatagtggaagtaaaagcatttaaaaattaaagtttaaaaattattaactattaaacaaacataaaaaagattacattttttttagcattattaaggacaaccaaagtttgcttcagtggagtcctcaaaaagaaaaaaaaattatgcatcataaaataaaaattattaaattagtgcagaataatttcaaata

SEQ ID NO: 63073 - DNA, 1050 bp, Homo sapiens
acttttatagctctgacatttgagtgaagacatgcaatatttgtctctctgtgcctggtttatttcacttataatgacttcctgttccatccatattgctgcaaatgacatgatttcattttagggggactaaacaatactccattgtgtatatataccacattttctttatcaatttatcagttgatggacacatgttgagtccatattatggctattgtaaatagtgctgcaataaatctgagagtgcagatatcgctttgatatactgatttactttcttttggctacatatctagcagtgggtttgctggatcatatagtaattctattttcagtttgaggaacctccgcactgtttaccataatgactgtgctactttacatacccacacacttatcttagcattatataaattaaccaataagcatttatttcctatgcacaaatatagcttgtttactgataattttttaagactgtataaaatgaatttggcagtagagaagcttctataaaaataagtcactgttggattatgtaacatgaaaagaaaattcgtatttttttctactggtgtaatacatatgaaaactgaagtcccaaattataaatcccaaatgcttatactctatgctcaaatttcctccatttgctaaaatatacaaaaggaagcatccagccaagaaacaggagcctgttttaagaagcttgctatcaattgttatcttcccaacttctctttcttcctccaatgaattaggaaaggaaaggaagtgcccaagtgccccttcacaagaaaggtaagggttaccaaatttgattgcagcattgtttaacttatttcctaccttggaattgtaagataaatgtgtatgatacaaacgaggaaacataatcagaacataacttccacagattcacaccactagtccacccatctaccagtatctgcagccaacacactgctttccaagttatcataaattagggctgtacaaactatttctgtaaagggccagacagtaaatattttaggctttgtgggc

SEQ ID NO: 63074 - DNA, 2092 bp, Homo sapiens
taattgtcatacagtaagagaacactaaactactgctttaagaatggaaaatgcaataagctaataaagaacttacaatttaagggtgaggtagtcctataacaaagaataatgtactcctcccatataactgaagataacaaactaagttgttgattaatattactcatagtcttcaatatttgaatcatctgagtccctagtagctttgtgctattctcagttatttactgttttcatcacgtgctcttcaccaaaaagacatatcacatttgtgcatcatgtagagtacacctctgttaccatttctaatggctatagacagacaccacatgccttcagttcacctttggtaaatccttgtagaacttttaaattatacaaattatttcaaatgcatatgatggaaataaatggtacataaatgatgtaaattatcattatttcaacaaactagaaatagaaaaaaatttttccaacctgacaaaagatatttaaggaaactcacagctaacattatacctaacagtgaaagactagatacatttccctaaggtcaggaacaagataagcatgcctgcttttgccacttatattcaacattgtagtggatgttccagctagagcaaaaactaaataaagacatccagattggaaagaagaagtaaaatatttctatttgcagatgatgcaatctggtatatagaaagtcctaaaaatttttttaaaaagcacttagagctaataaatgaatcagcaatattacagaacataagatcaatgtacaaaaagtaaattgtatttccatacacttgtaatgaacaccccaaaaatgaaattgggaaaataattacattgacaaaagcatctaaaagaataaaatacttatgaataaatttaataaaggaagtccaaaccttatactctgaaaattacaaaacattgtttaaataaatttttaaaagatataaataaatgaaaagacatcccatgtttatgggtctgaagacttaacattgttaagataatactctccaaattgattaagaggataatactctccaaattgatctacagattcaacatgatccctatcaaaatctcagctggcttctttgtagaaactgacaaattgattccaaaattcatatgaaattgcaagggatgcagaacatcagaacaatcttgtaaaagaacaaaactggagtactcccacttctcaaaaacttactgcaaagcaaaagtaatcaagataggttgggcatggtggctcatgactgtaatcccagcactttgaaagtccgaggcgagtggatcacttgaggtcaggagttcaaaaccagcctggccaacatggtgaaaccccatctctactaaaactataaaaaaattagctgggcatggtggcaggcgcctgtaatcccagctactcaggaggctgaggcaggacaatcgcttgaacccaggaagtggaggttgcagtgagccaagattacactactgcactccagcctgggtgacagagcaagactctgtctcaaaaaaaaaaaaaaaaaagtaatcaaaacagagtgatactgggataaatcaatggaatagaactgagagtccagaaataaacccacacatctatggccaattgatttttgacaagagtaccaagaccattcaaagacaaaagaaaatgtcttgtgaacaaatggtgctaggagaactggatagtcacatgcaaaaaaaaaaaaaaagaacttgcacccttactgcatactatatacaaaacttaactcaaaataggtcaaagaactaaatgcaagaatcaaaactataaaactcttaaaagaaaaaaaaaattgggttaagtctttatgacctgagatttggcaatgaattattaaatatgacaccaaatcacaagcaataaaaggaaaaaaagttaaattggactttatcaagataaagtccaattttttgtgtttaaaaagataacatcaagaaagtgaaaacagcacacgaaatgggtgaaaatatttgcaaattatttacctgataatggcttgtatctagaacatatgaagaattcttacaactcaat

SEQ ID NO: 63075 - DNA, 1157 bp, Homo sapiens
gcctgccaccatgcccagctaatttttttatagttttagtagagatggggtttcaccatgttggccaggctggttttgaactcctgacctcaagtgatccactcgcctcggactttcaaagtgctgggattacagtcatgagccaccatgcccaacctatcttgattacttttgctttgcagtaagtttttgagaagtgggagtactccagttttgttcttttacaagattgttctgatgttctgcatcccttgcaatttcatatgaattttggaatcaatttgtcagtttctacaaagaagccagctgagattttgatagggatcatgttgaatctgtagatcaatttggagagtattatcctcttaatcaatttggagagtattatcttaacaatgttaagtcttcagacccataaacatgggatgtcttttcatttatttatatcttttaaaaatttatttaaacaatgttttgtaattttcagagtataaggtttggacttcctttattaaatttattcataagtattttattcttttagatgcttttgtcaatgtaattattttcccaatttcatttttggggtgttcattacaagtgtatggaaatacaatttactttttgtacattgatcttatgttctgtaatattgctgattcatttattagctctaagtgctttttaaaaaaatttttaggactttctatataccagattgcatcatctgcaaatagaaatattttacttcttctttccaatctggatgtctttatttagtttttgctctagctggaacatccactacaatgttgaatataagtggcaaaagcaggcatgcttatcttgttcctgaccttagggaaatgtatctagtctttcactgttaggtataatgttagctgtgagtttccttaaatatcttttgtcaggttggaaaaatttttttctatttctagtttgttgaaataatgataatttacatcatttatgtaccatttatttccatcatatgcatttgaaataatttgtataatttaaaagttctacaaggatttaccaaaggtgaactgaaggcatgtggtgtctgtctatagccattagaaatggtaacagaggtgtactctacatgatgcacaaatgtgatatgtcttttt

SEQ ID NO: 63076 - DNA, 1085 bp, Homo sapiens
cttatgtattctggacacagtgacagtaagccagaagctaaattcctcaagaaataaaacacagccatctgagagcaaaggatgagtgcaggaaggtgaagtaataggtgatatattctgatgatgtaagagtcaaagccaggcaatttaaaggaggaggaattgagaatagagtggaaatggcaataagaagtaaaggggatatgtaacccacttttgacccagctgtactgagaatatgtaaacaaaaacagccatcacttgaaaggactgcaagggaaacagtggagtatttcgaaggggagtcttcctctgagcatacaagtactctcttgctaatggtggtctgcaaatgagttttctcattaagactgcacaaggactctaaatagttgtatatatagttgtccatacacaaaagagccaagaatttgagttcatcatactggccagagccagaaaagaattattttcttgaatctgaataaccaccatagggcatatatttgtaaacaaactaaaaacaataaagaaggttaccactgttttaaaaatgttataaataattcaaaaaaatgaagtaccagaaaaacaaaatggagtaaaggtatagtacaaaaactcacatgtagattgccctagacaccttcaccttcacataacagataataatctcttatagaagccagcagactatccttgagaagctgactttaaagaagtaatacatacataaagatatagcagtaagattagaaatagaatgctaaaaaataaaaaatcctgaaaccatgcaatgcatagtaaagagactgggatagtttcagtacttcgttcataaataaaatccaaagaaatagcaccacctactggaatttcacatatttttttaaaaaattcacaaatcttagaaaatgagactattaagtaatatttcccctcatttggttaaaaaggtaagcttaaatattaaaggacaaaatctaacataatcaaaaaagcttatattaaaaattattaattatcagcttataatttcaatctcaaataactcaccattttgactaaattcatatgaagatttt

SEQ ID NO: 63077 - DNA, 1114 bp, Homo sapiens
gtaatcccagctactcaggaggccaaggcaagagaatcacttgaacctgggaggcagaggttgcagtgagccgagattgtgccactgcactctagcctgggaaacaagagcgaaacttcatctcaaaaaaaaaaaaaaaagaaagaaagaaatataattgaagtcttttttccctcactggaaaaaaataaaaataaaaataaaaagttgataattacagctgaaagttataaatggtaaagtttaataaattccttatgtgttaaaacttactgtgctttttcacaggctaaaggaatacaacaattgaagaaaagacctaaacaataggccaagaaaatctgaggtctccactatcagagaaaagtcttcacatagaaaaataatgaagacataagctcccattataagttgtacaaacatatgcaaagaaagttatgagatgcctcatttaacaaggctataaaatgaagatcacaatgaccccaatattcaaaatcattacaccaaagttaaagtgcctgagcaaagataatatgaatcagcaaaatataccaaaaacataaaaggaatcatttttgagcaacaggaactcctataagttcaagatgtttattctctcttacttattaaatgtaacgaaaccagatgcaactactcctgaaggagtgggatagcagaaatgactgaaattttatgtctccattcttttctaacactgataataaaaacgtaatttgctaactttacataaaaaattgaccctcttttggtatgtcaaattatcataatcttttagcatataagaagtcaaattgaactcagatttctatttttttataaatttttatgaagtataatatatatgccaaaagtataaaaatcttaagtgtatagttcaatgaattatcacaaagtgaacacataaccactccagaagctttgctgctactcattcaaatactacacaatcataggcaatccctatcataacttctaagcccataattctgtttttcctggtgctgaactttatatcaatagaagaatatactgttttcttttatgtctgatttattttattttctgttcctgcattaatttctcttaggat

SEQ ID NO: 63078 - DNA, 1081 bp, Homo sapiens
aacattgtttttctatgtatcatattatatataaaacctagctgatatttaaaatatacttatcagtacttaagagcaccttttattgagggtataaataaagtattataccaatttgaagcgattaggaaacatttttataagtaaaataaaagaataacacatttaatagatgtaagaagtatactttttctcttaaacctcataaaggcacataatctgctttggtaaattatttcaagtagaatcatgtaaagaaaactctgactattaataagcactttaatctttttactattacagttgtttcaaaggaaattcctagtagtaaagttaagcatggtttttaaatctaagtaatgaatgtcattctgtgattaatcatttgatactagtaatttgatctttttctttttgaaataataatttgaagtggtaactcctgacgaacatgggattgtctcagcttttaggaggctcatgaatcattgtttgaaattagtaaaatgggttgaatgaagtactgaatctaggctggcagtgactttatctcattgctagattgggcctgtcaatatattattgttttggctatggtgataagaccctgggcttatttttctggaagttgatgaaagttttgtttgtttgtttttcttctggggaaaaaaaatcccacaaaaagtatacattgttgttgtcattgttaaaaatccatgaagtggaattttgaacttttgcaaaaggttcttcaaggagcttccacacaatgtctgtacttcaatgaagaatttaaggttgagctattttctggctgacaaaatgggaatgtatttttatttttttcatattgttgaagattatgatatatcaagttttatgtgtcaaaaaacttaagtgaaaaaatttggagaattttgtttcagaaatagaaagatgtcagattatgatgattctaattactactatttatttaatttccttctatgtgctaggtactatgttaagtaatttatatacaaaatctttaacctaccttgtagcatggtactattatcctaatattcagaagattaaacag

SEQ ID NO: 63079 - DNA, 1033 bp, Homo sapiens
tgttatagatgtaattacttaaataagaaaacaagtaattcattactttaacttttacaactaactgtacttaagattattttcttgttccataaaggcttttacctaaacaaaattaatttgttttaaaaaatcttgtatctatatgctttcatgaaataccaaagcatgcctttataaatatgacatttctaagaagttgaaatctaaaacactgtattgagaatgttcctagtcactgaatgatgaattattttaaatctcaaatttacgttagtatatatgtcagttctgagtttatattgaaataatacacatttttcttaaccactttccatagtttctatatagttcatagattatttatgattttcattttttatctagaagttttgcagttaaaataattcccttctatataaaaaagcttttttgagaattcaaatcattaaagtgatttaaatgttttatcctgatgattatatttttaggtattctttcagtgaacattgtatctgccattgacttttgtatgcatacatgtcatatttgatttagtatttaactttcaaagaggtgtgccctatactgacattcataagttttacttggaatatttaataaatatatgtcttcgaaattatcttccaatataaaatacctctaagttcattcttttcattttcttgttctcatatgcttaaaattatttgtgagaattctaggcaagagttatttttatttaatgaataatgttagttgagtaaatacactaaattgtaggtcatggaaaattaatgagaatttttttttgcttcctgcttatgcatagtgtatctttaattcggccaatgatgttttcatattatttgtcttagtttattcttttatttcattttttgtttttctgttttcttttttctagcttgtgatgaatggaaaatactaccaaaaccaaatcttcatagagatgtcaacagatttggacactctgcagtagtcattaacgggtaaaagaagcacatttccaatt

SEQ ID NO: 63080 - DNA, 1033 bp, Homo sapiens
cacttacaggacatttactttgtaagatgtggaatgctatggaaaacgtggctgggaaaaaattgtggctgggaaaataaacagtgctggtatacaaactaggtcatagattacattactgcttataatacttaaaattatacaactttatatactttgtaaagaattacaaatttcaaaggagttatacattttcaaatttaataaaaattttaagaagtattgatatatcatctttgtttttatctacctcatcatattataatgccacagttggcttaattgaaacatgccctgaacagcaaagcaaagaaaacccatacaattgtgttaacatgaagttaaaaatgaaattattgtatttgtttatttattccagttagtccaaatcaaaatgcgaggccgtgcaaaaagccatgctctctgaggacatcatgttccaactgtacaagcaatggcatggagtgtatgtggtgcagcagtacgaaacgatgtgttgactctaatgcctatatcatctcttttccatatggacaatgtctagagtggcaaactgccacctgctcccgtaagtatttatctagagtgacttttcacttgacagcaacgtaaatttacttttctgtgatgtaaagaagaattaaatatttgaagaagtttcaaaaaatgagaaaaaatattgttacggctacttttgaaaccaactggtactgttaacctctgatttttattatatcatcattttgcatgccactaagtatcttaccctaaatattaacatattgccacatatgtacagcctcttttccctgaactgtgtgtatgttgcagacagtataacacttcatgagagtgttcacctcaaacatcacagattgctttggtgagcctttttagtatcttttaatctagtgcaattcccatatcttttccttatatgactttgatatttttgaataacctataccaattgttttggaggtttctcaatttggatttgtctaatttttccctcatgattagattcaggaaa

SEQ ID NO: 63081 - DNA, 1058 bp, Homo sapiens
ctgcctctctgattttctgtttatggccagtgcagcatcagtgagggtttacttggaatgactgtatgttaaaaagtaatcccatggaaaaagagcttattaaatataaatatataactattaggcaggaagtggaattctctgcagaggtaaacaatcttctagacatgttagatgatctattacagtaaaattatagattcaggaaggaaaaatcataattataggcaggtagtgtgaaggccttccttccctaatggaataaggcaagtgacaatttatgtccttaatcattagaagagaaggctgaatcaatcagggagcctctgttcccattgcatcctgaggagcactatttaaatatctgatctctaaaatttataaaatgcatctatgtaaatatagcattgtgaaaatatcaatttgtaagtaaaaaatatctgccattaactggcagctgaatgtaagtaagttgtctagttaaatttccttacctcttaaaagaaggatttgtaccctagagctaattctcagttgtggtctagtcttttgagccctataaatgtttacatgtagtagctaaagtttagaaatgatatttaatatttgttaaaactaatatgaatagtttagctataaaactttcatacttctcaaaatgacaaattgattttggctaatattgtattatctcagtgtagtaatgctgtttattacatactaatcaggtgctctggcaagttgatactacttcaatttttaaaatatagatataaatttatcttttggaagtcaaaatctttcaatatatgtggtagatgtggaaaggataaaagacaaatagtagaggggagctagattaggatcactttccagtttttatctgtattattaatattactgtgttctctggaaattcctttaatataatgcccttctttccaaaactcatccaggtagtgcttctttctattaaagtgtataatagtgtttgcatttaatttgctactgcttccgaaaaagaaaatgtatcttgagggtttatgttatgctatagc

SEQ ID NO: 63082 - DNA, 1033 bp, Homo sapiens
tattaaagattttaaagccagcaacatcactttggtagtgatattttcaggtaatattgatcataaagcatatatattcatgtctacatgaactggatattatcttaaatgtctttgccagaatttagattctaaatataaagctctcagcaagttcttaatgcttggaaaaaattcagcttttgtcttagcaagaatgtgaggtagtgcataaaaaacaaatgtaggttcttctatactagatttttaaaaacgaaatttgattttggagtgttaggttttatttcaatttaatttaatttttaaaataagtaatatattaacataattcaaatttaggaaaaaataaaaagttataaattaaaaagtttcacatttatctataacctagtccacactttccctccctgccttcatagataaacacttgtttattatctatccttccaggtttcctttatcaggatgttgcatattccaatatcaacatatgcaaatgtgtaaacatgtatccctcctttattatacaaaaataatatatttctgtatttcgttaaacctgagttcagacaatttgcacaacatttttgtgtaccaccaagaaagaaaaaatcttggcaattaaagggtgacagcattgattataaagaacattgcaatgttagaaatattagaatgtgaaaaacctcatctgttagagttgaagaaatatggtatgtaccctctactacatattactcttgtcacttatcaatataacttggatatctttccattgccaacctcttttgtttcttttattataaatgcattctattttgtagtatgattataccctaacttatttagtccctataaacagactcttgatgtttttctttttcattgttatgaactttgtacattgttcattttgtatgtgtgcaggtataattataggataaattccaaatgggattgcttgcttaatggaaattatatttgtaatttttatagctatgagcagattaccctctgtagggttttaccacat

SEQ ID NO: 63083 - DNA, 1165 bp, Homo sapiens
caatgattgtacacagttttcttctttagctgtcactaagatggtgtcataatgtttagagatacgctctctaactgtcagcgtttgttacagttcagtgatgcgtgataaagtatgagggacattgtcttcttgcactgctaaatgtattaatgcagtgatgatatttctcaatgactttttactcaaggtcaaaatgatgaaattcatctgtacttttcaataatttgtttattaatcaatatatttttcatcttagcctgttccttcaagttttttaggtacattttaaaatttgaagcaaatgtatattaaaatttaaagaagactgtgtcatatttttacatttaattgtattttaaattaccagccattatttttcaattcatcttttaaaataaataaaacagcatttagttattgttctttttgttgctacctatgaaaatataacttgagatagactctagaattctctgatctatttgaattctctgtttatgatctctggatataaaaattacttaaaaaatgataatcattatatgataaccattcatactatgtatttagtaattgtgtcttatttacataatcctttaaagtttacaactttaaattgcttgatttcacaagcaatagttatttttgccctaataccaattctatatggtagagactttaggaaatataaccccctttttacagttgaggaaattgagctcattgttgttagtaccctaaggtcacagatattgaacttaaatctagaattttggaccccaattccagtatcttttctttagttccattcttatttgttcatatttatagacaatctgcagattgtatatcactgacataaatattgcaatgtgttatagaataatgaagttactgataatgtaattaaatattcactgcttctggattagcatttctaaatcactattctagtgatgtaatgtcattattcacaaaacttcatggttcattgccaaccctattccttcttcgtatatggaaatcaccatcttcttccactggaaatattttctcagattagagatgccattgtttatagattttcaattactgtagttgatctaatttcacctaggagggtatatattgattataaatgtttacatgggataattacatt

SEQ ID NO: 63084 - DNA, 1082 bp, Homo sapiens
atacataatataataggctatatttgtttatatatcttaaatgcattaaaagaatatgtggtacctgttactgtgcttagaacagctgtaggaattatgatttacaagcatgtataatatgctatctacctttcattctgcttggaaaaggatgacatatatgagtaaaatagtgagtgatatcatccaaattgtatgatatacattatcatataatagtataatatacgaaaagtgtgtgttagaggcagcaaatcctataggagttttgttaaaaatgagttcaatgtagtcatatgtcatcaagtagaactttttgggggagatgaggactaaacatggatggatgccaaaaaatcgcattggcttgtgtacacacaaactggacctgctgagatccatctgctttaggattaaggttcctctaaaactgaagagcgtcatgaattttctggttctgaaaatacttttagcacagtggccccatgaatctctatgccctgtgactgctttatattactccgatgtagccaaagaagtttacttggaattctagcacctgcctttgctcattggcaaatcccactgcttgacccataccattttcccacagctcccactttacctgagttttgtcctggacggtctgtcccaccatgctctcacctaaatccagccttcctacaatagcatccttccttgattcctgttctcattgagactaccttcctggcccctttgccagtgttctccgctaaagagatgttccccacagcttctgtggctggcttctccagaactttctaactccctataccaatctgtaggaagcctcacagtcagtattatgctgtgttctccatggctgagtcagatattcagaacgtgtgttttaaaagtagtaacagcttcaccatagcaaaagcatagcaaagaaaggcagtaaatcctgacacaattatgaatctcaaatgtattctttcttgctgtgctattagatatgagcaataatagtttataaggatatatgtaggcttttgataatttctatttttaatttgctatgaataatatatatgtga

SEQ ID NO: 63085 - DNA, 1127 bp, Homo sapiens
tgtaggttttgcataatggaagttgccacttaacaatattggcccctattttttattcactataatatatttttgagttacacattgactataatcctaggagtactttcttaattcttatattataatactgatctaatttttctcactgggaagctcagctgaagtgcataacaggttttaattaagaataaaaggaggaaagaaaacaaaacttcacatcattaggaattctgatttctgctgctctaacaaaaaagaccacaagcaatatgagattcatcaaatgtgagaaatgataactaaccatgttaggggtcacctataacaaactacaataattgagaaagtaaccttgacgcatttcagttgaagtgtgagtatctgtagtttattatattccagacagtatacattaccaaagatgtagggccaaattaactttaatgttgcactcttcacaagacattccatagctagcaataacattaagataacgctgttaaagtaagaatttcaattataaggcagatgagattgtgaaaacatgacagctttaatgagcaatagtagttgggattactttgataaggaatatagttatcatagatagaaaagaaacaaaatacagcctgcagccttttcttattgtgtcatgtcaccctctattgataacagctttgggttccaattcatttctattcattctcccaacctgtgctagaatgatgatcctttatcttacatatactgttagaacaccttccaattctgcattccttcattcttccaaatagctgatagcatgttatcttacttgctctcatcacatcttggttaagaaagaaaggcaatcaagatattggccccatcttgcaggtgggaaaactggatcgataactcagtggtaatactgggaatagattcagattacttgaaagatcaccaaatgcttattcaggaggctgactttaaccaaggaatatgtaatgaatagaacccaaatacagtatcattctttgtggttgtatgagacatgctcttgtttttgaatttagagtggtagagagagacatgatcttgtttttcactctggaatgacagccttcttttcctctgatcttatt

SEQ ID NO: 63086 - DNA, 1049 bp, Homo sapiens
aatcaaatcatgtaatcaaaagaaagctgaaaataatagcaaaaggctagttttattagaaaacttttgttctattataataatgcattatgtgaagtgcttggaattggcctcaaatactgttaaaacacatattaaagaagccaataattacactttgtaagtttgcctctttgtgggcaccctttgtcatctccttgtggaataatttgagaggtggaggagacacatagacattgggcgaggtaaggaaaaagttacaacacacattccagtgctctaagacctcattggaccacctgctgatccagatatgtgtatggtggagacacaaaaatcataaataacttcccccccagttaaatatcgctgcaattaaattctccatttgagaaaacaggattgaagagtgatgcccttgttgacagcatttattactgtgggctcacctacttccaaaaaagaattgagatgacttacaatgaaaaggaaggacaaaataacagcacatttgctgttgctggtggtgttggtgttgggttttgttttgttttgtgagtggtgtgttagaataaactttggagtcacagcagctggataaaaatcctagctttttctcttataagattttgacttgggtaggttaattcagttctttgaactttgtttccttaaataaaatcaggcacaataatgactaattcaggattgtggtgagaattaaatgagctaaaataggtaaaacacctaggatactacccaaaacaaagtcggggctcaacaataaccattactttcctcccttaagaagatggagattttaaggaagcttacccacaagggctcttttctctttctctgtcaacttattgtcttttaagtatctaagatcacaataaacatctccaaattatgtaaaaaagaaattggccattgtcagaattcattattcaccaaagcttctctgagcacttgctccatgtatgacacctcacacatgaactctggggaatatgagaagtagctggcatgccccagccccagcagaa

SEQ ID NO: 63087 - DNA, 1033 bp, Homo sapiens
tcattcccattttacagacaaagaaatatcagagcaaccagggttaaatgactttaccaaagttattattacaaccaggactagaattcataggattcttacttttttttttttttttttgagacagagtctcactctttcgcccaggccggactgcagtggcactatctcggctcactgcaagctccgcctcctgggttcacgccattcttctgcctcagcctcccaagtagctgggactacaggcgcccgccaccacacctggctaattttttgtatttttagtagaaacggggtttcaccgtgttagccaggatggtctcaatctcctgacctcgtgatccgcccgcctaggcctcccaaagtgctgggattacaggcgtgagccaccgcgcccggccagaattcttacttcttatctgcctcttaatcttgttaggtcaaaatctctcagcatttttagaaaatgccttttttattatattttcagcagatcatgagtctaatataccagcgttacccttttctatgctttccttccttgagaacgctttcaggagagaaatcagttatagttttctgtctcttccaaatagttaaaaacataagagatcatagatgtagtaaatcagtttagaatcccaatgccttgattgggatgcttaattttactataatagcctaatctgaaatgttatctgaaaggcttatttcttcacattcttttctacaccacaaaaattgttcataacaagaacaatcttgggggaaaaataagatgagatgttttagacagcttaatggggctgccactgtcttggataaccactgtttagagctgtcttggattagctgaaggctagtgttgactgaacatattgaacaccatcttaagttgtactttaagtcaggatagacagtccttacaagaaatgaaagctgctcctttgaccattataggtgttctgtggctagagatgaagtgccacactaacagaacaaagcttgcaatttgtggaattgaattccaagg

SEQ ID NO: 63088 - DNA, 1003 bp, Homo sapiens
atgacaaattcttttatttttccataaaagaacttgatggtttttatttgacctactaaccttcggccagggtaattttgacagtgtctgtaagataataaagtggcaattatagtagtaagtttgatttaaaacacctttaacataaaaaagaatacttgttaattcttggaagtaaaaccacaagtgtttatacatgtgaatatatataatattctttaataaattctatatctttagtagatatatggctgttcaagttatatagttcttgagtgagttttggtatttttagattttccaggaatttattattttatctaagttgtcaaatttattggcagtctcttatcttctaaatattcccttattattttttaaaatgtctgtaggaactatagtgatgtcttctctttcattcttgatatatgttgtttctttttcttggtctgtctggctagagatttatcatatttattgatattgtctgagaaatagcttttgggctttatggattttttcctttgtttttctattttgcatgttattgatatttgtatctttattatttccttctctctctttaggtttaatttactattcgttagtgtcctaggagggaagcttggaacattgattagagacattttttctttcttagtataagcatttaatgctataaatttcccttcaagcatcctttagctgcattgcacaaattttgacttgttatattttcatttttattcaattcacaacttttttcaattttccttgtgactatttctttgatctttggcttatttagaagtgtgttgtttctaaatgtgtcacaattttccagatttttaaatttatttttagtttatttctattttggtcagagaatattactctatggtttttatcttttttaatttgttaaggtttgttttatggctgagagtatggtctgtatggtgaaggattcatttagatttgaattgaaggtgtattctgctct

SEQ ID NO: 63089 - DNA, 1050 bp, Homo sapiens
atataaaattgtatttaaacaactactttttgccagtcactatgctaagtgccttattcttatattattctttataatcctcaatgtaaactttcaagattggcattataatctctattttctgtatggaaaagctgtggcacacaaaagttcaataatttattcaaaatcccataatatttgaacccacacccacttcatgtccagtaaagtcatttgggtctgctgaagtatttctagactttatagtaagattattttcaaactctattgtcaaaattcttgaaattgcaaaggctactccgtctacaaacttcaagggacgtaagaggatggttacagactgtcaagaggatgtctgtggtacatgggattggtaatgtagaaattaggcagtgctttgaatgttactgacaggtcacagcacactgacagcaacagggaagaagatattgtggaaaataagacaacctcttgagaaggtcatctcagtatttgtatcactgatggggtttacagaaaagcagtcactttatccactggcagctgcataagttttaggttgcatttatgtaaagaaacaaataagtaacaagcaagctggcattggtggtttctgggactgaggaagaggagggaaaagaaacccctagggctatagctgtaacatacttactcattcgcacatttgcagctctatgtgtctttagcattctgtgaaagctgatgttcataatgttgatcatggaacatcgagacaatactaaattatgtttaatatagacttgttgagaagcagagaaaaggatattcgttttaagcaatttcgcagtattttttttaataccctaaaacggcaaagttttagctcttgtagagttaatgttcacctttctgggaaaactctgtaatccagaatgacttattctctgagaaatccaggtagtttcatacatgcttttgtaccaagtcatattaaactctttcattcatagttttgtccatgcttttgtacttataataggttgcaactggtataataattacagt

SEQ ID NO: 63090 - DNA, 1039 bp, Homo sapiens
gtggcatcagaggatgatagcttcacgcaaccatctcagtaggtttaagatatgccattgctttcagcaccagctggagttcatggaccagggaaaccctctgtcttaggtgggcacagccagcctttgttctgattctccttttcctgtaggaaaagcatgtttttgatttcaggataattatacctgtcctcttagagctctgctcattgcgatggtgttgtccacattctaagcatgctcaatgttgaatataaatcatacttaaattacagaccacacttttttctctctttttgcatatactattccatctttataattttgaatttttctgtctcctgattattttatctatccaaccactactggaatgaatgctttttgagggcaagggtgatttcaaatctgtttttctcttcaattccccttaagcataaaataaaatgccagcaagctggcaagttctcaataacagtaattgatgatgaaccggcctccttgcttattttatcttttcttacttccctacttggctttgaatttgctcctcactttcttgacttgtgtccaaccagacacaaaaaatggaaaatgtactactttatgccttgtaaacgttaggtattcatgtaacagaatttttcccatatatgggagcagagagtttccatcaccttcagattcatcattcatggtacctgatgatatcttattgcagaaatttctatccaaagttcatttatggatgtttattcaaagaaataaacattttctgcaccttttcatacattgagtgaatgtcttgttcttttcctttcagcacctccaaggtaaatgggatgcaataagtaaaatagtttggcactggtcagataagatggataattataggtacttgcacagctaatggaagtattgttttaaaactgggatgatttccaaaacaaacacttcactaatgaaaacaagtctgtgtgatatacaccaaggtttttctcgatccttcacgagatgggcagactgaaggcaactgcca

SEQ ID NO: 63091 - DNA, 1224 bp, Homo sapiens
tttgtcagccaaaaacagatggttaacatgatttatatttttgttcttattgtagatcttcaccatttaattggaatcagattatcaggctattttgtaaacaacctggaattgaggtgtttgttttatcactgaatatgataaataaagaatgagtggggatggataacatgtttggctgaaccagaaacacattgcatgggccatgttggggcaaaacagatttttgaagcagttctagttgtactccagaattcaggcctccacactgtttggggtatgtgaaaggtttgtaaaagcatgtaaatatcatttgtgccctgaatgaaacatgcaaaataaaattctgtttaaattcttcacaaaactgaagaaaatcgtttaaacccataacttcgtttgaaattcctcctaatgacctgtcatttcctccttttgaaatgatcctattacattaatcagattgatgtagtggtgatagattattctcattcaaaggaatactcttgtgttgtccttcccaatctaccatctagaatctctaaccaagaagagttcagaaagtgatggctctgttccctgcctttaggaacacacagttttgcttggtttgattggagctttgcgttgcctgctttcagtggcgaaagaggcccatttgtgaatggaaatatcgtctccttcagtacctgctccaagtaagactgattcacatgggccactcaggcctgcacggggctgatcgtggccttctttgttttctagcgtttgcttttggtgggtgtgctggagagcctgttcaggagagggcttctccctcccttactagccagattcataaagcagagttggttttacaaccatctattttttaccaagcccataaacatctatgtctctggcactgcctgtggctccggcgtgtgtccagcatgatgatttggtggcacagagaggggctgtttacaccccaacagccaaaccttccatttttcatgaggcactaggaaaataattgtgctccttcccattttcctcagcattggtttccaagctttgcctttgttaccatattttgctgaacctgaccatgctttaaggataaaatgtgctcggaaaaattggtgaattttgtggtgatatgtacaatcatcttttataatttaaaaaaattccattaatatgtatctgttctgggttgtgggagacaagcctttgttttcc

SEQ ID NO: 63092 - DNA, 1004 bp, Homo sapiens
acagagtgcttcgatgcacaccagaccttcagaggaccgactgagattcttctcttagtgccccagagaagatgatcccatcagagaaggaccctaaagagaatgagagagaaggcccttggtctttagaagagaccagatggtattgttctgttagagtaccactcttccttctggagtatgtttctccagcctcgctcagggctcccttggtttgagtgtatttgccgatgctggcgaagacacacaccgtgggtgaccccagtcagatcagagtggggattcatctctgccctcttctgggcatccactgcacggtattcacctcttctagaactcttagtgaagttgttcattggatatgaatgtgttttctgcacccaattttgaaagcatagattgcatccctaaactgctacattcgatttttgaagtggtacactcgccgagtacctactttgtaacacacagaaaagtgtaactcagcctgttctcaacaagcttggcatctggccaagagacattcaaataacaataaactcaagacgtagttaatgaacagtacaagacagtacagacaggacgtactgtaggagtttgaggggagtaaaacgcccccccggccccttgtgggctcacatgctccagggaagggctcttggcacagccagcatccttgtgtttaggggatgcaaaacaaatagttcctaattcagctttatttgaaaacctcccagtttcccagttgggaaaaagccaagcccaaacaagatctgcatgtagttcagccttaggaacacgacaggcagaactgtcctctgcttttcaaagtgtgcattttatacatctaattttatatgtcaactgcgcatactcagagaaagataccaaagtctagattttgaaaatgcaactgaaggagtaactgttggactctgccgttagtggatatggcagaattagctcaggggcctggggtctctagagggtttgcttctggcttt

SEQ ID NO: 63093 - DNA, 1843 bp, Homo sapiens
ttcaggaggagttaagcctttttctagactacttggtgcttttattaactgatgcaagtattgcattcatcatttttttctactttgttgcctttaaaaccctgtcttccattcaaatgtaatgctttgatcatttaaatagcacagttatctgaacacaactgtgaaaaacctcacgttattccttcattgagttttaacattaaaattcccaggaacattagtggttcttgaaaaagggaccgagacgtgaccctgtgtgagcaggtcgccttccagttttcaccatagcagcatggaggggcactagcttgagctgaggtgcaagaagcacttgaagtttgctttcaagctcgcaagggccggggtatgaattgcagtgaaaattgttccatttctttggggagaaagtcctagtccttataaatatggtattctcatttgtcaagagaatcttatttcttttatgttatgttcacctgaaatacagtaggagtttgcttgtgattaattaagcagatgataaatggcacttaaaatgaacattcagcacctcccgccgccccccatgtgtagacagaaaacagaggtaattggatgggaaacagtatggcatttaaaccttgccttttttttttttttttttttaagagcctttcctctgccttatgcagataaagagagaccggcctttcagaattgtgtaatgtcccagacatatgtggaaaccaatcagttgtgcctgctccatgccctcattttgtaagtgtgcctgctcaattgactgttggcaaaactgtgctcagtggcacatcagtcgttaggagctgccaccacctctgtgtgaagtaacgtggcttttctctcttgccacttagttccttggggaggttgcttcggggagttacatttcaccattggtgaaacacaaacctgtttggaaaaggcaaggttgtctgggactgtgttaaccacatgaaccctcagaagcacctctccttcccaaggactgtcactggtacagtgaagcctggtgccatctccggtgagcgctgggggctctcctccctgtgctgccactctgggccctgcactaagggtctgggcaagctatagaatagctgccgcaagctggtcctgtgttccaaagctctgggaagaaattccccttggttcttgctctcccacctactacccccctacctcccaaaaataataaagtaaaataaaatttaaaagataaaaagggcagctttcctggaggtataccagactccatgtctggatatccacttggggtgcagcagagtccatgcctagatatcaatccagtcctgtgggacattgtgagcagcacaattataattaaaacagcgacaataataatggcacttaggctttattgccctgctagtgttccacagactctgaggttagaattcccgtgcaaatgatttattaaggaagtgctctctgaagaaactaataacggagttggggtggggagcaggacagggagggggagaagccacgcatgggagcagattcaaatgaggccctgtctgatcccaggaggggctccagagcataaataatccctgagatgtatcctgcccagaggcaaagagctgggcttctgaatccaacactagtcagtcattgattatggggcacctggcctcagtggggagtggaggtgtaaacaggctgggcagcttggtgccaggggtgctcctttgagggccacaggtgcaggctctgagcagcaacacgcatggaagctggtgagtgggttcaaaggaggtgcgccgggatggggtgctgtcttatgtagcatcacaat

SEQ ID NO: 63094 - DNA, 1042 bp, Homo sapiens
tgaggatatttggagacttgaggagacagtctagttaaaagcttgtgctttttttttcccctggcaatttgtaagttgccctttcttatagacagaaaaggtagagttacaattaagtcagtctgtgtgatgctgtgtagagcgtcattttttcacaatgtgctgaaaagtttattgcctggtgacaaaaaagtcactctgatttcattttcaaaagttgaatttaaaactcagaatctagtttctttataattatgcttcttatttggcaacatatggtgaaaatgtatacggcctatcaatgtgaaagaacagagccgaggctctagccttttatggtgattacatctacctgtatgggggctttatgtacttacaatttgaatcatttatagatgcacactcaacacagttctagcataactagtactgtgggttttttttgctgactaaatgataggcaaagcaattttcaacaaatgtctcccagtaggctgtcatcatagaaggcttgtaatattgctttttaaccttagcaatggcagctatccagaaattattgcattgataccaaactgccttgcaccaggcaattgcccttttctccatgggaacccggtgaactctcaagtagatgcctgctcccctcccctcggattctcttgttttttatttcagggagatcttttacctgttcttgttcagctgtaggtagccaagcacattgaaagtttaaaaatacagcaaaataattctctggattgtgttattatgcctttaatgcattcagttaacatttggagctttgtcaccagataaacggtgcacattggtgcacaaagagaaaaggaagggctttgtttcccacccctcttagacagagacagatctagctttcgtctctctttctccttctcttcttttcctttctttcactttcagaacctcttgaaatgtctttgggggattggtagatcacgagtctggggttttgggaaggatttgttgaggcttctgggaaagaacttgaaggaagcaaatg

SEQ ID NO: 63095 - DNA, 1082 bp, Homo sapiens
gggcaaatatcctcgatgctcattcctaactgaagaaattggacagcagggctaagaaaggcaatctgagttccttctttcttattttcttcctcccacatctgaatcaccaacttatacacgccctttcatctatctataggaccagaatggctccaggggctggtggggagagggagccgggggtgggcaggagaacaggctttcctttgtccatgtgaatgattggggttggggttttctcccttgggaagtgagtatgagcagagcgttgtctgaaggagttcatttcctctttacaagtgtctctggtgccctttgggctcaacctgattgtggctagagcggccactggcaattccccactccatactggcatgatttccaattcctgcaagagcagaaaagatggccccgagtcttattctcagagtaattccccacagcaaccgatggaatgggaaaacatttgtataaatcatctaactttaccttctcagccccgtgacaggggtattagaatatgcctgggttttcaacaaggaaattcaagctcagcaggtctaatagattgactcctgactttgtggttggttagattgaaaggagaatattacactcaaattcgaggccttttgatttgtgtaaatgactactccctatagtttaggagatggaggtggcggacaggaacaccagggtagcgaatggtaggaatatttcaatggctaatatcctttgacatccacagtttgggagaggaagttaaaatgtagccaacagaacagaaaccgccttcttctcctttatttcccgtttgtctgtccatgaatcatttgtgcctgagctatgatcgctgtttcattctggaaaagtgaaattttaaagaaggtacccaaaccattattacaccaaaaagataaataatagtaagaatggaatgatttatatacctcagaccacaaaagacataaactttgagtattccaagataattcacgtgcaaaattgttgcaatatttgtactagtatttattaaaatttacatttgaataaaacggtgcaaaatgtaaacaaagctg

SEQ ID NO: 63096 - DNA, 1039 bp, Homo sapiens
gaatggttctagaagaatccatcttctttattctgctttccaggatcctcagagttggttataaaatatttaagggcgagaaaaggatcgcaggagccaggccctgagatgagcttggagtccctgtttcagcacatcatcttcaccgagcatcaggcggaggagagtcgccgtttgatgcgagaaggtcggggtatttctgtcctttgcatggggccttttgtcttctgatgctgggtgcttggagcagaaggaaatcccgaaggcagtggtcagagccgttaggggagcttgcatgccatgctgagggaaagacaactgaaaggtggcttatcaaacgccaccaaaatggggactttagaaagattgatgtgtttaaagatttaatttttattacagtaaggtcggaaataaccagatgtcgtgaaaaaattaagaaagcaacggaggagctgaatgaagagaaaatcaagctggaatctaaggtattgaaatgtaaagcatactaattatcacttgaaaaagcctgccttaacttgacttttgggggatatttcagtgtttaaccagttgtccttcaagtaggaagcacgttactctgtgctggctgttttagttccatgttgcctggtgatgtttaaagttctgaatcccgtgacaccttcaattccaagacgaatttgccctaaataaactaaggtaatgaagaattcattgtccattttgtgggatggttaaggttttaaaagagcacaatgtcattagaagaatcattattccacttatttaataagtagttggtgcagtatatacattttgaatgataaataatttgtgtgctatgttgatataacaattgcatgtaaatttcaaacaagcccctgcctttagttttaaaagtctctaccacattttagacatgccttgcgtccgaagtataccttttccattagcgtttctctctttcctgcagcgtttgtaatgttctgttattttaaaaagaagcaagagagtctgatggcttcttgaaggatggata

SEQ ID NO: 63097 - DNA, 1021 bp, Homo sapiens
ctgatataatatattttttaatgttactctgtaatattttctttgttagcaaagttttgttttgtctgcaaatggaaatgtaatttgttgatatatacacatacattaaaaaatgttgattcagttgtttttactagaaagaagacagaaaaggcctaccattgtttagaaacatttgttgaaattactaattaatataggttcataagcatgcattgctttttaaccagctcatatatgtgggtaataatacatttgtatcttactaataaaattaacatatgagggtcacagttcatacaatactaatttataactgaaatagtttgatttgtattatagtcaagatggtatgtatatgtgcataaagattttaaaagtggaatcacaattataatgcatatgactaatgggaagaactgaagaactaatcctaaattgatttcttgtttcttttattctgagttaattatatgtctgccaataacaatgaaaatatatttacttgaatatttgacttggcatttattgacccatttatcaaacagtagcagcacaaggagaaactattaatagaacataatttgaatagagcagtgcttgagctattgtacagtcatacattcagaaaatttggggggcatttattttggatgttgtttctggtcaataaatgtatttgggaagtacagtattcattttttttcttttatgtaaaacccggatagcatgtaattagaacttgaatgatagcatttgccttgcagggctcaatgagtcttttaaaatatatggttgcaaaagtctcaggttatatagtatgagtactttatgaattggacagctacactatgcctggttaggtttggtaatatgaaaacagaaaaatgagaacatgccctggatttgcattcatgcttaccaatacatccaaaacttctgatagttaaggaaaagttgtatagtattgatgacagggcaaaccaaaattaaggactgacagaacattggtagtttcttt

SEQ ID NO: 63098 - DNA, 1059 bp, Homo sapiens
caacccttttgcctctggactagactatttctaagctctttactattcaatattgtctgggacagagatttcacaacctgtctctcaccttgaggaagttcttataactaccataaatcttgctttctgcaatttaagttgaatttatatcctttttcttttccctgtggagatgggaacagccccaaactggaaacgatgctttcttatgagggctagtactgaacatagtagaaaaattacagtatttccagtccagcatcatttttagctttcatatattaaagcttcctaacttcatttcaatattcatctcaggagatgttattttttaagttccaaatgaaataacagttgcatgtctaacattaatgtttattataccttttgctacttagaaccaaatgaagtattaaaataaaaaatgagttctcaaaacccatttaaggtctttagcagactcgttttttatttgatataactataatcatgggactgggtttttgcctctgctttgcagattttatcttattattttattagttatattatgtacatgatttattcattcatatattccttataaactgtgaaaatagaaacttattatctaaaaacaaacagtcttaaagcagatttcaatgtgtgtattcaaaaagcgttagtacctagctaagaattcttctaggtattgagaggaaaaagaaagcacattctctgcccttgaggagcctatagtcttattaggggaagagattataaaattgtaactataaagtacttaaaaaataatacaagatagtgtatataaaataagatgtttgatgctaattttattttgcattttaaagattaatacagaatatattttatactagacaaatcttctctgttacctaaggtactctaaaatgtctaattaattgttttattctgatttctgtttttgtactttgaaggttcaacagttttttgaaaaatccttcttcttacagcttttgaaagctcatgaaaatgctttagaaaaacagtacagtgaaattacaaaccataggaata

SEQ ID NO: 63099 - DNA, 1062 bp, Homo sapiens
tattaatttgaagttccagatgaggacattattttcttctctgtgtattctgacacgtgctaataaggaaacacttcagggcctagaaagtgctacacataagttcatgatgcgttgggttgatgactgataatagtgaaattaattatatcttttcttgagactcagtatttttcacatcccaagagataagacaactctcctttctgttattcctaacttttggcgggaaatgattgaaattacttttaatctttctagattccagcggtgggaggaaatcagtctgctattttacttgacatttgttactctggttttgttcttaaaaagtgaaaatgtattttctgtatggattatttagatgatttttatgcatttggataatgaatgtatgatatttgaagtgacatagtcataaacacaaggagtaaagacctcaagttttaaaatttgactctcattgattaacaatttagtgttacctttgctggcttaattttaaagaagttcctgcactttctaggtttcatataagaaaagaaacctcattactggatctatgaagaagcaaatgaagccttctttcacataaatcgtataggaaatatgtccactagagctgaacaaatgcttcatattagcagtgtattaccttaggcaataattttagtagattgtgagacaatatttgcaatttaattttatgttaagttttataagcataaaatatcaatctcttgggtgatatgtatgatgcagaatgagttttgataatgacaatctgctcattcatttttttttgcactttaaaaaatggtgatgcccactggtgtcattagagttagtagtgtgagggcttccaatctgaactccagttttgtaggtttatcactcagtcataaaaatgtgctctgggttaaaattaaacacacaaagtctgttagagaatgctttttccttcacaaatgatgacttaggaaatttggatagaaagaaataccagtgcatatatttagtccattcattgcattttagcagttattaaattaaatgccaata

SEQ ID NO: 63100 - DNA, 1038 bp, Homo sapiens
taattaactaagaatatctttctacactccttgagaagaaaggggcaaatcagaataaaacagactcaaatcaagtgttattgaaaattcgccttctggctatctcttgaaagtaacacctattcatcctgctttattacactttctacagatgtgtgttttttctttttttccagcactaccctgtggtcattgatatttaaagtgataacctgaggaatggcacctttttacaatatcaaataataaaggttatattcattcttcagtacttgctaaggcaggaatgtgactaatagaaaacatccagaaagatcaacatgtaaaagaatctgattaacctgaacttagcgctcttgctcatttcctttctccttgtattcttccttctatccattctttcatccatctctccatccatcctggctcttgcctacctctcagaactcatgccataccagctctcctccttgtagactcctctccagccatacagatctttctgccccccaaataggcccaacttgttctggtgttaggatcatttcatgagctatgttccctctgcctgggttgctccaccccctgatctctgtatggctgtcagcttctgtcattcagatgtcaagtgaaacgtcacctcctcagagaggccttcctttaaacaatctatgtaaagtagtcacgcagtcacactatgacatatcctagttataaattctcttcatacttcttataatttgtgacatctttcttgtttttctgttctacttatcaccactaaaacagaagttccatgaaagcagagtattctttatcttgcacatcgcttatcccttagagcctggaacagtgtgtggtatataggaagtgtccaataatatgtgttgaaatatggtttcaattaacttgttcatttaacctatatttattgcttaaggatttaaatataaattattgattctctagttaaagaaactggattcatttattgttgtttatctttcttgggtgaattaccctgtcttatttcttact

SEQ ID NO: 63101 - DNA, 1067 bp, Homo sapiens
ggagggcaagcacccgcctgagaagctgctggtgaaggatggcactcggtggtgcaccgacgtctttgacaagttcatctctgccgaccagtctgtggctctgggtgagctggtcaagcgtagctacaccccggccaagccctcccagctggtcattgtcatcaacatctacagctctgagcacgacaacgtcagcttcatcactgatcccggggtgaagaagtgtggcacgctccgcctggatctcacagggaccagtggcactgcggtgcccgcccggagggagatccagacccttatgcagttcggggacaccgagatcaaagccacagccattgatatagccacttcgaagagtgtcaaagttgggatcgacttcttaaattactaaccctcccgccccgctgcctgtccccttggactcaacttatctgcatctgctgacctcaaccttgactgttctttccctaaccttgaccctcaccattgcccatgtgaatttcagcagggaagatgagaacaatcagggctagaaataattagtgacttttgagggcacactggagtcagaaaaacagaaattaagattaaggtttaggcatagaaaattaaaggatcctggaggagcagctagttttcataggtacaaaagtggtgaaatggccacggagaagggaatcagtacatttctgcagcagtggttgcgctgctttgaacagatctccgttatgtagaatttaggatgccctattgctgtctttctagatttaaaatgagatctttgaaccaggaggagatcttcatctgagacttgtctttctaaattttttggatggccatcaatataaaatgccacccatctgcagttaatttcttttcctcatcatgtgattaaaagtggtgattcagtgggaactgggaatgtttttagctggtggtagaaggctgcctacactgggcactgttttagattctcatatcatttaaacagcaaggaggttcagggaagaataaccgtagccttgggtaatccactagggcttttgtgagtaggagagctgatacct

SEQ ID NO: 63102 - DNA, 1048 bp, Homo sapiens
agtgggacttacagtgtgggaagaggggacaaggggcggagcttatgccaccctttctcccttcccatccctgtccctgctgccgtggcccaggcccaccttgctttttctggccctgtgggggcctcactgccacaagtcccacctggcaggctgacatcccagtgggacatggtaaccgtaatgtagcgtctgggtctttgcctttcttccttcacaccaactccttgggctccactcatgggtctactgccatccccagtttattttcaagtttgaactttggaggagaattgtatacatacaggcctggcagtttctttgcagcaagttgtcccttcttcctcaccccgttttgtggaagcttcccccttggaccttctatgctcctgggaggtccttgactccacaacctcaaggatggaagaatcagcacaggagctgtccctcggaaggggcccctcttggtcttatttgggatttcttcctcccgaccccttgggatccaggctcagaggtttcacctttcccgagggcaccatacgtgtgagagccacatcctctttcactttaacctccagccatgtttgtgctaaggatgtctaatgtgaccctgtgagagtgaagctggggaggggggacttttacttgcttgaatagggggcagtgggaaatcctgtcatgcacctgagtcagggccctgttgaccgatgtcacctaagggcagacccagcttctctgacccatgggctgagctgacaggcattgatgctgcccgggtggttggccgtagctgagggtactaggtgatgggaagagggttcgccacggacagtgcaggacacgagagtggtggttcttatctggttttataaagtcagccttccagatgtggttctgccattttgaggcatttggtatttacagagtgaagatgttcagtcacctgcctgctggtagtatcagttttagcactgaaagtctcacatcccaggaaatctctctatcctgagcaaactgggacagtgggccaccctccctctctttc

SEQ ID NO: 63103 - DNA, 1036 bp, Homo sapiens
cagtggccagcccatccctgtgggcactaggggcggctgctgtgaggatctggcttccaggcaggaatggcgagccatgctcacctgttgttatggtcccagggacaggacagagctggctcctgttgcacttaagcccctgggcgtatgaacacccacgcctggggcctgggtcagctctctgtgtattgagagtcagttttgtgagtcttcagctgaggctgggttgtgtggcaagtcaccagagtcattagatgtcccctccccactgtcatgactctcaggaagcatcctgcccacctttcccaggagacgtacctctgattttgtttgtgacactttctttacaaaaaacccacagagtcaaccctgagccccagcatagttgaatggccatgggaacctcagcaccatgaattgttttcagcgctcactcggaaggcttgactccaagtagcacacagttcaacttgcgtgcagtcaagggcgagtcgtctcctccctgcactctctccccttccccaggctgcttcccctgcactcccctgcctccttgcagtgtgagaatctggctcagtgtatgtacctgccaaaaatagatctgtttttatagggatgaaggaagagggtggaagctccagaaagaggcaagctctttaaaaagagaattacaaaatgcagtttagccattcacagaagccctgggcatcacggagcacaagctccatagtgtcagccttccggcagggcccagaaatggggcatcgggacacagctgtctgcagagacgccacctggcgttctgagtttttcccaggaagaatattcaagattcatggttttgactcttttcccagccccacaggaagacttcagcaacaaatgtgtgacccacgaaaaggtcaattcttatttatagcctgaaaaaaaaaaagagaggtgcagtggctggtgaatctgtcaggggagtttgagccctgggctggctcttctaggaggtgggacaagaggtgtggggccctcacactggggagtc

SEQ ID NO: 63104 - DNA, 1008 bp, Homo sapiens
tgtcagttgtccaaagtcacatgattaggaagtggccaaagggatttcctctgatcctcctttctccagcccacggtcccattcagtgagggaaaggggctagagctcccggcttgcagaatattcaggaaacagatctttgctctctgatgctggtaagtttgggggaccctgaaactggctcctgaagagctcatggcaggaagcctgggttcagtgaagccacaggaggctgctccaggaaccagctgccacttgacctgttgcatttctttcccttggcttcaggagctgagtgaccaggcgggttcggagttcgagaactctgatgtcagatgggtcatcacggtgcctgccatctggaagcagccggccaagcagttcatgagacaagctgcctaccaggtgagggtagagtcagggcgggtggaagccggaggagaaggactcaagatgtccagggtggtgactgtagccccgcccaggtacctcccacattcactggcctccatgggaggcagcaaggaggctcccctagccagggtgggagctgggagacaaggagccatccctttcctcagcttcctcctgggggagccatgggggtcagtcccacaacaagagctgggttcggtttccttcctggctttctacatttccaggtcatgtttctactgcggagtctccagggctaggatttcaaagctgtggttcagagacatttctctgtgggtgaaatgaagtgagaaccttaagggaaaggcttgggaaacaggaatatttgaacaagaaagcaagcaagccaaggccattggccacgaaccaggcattttcagcttggtgtggaggctgaaaactgcatgtctgccgcagaaaagaagggaagtgtgattgttccctgcacacttcactcagcgggggggtgttggaggtggcagacccctgcagagggcagtggcatggccaaggggcataccaggcacaggcgcttgttggccagggagacag

SEQ ID NO: 63105 - DNA, 1033 bp, Homo sapiens
ttttccgttttttttcccctgagaatttttgagcatcattttgacatcctaagtagtgaagtagagaaacagtagcatgtctctactggctgtgtatatttctgtgctgtactgatggacattcgctggtgaattatctttgatttggaatatacagatatatagatgtgggtgtgcaccatgtgcaggtatctctgaaaatgttacccctccataccttctgtgcagatcagttttcaatcattgcacagtgtagctgaattttaacttctgatggaaaaagtccatgaagttcggctgcctctaggcctggctgagtgatcagcaagtcaaatgatttgtttaatattggcccagttgccgtggggttgaagggaggtacagcagaaccaaaaaatccttgcttcttgccctcaaagtatcctagagtcccctggggacccaagacatgtgttccatgtgtggctcaaccttggctattttgcaaatcagtgagaagacccagggctctgagaagggctgagtgatgggataattaggaccaagcagcagcggggtggatagtttgtctgcagataatagcttgtttgctaattgccaacaccagattttctgggcaattagacatttggtttctttcaggaccgtctgtgcaaatgtggacacatggcgcaggccttccaggtagcaggtggagagggtggcttctggtgctgatggcatttctccgcaggctgcccaagggctgtgggcagggaggacctctcaccaacaggtggaaggaccatctggctggaacccctagtggggaggcagagttccccctgcattcatggaaggggttcccttgtgctgggagattagcaaagatggtggagatcagcaggctggtctaggaactgagctgacttctccattctcttttcaagagcaattagcgcccacggctaatagcaattctgttagtcgtgggtgctaatagaaatcagaaatagcttcccctcccagatgagcaagttgatttaaacttttc

SEQ ID NO: 63106 - DNA, 1040 bp, Homo sapiens
ttcagctgaagaaggatgaaccttcaccttccctacccttacctcctcttccctctcccctccccagggacaggtggtgagtgtttgggaggtgaaagattctgctcaaggggaaaccaactggcctggaatggcctcggccctttctttagcctcagtccaggcagcactagctgtgccgtggcctctgaagactgacctgtcacaaggctgttcatgatgaaattggggaagtctaaacccagggcttccagaggcccaggcaggtggaatcttgtccttgaagctgaagagagtcttgacagtgacccagtgagttttagaatggagactgagcttccctgtagaatacaggaaggctcaagctgtggtcatatggcctctcaagttcttctaggttattctgaaagttccctggggtgagcagacagcttggggggcaaactggggccagagggtctcctttacccctggcagcaccggccctcacgtttcctatcactaaattttcctgaaggttccctttgccaagttcctgtctggtgggaatttttagctttgattaacaagcctagagaagcaaaacgtaaaggaaatgtatttgctgacattatgcaaaggtgggggctctgcttgtgtcattgtgtaagcacacggtcgttttttcagcagcagttggaacgattttataatgatgatggtaacaataataataaacaaaataacatccataatgtatcgggtgcttgccatgagccagattttacagatatagatgcccacccagtggcatgcatctaggacgtggtcatggtgggatttgagctcaggctttcccgactttgaactagtacctctaacatctctcttaccaatatgtgcctctcctacctggatcttcggatttgagagagaattatggttttcgaaatagagctttgcagaccaaagaatacgccacacagtctcatgagcctgcagacagagacagccaggagctgccctgtgatggtgactcctgacttcctccagctatttgc

SEQ ID NO: 63107 - DNA, 1113 bp, Homo sapiens
atggctgaaaaccatacaaatttattatcttacatttctggaagtcaggaataagtccaaaatgggtctccctgggctaaaaccaaggtgttggcagaactgtattccttctggaggctctaggggataatccatttcattgccttttcaaacttctcgaggtgacctgcattccttggatcgtggccccttcctccatcttccaagcccatcactccagcccctgctttcattgccacatcccttctctgactctgcccctcctcctcccattccctttctaaggacacttgtatgaggacctcttattaggcctacttgtgtaatcatttccccatctcaagatccttaatttaatcacatctgctgactcccttttcccataggagataacatagtcatcggtaccagggggctattatcgagcctctcatagccagaaagattggagtcttgcctaggtttggggtgttggagagtcttctgtgtccctcaggagctgtctgaagtttggaaatgactcctcctccgtgttgtacattaggtcaggttcctcgtgcacctgctgcgggttgccctccctggagtttggattgtggatcaacccttgacttctattcaatctcagtagggtccttagagacattgttacttttagggctgatttagccccttctgaggggcccatgactcattgagatctgaataaaaaggtttattggctcccaagcagggaaaacaatcaatgcattaaacaagttattgaaatgtctataaaatgtcacattatatttgcttttactatgtagcaaaccaccccaaagtttaatgggttaaaacaatagtctttttaaaaaaatttattttaagacaaggtcttcctctgtgacccaggctggagagcagtggcgtgatcttggcttatgtaagctctgcttcctgggctgaaacgatcctcccacctcagttttgtgggtagctgggactaaaggtgcacatctccatgcctggctttttttttttttttaaatagggacaaggtctcactatgttgcccaggctggtctcaaactcctgggctcaagcaaccctcctgcctcagcctcccagagt

SEQ ID NO: 63108 - DNA, 1044 bp, Homo sapiens
gaatgactatgaaggacgccctgtgatccccatttcacagaggaaaaagctgacagtcctagcagcgcacagctggaagggggcctaggtaaggacctaggccatgggatgcaggccccaggtggtcaagctgaacagcctctcctggcatgtgcctggcatgtcataggccctcagggacttgtgttgagtaggcctgcggctaatagagagtggctgccctacttccttcagccaccaagctgtagatggtagtgacagggcgctggttatagcccccaaaggaagtaagcaaaggtcagggtgatgctctgggcattgcaggttagggttctggctatgggatccacttccgtgtcaacatctgctgctgcaacttgtctgccgccttggtggtcctcccatgccttctgtgtatgtccctacacagtgtcttgtgtttcccagagccttgtgatcgcctttggccctggacacatgcagtcctccctgcttgggacatcctctctttgtttagcaaggtcctactcatccttcaaaactcagttaaggtatcacctctcaggaagccttcctgggctcatccatcgggatgagatctgcctgtgtggtcccaaagccttcggtacttaatggttgataattccaactagtgtttgttgaggccctacgatatgccagctttgtatgcctgtatctcattgactcctccagcaaccctgtgaggctggcattattattaccccattttgctgataaggcaattgagggctttgaaaaacttgctaacttgcccaaccagtgaatgctggagttgggatatgagtcagccatggagcctaaaatcttgtgctgtttctctcaatgctctttcttccgagaaaggcgtggactatgtctttcatttccatttttttttactaaggacactagtaggtgttcaataaatgtcttactttttgttgagtgtcagtcagcaagacatgagggaacacagcagagggcaatggcgtctacatcttgcccactccgcagtggtgctcc

SEQ ID NO: 63109 - DNA, 1016 bp, Homo sapiens
gtgagatcttttggatacataagaaaaaaatagatgtaattatgtaattttaaaaaccataaatgggctgggcatggtggctcatacctgtaatcctagcactttgggaagctgaggtgggtggatcactggaggtcaagagttcaagaccgtactggccaacatggtgaaaccctgtctctactaaaaatacaaaaaagtagctgggcgtggtggcacatgcctgtagtcccagctactcgggaagctgaggcaggagaatcgcttgaacctgggaggcagaggttgcagtgagccattgcactccagcctgggcaagagagtgagactctgtctcaaaaaatacccataaatggtggtatactaacacaccattctgttccttgctcttttttccccccacttaagactatatcacagacaacattggaggatttggatctgggcaagaatgtgccccagtttatgtgttacaaaactcaccctggctagcgggagagagtggactggggtggggacggtgggtcaggactgttgcagctgctgcagttgacggctgtagctctttgtccgtgtgcagcctgtgctccagccaagtccacccacacgctcattcattcagtgcttgacagtcaataatcgtgggcagaccctgggccacatgagtcaggctctgtccctcttcccactcactgtgccccgagccatactgctgcacactttgccagggcacaggccaccttctgccatccaggctcctctgccactgactcctccaaattcttccagacatgtctccaacgtcacctcctcatcaaagcctctcctgatccccacagcaccacgtcgatggtgtggaaagagggacctggactggaggtgtctcagccccagcccttcccattggcacttcctggagaaacagcttagtctttcagagcctcagtttgcccatctgtgcgctggacgtgattggtatctgtttaacacattgcctgtgtggattacgtgggaaa

SEQ ID NO: 63110 - DNA, 1066 bp, Homo sapiens
catcattattattatattattattattaatgatatcattattacattcccaggaaattctgatctgttgggttaacatttccaaggtgccaagctgtgggtctcttcaagagaacagagacacctgggcaggatgaattggcatctttttgcccagctaatcgataagcttggaactttgtctgggacatagtagatgcttgagaacacccaaggcaggagtgaagcctgtttaccgagatggaagattctgcaggcagggaaaccacatgcccgtggaagaggagaggtgaactcgggggtgctggcaggggctggaggtgggaggtagtgaataggagatgccaaccttttctcaacaatttagttgcatcttagggaaaatgggggctgaggagggccctatgatgacaacttgaattgggtaaaatttaaggataaggaattactaattagtaataaggtagaattcttaagtgtatgaaatgaataatatgtagctaaaaaataatgatatagcattaggcatttgagacatgtggactccaagcaattaacctctattcttcttctgaattgcaattgcactaattggctgctttactctgacggggcgatattaacctttctgcttttctctaaaggagccagtatgttgggtggatgtgctgctctggtttggaggaaaggtatttttcctgaataataacctatttgcaatttttctcccaaatggttgcattgaaaaggttctgtcagattttcttgataaagcttcatctatggaaaagatgctttaaacacatctgacctcctttgggagcagttgggagaaatggcctatctaggctcttcaagcttcagacatccttgtgttaatagcttctccttcatccaagcagcacacacttgtggagggagggcctgcacattccaggcctgtcctgggtgttggggacacagcactagccagacagtctcctgctcctgtgcagcttgtaactcagtgaaagcagaatatcaaaggcaaataaacacgtagatttagaatgcaatcccagggctat

SEQ ID NO: 63111 - DNA, 1012 bp, Homo sapiens
cgggaggctgaggcaggagaattgcttgaacctgggagtcggaggttgtagtgagccgagattgtgccactgtgctccagcctgggtgacagagcgagactctgcatcaaaaaaacaaaaaaacaaaaaaacaaaaaaaaaaaagaaaagaaaaattacattaacaatatttgagggaagaatgttacagttataataggatgaagactttaagaagaaagttttaggaactcaattattcccctatagactcatttaattttctcaaagaaaagtgaaactacattaagtcaaaaaatcaatcaataaatagaaactaccatcccagtcagcttctgtcattcactcaatcaacaaatattgaatgccaccacgtgccagatgctgttctaggcactggggaaagaacagtgaataaaataaattccttctcttcatggaatttaagttccagtgacactccagtagcacttatatcagagtgagtcatcaagagaaagtgaaatcataaatgtgaaaccattttgaaaagttggtgtgcaaggggtttattaacagctgattggtattgacagatccaggtaaataacatgattattcatgaatattccacttccttatttttcatcgatattaggaaatatttgtggggttttagctataaatacactcatatatatgcagattttatgcatactttacacattctttgttttagtacctcggtgattgcatttccatttcatattgagattaaatgtcttagggcatttccagagcatctctgagcttgagaagggttgagtgtattgctaaccttaaacttagcaaactggggagctgacgatgggagggaagaaaggggaaagaagaggctcaggagatttagagtgttcctggaacatatccacggagagagggtaggactgtactctcctgcttcagaaagaggaaatgatattagagagaggatctagtcatgattgttaacattccatgagtctgtaactgc

SEQ ID NO: 63112 - DNA, 1089 bp, Homo sapiens
caaagaagccacgtccacaatccagctctcactccagccagcccttccttctgaactctttccccatttgcagcctggaccacaaagttcagccctcagggatgtcttgattcatttgacatctcaatggaagattgcgagtatcctgggctgggaccaccatgtcttaagagtctccccctataaccctataacccatttgcctcagttccaggaggacagcgacttgatttgtcttgttcgccactgtgtctgcagcatcattacattacctgatggaatagctgctcagtaaatatttgttgagtgattgaatgggttttacacataataaatggttaataagtacttaactcacaatcagatgttttggaggtgggtgagtaatgagtacaccaacctggctggagcaaagggtttcttttcaggaataatgagaaatagggtggaaaagtagtttgaggtgagattatgaagaagctggaatcccattttgtaagagaaggaagcaaccacaaatttctgaatataggaagggcaagaaataagtggggttttaggaagttaacttgcagcagtgggtagcattgatgggtttttgttatacagaaaacaagagacagaggcagaaaatagtatatgtgcaagggcctaaacactgatggcaaccatgggaattgatgagtgagagagaataggaaggagggatgtaaaaggctttgagtggttggatgtggtggagttggggaagcaaagatggcttttgagattaccttgtagaattctgtgatagttaacggaaataggatcagtgcgtcatctggttttgatggaggcgatatgatgcattgggtgttagatgtgtagagcttgagtagcattggtatcccagagaaaagggaggactgaagatcctgatagacaacatccacatagagttcaaagttgtaagaacagacgaatcctttggagggcaaagggggaaaatcgttttgaagtaggacctaaattttggggaaggaatagatttaggacataaagggaaggcaaggagctacctcaggaaaaagggtttagagaagaaggaaa

SEQ ID NO: 63113 - DNA, 1001 bp, Homo sapiens
ctttgggggtcataaatccttttgagaatctatgctaaatgaccatctccccacaaaattgtgcctataatttcaaaaaattcgtggaacttttaaggttcaaactaagattctctatccagtatgggctctgaagtcagacaggtctgagattaagccctggagatatttctctctctctcctatgggcaagtctcttacctttgagcctcacttagaaaaataacacctgccttgcaatactgttgtgagaatgaaaaataattatatacaagtgtctggcccatagaaggtgctcaataaatagcagctaaagaaaaaaaaaggtaatggcacctgtcatcagcgctcagggaatgttagttttctttctttctcacagtaaccagcagttatctgtgcacttcaggtgttccataaatgttactgcttggctatcaaagttatcttaaaattcccttctctgtgaggctgctctagtgatggaggatctctctttacactcaactggactactgcaagtctccaaacagataaagaagtctctccttctgtatctcatagaagcactgtcacattaataatccagaaatcaacactgaaattgtgatatactccacagctcacaacttttaatgatcctaccatattttcaaacatttcactagagatttcttcaagagaaataaaaatggcagctcactatactgagcttttgctatatgccaagcactgattaaatgaacacattatttcatttaatcctctcaatagctctacagacaacttagtgtacagtctgaaagtctaggagtacattctctaaatgtttgcttgagactgtctctgattcaacttttaatagctatacaatcttggacaaataaaattccttatctgtagagtggagataattatagaaatcatttcccaagtaactagagaatcaagaacaaactaaacccaaaattagtagaaggaaagaaatgataaagatcaga

SEQ ID NO: 63114 - DNA, 1085 bp, Homo sapiens
gagtattttcaaaaacaatgtgtaaaatgtcatgccaaggaggggagatggcagaaggtctctttaaagcttttggggggaaaaagggaaggggccagatgcaaactctaagctccatcttctttttcaggctatggctacatctaccccgtcaccaggcttggcaagtacttgtgcatgctctatgctctctttggtatccccctgatgttcctcgttctcacggacacaggcgacatcctggcaaccatcttatctacatcttataatcggttccgaaaattccctttctttacccgccccctcctctccaagtggtgccccaaatctctcttcaagaaaaaaccggaccccaagcccgcagatgaagctgtccctcagatcatcatcagtgctgaagagcttccaggccccaaacttggcacatgtccttcacgcccaagctgcagcatggagctgtttgagagatctcatgcgctagagaaacagaacacactgcaactgcccccacaagccatggagaggagtaactcgtgtcccgaactggtgttgggaagactctcatactccatcatcagcaacctggatgaagttggacagcaggtggagaggttggacatccccctccccatcattgcccttattgtttttgcctacatttcctgtgcagctgccatcctccccttctgggagacacagttggatttcgagaatgccttctatttctgctttgtcacactcaccaccattgggtttggggatactgttttagaacaccctaacttcttcctgttcttctccatttatatcatcgttggaatggagattgtgttcattgctttcaagttggtgcaaaacaggctgattgacatatacaaaaatgttatgctattctttgcaaaagggaagttttaccaccttgttaaaaagtgaaggtttcattatctctcaggtgacagacactggctgagctggttttcttgtgttgtctttcagggtcatgcagcctgtcacctgagaccttcagtcttggagacaaatcccttatgagagccaagttcagtcttgaggccctgcagaaattt

SEQ ID NO: 63115 - DNA, 1600 bp, Homo sapiens
tcagcagccttctaccatctgtcctcagtgaaagccatgctgtgccactgtaccactcaaaggttgcgttcctgcttctacaggggtggactgagcacttatttttatcatgatcaattggtatattataaataagagacaaaagtataccattcactcaaaatagtgacagatttttcctaacatattatcattcttaacattacaaaagcccatctccttgcccatgggaattcctgcagcacaggcggtcatcaacacattagtctgctttgtctgtactaaaacctcttcaaaatacatatgtgaagcctttgcccccagcctcatgagaagacctgctcatagggaggagtccacaaaaatgagctctgtgcaagggattcctttgtttgcccagccccagcagtggagcatcagtttccttctgtaaatatcagcttttaaaaaatactggttttcaggaaataaatgactagtgcatagaagcaggtgtctttacacggagaatcgacaggctgtaatttagctaagctgcctgcagcctccttctaagattctggaaatttaggttgaggaactacagtctaccagaggaagaagaacccttcctagtggaaaagcggttttaaatgtaggcacaaggttcgtgtgacttaccaattgcaaaaccaactccaaagttcggagctatgagtccataaatgttttttgcaaatggaatctgtaagaggaaataaacattatgctaaaataacaagagatccaactctaaatcatctcggaaagtcttgaacttgtgttttctctgagcgtggtatgcctgttcccttctgaagaaaacaggaggaagaagggtggggtttgtgaagaaccggaccctccaaatctttaaaagtcaaagcttgaaacgagttttatgaccaccatgaaaaacttgtcaccggcatatgtgaaagatcagcctagtccaccctcaagttttgacaagaacaagtaggcctcatgagggatggatattggccattggtagaagagattttattctagaaaaacatcttgctattgtttcaggttggttgtcctgaagtgtttaagacactgtcaagcttaagatgatgcaggggaaaagttaaactgtgaaataaaacattttaaataatttctgacataaaatgaaaatacactccttggaaagtcttgtccaaacatttttaagatgataaaaaattagaataaaatgaaagctgtaataaaacatcaacaaactcaaacgtaaaatgtttcttggtgattcttgcccaaagcgcaagttttattcacagattgttcccacttgtcaaatgccatcttttactcacacataaaatgctgactccaacaattatcattcccagaagagcacaaagccacctaccaaaagaaaaagcaccatcaagaaatgatcatttgatttttttctagtccaaattttcaatgaaaatcaaaacaattacttgtaacagcaaaggcagaaacaacttagaattttttgaaagaactacattattgtaacagaatgagtgttgttttcatatcatcttacctccccattttgtgt

SEQ ID NO: 63116 - DNA, 1476 bp, Homo sapiens
tcacatcacagaggaggaaaaagggagaaaattcaggtattgctggactgacgggggaagccagagagttagataagcaggaaagagtggggtgatattggaaataggaacacactttttgagccacagggccagtcactctgttgggattctttcatttaatcctcacaacaatcctatgaggtagacgttatcatttctccatgcaacagaggaggaaaccaagactcataagcctctacatggtggggccagtgtggctcccaggcccatgctagccctaactatctcccaggagtcttcaaacagtttcctgggctacaggagcatttgtaggtgattttatacacacacacacagacacacacaaacacatatacacacatatatactttttttggtcaaaaacattgagtaacctccattcagccttaaactgttatcatggcaacagaatggcagtttgcatttgtgctgagaattttctgactccatttcggcaaggtattatgctagggtcagccaagcaaagatgcatctgaaatttacacacccaagctggaaagcagatgtctcctaagagaggtctgagaaggtgatgtggttttcagagctggggaagcatctaagcaagcggagggaaggacaaggggatggcttctgtctgagttatttccacagcaccttccataccttttccatgagtcagacgggccatgcattactcaaaagtatctagttaaatcctatttaaaataaagggcacaaggccagtgcccagtgcttgatatattttaaaatatgtggaatgaattaatgaatgtaaaaaacacccaagacaaacacaggctgcacataaccttattttaaggtttgtctttaaatctccttttggggaaaagcatcaaagggcagttcaggaaatgccaaagcattaagatgcattcagttccactgtcagaaagaccttctgatgtacttccaagagaacattacaaacaaacctcacatctattcaaacacaaaaatgcatgtcctcttgttcacctcattcatccttaatccaagacactctcctttcacctggacaagtacctatcagcatttgctgttttaaaaactggcaacaccagataagaaagatgatcagaaacactgagcgtctccttgctgggtaaggtaaataccttagaaaggttaaaatgactcatgcatttcaaaattcaaattttgaatcaattaatttggactttttcaaaagagggatgctttatactctgtatcttgcctatggctataattttggtcataaagttatgaattaaatcgttctgtgtgttcacatataccccaaagtccatatacaatgatttttccataaaaatcgtaaaatcatctctaaaatcctacatacagtaaagacaagacagcaactattactgaatgctgtaagggttatgagaaaagcaacagcac

SEQ ID NO: 63117 - DNA, 5013 bp, Homo sapiens
tttcaagttgggaggtctcatctgtttggggcatgttagtttaaaacttgaagatgtggctttaggatgcctagctacatcaaacacggaatacctttccaaattgagactggaagccccctcacctaaggctatagtcactagaaccgcactacgcaatctgagtatgcaaaagggattcaatgacaaattttgctatggtgacattactattcacttcaaatatttgaaagaaggagaatcagaccaccatgtagttactaacgtagaaaaagaaaaagaaccccatttggttgaagaagtttctgttctccctaaagaggagcaatttgttggacagatgggtttaacagaaaacaaacacagttttcaggatactcagttccagaacccaacatggtgtgactactgtaagaaaaaagtttggactaaagcagcttcccagtgtatgttttgtgcttatgtttgccataaaaaatgtcaagaaaagtgtctagctgagacttctgtttgtggagcaactgataggcgaatagacaggacactgaaaaaccttaggctggaaggacaggaaaccctcttaggcctgcctcctcgtgttgatgctgaagctagcaagtcagtcaataaaacaacaggtttgacaaggcatattatcaatactagttctcgtttattaaatttgcgtcaagtctctaaaactcgcctttctgaaccaggaaccgatctcgtagaaccttcaccaaaacacacacccaacacgtcagacaacgaaggcagtgacacggaggtctgtggtccaaacagtccttctaaacggggaaacagcacaggaataaagttagtgagaaaagagggtggtctggatgacagtgttttcattgcagttaaagaaattggtcgtgatctgtacaggggcttgcctacagaggaaaggatccagaaactagagttcatgttggataagctacagaatgaaattgatcaggagttggaacacaataattcccttgttagagaagaaaaagagacaactgatacaaggaaaaaatcacttctttctgctgccttagctaaatcaggtgaaaggctacaagctctaacacttcttatgattcactacagagcaggcattgaagatatagaaactttagaaagtctgtctttagaccagcactccaaaaaaataagcaagtacacagatgatacagaagaagaccttgataatgaaataagccaactaatagactctcagccattcagcagcatatcagatgacttatttggcccatccgagtctgtgtagcagacaggtctatttaagctttcaaatgaacagggtaaagttgcatctaaagtaccacagatacaaccatgtttaaatcctcgtatgcactctggcctgcttctccagttacttgcttgtgtaagaacaaaaatgagaaaggttgttttccagtaaaaacatgaccagcttactaattggttgttttggattgcatttatagctatgcttttttgggtttatactgggaatttatttttactaaattatttaacttttctaattatgtaattatgtaagctagcttttcatgtttatgtatgtatggtgtccccttgtgttatttttcttcctcttggtttttgaattagtgttaaatagaatactgtctagattcttaaaatattttcatttccatcatggttataacaaatttgctgcatgcccaaactgacaacagcaatcactgagggaacaggttttgaatctttcttttgtgttatgaagtttatcgtctctacttgcttgagatttttgttattttgggggtttgggggtgctttttgttttgtttttgccaaatgtaacatgaaagcagatgctgcagctttagtctgttatgctgatttagtaaaaaaaaattttttacatatattgcttgctttcgatgcttctgtgaaatttttttctaaagcttttgtgcagctgtatggtaaaaatatggtgattaatttgaagagcttacattgaaagacaatgtaataggaaataaatgtagattgcagttggtcaagaattttgtagagaggataacaagacttaattactgaaaaacagtaacatagcattttgaaatataatcttttaaaatattgatgctttccttttaaatggaaatttaaattttataattaaaagtttaaacatttatgataattttcctcatcagttctcccataggaaataaagcatgtgaaagggtatttaaagttttggaggactctttttaaaatgactgtgttgataactagtttgggctggttttgttttagaaaaaacattttcatgtaggagtattctgtgaaggaaaggaatcatgcaaaatatactttttgctttggcgtcttacagttgtaaaggaatggtgatcattctgaatacttctgtagtgagtattcattaagaaaagaatgacaaaaatagtattcatacataggaattgggaccagttctctgaaaatgaagatatactcacactgggtccattttacgggtcccagtaacatttgactgagggaaaacaagtaagctcgactgttgttggggtaccttaatggtttcggtctgttatatacctataaaatagacaagtatatgtttgtccctttgtaggtaactgctatgatgattgctatatagtgaaactgacatgagtttaaaactagatggagcagcttttattgctggcaggaaaaagcatggtgtaatattaaggactggggcccaggtctagactccaggactccataaaagagtttaagttcaagcccttccattaatgaactgtgtaagcataggcagttacaaaaggacccatctctaaaatgggaataataatactttacctccctcacagtattgttgtgagggaaacaatagcataactgcaaaagtgctttgaacagtaaaaagatatacaagtaaaaggcattatttatatgagtaagaaagacatttttgaggggagaaaagttattccactttaaaaatcaatagccaagtctcatgccttttgttactttagtaagcgaaaatttcaggtactaaatacctttcttagccaagtttataacaaaaacatctcagtatacttcattacttatttaagcgtgatgtcttttttttttttttttttttttttttttttttttttttttgagacagagtctcgctgtctcccaggctggagtgcagtggcatgatctcggctcactgcaagctccgcctcccaggttcacgccattctcctgcctcagcctccggagtagctgggagtacaggcgcggctaattttttgtatttttagtagagacggggtttcaccatgttagccaggatggtctcgatctcctgacctcgtgatccacctgcctcggcctcccaaagtgctgggattacaggcgtgagccaccacgcccggccacgtgatcttattttaaaagaacactgctatagaagaatttacacaccaaattccctgaaagctaaagtattgttccataacttacacttgaggcaatctgctcagtgtgtaaccactttataaaaaataacttaccattgataacctggaaggtggactacttgtaagtagctggtgtttattgattaaaccatggaagttttcatgatacccaagcatgttgctgaaactgatgcatttgaaagagctgttgaaataatgcaaaactttggttttataagaatctactcatgttttaaaagtatttaactctgtagaccacaattatagaaagctcagtaatgctgctaatgacatttgtaaactatatctgtaatgtagtgcaatatttttatatttcactgggagaggcagtagagacatcatagttgtactttagtgcaagtgggggaacactccaaatagcctagagtatagtaaggtacaaagcttcaatgaaaaaagctgtattatattacattactgatgtaatcttgctgccatgctatgtatcaatagctaaaaaataataataaagactaccacagaaaacaagaatatcttcatttaatgaaatctttaaaaaaggtgattgctgcatctctatggaattatcttctggtataatttggccatgcagaaaagcataacaaagtccacttttcctaaacaaaattgctgttttgcagactgccccaaaacatttttttactattgtttccttatggattatcaagtttatgggtttcctttggctatgtattagtaattagactttaaaatatattttctacattagtattagctgagtgaatggcttagacaaactgagcaacattttagcattattagcaatcataataggctatacttcttcatatcaagccttatattcaatatcagaagtacttgaaataagtggctattttgtgatgctgggaggagaaaacacaacctaaaaattttgaggggtactatcaagttctaaatgtatagctgaattttttttaaagcaatttggaaatatttggctcttaaaaataagataaataataaaatgttaagtcccctaaaagtgaataaattttaaatacctacttttaaaaatactgtcttctaaattgacataattgcttttcttaccaaaagaaggagaggttcccctaattccttttgggccatagatccgcttttaggatctgattaaagatgtggactttcaccgcaggaagatacccatgggcacaccattcaaaatgtatcagatttcaacggttttacaaactcccccgggattaagtcaaatgggtggatattacagctgttttcatcagatatggttatttgttgacaaccatcaggacaacaatgtttatagatggaaggataacttcctggtttttttccacattgaatgtggctagttacatatctcaatttaaaataaattgtggaaagccaaaaaagtatggtcaagctaacctgg

SEQ ID NO: 63118 - DNA, 1037 bp, Homo sapiens
ggccaacatggtgaaacccatctctactgaaaatatgaaaattagctgggcatggtggcaggcgcctgtaatcccagctactcaggaggctgaggcaggagaattgcttgaacctgggaggcagaggttgcagtgagctgagatcataccattgcactccagcctgggcaacaagagcgaaactccatctcaaataataataataatatgtattaagatgaagggcagatacaatacacattcattgttttaaaaaaaagaaaaaccttggaacataacagaaaagcttttgtatgtctctttttttgtttttttgtttgtttgtttttttctgtacataaatatatgcctttcccaatttttgtttaggaaacaaaaatttctaaactatgcatttttgtaatagtctttatttcttttagcatgttgtaaactttccccatgtcaacagatatttttcaaaacatttttatatcgctttgattcatttatatgggtatataattgatgatagttgaaataagattggcaaaatattatatttgaagctcaaaatggaattcattttactgtttcctcagcttttgagtgtgtttgaaatattccaaaagaaaaatccagacttgaatggtgtattcctgagagagagttgcaatggccatctccacaaaacacctgatgactgaggaatagatgagacgagggcagatttttagtcataaaaaatgagttcagattgagttgaagtttttgcctactgtagatcattagatggactaatttttcatttatgcatatgtcaaactataattttgctgagacatagtatggttagaaggacgtagtagaacttaaagctagataaataatgaagcaccatattagaaagctctgaatttccatgtgataagtttgtaggctaaaggggcaaatgctttaggaaaatttcgtagcaatatgtttggtgtttaaagtagggaaggtctgagtgagagattgcagttaaaagctgtttattactaaagtgaaggccagtt

SEQ ID NO: 63119 - DNA, 1126 bp, Homo sapiens
aaagcaagattcagaattatattcatgattataattgtattgactactatgtctcagtattattgagacaaatctcaattttgtgttaaatatatattagaaaatatatagaatagttctagattgtataattaggaatggttttctttttattttgcctttctgtttatttcccaattttctacaatgagcatggagcaaggagtaataataaaacacattgaagataaagtgtttaatttttttgatgatttaaatgtgtagcctaaggatagttaatttatattgttacagtaaagattttctccttcctttatttgccatgatagaaaagtcagcatcagccatggtgctctctgcacataacagtctgttactgtttttttcctctattactaggaatccattgaatcagttttcatttttttcccctttatcaaaggttgaattaataaaaggaaatttacaaagtgttggacttacacttcgtcttgtccagtcaactgatgggtatgctgggcacgtcatcattgaaactgtggctccaaactcgcctgctgcaattgcagatcttcagcggggagatcgacttatcgccattggaggtaattatgctaatatgcattatactttacctttacagataaactacaaagtaggtgtgaggtttttcctttcttcctttttccttatttctataatatgcatatgtcacttttataatggaaataaagtaataaactttattataaataaaaattcaaaggaggccttcaaaatacatttaaaacatacatgccattttagttctagtgtataaatctttaaaatactttgtttagaccacttttatataaccactctaatccttcccttcccaccttctactactctatttattttttcttgaatgtgaaagtaagggcaaataaacaggttatctttctgtacgactaccaccattgctactctgaacctaaaattggtagtattagcactactgcccccatcacttagcactagatgatgagcagaagaaccaacattccttttccaggagggcacatctgaactgtcctgtgatcctgtgtcatctaaatggccagccatttgttagtatgttgtt

SEQ ID NO: 63120 - DNA, 1034 bp, Homo sapiens
cactttaggaaagtattagagagatgttttgggagatctggcagtagcattcaactccctgtccacatatattcagtccagtggtagtcagcaattacaagtttctgcaatttttctgtgccagtcatagttttaagattttacatgcattaaccatttaatcctcatttaacaataccataataataggcactattattatctctgttttatatatgaggaaattgagatgtaaagacagaagtaatttatccaaatcacccagctagctggcagtaaaaacagtctgcaaacccaggcagtgtgactccacagctgatgttcttaactagtactatatcatttccacaaatggtgtcctataggcctgggttcagatctagctttttccactctcgctctatgactatgagcaaggtatttcataatctctacagtagaggtaatagtaactgccttacaggatataagggttaaatgtatgtaaaacccttagcataatacctggcacataatatctattattatttaacttaacctgattgacctcttttgttcctatggttttagtgcatatattttgtgtgtcctcataaatcccctacactcactcccttttattttatttgtttattttttcttgtacaagtttataagacccttttaaatccttcctgtaacaatgtgaggagggcagggagagtatcctcctcaatcatgagatagtggtattgttgttgttgtttaagattgtgttctcaaataatgacttgagaatatcagcaagcttattaagagctgttataaggaggatggagatcagtagctgctgcccatgtcaactgaggataaaatatggacaagcatttatatttcatcaggaatatttaagataagaaataaagaactttttaggaataaagaatattaatatcatagcatggatgttagtgcttccagatagttgtaattaataacagaaagttttaaagcatttaggaagtagttcatgatacttcactatttgacatctc

SEQ ID NO: 63121 - DNA, 1108 bp, Homo sapiens
taggtttgaccaatgtaaagcactgatgggaaataggagtgaactgggaaagccagggttttcttcctcttcccccctctgcattggacaatgtgtctgacagccattctttctccttcgtggcaccatgcttctgacaggacaggcccaccatatttccagcttctgcttgatactgtagcctctggcctctactaataccacctcttcctccccctgcccttccttccagccaaaggttgatagtaacttcttagaactgttactcatatctgagtgtcctcactgtctcctgtttggtactcagttcttctgtcaccaagtagccatcctctgttttaaagggcttccatattaaatacttagttttctgttttcttagagcctattaataaaacagtaatcatcatttcctctggaaacctttcctaactatcatgaaactccttggtaatgcttatcacagttgggatttcgcatttatgtttctatgataatgtgatcagtattgtctccagcaatatcttccgtatcagcaggtaccatgattgttttgctcatagcacgtggcattcagtgggtattcagtaaatgttttcggtatgactaaggctggctgtctgaccatgagccttcatacaacctcaacccttcttcttccagaccttcaaagttttagcgtgacttttagtcacacttctgtttcctttccatcttcaaggctattcctgatgtatgttttaaccaaataaaaatgtttagggtaaggaagtccacaaaatgagagatatactactcaatattaattttgtgaaaagcctgatttttagagtgaggattttagtttacagatgtggtgcattatagtattttatttctggcattactaaacacatcaaaaacatttcttactctatgtgtatagtttaatgtaacctaaataaaatgactaggtataatctaaaattttacttgccttacttccctttcagttttggagagttttagaagtcttgctgaatgaaattgaatgcacctacaagcccacctctgtcatgtattgttgaatgtacatacaaagagtataaaagagcttcctaaagaactg

SEQ ID NO: 63122 - DNA, 1057 bp, Homo sapiens
tactcatttttggatcctatgacagagaggcaaatgttcattgcacacttgagttaagcagtagtgtttgggaagaaaaacagaggagttctattaagacggtaaaatggatttacagtgatttatatctatataaagttctattttataagcatgcatttattactatttctgtattcctagagttatttttggtcatgtgcaaatagctatgaacagttcttatttatttgtctcgttacaatacaactacagtgataaagtaaatcacaagaaactataaatagtattcatattacctgcacaagaaacctagtccgactagctttcctttcagaactttaagattgcttcagttatgaaattagaaggaactaattttaactaaacaccttcaaatacatgtgaattcagagtattcattattcattcattggacagatattttatgagcacttactttgtgctgggcactgttttagatgcaagagaaactgttcaagacaaaaaaggcccctattcttgtgatactaacatggggtagatttgtggtatggggattagaagagggaggaggtgatctacattttatagggtaaagatagaacacagtaataaatggtaaacaaaaaaagtgaacaaagctattcccaaagattcacaggtgctatgaagaaaataggcatatgacagaggaattataagttatgataaaggaggctctttagatctggtgataataggactctaaagagatgacactggagcaggcttaccagaggacacccagttaaatctgaatttcagatagtgaataattattttagtagaagcatgtacccagtactacaggataacagtcaaaatcctgctaagtctttaatggacaactatgtagtatttttatggatattcctttgacttttaaattgtttctgatttatttatgtattaactgttgtgaacatctttatataaaaattgggcagtatgaaattattttggaagaaagagggtaattttgatcagagtggagaaggagggacaagaaaaactg

SEQ ID NO: 63123 - DNA, 1090 bp, Homo sapiens
caagaccagcctgagcaatatagcaagacctcacctctacaaaaaataactgggtgtggtagcctgcatctgtagtgccagctacttgggatgctgaggcagaaggattgcttgagtccaggaggtcaaggctgtagtgagccatgatcacaccactgcattccagcctgggcaacagagtaagaccctgtcttcaaaaaaagaaaaaaacatgttttttctttaaatttttattaaaatataactcaccacctgaaaagtgtactaatcagaaaattcagctccatgaatgtctacaaagtgaacaaactcatgaaatcagcattcaaaacaagcaacagagtgttaccagcaaccaagaagctcctcatatgctacctagtcactaccttcctctcctctgccttaaagtaactactatcctgacttctaacactatttttagatttttttgtgtttgttttttgcctgattttgaactttgtataaattgaatcatactgtatgtactcatttttgttgtctttagctcaagagtagtttgtgagattaatccatgttgttgcatatagatgtagtttgttcattatatttgctgtggagtattccactgtgtgaatgtacttcagtctgtccatttttgttgatgggtagtgttgttatgaatattcttatatatgccttttggtgaacatttgtgcacatttctcttgggtatatcgaggagtaggattgcagagtcatagggtggatctctactggcttcgtagatattactacaattttcaaagtagttttaatagtcgaaaccagcagtttcacatcctctccaacatttggcattgtttgttctttcattttacttaatgcatgtaacttaaaaatcaaaacagaagaacttatgatgaaaatcagcaattgcctccctaaaccctttactttcctgccctaagctagactgttcagaagcaatcatttgtaactatatatttctttttttttttttttcactttgtcacccaggctggagtgcagtggtgcaatctctgcttactgcaagctctgcctcccaggttcatgccattctcct

SEQ ID NO: 63124 - DNA, 1444 bp, Homo sapiens
ggcgtggtggcgggcgcctgtaatcccagctactctggaggctgaggcaggaaaatggcttgtacctgggaggcagaggttgcagccagccgatatcgcaccactgcactccagcctgggcgacagggtgagactccgtctccaaaataaataagtaaataaataaataaacaaactggtgatgatgtgggactgattcaagtttcagataagaatgaattacaatacatctaagatatagcatacttctcacagggaaaattaaactagctagtgttcatctttttttacagatgaggaaatggagctcggagtagttaaataacttgcttaaagtcacacagctttcaagtgttgaaacgcagctctgataaggccaggccacctttaaacacacacacacacacacacacacacacacacacaaactatgttgttcttaagtgatttattttttaaaagcatgccatcgatatagtaaatatgtgggatatctttccaaactaacctagaactcttgagaagagtatgactataaagctgatttttttttcttaaattggtcattttagaggatccttttaaaagtaaatcatgaggctaaatctttgggtactgtcccacgtggcatttcttttttaattgagcagaattgtgtttccaaatagaagagacaggtttcaccatgttggccaggctggtttcgaactcctgacttcaggcagtctacccacctcggcctcccaaagtgctggggttacatgtgtgagccgctgtgcccggcctagtttattcttttttagctatctaatcttcttagtagagctaaagcagtaaagagaattgtatggagtcttacgatcctttggcatttgtaatcattacataacaaatatcttgccagttaacgttgttattacttctttcccccttcatttattttgcctttttcgtgttgctaaagtgaatcagcctctctggactgccagttcctgatgtttcacctagagatgctaagttgctcaagtggttgctttctaaggacccagctgactgacatttcattttacccaagttaacaaacttacaatgtttgtaaaacattttattttacaaaatgaattataatatgtagacaatatgtttacagatttattcaagttaggaatttcattcatccacctcaatgttaattggtttgattttttaattaaaatagtatattataatagcaatatatttttttaaatgaacctcagaatccatcctcaagggagaaagattaccactaatgttcttttactacgtggataattcatcttaaacatggagtctgagtaatagtgtctgggtggggagctctgtttagggtttaggagtcaaatatttgagattcttacggatgcttgtgttcctggagtattattgtatatagacaagcaga

SEQ ID NO: 63125 - DNA, 1800 bp, Homo sapiens
tcccagatcccgaccgcagctccagaagtgacggccacgtgggtggcggcgcgcgccgcggggattggaatgttggcgtggggggacgaggttggaagggccgcagagaagtaaaggaggacccgcgtccgcgtgcccgggcgccgactgctgggcgacgccgccgggagcgagcacgcctctgacgtcacgcgctgctcgtccaatgagtggaggcctgagggaggcgccggtcccggccccgctgccgccgccgccacaccggcccttcgggagcgtctgaggaggcgcgggccgctgcgggctcgggcgccgcagcgcgccggcccgagcccctggacgaggcccacggagccgctcgccccgacccagccgcccgatgtcctcaaaatggaggcagcgggggcggcggcgtgaagaaagcggcgctgtgggcgcgggagtaggggcccgggcggaggcggtggcgggatggggctgctgctcatgatcctggcgtcggccgtgctgggttccttcctcacgctcctcgcccagttcttcctgctgtaccgcagacagcccgagccgccggcggacgaggccgcccgcgcgggcgagggcttccgctacatcaagccagtgccgggcctgctcctaagggagtacctttatggcggcggccgggatgaggagccctccggagcggcccctgagggcggcgcgacccccaccgcggcccccgagacccccgccccgccgacgcgggagacttgctacttcctcaacgccaccatcctattcctgttccgggagttgcgggacaccgcgctgacccgccgctgggtcaccaagaagatcaaggtggagttcgaggagctgctgcagaccaagacggccgggcgcctgctggaggggctgagcctgcgggacgtgttcctgggcgagacggtgcccttcatcaagaccatccggctcgtgcggccagtcgtgccctcggccaccggggagcccgatggccctgaaggggaggcgctgcccgccgcctgccccgaggagctggccttcgaggcggaggtggagtacaacgggggcttccacctggccatcgacgtggacctggtcttcggcaagtccgcctacttgtttgtcaagctgtcccgcgtggtgggaaggctgcgcttggtctttacgcgcgtgcccttcacccactggttcttctccttcgtggaagacccgctgatcgacttcgaggtgcgctcccagtttgaagggcggcccatgccccagctcacctccatcatcgtcaaccagctcaagaagatcatcaagcgcaagcacaccctaccgaattacaagatcaggtgagctggaggtcggggagggggcctggctgccgggaacccgggcctgggcgggacgctgcgtggattgggaagggcaaaggctcatttctgtcctggcgcctgcttctggggccttcccaccctggacagggccccagatcaaggcgagtcgtgaacacttgctttgcttccgaacggcattgataggagctagaaaccttttcgcgtgttcatggggactcagggtgctgtcaacgcgggcagaatcgtctccttttataagcagcatattggaaatggaagggaagcctaccctaatccccaggagtcgcttctgggactgttgagaaactctccctctatgtggttgctgcattgagggcagccgcgtcactggctttgcagcatccccttggccgctttgagaaattgttcctggacacagtacacgcgtgaagagtgtgcttatagccca

SEQ ID NO: 63126 - DNA, 1040 bp, Homo sapiens
gcgatcagggagactcaaattcctccaaaatcctcatgggcctctcatcaaagacacttcaactttttaacaatgttattatttgattacaggtgtgttttcaacactatgacagtgtgaataaaggcatgtttagaaaactttgcaaatgtcttttttattgtaacatatgacctaagctgatgcagtaggcttcatttgcaaatgtagcttcaagacacgacccctagttacccacttcctttccaatcagactgccccccaaactcctccagcatggaattctagagtctaaaagaataatggcaatgccactgctacctcctgagtgcctggaatatgccaggctccatgctaagtgctgtagatgaattatctcatttttccttccaacggccctttgagggaggaacttctgtctgtctagaagatgaggaaattgaggctgagtttggcccgcaggcgtgtttttattttctatctgaatgtctctaggtagagcatccactccccagttgcccagttgtcaaaggctccatcatcccattttcgtaaccacactcacctaaaaaaaaaagttttcttttttttttttttgagacggagtctcactctgtcgcccaggctggagtgcagtggcccgatcttggctcactgcaacctgcgcctcccgggttcacgccattctcctgcctcagcctcccgagtagctgggactacaggcacccgccaccatgcccagctaatttttttgtatttttagtagagacggggtttcaccgtgttagccaggttggtctcaatctcctgacctcatgatccacccgcctcagcctcccaaagtgctgggattacaggcttgagccaccgcgtctggcccaaaaagttttattttaaacagctttattaagatataattcacatcccatacaagtcattcaaagtgtatataatggaatggttttgagtatattcacagatatgtgccaccatcgccacagtccattttcgaacatttccctcatctcaaaaagaaatcc

SEQ ID NO: 63127 - DNA, 1032 bp, Homo sapiens
ctccagcaactccctcaccaccacgcctccctgcctaccatccccggaagggtgcttattctttaacaaagagaatctaaaaaaaaaaacaaaaaactgttgtctaatatatctacagtaaatgttacactagagcttttattttcctctgtagcttttcagaagaagcaatttaccttggatttgtaaatcaagctgaaacttttttgatgttcatgtactcatatgtcttgtaggtggtaggtgtcacttgtgtgtatgtgtaagtgaagtatgatgcatgctcattcacttggtccctttgaaataagggaaaggatcacagtgctgctgggccatgatggtatgtagaagggtctgtcagcacacatggaaagcccccatttgcacagatgtagaactttaataatccagatgcaatcattggaagtatttaatatgcaattggtagcaccttagctaattaatctgcatatgaagcattttctgatatatttaataagaggtatagaagctcttcaagcattaaaatagagttgatgtttcattccatttgttttatccatcaaaaaatgcactctcacagtggagttgaagtctaatacatgatacatgtgggcctgttagtcttcgaagcttccagatggtttgtgttttgaggtacaaaaaaatgctgcagatctagaaatgcatatatttagcgggtatttgaaagatagaagcattatttataactgaagagtataacacttatcttcttaagtaaatgctctcataacttgtatacatttttgcaggtacaaattcaaaagtatgtaagcattgtataatgtgacaattgtataatttatgtaatctgatgcatgaatcagaatttttatataatatatgattattgacttatagttgattaaagtgtttaaacttaattcagttgtcaacatttattacagatacagcggtgttaccataatggatttatatatgagtcctccttgttttttaataaatacctaggatgcctcttatttg

SEQ ID NO: 63128 - DNA, 2169 bp, Homo sapiens
gcctgcaaactcttgaaggcctagcgcaagctgtatcttctccacaaagcctgagagattctatgaaattggaaaagtttttcagtcctgaatgttttcacttatcctggagaagtgggtgtgcttcaatgacccaagcatcaaattggtatctgtactctagcttctctttctctggtctggtaaagtcctggttccttgggctgagaggctggggaagtggtgagggccagtgaaaagttaaactttggcttttctcatgaacacccccaaatacatagcactattaaagtagatcctgaaaacagggaaggacagtttaattcttattgggggtgggggtcattctgcattcaccagtccccattccccatcctccactgaatagattagatagtattccttaacagcaagaaaaccaatttcctcaatattttagttaagtttccttaaagccaaatggaaatgttttaaaagatagtgatgaaaattattttaaattgttgggcttaatgagagaactatgatttaaaaagaataaaaaattgcttagttgtaattgggcattatgttttacagaatgaaaactcttaatgctatacactataaataaaagattatgttacagggccttgattaaattcctgagaaatatttttctttcacttttgatataacattaatattagaatgctttgtaataacagtgaattaataagtgtcttttaaaaaagatttttggttatatttatgcttttgcctaaaaagaatttttgtcaatagaataaagttaagtaaatagatgaaatgggagagaatgcaaatatactaaccgtagtattaatatggttgaactcttgagtttcctgataaccagggtcaaaaagggaaagaagataaattagatattattataggagaaagaaatagaccagttactcaggggaggaaaagttctgcctgtttctaaattaaaacagaagttactcacatggggcttcctgtaaggataatctttgatttaattccgagtgcttccattttcatagcaaattagaaaagatttttgctgtaaccatcttcactaagaagccaaacatataacattaaatcacagttcagtggaagcagtttcataaggacacaagtccaagtgtatagttttcagttacttcttacagttcctctgagttaacttttagaaatctttagttttcatctattttagttgtatttattatagaatatttcatctcttaatgtaatcttacatgatataaccagtctcagatattaggaaattgcccacaatgttagaaagggttttaggatttagagttatagtcaaaactttggtgcatctgccctagttcttgcctcaggactggctagccaatttgtgaactgtcacattcactttaagcaaggctagcgaaaaacttcatcagggtttgaaaaacaaaaagtcgaagttccaggtaattcttaatgtttgtcccagatgttatatctatgaaagtgacagtctttatcctgttctaggacagcaacccctttgatgccactgcagggtatcgtagtctgacctatgaagaggttctacaggagctggtgaaacacaaagaactccttaggaggaaagacacccacatccgggaactcgaggactacatcgacaacctccttgtaagggtaatggaagaaacgcccagtattctcagagtgccgtatgaaccatccaggaaagctggcaaattctctaacagttaataaagccaattgtattgtattgataattggacaaagagagagaaagaaagaaggaaggaaggaaaaacttgttactgaaagagactacactatcaggtttcattacatattctcctttattgtgaagagtagttttacctgtaaatattagcagggactatcaagagtgacctttgaagcaagctaaatcatttaaatgtttaaattgaaaatgggccagattctcaatgaataagtggttccttaggactcactcaggtgctggtactgacccactaatctgccataggcccagaaatatcttcagaagtacgtgagttgttcctcaggaatagatttttcataaagcagaattgatcctgtggctggtttctcagaaatcagtttgtagaaatattt

SEQ ID NO: 63129 - DNA, 1013 bp, Homo sapiens
ttttatttctgtgtcagagcaggtgccctctttgtttttcatcaagagtataaaattctactctagtagtctctgaattcaaggttctttaatatatcagaaataatattcattgtatttttaatgttttgtcatcctggttttaaaaaataaatattcttcacttaacagaaaaaaatacataaccaaaatttgaatgttaagtattgttagactgtcgtcacgtcattttatggaatagtatctcttgtacttacagagatggataagatcttataatggcaactctttgtgcctcccatctttagactaccagacagtgtatattagggtgacattctaagattcagatgtttatttttgaatttgataagggatggaaatttttgcttttccttggttatatgtattattgctgttctttctctgtgagggttatgttgatactctgatacaaaggatgcacaaagcaaagtctctgtctttaaaagtataagcaggtagatatagaatgtgtaattaattgtcctagttgtaaataactgtcctgggtggtacagttggtaagtgctgatagagataaaaattatagattagatggataaggttaggcagtctaggcattacagaaaaggtagaactaaaagtctcgaaggatggatctgtgaagacagagaggtaaagataaatgagaaaaggtagagaggtaaaaatgaatgtgtgaagtggttctcagggacctaacctgcctaaaactgttaagggttagaagtagtagtgaagatgtgaccttattagtatgaatttagcataccagaatgaagaatttgcatctaattctatagaatgtatgaagagttttccatatatgactgatgtgatgaaaatactattttaggaaaactcagagaacagtgccattgctgttatatacgtaataatgccggaatcggaagaggtgcacatgaactcagaaaaactgcgtttctaagtgtgattttagattccgaaca

SEQ ID NO: 63130 - DNA, 1760 bp, Homo sapiens
aagcttgtaagcatgtagccatttttatgaaattgtgtaacatgttcattaaaagtcaaagactgtttactgtagaatttacattttgatttttaaaaagtatagtaaataaatgatcctaaagaaaaagagcctattgatagtttttaaaccttcatttttataatgtcccaatggacttttttttcctgaatgagtttaaagttcagtcgttggcatcataaaccttaatatgcaaaggatttgttttaatagcaatatttactttttgctcatatttgtctagtgttaaagataatttgcctgttattcatggtaggctataaatcttttacacacttgaaaatttgtggcttcatttatgagacagaagacaaaaacttttgagatgatttttagacccattaatccattagtgctcagagatttacagaatgtatccaatgaaacaatgactataaacacgaagtatgcaacgtgattagttcccttaacactaactagaacttttatgtttaactccccagatactacttgaaacttttttaccctttgtcatcctaatactcattataatagctctcattaattggtgtatctcccagtgggttaatttgcagataccagcgatgccatccttgtgctaactctaatgcaaattgatatttagagtcttcaaaattgaaaacaaaaaaagctctgtaacaaaaaagacaaactttgctggttttttttttttcttgagagattgagatatagcaagattctgagagagaagaaaacaggccaaaaaaattcacaaaaactagtgtaggctaataaactgatgtgaaaatttctcaatttacagcacttgacaggtgctaaaagaaaagcatctttaattttaatgtgttgttaggacctctttagagagactgtacaagttattaacaaggtcctctgagacaggagacgggtaattaacaagacctatggagatatagtttaggtaattaacgagctcttaggcactggacactggataacacgtagcgagtccaatacttaaagagaacaagttgttatgatatgatcaaatataagatacagcatgtaagccctcttgaggtttctgataggaaagtagtaagattgtattccagtgaccccagtgcactgactattgtaaatcagcatgtaaggtttttggtttaacttttaaggtagcatttgagagaattatttttaattgttgttacatgtagattaataatctttgctaattgccattaatgaacatgtgtattttgagaaaaatgcattggaagcacatcagttgtatgattctaaattgtcttaaacatttattttcagtttattttttacctgtgacttgtcggctaaaattgcctattgcaaattaaccttgctttccttgtctactttaaaacagtcaggatctaggccagcgaggagatgtggccctggcaccagtttggtttttacatgttatgcccaggttcctccagtcatgcccctatgctaccttcaagtctgagattttatattcccaacttcaaatatttggtccagttatttcctgtgtaaatttgaaatttctgaagtatgaatcttgagttttggctcagaaaattcccacattcagcaaacatttattaagaacatgttatactctaaaggttaagaatataaagaaggcccttgcgaggctcctgattcattctgttacctgctgtctcagtggtgctactctagcc

SEQ ID NO: 63131 - DNA, 1073 bp, Homo sapiens
tccaatgctggcatgctgcaaaactcctatgacacatatacagtaagtagtgttggagttcttgtaatcttcaggagaatgttttctcagtttattactggtactaagttgtttgtattttataattgccactagtcttgttttttaattgtaagtcacaggttgtttagcatcatcagtatcaactaatttttttcatgctttatcaaataaattgtcaactaatttatcatttggtttatcacacaatttgcgaagtaatccttctttttatcagcagtatatcatttgccaaaaacaaatatgcctgaatgtttgttataccatttttaatttgttcacaacaaattatcttttaatatattataaaatcacaaataataaattgtaaataatgttaccaccaggctgtttttcacttaaaagtggaaatgatgggtgtgtgtcttcaccaagccaaatttgttcatttcatttcttttttttttttaactaggacatagcaagttctggcttatttaagagttcatggaagagatgtataccactttcaggtctggcccatggaatgtcctcttaacactcttaacacaatcctccgttttgcctcttcctccatatcctggaccagggattggcaaactaagcttggaggccaaatctggcttgctgccagtttttgtaaagttttgttcgaacacagccgcattatcgtcataattgtgtacggtggtagcgttgagtagttgtgacagagaccatatggcccacaaagctaaaactatttattgtttgggctttacagaaatactttgctgacccctgcagtagctgaatggagaggatctttgagatgggcagagctgtaagtaggagcagcctgggtctctgcatgcaagtggaaggcccacctgacgaggaatagccaagtggcccttgtccaaatgataaattcacaggatataagttactgagatttatatatatatttattagagcacttagcattatttatcctactgaggagggcacatgggctgtagtacctttcgttgtgtttaagaaagccctag

SEQ ID NO: 63132 - DNA, 1348 bp, Homo sapiens
gataataaaatgagtgccagtttccttttatggcttggctgcctgttttactgctgtttctgctatctcaaaaccctgagcataaatgaatgttccatttcatcataaagtccttagaagaaaacttttatgttcagaagtaagaaagtaaatttaatgctaatgaaaaagtctctgagaatttttaacattatcatgccaaccagaacctctagttttgacatcatagtttatatgattgtgagctgaatacattactaatggtctagcaatatgctagttgttatcagcctcgatgcttcagactgctacaccttagcattttaagattgtttccttgattttttgaaggttaatacatttaagtggctaattgctctcattctaaaagcagcagaatgcacacagactgtgtcaaatagtgtgatgtaatgtgtcactgattatgtactaactacaaaattgtttgtaggaagtctcaaatctccacacagaagaacattaagctttgatacttctaaaatgaaccaacctgacagcattgtggatgaaggtgaattgtgtttcggaagacaaaatgacccatttacaaatgtgactgcttcattaccccaaaaatttgcaacactgccaaggaagaaaaatccatttgaagaaagcagcgaaacatgggacagcagcatgaatttattttcaaaaccaattgaaataagaaaagaaaataaaagagagaaaagggagaaagttagcctgtttgaaagagtgactggaaaaaaagatagcagaagatctgataaacttaacaatgggggatctgatagcccttgtgacttgaaatcacctaatgcatttagtgaaaatcgccaggactattttgattatgagtcaaccaatccatttacagcaaaattcagggcttcaaatataatgccatcttcaaggtaagcttaatatgggggaagttctactatttgggaaaatcttgtacttgaaggtatcaaatatttcttttaaatgctagaatattttcaagtcattttattttatttgaaaaacatttttatttgtataattaaattatagagccaggcaatgttgcatatatttttggaactgaacttttttatcttaagaagataaaagactcttattctctatcctggtctacttccacttatgtgagccagaaattcaccaaaacttagaaaacaacatggcttgtgatgagacatggcgagagtgaattgccagtgggtgttagttcaagccagaaatttaggtgataatgtttctagggattcgttcatgggctacctggaaaggaccaacagcagcccatgtgctattc

SEQ ID NO: 63133 - DNA, 1103 bp, Homo sapiens
ggccaggtatttattattgtattaaaatgtcatgagattcattttataatgctcaaaaataatttgtattggtgaattctttcaaaatctctgcctcaatgtcttttaatgttaaaaaaaaatgtccttaggccgtgagcaacacttaatcccatatggaaaacttctagcattgataagaatttttgatgatgagtgattttcaaattacaaaagaaaagattatctgaaaacattttcaaacttgccaaagacctattcattccttcagtatatgttacatcacagagacaatgatcagttttttaaactaaataataagtaaagcccgaaatactgtggctgacagattcttattcagagcttaggttgccttgatgtatagttactttacctaaaaggctatttgtatgtaacagaactcagtatcctctctctattatgtgttacagccaatttttttttcttctctttaaggtggtttagattagaatccaaacaaggaaaacgaatcaaaaacaggggtgagataaaggtcaatattcagtttatgaggaacaatatgaccgcaagtatgtttgacttatcaatgaaggacaaaaccagatctccttttgcaaagttaaaagataagatgaagggtagaaaaaatgatggaacattttctgatacgtcttctgcaatcattccaagtactcacatgcccgatgccaatagtgaattttcaagtggtgaaatacagatgaaatccaaaccaaaaaagccttttctcttgggtcctcagcgactctcgtcagcgcattcaatgtctgatttatctgggtcccatatgtcttctgagaaactgaaggctggcaccataggtcaaacacatcttctcggacaccagttagattcctttggaacagttccagaaagtggtaagtgtcacattcttgtgtactcattggtctgaactacccttttagtttttaaagtttaatttctaaatttagtaaatcaaaatagcagttgctttgtagtattttccaaattttgtcattcatcaaatattgagtacctactatacctcaaattggtaagttccttgaaggcagagcttg

SEQ ID NO: 63134 - DNA, 1078 bp, Homo sapiens
agaacacgttgtcttttgcgctcagacatcggttccagaatcgcagggaaggtttcctccgcttttgcccttttagctcacttgcataccatgaacacattgcttgctggtcttacctagtaaaggtctatgtgctatgaacgcataactaaaataacctcaggaaaaagaagagtgataactacaaaaacaaaacataatgttcctccacctcctttccgagggcatttgaaggcccaaggcattagtcctcttggtcctttttgagggctcatgtttgggagtttcaaaaggcagtgatctaattgttaaattttggaacaagttctcccagtttcatccttcttggacgttcatctctgaggattttaatgagccagagcaagacagaagtgcaaacatgaaatgcgtctccaggctaagttgaccaggattagacactgccatggccagcctcctccctctggaaggcacatcacattattattattttaaaaatcaaacttctttttagctgaagtaagtttcctttctgctcctacaaatatcatggctggtttaaggtttgatgtctgcttaatgcccaattatgctatacaagacagatcacactacattagccaggattatgttgcctcttgatcttatcagctttgtttcctaaactacaaaaagatctaacacagtactggttagcagtttggcttagacaatctctatcgtcatccatcactgtcaccagttagcaggaggcattaggcacaaagctaagagacaggatgcagagctgacactctcttcccaggctaacactctaattccacatttacgccagctcttcctaggctcgcccttccttactatggaagctttctttcccttgcttatttttggaaaaggaaatctattcccgtaagttgtttgcttgcttggtcttaaattctttgtaagtatagacaggagagggagtaaacgcataaggaaaattaaaatatatattcctcagctaaaatgagggttgtaaagtcagagatctgagggagaagatggagactaatggattgaatctgaccgttcc

SEQ ID NO: 63135 - DNA, 1084 bp, Homo sapiens
gaagacaggacacagcctctgacttcataataaaactttgtgtgcgaggggttccccaagagcccccaggatgaacatgttgctggatggactcacaaatgctgctggggaaattgttgatgctaccttgcttcttctagaccagagagctattctggaacaagcaacagtacataaagaggcttttgaaaatgtcagtggctgagaaactgcaaccagcagctatgagcggattttgaggggcataaaaccacacagctcctgaaagcagctggacgttccactggcaagctggacagaaaagtgcaccaaactaggcgagatctttttattaaccacagtgtcagagaatggcgaatacatggctatttgactgtaattatgaaagcactggtacaaataaaaaaggagtacagaatgtcttagtcccattctttaagatttctgttaatttttaaactgtattttaatttaaggacatttttataccttagtaataaattaacatttcaaaagtacttttacctgctgagatggttcattccgctaatatgggtaacgctgtggactcaaataattagtgtaaattgcctttgaataacacagagctgggaacaactttaacttgctagggcttaatgccccttgcagtacaggatgaagagtccttaatggggcctggaaaaacaactaatacctacaaatcaaaggagaaaagccgtttttgatgcatttgtctgagagtgtgagttttaaactaaattgttaacacttcctccccgctgagggtcatggattagctaggctgggagattctttgagaatctttcacactgaccaggggaggtggggggttccaaatacaagtgttttcttaaccttaatccctacctccctgaccaggacagctctgcatttccctctaattaggtgaagaattaggaggtggataaatgtgttcagggatgaggataaagtgattagttcactccagaccatgatagtgatttctaggcgctacttagttcctttcaagataataacttttctcttttttacaaaaacgtattcaagcaaacctcaa

SEQ ID NO: 63136 - DNA, 1097 bp, Homo sapiens
tgacttctgacagtgtgcatatgccatgaccaggccgctggaacatcttcacacctccctggaatagaatgcaattacattttccctttaaataaacttttcaagccaatctattaaatggttatctgctgtctgctccagggagtgcaggcagatggagagctgggctggggtagaccagttgtaaattcatacacacatacacacacacacacacacacacacacacacttgaagtcctgcacgaggtcacctacaaggtcaggccacctcttcctgggaccttgctcaggttttggtgtctcagaagatgctgcattaccaacctttgaggagaaaaccaaatgggcttgtcacaaagaaatacaaagtgtgactcagagcagggagcaagtgtggagggaagggcctggagaggacagtgagtgggagagctgccatttgggctggtctggcttcagaaccctgctttgctttctctccttttggctcaggagatgattgcacatgtggctcacagctgactcttgcaggatctcagataaatgatgagaagacaggtaacacctgggcaactttttctcattctgtgtggatagaggttggggccagatggcctctctcctcctcccccattatttatggaaggcttcacttactttccaacaggaagaagcaggaaacactgggattatgtgttcagggacagaaaacagtgtgtacaagcacgcgggttctggtaagccaatgagtgtagacatggttactgccccccagtcgccactctcttccaaaagccctcggcttgggtctgattaaggactctttgaaggtcatcataacagataacactcccacagcattttctctgagccaggcgctcttcttagggcaacacacagcaatcttttgaggaaggtgtgctactattcccattttacaggtaaggaaactgaggcacagagagattaagaaacctgcccacgtgtatccagctatgtaagtgaaagaacccaacatgtggatctagagtccatgctgataacctccactctccaacactctgcagagcagaaggacccttgcggtcatctcac

SEQ ID NO: 63137 - DNA, 1041 bp, Homo sapiens
aaattagccatatgtggtggtacacccctgtagtcccccagctactcgggaggctaaggtgggaggattacttaaacccgagaggtcgaggctgcagtgagccgtgatcgcaccactgcagtccagcctgaccctgtctcaaaaaaaaaaaaaaaaaaaaaaccttctggaagcagaaaggaggaggttttccaaaaccaaatcatgtcaagtacctagcttgacctcaaaaaaaaatacagaagcagggttggtaattgattgacaggaagggcagctcaaagcaggaaatggagagtggtatgaaaacacttaagcagtactgcccaaaggaagaacctgaaaagttcagccatagattttctgagaagatgaaagtgtaggcattagcatactcaagaatcaggcagacagttttccccatttggaagctgaaaaaggaatgatctgctgcccaagacaagaaaatgatgtgggcccagagggaaccgtcactcacacgtacactgtccagggggccagagaaggattacagccgccattttggcttctctagagtgaagcagcaaaacaatgtctagtggttgctaggcaaccattagtccatcgctgcccttttccattaaacattatctgccttcttagattgttttatttttttaaacaggataggtaatgcaacagagaattaacggtgcaacctaacaatgaaaacgcatttgaggttcccgaatcagtgaaggctttgcaaaggttagatcactcttgggtggatgccgaagatagtgacagttgactgaaacctcttccccagacatttcatcactggtcctcatgtttcctagtgccaaaaataataatgtggacgtaacaataatctctgtacattgtaaaatgtctgtcctctgctacgacctgctccaagctagatcttgtcctgaagcaagtttctctatcggcaaagagtggatgtcagaggtggtaaaatggagttctagccctggtcagctttgcagatagctaagatcatggtatccaaag

SEQ ID NO: 63138 - DNA, 1119 bp, Homo sapiens
tgacagcgactcaccgccttctttccctagtaatcctggatgtcccctcgatgccagtcagctggaagggaaaagagcatggaagagcactggcgggaagttacgggcctggcctggaagtggaacacattagttctcactttgcactggctcagacttccttacttcatcacactaaccacaagggaagctggaaaatatagactgggaggaaagaaattttagtaaatagcttgcagtatctgccacattgcctcaatcacatacgatgtagtaactttacattttgctgatgttgagtagcacaaactactatttgtgatttgatggagtcatttttacttgggtgtgttgacagagctgagtcaaagtagctgttcatattaccgtgtagtgggtgtggtgtcacagtgtgatacctgctgaaagagcattgcatgctcagtcagtgaggcaaaggcagtgcttattatgccataaagggctgttgggactttaccaggtaggcgagtagaagcgagtgcatcctaggtagaaggaacggcgtggcacatttgaggtacagcaaggactttagcaggggccaggggagagaatgagaacagggaagtagagcagcagaaagagatggcgttgaaaagagctggccagaaccaactcacacacaactttgagagatgctggggagattggacttgtgcggggaagagttgggtgtctatggatggtgatgtgggatgaagaaggtagtcagagagcaggcttttaaagagtaatgttatattagtagtttagtaatatagagttagacatttagtatttagtaaagtaggtcatatttatacttgttgtgtcatggtacctgtggaatgccatggaaatgtcaaatggacacttctatgtagcaacctggaggtcagaagggagggaggttgcagaaataggtcgatgaaagaggtcttgaaaggtggcatgtcaacaggaacaaatgccgctgagctgtcaggcaagataatggtggagaggtggctgttggagttagcatcagatggcaccggtgatcttggccaaatcagacatccagaccagaattgcaatagatggtgcaattgcaatctt

SEQ ID NO: 63139 - DNA, 1043 bp, Homo sapiens
aggtaatcagagtatctaggttttcaaatttaaattagtgggtgactttatgctagaaagtagaatatgtgttagaataaatttatcaatatatattcttggcctttgtaggatactgagacaataaggtccatttttcatttttgaggttggggagctctgtagattttgataaaatgtgcagaactgcattctttaatctttattatttcatcctccctccacactgcttgctttaaaagaaaaaaatacctacacacattttctagtgttaactgctgtaatcagcatagacttcctgggaagggattcttgccttcagtaaaggacatgacagcatgtggccaatggagattgccacgaggaaacctggaaaggcattgaaccattttgtgctactgttaaaatgaggtgtgttgtctctttattatctcctactcaatagtgagtattctggaggtgtctgttccctttccggaatttcttcaaatacagagatgcttcagagtagcttcctgccacattggctttcatgatcttaatccctggaacacagctataggcttctgggagatagtttattaaatgccatgcagaatgctatgtttttagatgtgcatgtaaatcaagaattagctgaggaatatctttttattagtagtagtagtaactcatttttagattcaagtaaagtttgttttccaggtgagatgacatttttaagaaattgaatttaagtatgtgcttttatatccggaccaggtttctcaaggaagcagaatacaagggaatgaaaggggaagggagggtagtgcccaagagaaacctcggctcctaagtgctcccctgccaggtttcccccgtgcctgcccactggcaccatcctggcagctccagcccacaccccctcctggaccctgggctgcctctcgctgaatagctgcagggggcctgctatgtgacaggtatggaatgaggtaatccttttccacctctaatttctgaagggtgtgtctgtccagtttttacttgttcattgaatt

SEQ ID NO: 63140 - DNA, 2305 bp, Homo sapiens
ctcagcctcctgagtagctgggattatggacaaatgccaccacacccggctaattttttttttttttttgtatttttagtagagacagagttttgctgtgttggtcaggctggtcttgaactcctggcctcatatgattcacctgcctctgcctcccaaagttctgggagtacagacatgagctaccatgctgcccttgtattttcttatctgtacccagtgtaactacacgtttactggaactgtgtttttaagactgacagttgtttataatggattagtcgtaagtaccaaaaagtctcagttgatattatctttacaaatgacttgaccttaatgttataaaagtagttactgtttttttttaattggaggcagacttgatatttcagagttgcatagtaaaagcaatttgttaatttttgtgtactttcagataaactattacaataaagaaaggagcagaatgtagtatttggaagatgatttaaattcagcaacgcctaaaaatgtcttcctaagtatttttctcagccatgtcattctttaaattatgagatggttcttagaagagaaaatggtgtaattgtattaaacagacaattataactcaagataatataactttgaaccttctaagaactgatttgtttggttttcctcccattccccattcctccttaaaagattgaatgaattaatgagcagaaagagaggattggtaacatgggaaatcgttttcattagatgtacatttcctggttctgacaggaaaggggctccagaaaatcataaaacaagcaggtgaacaagaccaggtgtgtcggcacctccctgctcagtgcccagcggaggtaaagaaccactcagcatggtttttgtcagttcacctcttctgtcgttgtcagaggtttcctacctgtctgatataaactttctctgggttgataatataaattcagaaacatgtaaaatgaatcatgattatattactgttatttttagacttaaaatagtaacaaaattttatttatggtggcacatttaatggctttttttttctgtgttctggaataagagaatacctagctactatttaagcatccaaaaatcatatcttgctttcatttagttgagaaaagccagcatagagaaagcaaagttttagaatattatgtgtcatactaattcagtatccagaccaaatgttggaaagtcttattttatgatttaatatcccttgttccattttacagatatgatcatgtaaaacttacctacaatattcatttcaaactgctaaattaggtaaatacagacttttagtatagaaacctttcctctaaaaatccattatgggggaaatattcactatacaatccagtggttttgtctgaaatcctaaaaatgttatttttgagcaggcgagtggtatagatattctcacacttggggccccgatatgggcatttccctttgacttcagtctcatttttttttttttttctgtttctactccttagagcatttagtgacccctgcaggcatgttgcacttcccatactgaagccttgccagagtggcctcctgtagggtctgacttgggatcctgtccagccaaggaagcccttcttcagcctgctccagtgcccgcagttgccccctcagcatcccctcggggttctcatgtagatgggaacattttaactacgcggaaggcaggcatttcagcagaattaagtatagcgggggctcatctaataaaggaagccacttctcccaagtcgtcactcctttctgggcatgggttgtggaaagctctaaaacgttatgtgtagcagaagaaggggttggagggaagatttgtggggacaggttgtcttggattggccctgctgacatgtcatttgagagcagttttattttatcctttctaataggaattaggtattttactcctagaaacattattccttgagtacgcatgctgctcaaaggatgtagtcatttgtccactccattctagtcacagcaaaataaggattctttttggatcagtaataactttggttcctaaaacttcaatatgtgcatttactaccaccagaatgcctgagttagatcagtaatgtaaacgtcagttattgttaactgagattaatatgtttcaggccgttggtatggcattaatgtaactatgatttactatttaagtactttaggctaaaacatcttactaaagaacagtaattttgagctttacagcactggttctgagaaagggaagttggcagtgcattcttgt

SEQ ID NO: 63141 - DNA, 1023 bp, Homo sapiens
gaaacttgatgtctctgtcagtgtctgcagccttatcaggggtaaattcctgttcagcctactgcaatgctgaaatagcttgaagatcctcattactacctttgtggaccctcgaggggcctcagtttgagaaggatttccatccaggagactggtataactagggtaaagggtctattgggagtcacgggagatatgggtcctgtctttgtattcattatactttgagaaggaatgaacatagaatttctaatttctagacatggctttcttacccacaagttctcaattatttgtataagtgtaattactgtattagctggaatatttattttcactttttttttctcctttgtaattcttagcttggtgtaaaaattgccaaagcagttgcctgccacaactttgtaaaagccaaaaaggaggttgaaaattcacaggctgcccgaaaaaagaagaaacttgcatgggggtgagtttacttaagatttttggtagtaaatctcctgacttcatagaaattctgctaatatattttgtgatctagttcgtgtataactgttaactcattttacatttttttcttcgttgaatgtttatcagattataaatatagaggcatttcttcatcctgtttaatgtttattttgtaatcattggagtatgtgaaaaatttttgtttgttttgctttggtctctaagtaaacatgttcagcaaagtatttttttttttaagaaataaattgagatttgtatgttcttccttttaggtttgaagcaaagaagagatgggaaaccaaaagcaacatgggatacatgtaacttgccagagtgcttcaagacatttgtagactcaaatgctcaatttactgagaatgttttcctgcctatgttaatatgtcagaaaattgatagcactaaaacaaaaataagcataaaatttgggattttgattatcagctcttttcagtctttctttaaggactttgtcctattgaagtgaataaaatgaagcattctgtt

SEQ ID NO: 63142 - DNA, 1957 bp, Homo sapiens
attaatgcagagtttcgaaagttattttttaaaaacacagtgttaccagtcattggaagtactttttcttatttgcttcttgaactttgtatgttatttcaactttggctatttctttgcttgttttttggaaggcattttatgatgccatgcaagagacactagaaagggatagctgacaaggaaaaaattaaaaattggataaaaagtaaatgaataatgtcatattactaaaaagatgagaggctaatttgtgccgactttttgctaattttgttcaagcctcaaaatgaggagctgtcacccgttctgtgtagcactgatgacagtgccaatgatccatgaaataagctgccgctggctttgttctgataagaatgaacaaatctgcaccatgttcggctcccagaatctcattttcatacttgcatgcaggctaaaagaaataagctgtttgcaggcttgattaatcagacattggaggggtttttgtctctttgatctctttcgtctcctaggtaacttgcttgacattaatgttgagcttgagtaaagacaatcaagaattgtcgaccaaactgatataaaaattaaagaccttaacactttaagtactccagtaatggttccgctttacttcagaaaacatctgttttcatttaattaaagaacaaaagagaatggcataaatatttttcatagagacctattattccataaaaagttaaagtatgataattggtatttttaaataagtgccttgaaagtgttcaaaagggaggaaaactttataaatctgttacaagctagtaattttgagatgagtaaaatttactctgaaacggataagaaatttacagttatgctagattaagcggtttgaatcagatacttcaaatgattatcagcaaactttataatgacaagattttgcaagaaaaactaactttattttgaagtttgtcttttaaaaatctgtactgtgttgcaaggatgtgccattatatctattttacaacccaatatgatttacacacgctaaacctgtaaaattgaaaggaattaaaaaaatgtcgccgtgcatttgcttgaggttatgcagacgcttttacaaatcttccaagtggctgtaaagatgaatgcctcaagggtccagccagggccctgcttttccaaccagctaaagcccttatcttaaatccaagcaaagtaccattaatctttttgaaagaccttttatggcttttaatatatcccaaattagaacattttacacccttggttcctgaaatatggtgataaaaagcctttagagcttaattttccttactgcatgctctgaccaatttgcagttctttgtgataatgtttagacaccttaattaaaatgcagcaaaatattggatgttctatatggaaaatgctgatactttggctacacatacaagaaattttgtatatattttattcatttaaaaaaatttctttccacgttgtgttgctatagttatctgatgacccaaaaccattttttaaatattaaaccattgaccaagcttttgtgatgtttacattgagcatgaagatgcatttttctttttatggaagtggaagggggattcttttcggcctattttatttgtttgtaatactgcagcacagcacgatattcttttatattctggaacccaggttagtcatcttgactgggaaactgcgtttcttctcaactgcctctttcatagaaggtcttattagccttttatattttcagatattttttctttctccacagaaataagtgagacacgttcattttaattatacgaaggacacaaaaaggctatgagttttcatcattacaagctaaaagatttctttctgtagaaaatacatagaccaggtttgcttagtgttttatcagctgaagaacattttatttaacctaagccaaggt

SEQ ID NO: 63143 - DNA, 1291 bp, Homo sapiens
cctaagtttaaagttacttctagtcagggccattatgtttgcatcaaaaaaataactgaaaaaaactgaattgaaagacaatattatagtgaagcagatctttattctgtaatccagaaaacaaaatcgttttctgtttttgtgaatactttgtgtagaaatgtcttgacagccacgtttctgaggtaaaacggtttgctcagatacaaagctgagcggtgtattccaattagctgttctaacaatttaccactggaacctgtgaccctgcggaaaggttgcagatcttttctgttgtcttaattgtgatttctagccactgaagattgggtaaacatagtaaaaaatgcattaagtattatttatatgtattttaagggtttaaatttaatatctccatttgaatattttatttttatggaaaggaagttacttcattgctagtatcagggatgtgtatgacgaatataatgtaggttttgctgtaaaagcaaatggttgttttttgtttaaatgattatttcatacagagtcatctaatgtctgcactctggcaaaatatattttatgtctctctttcaaattttattactgtgccttctgtcccttactttttcttttgtttgcttgtttattattactctttccagtaaagcagtagagtttaggagaccattttctttttggtatatttcactgatcagcaatgagaaagaatataggagaccattttctttttggtgtatttcactaatcagcaatgagaaagaatataggacactggggagggaaaaaacctttcaccaaataggcttgtgttgatcaggagctaattcaccacctagggaatgtgggaactctgcctctgggaaggatatgtgtgtctgttgaggatcatctagaactcgctctcattcattaactttggtcatctttcagtgctttttaatttaaaagttactctgtgtatcattttgtattccgcacattatctggggggcttttaaagggctattttaattctttgaagccttgttctccttagttcttacaggtaattcagttattacatgtagatcaacaattggcacaatgtatggaaaataagctgtgacttcccaagtaagagagggcctggatgaatttctttacatctagtttaaagatatgtttgttcccatacaaaattgtgcacagccgtgacactgcagcattttaatatcagaaaaataaggctggtgttcagtgatggttttttttctctcaggtttttaggtgtgcttattcaaat

SEQ ID NO: 63144 - DNA, 1001 bp, Homo sapiens
caattgggacttggataaagttttcctaaatgatgcactggcctggtgtagggtcaccatgtgacattctgcccaccagcggttgcatatgaactctgtccttgtctacctcgctactattcactacaagctttcctttctatgtgcagtttgaagctgtttgtcaaaacatacagaactagcgccttagaggtttcagaaatgtgagtttcctttgaggatattaggattcttttttttttttttttttttgctttgtcatactgcagttttagaaatgggaattgtatgatactgactagatgttttccattttttaagggctatttcctgtcacactttttgacaaatgagattgcttcagaaatacatgagattttcagcccttgtaagaatagtaaatgtttttctcattgtactttttatattcatacaaatacaatgtttttttctggtaaaataaatgtgtttaatgtgggattatagcattctgattaaaagaaaaataatttaggccctgttctttgccctgtgtaagtggaaaaacatctggaaaatgtttgccgttcagacacaggccaaattggaaagatactgatgttactttcattaagtacccgtgaagaataatcaagatggaatttttgaatgaatagtttggtttgagatttaattttacatatttatctccttggtaccaataaccatggatatgagagatgggattttgagaactaagtgtgagtttgggggcagaagccctttatgaattaaatgtatatgtgcatgataggtgtccttttggaaatcaggtatattggtttttcatcagtaccgttttcttttttcaagcagcagtgactgggacctgctgataaagcctttgctcagaggcacagatcccagagttcttaaagccttttccaaccataataagtgaaactaatttttgatgtttaacatttataaacctatgaaaccaatggggcagcatcagtatt

SEQ ID NO: 63145 - DNA, 1040 bp, Homo sapiens
tgtgatctcttccaagtagcaagtgactgaccaacagaatcccccaagtcagtcagtttcctcagattttgctttgctaaaggaagaaaaggtaagggaaagcctagtcttcagggttaaaatgtggactccatgtgatccgtgcacaactgtccatctttttatctttttctgcttattagtacccccatctgaaacaaggggaattcacagagaagcatttattttactgcaggttctatgttccttttagtagagttagtaatgctgaagttttgagttgaacacattttacttaaaaaaacaacaacaccctttatattttgcaattatttcagactttcaaaaagttgagaaatttggaaaaagatttcctatttacctttccctcagataccagaaatgctaacattttacaacatttgccttcatgttttctaatttgacatactttatttaaatttaccagttgtcccactaattccctttatagcaaaagaaacttctttttcctagtcaatgactttgcattttgtcgtcatgtttctttagtttttttaatctggaatggttcctcagtttttctttgtttctcaggaccttaatatttctgaagaggccagttactttgtagcatgtcccttataattttgatttgtctgctgtttcctcatgattagttttaggttatgcatttttggcaggaaaatcatgggagtaatgttgtgtgtttctcagtgtcagcgatccagagactcgtgctgtctctttgtccctttcctgatggtgttacttcgattaactacttcaggtagtgtctccagatttctccactgtgatgttattgtttctttctttggaataaataagtgtcttgtggggagttaggagataatctgagactgtgtaaatgttctctttctcatgttttccctgtttgttttagtgtccactgctgattttcttgcttgtgacagtttttattatggtgactgccaaatgacttttgatctttaaaatatgatctcattgtactttta

SEQ ID NO: 63146 - DNA, 1052 bp, Homo sapiens
gtctttttctttttggctgcaggctttaagtatcttgtgaattttttattttggcgtagggaaaaaacaagttgagaaaggggattcagaaattatatttttttctttaaaccttttaaaatcatttgtcacattaaatacttctgtgtttaatgtgtgtgtatgtgtttgtgtgtgtgtgtgagagagaatatatattaatgactaatataaaggaaattataaagccatggacttcatttagggaaatagccaagaaataacataaatggcagttatatggcctttcagaaaataagctgacattttatataaggtttttaaattgtaaaatgtacataacataaaatttactgtcttaatcatttttagctgtgcagttcggtagaattaagtgcatttacattgctgtccaaccatcactaccctcctccaaaactttttgtcttgcagaactgaaactctgtacccattaacctctgtacccattctcccctccacccagccttggacagccactcttctgtctccatgaatttgactgctatgggtatctcatataaggggaattatttaatatttgtccatttgcatctggcatatttcacttaacatagtgtcctcaaatttactccatgttgctgcagcatgtgtcagaattcctttcctttttaaggctgaataatactccattgtatgtacttgttacattctgggtttgtattgcattttgcttatgtagtcatctttcagtggacacttgggttacttctaccttctgaccattacgaataatgctgctatgaatattggtgtacaaatatctgtttgaatgcctgctttcagttcttttgggtatgtacccggaagtgaaagtgctagatagatcacaaagtatttttactgtttgttttttttcttgtaagatacagttctccccttcccatcttataagttcttgtgcttgcagtttgactattactctgtttcatctctaaggtagccttattttgattcactgagtatagctttcattgtgtataacagcattt

SEQ ID NO: 63147 - DNA, 1503 bp, Homo sapiens
gctggctttggccaagttcaggagtcttgggctctgtttcctcatctttaaaacaggatagcattattattcatggagttgttataagaattaaatgagcttttttacagtattaagcccagaatctgccacgtaataaacactccataatttttagctattgttatcattaacattattgttgttattaagggaaagcataggctttgattcacaaaaatctggatttgcgtcttatttttattagttcaagaagttacatgacctcaggtaagccatttactgtctcagccttctggtactaatgggaatggtagcagctaccttctggtgttattgtgagaattaatggtctacttgtgtaacacattcagtataattctgtgacatggtcttggctagcaaatgtttgctttccttccagcccttaattttaggtttcttttttttctagtcaggccttgaaaagaggatagaccaggctgtggaggagtggaatattgagaaggctgaggaactcagcaaccagctagctactcgagaggtgagtcaaaagggttacacattttctgtattttcaaattttctagaataaatttgtattctttttatgatcattaataagttcagtattaaaatatttcatctgaggttttcctttttgtccattttcttctcttttattctgtcatttattttgaaatgctaggttttattttgtctttaatgtttttaaatcattctggtctaaaacttgctagaaataatccatgattgatactgaaccttagattttacctggatcagagaggtttgtttcaggtatgattaaaatgctagctttcttttccgtttgcatctttaactcatttgaactctgagggcaactgtgtattctaaggccacatccctgaaccttttcttaacccttggtaaaatgctttcttactgtttgctcagcacatccccctcagccctaaagaattttgggtcttttttctttttttctatagtataaaactaatagatatattgggtattcttttgccaagtacagaaggccacaagaagattctgaattatactcctggaggtggggtgtgggcaaattcccccagttgagaattaatgtcaatatagattaaagagctcatattggcatgtgttttgttattattgttgttgctttgtaattcctttttttcctttctaggaaaaaatctccaccatagtctttttttttagtgccttgatccttccctccttcacctcagactttaactactccatagtgtttcgttacgtagagagcatcatgggttatctgggtaaattactggccacactcactattctgacttgcaggtggactttttatcctaaactgagaccagagataactgtgatttcagcaaattcttctatggaaatactgttgcactcttccatcattatatctgatgtaaaaatatctactgtggatggatgtttgttgtgattttt

SEQ ID NO: 63148 - DNA, 1041 bp, Homo sapiens
agcttaaaaattttcctttagttattttcctgctccttagacaagacgccctctgaaagctttgtccattaaatataggtgaaacatgcagttttattctctaattggtatagcttcaaatatggtattttaatcctaaattgcttgcaaagtatgttgttaggtttttaacattcttgagcaatgctttactgaatttcatgttttttttagacaaaactactcatatattagagaatcaaggctctattttctttacctgtaggtgtatgttgtaacaaacttgtttaaacagcttttaaacttctaaactttttttttacttacacaagtgaagattttaattattttataacaggttcattctatgccattttagattaaaaaaaaaaagtttagatggactgttcccaaaccattgttataattattaggcacctggaatgtcttctaatggtcttaaaattatttctatggttattctacatgtgtaaattaatctttttcctcatagaagaaaagatgtggagtgggctgctacctcctggcctaaatgaaagtgacgctgagtcaaactcggaagatgaagctacgttggagaactctggacttaacttacaggaagataaagaggatgagagcatcagaaaaacagaaatcatagatttctcaacagatgaaccaaaaactgaaacagagtcaaatgtaaatgcctatgaagagtgtccttctggaattcccatagatatgtggaatgtaggttttctctgaaatgctcttgctacagcctgtgtgtgtgcacatgcctctgtgtgtctctgccctggtcagaatgtgcatgtattcttgggacttaacagggagggagatggactcagaatgcttttactgttctctgaggcatcggccacttagatacttgcgtttattttgttttgtttttcatagaaagacggagggggaaaaaaaaaaaacccaaaccactatgtagtattagctgtttgcctagcgtggtacatgagtagtttctgtctttattta

SEQ ID NO: 63149 - DNA, 1028 bp, Homo sapiens
taaacaaatttaagtttctgtttctctgatattccacgtttctggagacaggctgagtgaattttcacagttaaagggtaacttgggattatctgccttaaaataaagaaatacgctctgaaaggcataagtaagagacacttatagagaatcattctccacagcagccaaaacaagaataacaggaggcctaacatggtgccagttggaaactttgtgaatgacaagtatatgctatgaatagaaagactgttttgaaacatgagtccaaagcaaaagtcactaagcagccactccatattggctgatctgtaactgggctgctgcttacacgggcaactccattttgcaggctgcacagtaagtggcagcagttatccgtgtttatcagtgactgctcagtctcccttgtatttgtttttttgagagtcacaggaaaatggcacatgactaaaggttctaaagagtggaattcaaaacctacctgatttgaattttgcctggatttagaggtggattccacctttttcaaactattttaattttttttcctttgggtacactcaagaaattatcataccaggcagatgccacactgaggacagtttttaatgccacatgagcaggagctaaaaatatataattttgagaaaatttaaaaagccataaaaaatgcctaactacttgaaggctgattagcaacaacaacagcaaaaagcatgccttcttcggggcaactgagactgcttcccagagggaagcatgtttgggtgcccagagcatagactatcaccctgcagagatgctaaaacagtggtttagtaggagacctgtgccactgcccattggagaggcatacacgtttcatgagcagtcacatctaaagtccaggtcaaggaatacttggctcaaaaactgagcagaaacttgctatgtgtatagctgtcatttcgtgaggctagggatttttgcctgttttatatacttctgtccccagggtcttgaagagtgtctggcacataagtggg

SEQ ID NO: 63150 - DNA, 2311 bp, Homo sapiens
actttttcttctgtccctttaacaaatttgcagcaattaccctccctttggggtctagagtgaaagctaatttgtgggtagatgagattgcagaagaatggatgtccatggctgtgaacactgcacactgcacatccatctccagtgctcacactgtgcagctaccactccctggctgcgtgccatgctgtcgggttgcagatttgcacacataaattcctcaggaagagtttgcatgagcatcacctcgcaatattctgtactgaccaaacaagggatttgaacgtttttcagcacaaaaggataacttccgagtggtggtctgtacgcatactagcaaaggtaatggtgatctagcaaacaaaattggtttctgcagttagaagtgagcaggagcacttgtattatagtatttaaataatcctggttaatctctttttaagccgagtaacccctccagattttgcctttttattattgaggctggctttattttcttctactttttttcccgttttatagcagttaattatttttgtgattattatgcaagaagcattgcccttgagttaaactgttattgtttcataagcagctattaaaataactgagcattgttttatgaacatacactaatctgagatactgaaaagctttgcaactaaaaagcaaaacaacctacattagtcatctagccattgtttggatgttttgagttgattttttatggtgcctcttttagcttggaatattacgtttactttaatccaagtctaggccttttaaagggtccttaaaattaaagttcagaatgtgaatccctttgacatctattacaggtttataggacctttttggttgtgattactgttttcaatacgattgtataaatgaagttaactttgtcagaagttaaaatggaggtcataggagttcctggagaaatggctctcctgtttctttcattaccccactgaagttcaccccagtttctggccacaagaatatgagaaaggaaccctgttgttttccaagggaaatcattcctctctgtccccactgttgattaactaaagtcctggacaccttccttcctccactggccaagacccaccttgacccaccttgaacctcttttcagagccgagtggcatgaatatgtgtactgtttctgcttctgttgatggagtggctgtgggagaattaaaggaaatgctaatttgagcttcattcataggggaacctactatatattgcatccctgctggttggaaattatcttcatctctggactgcattgtttagaaaaatgttaatggcttacaattctgagaactttattgtgtggctctggggttaagaattctgtggtttgaaaaaaaataaatattttgtattgattctcacgtcatttcaatgttgtgactatgtactaaatgcactaagactgggtattctcttagaagagtgcgttttgttaaacagatggcagttcactctcattagttctatttgtcaatattacagccacacacttcaggataacttactcaaatgtgaagtcatgggaagctatggctagtaacaggaatgcttatgaaaaatttggagggcaagcacgagcaagaggcttttgccactcactagcacagccagagcaaggatgaagcaatgaagtcttgttcctagtggtgcttgtatgtcagaagccatagtgagctcagcacagggcgttctgcacatcatctctttaatccaagaaaaacaaaatggcggatgaaactcctattgacctgggatacaaagccactgactttggctcttgatcttttggtgggttctgaatcactccttctgtattagggcatatactttcactctaaaacattgtggtaaatgaaataaatcttgtacagatgtcgttggccttgttatgttatgttataaatcctgtacagatgtccttggccttaatacctggttcactggaactttgttataatatagaatatttgattttgcttatagcatattaatattgcctcctacatgacagccacactgagcacacatctgttaccacagttacttagcctgcagggtgagtgttgatcttgacttctgcaaccagtgctaaaaaacagtgtgtaacaatatacatatggtcatatctattctatattcatatatagtatggatacggatatcagtatatttgtagtttttgttttttaaacactgtacagtttcttctgtggacctttaatcaacttttggacttaggttgtttttttctttgcatttattggta

SEQ ID NO: 63151 - DNA, 1079 bp, Homo sapiens
gtaaagcagccatattaatgcactgtgataacagtgcattgaatttgatgatacccatgttgttctcataaggcactgcttgtaatcaaggtcaggatgctttgcatgctgtggcagctccagctggtagcgatggttctcagggcattggaaagaggccaccaggttctttagtttctactgggatgacatcgtagcccagtcccagttccttaggttctcagtccccttttacttccctccaccccacatggttttgaggattttttttaagccttttttggggagttgggagaggagtgagaaatgtgtgttgaataaacagattcctgctgttatcaaatgctgtctgctcttcatactttttcctattctgatgttttttcagatagctcgtcagcatgtgcaagttccagggggtacagatagtgaatgtattgaatatgctttccttcctgaaaagaggacacactggagctgcagagactgtattcagagcacagtgggggctgcacacactcaggagctctgtcacaaagctgttcatggaagaggatgttggacttcttacttggtttgtaattttaaaacaaaaactaaaaaaaaaaaaaacgttgctgctagacttgggggtgattttgaaatgggacaatcttttaatgagtttatctacagattctgtgaggaaaaagcatctcagaaagtgaccatttctaagtgaaatctgacagccaaaatcagcagcttcctccaaaaatataagagcagaagaattttttttttaagcacttgttttgttcatttgtggacttggcattttggtgtattggtttcacatgtcaggatctcttttgctttaaaaccaagcagatcattacagtacagtatttttcacccacaaccaaaacaaccccttttaaaagagttggtctttgtttagcattagaaagtcttgttaaaggaaaatgctaactctgcttttgctagaactttcccccatcagttcacaactttcttctactctgtgccttgagctttgtgcactttgcaactgtgtgaccatgttgtcaaactcctcc

SEQ ID NO: 63152 - DNA, 1020 bp, Homo sapiens
tctgatgttgggaggcaaataacaaacaacaaacatgtaaaaaaaaaataatattgagtagtaagtcctatgagtggacagtaagtagtaaagtgctgacatgcaagggacagccagtgagccaggatggctgacttatagtgaacagaggcagagagtggaggaaagtgaggtgggagagtaggctggagaatgggttggaattaatttttaactgtagtgggaaaccactgaagggctttcatgagaggcatgaactaatctgtcttctacatgagatcactctggctctcatctgggttgataaataaggctcatgtacttgtgtagggaagagaagactgtggcttggcttgggatcatagcagtggagttgatgaggagtgattggttttgggacagaatgccccagaatgaggaaaagagaggatgaccaaggattttgggttgagtgatcaagctggaagattgaagaaggaatggggatggattggagtcagcattgtattctggtcatggtaaacttgccagtgtatataaatcatccaaatggacatggtgatgaggagttggacctgtagatctgaagcgtagagaggaaggcagagttggagatgtagatatgggagcctctggcctgtggagagagtgtatgatcaccatcctggactacacgtggagaagaaaagatgaccagcgacagagggctgggtagagccagcaaaggagacctcaaaaggatggcagacagggtgaggtaaggtcaggaatgtgtgctgtggcattactgaaacctaaagagaaaaaaatcgtgtttcaggaagaaatcaacttataaatgctgaggaagaaaggctagtagtgattattatttctcattacctaagcatttgagtcatttctgttattgtctgagaagctggagacacaaaaataggatttgtaggtagcttagggcctagtcagaacctctattttcttaactctaaagtggaattagaactttcataggtgtttgag

SEQ ID NO: 63153 - DNA, 1019 bp, Homo sapiens
cggctaattttttgtatttttagtagagacggggtttcaccttgttagccaggatggtctcgatctcctgacctcaagtgatacacttggcctcccaaagtgctgggattacaggtgtaagccactgcacccggcccagtattcttaaataaatgcaaaataatctgagtatgatgttataggtttttttctaggcttaccataattctgaagtctttatactttcatacattcatgttttatttgaacatttgctcttaatttaggatgagtttatacctttaaaaagacagccttctgaaaacttttttgtgaagcagtataggaatatagctcttgtgaattttgagcatattgagtttgccttccagagcaatgcatggaattgcttaaacgtgcccatttttctaatcctaattttggtactggaataagagaacagggtgcaggactgcttggtttatagtagctcttatgtcagatttgcttgggatgagatgagtaactgcctctgtaaataacctcaggttgcattgtgtctgcacatgaaggacaaacatggcactattcagccactggccagtttggttatattcagggaaatgtcttgaatttttggtataaataggaatttttgtctctaagtggaattattttataaaacttctggctggatttaaatactaggcagtattccaagggatgataaaatgtttttacaaacttaattagaccatttttgtaattaaactttattatacatgtgctatgaggattaaactttgcctcataaaagtattctgacaggtgctttgcacagagtaagtccgccaaagtggacgttctcatatgtaattctgagcttactcatactggccaggaaggacgtgcacatgccacctttggcagctgtgatggggagcctgcctctgctcttgtgcatggaccttccacattctgtcctgtccaacttaatgccttaattaggaataatattttagaagaagtggtgtctactg

SEQ ID NO: 63154 - DNA, 1063 bp, Homo sapiens
tatcattcatgatacattatactagtgcttttagaaagctttacttacttttcagaaccttcatgaattgattcatttccattagtggccagcagaccttcacgtattttagctactgcagtggattaaaaaaataaaatccttagtatataaacatttgattggtttattggactgttcctttcttacaattgtttatgtttcaggagtctttgggagaaacagtaatagagaaatcttgacagtcaatatgtgttacattctttttaacctgttttcttatttcagctttacttttagaagcccagtcaacaccatttcaggtcacaccttcaactatggcaaatattgtgaaaggcctgtataccctcagaccaggtaaacatttctcatttctgttgggattggaactgtttgttacagccttttccaagagggcagtggttctgtatgtgttttgtgaggcttaatggtacttggatttgctggagcaaaaaaattgagtagatactcatcattgtgaaatgtaaactcagagctcagttggaatgttctctgctagtggaaaccaactagtgtggtttttgcagaacctgtgagggaaatacaagaaataaattgtaggatacactttggataaaattgaatctcatgtttggtcttagtttcttctttacttcctgcctcacgctgcacatacttacagacatccacattcacaaccccgtcttcttaggcctgttaagtaacttgcgaagaatctagaagtgttggtaaagttacagtcattttgtaaggatgttctggggagagagacaatcacaagaaccaaagcaaataccaaagatcactatagtcaaaagcatggtttttaaattcttaatgtgtctctctatcttagaataaaacattataaatttaaaggaatcccaaggagcttttgtatatatctttctataagccggaacctcaaacttgtcatagagttgtctagcaacttataaatgtccatgggagagagattacaaaagttatcaggatagaacgttgttctacaatctat

SEQ ID NO: 63155 - DNA, 1013 bp, Homo sapiens
ctttgtacagtaaaatatcataagctaaaagtaagtggggaaaaaatgcaaaattggaaaatataagacaaaagtttgctttccttgataatcagctttcatgaattggaaaaagataaccctaaatttctgttgaaaaatggacaaagcatatgaacagacagttcatagaaaaaaaagattataaacatgaaaatatacccaatatcacaatttaagaaataaaataactttttttccgctaacttactttagttagtgaaattggaaaggtttgatcaatattcagttctggtgaatctataaagaaacaagcttctcacacttttggtggaaatgtaaattggtaaagcctctttggaagactatttcgcattattgttaagagtttaatatgcaaaaatctgactcaagaattgtatctctaggaatttattatacaaataaactcataaatacatacaaatatgtatataagaattatgcaggtttttaaaatagcagaacattgaggaacatttgtattatcagtagggactattatttaaataatttatgaaagacacagaaaaatatgcaattaaaagtaacacaactctgtttttttagagaaaaatcttccaagatgcaacattaaatgaaaaagcagggtacaatgcagtgtttaatattttcacactagtattttttttttttagggggaaaaaagcatatccatgtatatgcaaggaacatcctagaaagaatatacagaagttttcccagtgtagaatgggaccttttgggaatgggtcagaaggtctgcattgagagacttctctttattgcatactcttttgcatgctttctgttttttaaccatgtgcatcttatttttatatatttttttaaagagagaaacgtgtgttaagaattcagtggctgggcatagtggctcacatctgtgatcccagctgctcaggtggctgaagtgggaggccaggtgtttgagaccagcctgggcaattgaaaca

SEQ ID NO: 63156 - DNA, 1052 bp, Homo sapiens
gacttctggtcaacagtaggcaatattggtagttaaatttggggggacgtgaaaagttatacacagattttttactgtgttttgggtgttggctcccctaactctccggtttttcaagggtcaactgtactatagactgggtggcttaaacaaagaaatttgtttctcatggtgccggaggctaggaagtccaagacaaaggtgcttcctattcggttcctggtgagggccctctttctggcttgtaaatggctgccttctcactgcagtcctcacatggccttttttctgagccctatgggaggagcgagaacctgagcgttctggtgtttcttcatctagggacactaatcctatagatcacagctctaccattgtgacttcgtgtagccttaattacttccttattcctagtatggcagtactaggggtttagggcttcaacataggaattttcgaggaacacagtctatattctattcagtctataacatataaaaaagttggtagtgttctctcttgatggttttatgatttggtattttgtaaaagtgagttaatagaggaatgcattgtgttttactgctctacagagctgaaggtgtatatgggtcatttgtgtccatgctttctaactaatatttataattagctacagaagggtttacaaccaagttagcatagaaatcagaatatttctgtgcttaaggtaattataaatttcattagccattctaatagtacattaagcctataccacttagttgaatatcctcccaactcattccaggttcaaatatagtttggttctatatagaatatccatgtaattcagtaatagtttttaaaaatcatttatcgttgagtgcatcttttttttttttttttttttgagacagtgtttcgctctgtcacccaggctggagtgcagtggtatgatctcggctcactgcaacctctgcctccaggttcaagtgattctcctgtctgagcctcccaagtggctaggattacaggcacctgccacccccacctggctaatttttgtattt

SEQ ID NO: 63157 - DNA, 1773 bp, Homo sapiens
accacagctagtatttttcctattttggatatatggaaattgaaatttagagggcaaaatgaattccctaatgtcatacagccttgttaagtaggaatttagatttaaataatgctaaattagatttagagtcaaagtttagatttgaacaagaccctttccttgcaaaacaatgcattctttatctactatgttctaggcactgtggtcagcaccggagatatacagataagacacaaatattgccctccaggggtttgaaggtagtggcagactacccagtgagggaagtgagtgcagtggggccccactgaagggccatgtagttcagatatttttgaaggaatgactaggagaagttagccagcttagtgggtgcagagagagatggttaggtagaaagaacagtcagggaggccttatgtcttttggggagtgctagtattcccattgtcagtcctgttctttgctgtgcaaccagaggtgtagacagttgtgccctacgttgagaagtttgtgaaaaggtttcagagtgccaaaagagaatttaagtaggtgtagaaggccttggattgatcatgctttgagttgtaggtcttgggtttattcactgtagaactgtagacaggtgactatttctgagccccaatcacctcatctgtaaatggaaataacattcaatttataggcagttagaaggactaagaaaaagaaatgcgctgggtgtggtggctcacacctgtaatcccagccctttgggaggctgaggcaggagggttgcttgagcccaggaatttaagaccagtctgggcaatatagcaagaccccatttctaccaaaaaaaaaaaaaaatcccaaacaaattaggcaggcctagtgctgcatacctgtagtcccagctagttgggaggtggctgagttgggagaattgatcaattgagcctgggaggtggaggctgcagtgagctgtaatcatggtactgcactccagcctggaagacagagcaagacctttctcaaaatgtacaaaaaaaaataataatttaaaaaaaagaaatgtaaataaaagcacctagcgtgcaccagacctgtaagtacgatgaattagaaaaaataaagacaattctttacatatatataagcttctaagtagaactgaaatatgagttgaatcttatttgaaaatagtatcaaaatatttggacatttatgaaacagcttagctgaagtggtcttataatttcatgttttaaaatttaatatttaggaatccttccatgtggcatttcttaatatccttatttgaaagcaagactttatgtgtaagatatgattgataagctgtggggctgccacaagttagttcttgtgtagaatcagttttgtttgcattgtgttttgtaccatgctcgtcccccaacactctgacccaggaatgaattcttagttggaagacctggatctatcatttggctaacggtctagtcttagacaaattactggccatttaggtgtttctttagtgttaaaatgggacctaattaatttagctttagagaatagaatgaaatcatgcatggatgcacttctgtaaaacacagtgtcttcgactgggctgccacaacaaaatacagttgacccttgaacaacacgggtttgacctgtgtaggtccacttatccacggattttctcccacccctgacacagcaaggccaacccttttcccactgttggagataaggatgaaaatctttatgatgatatacttccac

SEQ ID NO: 63158 - DNA, 1118 bp, Homo sapiens
gaactcacactgtacgttagccccagtaaacagtgttgacacagagatttggttcctaggtcaggacagtaacattcaagtgggaagattagcgccgatattactaacctgcattcagggtcctgttgaggagagaccacagagacaaaggtgctgggaaatgttgcaatttttatctcaaataaggctgaatttacagtagttttaagtatttcacttttaattaaaaggaagttaactgattacatttaaaccattttaataaaattagagtgatgttgatgtctaactgtatcttggttttaagcaaaataagtaagttgactgtcaaattaataatggaaattaatagaaactaaaccataatcagccaacagtacttaactttgattcactatttataaactccaatttgcatataaaatctttactgccagattgccaataaactgagctagtcccttggtagttaaaatcagagcaaggattgcgttgctatttattttttgtccagtgggtggcagcataactcaactggttatcttgtgtacggtcatttgaaattttttatgtgttttaaaggttttaatttctaaatctcttgtactacaaagtgtattctaagaaaactttcctccaaatactctgtttatttcttgctaaagtgaataagattttagataataagaaaattgcttgatatcctttcttcataggtttcaaataaaataaatattgcaactggtaaatagccctttacatgtgtgttctactgaaaatgtttctaagttatgtggagatctatttttttcctctctactagaacttaaagcagttgtcatggcaaacccaggaatttgccagggagacaccctaaccctcgatcattcaataggctctcattcagaccatgattctaataagtttactatcttcctttgaaagaaaggattttgtttgtattttcatgtgccttcataggacttaacataataccaggcccaaaaatagagatccagtaaaaagtacttggtataagttgattacaaaaacatatgctggctttaccactgacattaccagaggcatgtgtttgttccaggtaaaacatcatccag

SEQ ID NO: 63159 - DNA, 1007 bp, Homo sapiens
gtggtggctcatgcctgtaatcccagcactttgggaggacaaggagggcagatcacaaggtcaggagttaaagaccagcctggccaagatggtgaaaccctgtctctactacaaatacaaaaaaattacctgggtgtggtggtgggcgcctataatctcagctgctcaggaggctgagacagagaattgcttgaacccgggaggcggaagttgcagtggtgccactgtactccagcctgagcgacagagcgagattccgtctcccaaaaagaaaaaaaaatggtggtcttgatttgctagagcctcgattaagcttactagtaacaaaagtaaattctggagagataccattatcctaggcatcagattgtttccatagtttttcataagcagtatctggcacttaatcagaaataactagtcatagtaggaaatgaggcatcaaaccaggcaaaattgtgaagtacatttttaggcaagaattgggagaattcatcaccagtagtttcttacacaaataaaagtgtttttcagatagaaagaaaatgtttccagatgaaaacttgaagatatgtaggaatgaagaagggaaaatatgcaagtgtggatcaataataatgataatgtcttctaggatataagaatatatatatataatcaaaactcgtgacaataatgtgtaagtttgaagggaggagtgaaggtttgaaatgttctgaagccttgcattgtccaggaaatggtaaagcactactttattttcaactataatgtgacaaggatacagtctgtagtaaaaaaacatagttaacaagacatagaggggaaaaaatggaataattttaaaataaagaaatcaagaaaggattttttaaaagtacagagaacagatgagataaatagaaaataggataacttcagcatgtctattattatgtgaaatgttaaagactaagcactacattaaaaaaaggaagacaatttcagattggtactgttccttgtgg

SEQ ID NO: 63160 - DNA, 1043 bp, Homo sapiens
ttaaatagcagcggggagtggtttaaaacatggggatccagggctctgtttccagctctgtcactcagcatttgtgtgtttgcctctttattaaacgtgctaatatatatcatcttataaattttcttgacattaaaatgaagtagatttactagactatctcgttgcttcacactaaggtgtaaggtattttctcgacatcaaaaggaagtagatttactaaaatatctgtagttctttacactaaggtgtaaggtattttttcttctgcttcctgcctggcaaatgcttcttcattcttttcttaggcttaagctcatttgtgtccatctgtgtaaagccttcctggaactcctgcactcctctcaaaaccgaacagactattggcatttcttctgtggatccatagcatctcagcaataagaagtctattagggcagtgattgtgttattgtttctgcttccctgtctgactacttcacaggcccttccttgagggggagggactctatcgtgtttgtctttttatccttagtgtctgccacaattacaactcagcagatgtgttctggctgaatgctgagtaactaaatgtgacctgtactaatggaaagagtagcataattagcttcagatgaccactactcctgtgctctctagatttgtaagcattttatttatttgttcagtgtgatgtgtgtggcctgatgtaatctttattttatagagaccttaaggcagttttcatggggacagatcaagagacggtgccaggctttatgagccagaaacattttatttggatggagcattttgtttgcagctctggttttcataatgaaatattgttgttatgagccaaaataagagcgtgggaggagttgcatttggcagataatcagaaatttagtgctggagttgataaatcaatgatttggacctacagggcgtcagcctcagtcaagggcatcttaaaatagctgtgggtttgtatagtttatatgtcagagggacttatttatttttatcccaaggcatatcct

SEQ ID NO: 63161 - DNA, 1127 bp, Homo sapiens
cgagattgcgtcgctgcactccagcctggcgacagagcaagactccgtctcaaaaaaaaaaaaaaagaaaagtcactcagcaatagattaccagggtctataccacaattaggaagcaccccagcagttttgaaataaccacagtttatagcacatgctggggtgtgctttgggcttggatattgttcttcacaacttgtggtctgagatagcttagtttttttgtgttttttttccccaaacagttgttgcactaagtagcattttgttttctgtttcaaatgatagagctgtgttttgtcatagtcagatatatacttttcttgttgttagtataaatttctttcttcatctttttgccgctaactataaaatctttattcatttaacacatatgtttagtgcttaggcattgtgtataaattgttgatgaaaccctagatctatgctttatagcttttgagtgatttgctttctaattcttcactccaccatctacctgaatttctacctgaatccagtttatggacttcgggtctcgctgtggactctgtcacacacttctgttcatttgccagtaccctagtcaggttcatcatcatttctcgactgttttactgaaatgcttatctcaactgccttacttcattgatacaccttaatttaaccagtttttgattgatgaatatttaggttacttccagtctttggccattactaacagtgctgaagtgaatagtcagtcttgtaagtaatgtcgtttactaagtctaaattgtggttcacagaagttgtatcaagttgcattcccatcagttctgtatatatcacagtgtctgttttccctcaccctactaatacagcctattatgaaaccaaataatttttagttttatattaatatagtaatgattcttattaatgattaaaacataaatcagagtgatatttcttctgatgttagtgttttttttttttttaatttttttgagatgggggtctcgctctgtctcccaggctggagtgcagtggtacaatcatggcttactgcagctttgacctccctgggctcaggcgatcctcccaccccagcctccccagttgctggcactacaggtgcatgccac

SEQ ID NO: 63162 - DNA, 1052 bp, Homo sapiens
tgttttatgtattccacacttacggattggagggtttggtttatactttttgattcaaaagtggttttcagatcatgacagaggaagcctgccacctccaccatacataatgcagacactgtggaagtcagcaataaaagcaagaatgactgaagtatctggtgtaaaaatcatatttttagtctcagagggagaccttaatctgttggtgtttattgacacacaattctaactctctttggttattttgtttctcagctcctgttaatggaagcagcaaattaggaagtggggtgggatatgagatcagcacagtgaaaggaggaagtgacaagtatgttgttccacacagctgatgtacaaagaggttgtattgcaaacacttccgtgagttagaaacctctctctactgattatcaaccactctctcttccttattttgacattcatttaaaaagagagagagaacctggtttataaatagttatcatattcagaccttagattctcacctactattagattctctagtactgattaaatgtgtaatacactacttagaagggcatatttatagcagatggtactatcttttccatccgaacaccgatgggggaggataaagtttttatttaaaagttgtgattggttactttttgaaggtatgaattattggatcagtggttatatatcaaaagtgtgctttaaccttggactgagttaagtgctttatgattaacttggtttgtgggggtttttgtttgttttacagttgtgtgtataaatgtgtatgccagcagcactcggaacagatgtatagtgatctgattaaaaagataactaatcacttagagagagtctcaaaggagctgcaggtaaagaactgattgtattgatttttgcttccttgggttttcctgactggttgcagttagcttttctaatacacatttggaagcttgttaatttgattatgatataaatttataaatgttttctaggtgaatgttgatcaaatcatgtaatttttggaatagattgttaatttgaaa

SEQ ID NO: 63163 - DNA, 1426 bp, Homo sapiens
caaaacactcctttattccccattccattcagtgtgggttatgtgattcatttgtaattcggttcattttttgtgttttgcatttcatctttaccactacagccttgttgattttttaaatttacatagtaatttgatgtacagttcttttggtcttgacaaatgcgtgaagtggtgtatcccccaccatagtttcatgcaaaacagttaattgccataaaaattcctccatgctactgctttatagataatccttctccccaccttccagcccctgtcgaccactgatctgttttcctccctatagttttgcctttattagtatcatgtaaatgggactcttagaatatgtagccctttgggtctggcttctttcacttagcaaaatggatttaagattatgccatgttgttttgtgaacattcctcagtagttcattcctcagatgtcctgtaaaataaaattaaataacagaagtggattgatttaaagaaagtattgaacaaaaatgatatagatggtacatagaaaaaaatcttgaacctggatgactaaggtgtggaaatcgataatgtgataaaaagatactgggaaggctttgctttacctggtatctctgacagtaatgagccttgagttcttgaggaagtcacttaaccactctgcttcctagtctggtaaaataaacagtgaaatacctggtctcgttgttgttactcctgaggtaactgtgattcatgacacagaatataggcaggttcttctggtagctctttttttaatattaacatttcagtgccgtgaagcaactgttacctggatttcaaagctgttaggatccactgtacaaatgctttgtggaaacctgtagtgtgggagtaagagcctgtctgtaggaatgaagtaagcctcagcgcagggtcccagttcactgacttcttttctgttgggcttatccagtttaagatagtagcagcctgagttggagctgtagtaatgatgaagaggtgctggtgttgttgtaaatctcggcaagttttacagcaacctctttgtgattgcagcatttggaccttaatcctcatagtcctgtccttaggcacatttcctcgaggatgtctacaaagattgattgttggtgttcacgatttctccaaattttcctgtggttcattgataggccattttgtcacataattggcagtgtgtatttgagggtcagagcatgtttgagactgctccactaatgacagaagcttacaggaaacccagaaggaagccagtgatgattgcttgtttggttgttatttttaaagatggacaggttcatactaacttctcttaaatccatgattaatggctgcttaacatccttgaccaggttgccttttttgtttttaattgaaataggatagttaggtgatag

SEQ ID NO: 63164 - DNA, 2062 bp, Homo sapiens
gaatagctaggactacaggcaaacgccaccatggccggctaatttttgtatttttagtagcgacagggtttcaccatgttggccaggctggtctcgaactcctgaccttaggtgagccactgcacccggccttattgtttctttaataaatgtgtgtatagtcttatctttgtttctctatatataatatgcccctttttttcctgggtacttttaaaatttttacttaagttttccgcaattttttatgttcttttttagtgtttattttttggatttgtggggttttagaatttgtcaaatttggaaaattattcattattttttgtcagaacccccctgccactagttacacatatgttataacacttgttattgtaccatgagtcactgaggttctgttcatttttttaaagattttttttttcttttttactctctgtgctttagtttgggtaagttttaatgctatgtcttcatgctcactaatgttttcttttttagtatctaatctgctgttaatcctgctcttaaatcagtgagagttccaactgtttttaatgcaggctgacagtccaggtttcagttaaccaagcaaactgttagaactgtatccagtttcttgaagtagtatagtgaataaagaatctttagtaagtgcattccttttaatgacttgttgcgtctaaagttctttcttcattgttcagcaccctcacaatccattcccacatgtattcccaagtttctgccagtataatgtattaaagtcttatagttcttttggaatgtaagctgtctcctatttatttaggtttggtacttgttcccttgggaaatctgattctagttagagatctagagactctaactagagttctgcttagagagaatcttttttgtgaggtttcaggtaatatcatggcagggtctttaatcaagtaaagttagtctcatgttgggaggggggtgtgtaagcagggtttcgtgaggtcagggttttcagattgatcatactccaccaaactggccccatttctgctgggattacaggagtgagcctctgttcccggccgaacttcaggatcttattggggatcttgtcttgctattttttgacctgcatcatataaaatgttgttgatgaaactgtaagagaaaggcattttaatgtttacttaaggcccagtcccaaatctctaaagaaaatgaatactgtttatttactgtaaactctgtaaaccgtagaccatatgtattcacattgtaaactgttaagcactatataaaggttgattgttaatatccttttatggtatgtcttgacagggcaagctggctttccattttttcttcctgcttttgtggacattcggttattaacctctaaagataaagttggatagatgtgtaatatgtagttgcaggtatgctgattcatcatctgaatggcattttattaagtgtttattgtgtgccaaagtaatattttagcctctggtaatgaagagacacagttgaatgtgggaggtgatagaaaggtaattatgatacattatgattaaatgctataataaagctatgtatttggtagcattcaggaaagagagtctttataaaaatgaatagaagttggccaggaggatagggggtggggatggggaagctggactggaagagacttccttgcagaggggcagcctgtgccaaagacccagaattgaaattatttttggaatacagagtaggaggagagactggctcatgttaaacatggatagatagaaagggctagatagtgaaggaccatgttagtggaaggattttcttctgtagtaatgggaggttttaagggagacatttgtcttagtgtgttaatttagagcggatagagagtggaggtctaggggctagttagggtgttacaatttctgtaatctagacaagagatggagattgaacaaatacaattttaaaagataagaggtttcaatttggagatatttagggactagaatctacaaaattttgggggtgaggaaaggaagatgaagattaaaga

SEQ ID NO: 63165 - DNA, 1647 bp, Homo sapiens
ggttgcaccattttacactcccatcagctgtatatgacagctccagttgctccacttacttaattggcacttgtactggttaggctctgcattcttggtattgtcagtcttttaaagtttagcctttctagagcatcggtccccaccagggaccagttgcgtggaagagacaatttttctgtggactgggggatggttttgggatgaaattgttccacctcggatcatcaggtcttagagtctggtaaggagtgcgcaacctagatcccttgcgttatagggttggcgctcctttgagaatctaattcctgcgctgatctgacaggaggtggggctcaggtggtaatgctcgccggcccacagctcacctcctgatgtgtggcctggttccttacaggccaccgaccggttcctgtggcctggggttggggacccctgttctagagaatcgtagtatctctttgtgtatttattttgcatttctcttttacatgtgccgttggctttttcatgtgatcatttgcttgccttataattttgtttgtgataatctgctcacatcttttgctcatttcttttgttgtttgtcttaatgtgtttaaagaattcgctataaattttggatacaagttttgtcagacaactattattactgttttctccctctggtttgtcttttttttcttaacggtgtcttctgaagagtacatgtttttcagttttgataatgtctaaactgtcaattttttcttctagctgttgttttttgtatcctaagaaatatttgcctaccccaaagtcaagattttatctgtaatttttcttagcagttttatggttttagcttttacgtttaggtctgtgatctgaattatgagttgatgtctgtatagtgtgagataaggattgaggctccgtttattctatatggatatccaattgtgttggcactatttgttgaaaagactatccttttcttactgggttactttggaaactttgtcagaaataactgaccatgtatgtgtgggcgtcagttctatttcattaatcttatttagtccatcagatttaggattgttgcatatcttcttgatgaattgactgtttatcatgatggaatgtctgactttatccttgttaatattccttaccctaaagactcctttttttttttttttgagacagtgtctcgctctgttgcccaggctggagtgcagtggtgcgatctcagctcactgcaagctctgcctcctgggttcacgccattctcctgcctcagcctcctgagtagctgggactacaggcgccagccaccacgcccagctaattttttttttttttgtatttttttttttagtagagatggggtttcaccgtattagccaggatggtctcgatctcctgaccttgcgatccacccacctcggcttcccaaagtgctgggattacaggcatgagccaccattcccagccaagactacttttacttgtaggcattccaggtttttttttaagggttattgtttgcataatgtatcttttaccatcattttacttttaatttattttttgtgtaaagtacatttcttgtagacaacatatggttggatcttttttaaaatccagtctgacaacctctgctac

SEQ ID NO: 63166 - DNA, 2270 bp, Homo sapiens
atcaacacctccacctccaagttctgtgagtccagcctttccctgcagccttggcttttctccacctcactcggacgccgaatccaccccctcttggagaaagctccgcttcctttgtttcaggcctcggtctttcctcttctccccgtccgccttcgcctccctgcctccttccccctcaccgtcccctccccctcatttggtgtctgcggccagcgcctgagcggccctggcttcttgtattacctggcctagagaggcagcctggtacacacggagccccaagttcggtcagtgcgatccctatcacaactggcagtctctcaacattgggaagctcttttcgcacccgtcttctcttgaagtttcaccctcaaagtgaggggaaaataaggctgcctgagtctcgttagggaaaggccttcagtcttctgcagccagagagagaaaagaaatctggcaacttgtgttcttgtgtttttggccaggctgtgttaaacaagtaaggaatttgaaagttgacctatatctacaccttgttccttctctactgtgttacacttttgcatcctgctagggaaataatgagttgctttccgatgcagtggcagctccgacatcgtcttgaagctaataatgcataaaatcacttttcagagcttacactcataagaataagcctttcaggatgggttatgtcttgtgtccaaacccaagattgggttgcatgttgaactttatgttagtagtctgtcttaacgctcaattgcacgcattaagatttaagaccaaaatctgttttgtaatccgaaactgcctctgaccaggatatatgtatgcttccatagctaggaaaagaatgtgcttttactttggtttgtgtgtatgtgtgcgtggcggtggtggtggtgataggatgttgaaaatgattgtgaccatcacagccaggtttttctctcctattattaactgcaagttttgagtggcatctggtaaagcaactggagagttcatttctagctactaattttatgaagctgtacttgtccagttagctgtgcagagaaaatatttgccttgatgcagatagtcggaatcttacacactgtgtgtgggaacagcgcgtaattttatttgccccaagatactgccttagtcaaagacattgatatgtacgtttggtaagattatatacgctttttctccttattcatgataatcatgtttatattgtatagtttgtgtgttgaaggctgtgttgtggaaccagacctcctgtagagtggcagaatgacttcacctgagtcacgaaggaagattgccttagtaaagttcctttgaagagttcaaaaaagagcataaagttaggaacagaaatcagtaaaattgagaacaaaaggatttgtcacaccaaaagattatttttgtgaaaagatgagtaagctaggcagacagacctctgataaaaacgacaagaaaaaaagatgcaaataaatgaaaaatggaaaataactacaaatatcagattaaaaaaagaacgttatgaacttaggctgatgaatttgaaagcctaaatgaaaaatatagttcttagaaaactagtaaatgtgaaaattggtatcagaagaaatatcttgaactaataaactgaaatggtaaagatctccctttttagaagctctgcatccagatacgctgatgagttccaccatactttaacacttaattctttttgcaagttgcactggaaaatagaaaaaataccaagttcattttatgaggcttgtgaaatcttgattctaaaacagataaggacatgtaagaagagaaaattataggtctgttttacttagcatagaaatgaaaatactgcagaataaatactcgctcatcaaatccaacagtgtgttacagagtcctgatccatagagttagtcctagagatgaaagcatggtttaacatctacttatctaatttagctctttaatagactaaaggaaaaaaattacgattatctcaattggtgccctgaaatcattcaactagatccagcagctatttatgataaaaactcttggtaacctaggagtacaagataactagataaaggtcattaccaaaaaccttcagtaaataataatacttaatggagaaattttagatacatatactttaagatccgtaacaagataaggatgctcctgtcattactactgtttagcattgtaggaaggtcctggctaacattataaggagcaaaaaaataagg

SEQ ID NO: 63167 - DNA, 1005 bp, Homo sapiens
tgcccgctctccaaagtgccgccgccgcccgcccgcccgccgccccgcagcgccagggacggcccgcctggcaagaagctgcgctgaaggcccgggctcccggccgcccagggtcgccgccgcccctcgcaccgctaggtctgcgcaccatctcgcccccgccgtggggaggcgtgcggctcagcggtcggctcgacatgggacgtcgtcctggtggtttttgaaaagcagccgaccgtgtggagtacttccgtgctgaacgattgggactagacgctgaaatccccatttgtcttcagtttctagtttgcacatccagaacggcgaaggctgggtgtgtattccactaactgaaatatggcaacttagaggcgctgtttatttactgtatacgtcgacctattttagatgcgcatcagtatgaaattgtctcaatcttggatgtttcattttatgaatggaggcactttactaggtctagaatatttttttaaaagcctctgaactgagcttaaaactggcgattttatgaaatgtcggcaaaatgactattttattgtttgaagcgagttaatattctcagttgtctttaaaaatcagttactctaattccaggtgaagcaagccgctggtagcatcacccttatgagaagtgaaggttttgtaaactttccagtattaatttgggcgggtattccccgcttgtggcttgtttctgtcctagctggaggtgtaaaatgcacaatgtgtagcaggtagaatacagctccttatcgttctatgtaccaggtattttattactgaactagcaactagccttttccacctttaaaagttgtgccaagtcataatcatattgtgtataacttggaaatggtgctgtttaaaaaaattgtgtatttatacagtaacagtatgaattcattaatctcacctgtaactttcctacttggcattttctctacacactcaccctcttccagttctttaaaaacgtttatgata

SEQ ID NO: 63168 - DNA, 3961 bp, Homo sapiens
gatgcaattttcttcaaggaagaaaatgtgtctgctggccagtatggtagtcagcagtcacatttggcagccaagcacttagaatatatggttgatggtcctaaggaaatatctccgttttactttaaatgtaagtaaccacatatgggtagtggctaacgagtgggacggcacagatctgggtgttctcatttgttctccacgccccaggcatcaggtaaggtcaggttatgagtttaaactgtctgttatatttgtaaactctaagccccagcttggactggatgtacttataattatccatttggtctaacagtaagaacctgacctgtcattgtaaatggctacagggatgaaggtggctggagaagaggaccagctgaggaatcttcaagctggagagactcaagtcgccgggacgatagggatagggatgaccgtcgccgtgagagggatgaccggcgtgatctaagagaaagacgagatctaagagacgacagggaccgaagaggacctccactcagatcagaacgtgaagaaggtatagaggttacatacaactgaagtattggagaactgtcgtttctggggggggggggatttgggttatttaattatatcataaatttgtatgaaggccaacaataagagagttgatattctatttagaattcatgattttcatacagttactcaatggtcatgttgtaaagtgcacttatctctaaattcaaagtacagtagtagactaaattggatagcaggcaatatatataaagtttacttaataaaaatgaaaaaaattgttatttaaaagcagcttcctggcagattaagcacaaagtagaaacattttctctgaaattgtaacagaagtttattctgttttaaaatatatgtatttttcatttttaaaatcctcatttttctcttggtttttaaaaattaattttccatatgtcttgacatcctgttatgagagaatttttctctcatagccataactttaaaaactcctgtattttgtatggttaatttgctgttaaaattcttcaagagccaaaaatcctttcagttataaaattttcattcagccagatttttgccaccttgtcttacgggtttatactaactgtagtccttcccaggctagtggtttctgcctgttttcagattttgagttttatctgtacatttgtatgttaaagattgtcagaaattgtatgagctttcattatgatttctgtatttaacaatacagaatttaacagaatttctgtatttaacaatgatttctgtatttaacaatctttagtacaggaattttgagtaatttgagccaatagaatatagtactaacttaattttttttttttaattaaactttttagtaagttcttggagacgtgctgatgacaggaaagatgaccgggtggaagagcgggaccctcctcgtcgagttcctcccccagctctttcaagagaccgagaaagagaccgagaccgagaaagagaaggtgaaaaagagaaggcctcatggagagctgagaaagatagggaatctctccgtcgtactaaaaatgagactgatgaagatggatggaccacagtacgacgttaagtctcaagataatggatttaaactggtgtcttaaataggtttgatcacattcaaggattattatacttgtgcttcaaccaatctaaattggattctttaatgttgtttcaccataacacaaaaagcatgaacttgtattaatcctatataatagattgatcatgcaccatatccacaggaggttggaaaaaccatgccattttctggaatttaagggtgttgcattatttcatcaatcatttgttgacaaaaaagaaaaactaaaaaataaatttaaaatgtgacccttcaggtattgagtaacacctttatcttggtatagaactgatactttttttttgattttgaaatatctgataataatttggaatgaagtaaggttctgttaaaatatatttgaagaccctttaaagcagtgaatctgaaacaattttcacacccttaagtggttgatacgtacctattttaggtattttgaggtatttaccataaactaaatttagaaattttttagattcacttgaagtaaacattacaaacattggatacggtggggttttctttagattttacttgagagaaggtgagtacaaagcaatttgcagttgttgtaatgacaagattactgcgcaagtgtgaatccaaacagtatagcttttaaattttaaagcatttggtaaattatcgctgagtttttttctgttgccaatagcaaactgcttttccattaatggagaattcatgcctttcaagcattttaaatatgacaatatttataaatgtatggtttggaggaatcgtttaaattctctttcctaattttctttcttttgaagatagattctttcaacaagtaatttgtagtaatgactgtgttgacttcaattttggagcgcagtagctatgttaaagatgaactatttggtctcattgaagccaacacagaacttgctgctgtgttttttcttcagtgataaataaaatacttacagaatttgttttagtgttgatttgtggttatagtattttgtttataatggtaagtttgcatattcagttgagttttttttacttgaatttttatcagtgccattaaatgtctgtgtttagtatcaatgaaaatgaacctaaatataacaaagaaagcatatgtggctaggatgtccccctaacatgtcttcctttgttaatgcaggaattccttagtttccttgtaacgctgtcctctgagtttgtgtgtgcatgtgcgtgtttgaagtaccaccttgggttttcacctgaaattagaaaaatcgtagttaatttgagaaaatgttacaaattcatcatggctgtaggcacttatttctgttattgagtagtggtgagaattcctattggtacagctgtagggccagaagagggagtattgatgctttttaacttaaccagatgcagctatttttgtttgatgttaccaatgatagaaatcattttaaacaccttagtatctggtatttcaaatacgtagaagtctttaaaggtctttcgtggggagaaggacttttctttcataacaagagaatttcagatcagtgattacaagtggggcagtaacttgctaagagtttgcttcctggagagtagatctgtatgtgtgacatcacaggtaagccccaagaatttatttaatcagatttgttcagacgagttactgctgcctacgttagagttagatttcaaggcgagtcagcaaacccatcctttctgctcagtctcccgtactgttctcccaagttctttgttctgggagtcagaacccaagtgcaagaggagggcagaagagtctgatgctgttactttgcgatcctgctcttggtttccactgtccaggccatacaactctgtctactcccattagtatttaccaacaggtgttaaaggaaagctgaacaagcagcctactcaccgatctgctaggtggtcttccatgttcatggtggcttctgcagtttcattgagagtaacattgctgttaatacagatagatccagtagtagagacatcatcggtccaaaagactttgcatctcattagttgtccatagtgactaccaggaggtggctggcatctataacgtgtgggacgtttttatgtaaagaactgcctgtgtttttttttttttttaaccaaagacactgaccatagattgacttatacttttataagtctaattgaaatacttggggtactatgaaaggactgttccttgagtggctacgattagaaaatcaggactaacaaacttttctttgtctggaagcatatatatttgtgatataattttaatatgtataattt

SEQ ID NO: 63169 - DNA, 1129 bp, Homo sapiens
ccaggctggagtacagtggcactatcttggctcactgcagcctctgcctcccaggttcaagcagttctcatgcctcagcctcctaagtcaagtagctaggactacaggcgcaccaccacacctggctaattgtagttttagtagcaacagggttattaccatgttggccaggctggtctcgaattcctgaccttaagtgatccacctggctcggtctccaaaagtgctgggattacaggtgtgagccaccatgcccggcccattttaagtttctcatataagtttaagatactgttaatgatgtctgtgcagtgatgtacacagctttagtatttttttaatcagtgtcttaaattagcatttagaatgatgatgaattaatgccaacgtctattcatgattgccaatctgtttcttcttttaaaaatattttaaaaatgttttgctttttcaaaaaaacaggtggatggagagagaaagaaaaagccagagaggagagctggggtccacctcgagaatcaaggccatcagaagaacgtgaatgggacagagaaaaagaaagggacagagataatcaagatcgggaggagaatgacaaggaccctgagagagaaagggacagagagagagatgtggatcgagaggatcgcttcagaagacctaggtgtgatgctctaattaaattatttgtagaggccgggcgcagtggctcatgcctgtaatcccagcactttgggagggcggatcacctgagttcaggagttcgagagcagcctggccaacatagtgaaaccccatctctactaaaaaatacaaaattagccgggcgtggtggcgcatgcctgtaatcccagctactcaggaggctgaggcaggagaattgcttgaacccgggaggcagaggttgtggtgagccgagatagcgccattgcactccagcctgggcaacaagagcaaaactccgtctcaaaaaaaaaaaaaaaaaaaaaaaaaattccctcttaaagtaagaaaatggaggcccaaacttcgtggctgtccaaaggctgtgtgacccgttgggcattggaaccagtccagccatctttgtcagtccgttgcttttacccctgtggtttagggcagtcag

SEQ ID NO: 63170 - DNA, 1731 bp, Homo sapiens
tttgcatttttagtagacccgaggtttcactatgttggccaggctggtcttgaactcctgacctcaagaaatctgcctgcctcggcctcccaaagtgctgggattacaggtgtgggccactacgcctggtgaatttttatattctttatagtgatggggttttgacatgttgcccaggctagtctcaaactcctgggctcaagcaatcctcccgccttggccttccaaagtgctgggattacaggtgtgagcgactgtgcccagccgcatgtcttacaattaagtagagatgggttttgccaggccaggctggtcttgaactcctgacctcaggtgatctgcctgcctctgcttcccagagtgctgggattaaaggtgcgagccactgctccggcccatactgaagtttttaaaaagcatgtgaaaaaaaaaatccccaaaggatcatatgcttttttattttatatatttttaattgttcttgttgctgtgtagggagtggagacgtggagaagggcgagatgaggacaggtctcatagaagagatgaagagcggccccggcgtctgggggatgatgaagatagagagccctctcttagaccagacgatgatcgggttccccggcgtggcatggatgatgacagaggccctagacgtggtcctgaggaagataggttctctcgtcgtggggcagacgatgaccggccttcctggcgtaacacagatgatgacaggcctcccagacgaattgccgatgaagacaggggaaactggcgtcatgcggatgatgacagaccacctagacgaggactggatgaggacagaggaagctggcgaacagctgatgaggacagaggaccaagacgtgggatggatgatgaccgggggccgaggcgaggaggcgctgatgatgagcgatcatcctggcgtaatgctgatgatgaccggggtcccaggcgagggttggatgatgatcggggtcccaggcgaggcatggatgatgaccggggtcccaggcgaggcatggatgatgaccggggtcccaggcgaggcatggatgatgaccggggtcccaggcgagggttggatgatgatcgaggaccttggaggaacgccgatgatgacagaattcccaggcgtggtgcagaggatgacaggggcccttggagaaacatggatgatgatcgcctttcaagacgtgctgatgatgatcggtttcccagacggggtgatgactcaagacctggtccttggagaccattagtcaagccaggtaaaattctatttcctagaatatgcttaagtgttcacctgtaaaagtgaaattctgatggataaatatcagggctgtattgttattttccagataaactggtctttcatctttccttcagtatcatttgcagtgacttcgctgtcaaaagtttgccttcagaataccaccatccaaaacataaataacccaacccctctcttctttagtgatgtgctctttgttttccttctgcttcgatgactgcttctttgaaggctcttcctgtactcatgctttcagtattggtgtatttttcaggttttactgggaaccagcctccttttaaaaataaataattgaaaccaaaatgtactttatatatttatttttgccaactgagagattatgcaaggaggaactcattttactttactttttttgagacagggtcttgctctgttgcacaggctggaat

SEQ ID NO: 63171 - DNA, 1045 bp, Homo sapiens
gggattacaggcgtgagccaccgcgcccggcccatcagagtactttgaatagagaagtactgttaatttaaccacccccattagacattaaataaaatgtctccacctttctttgcttcgtaggcactgtgatgtccatttcagggcatgtggcttttttcacattcttcaaaggggatttctaggttgaaggaaatctgtagaggtgtatgttcccaggttgctttccagcacagtgttatatcggtttgtaaggccacctacaatatatgagactaccagtttccctgtagcgtcagtctgatctcagattaaaaaataaatgaaattttaaaacttgcttatttaagggcttcatattgttataagtacaaaaaatatttgaatggtaataccagtagttgtaatagtaaatggttaccaatgtaatgcttctttttcactttgtcaatggaggactctcgttggggagatagagattcagaaggcacctggagaaaaggacctgaagcagattctgagtggagaagaggcccgccagagaagtaagtagagttgaggaaaataatgccgctccagttcctgttaatatcttatcagtggttttaaaatttggttcattttgtagaggcagggaaaggagagccatgaagaattgtgtgcatgtctgattgcgtgtgggtttgtattttgtttttttgggtctgctgcccaggctggggtgcagtggcgctatctcggctccctgcaacctctgcctcctgggttcaagtgcctcagcctctcgaatagctgggattacaggtgtgtgccaccacacctggctactttttgtatttttagtagagatggggttttgccatgttgcccaagctggctttgacctcttgacctcaagcgatctgactgtctcagcctctcaaattgctgggatgacaggcatgagccactgcacttggcctgtgttgttgtttttgttgttgttgttgttgttttgagatggcgtctcactctggagtgcagtggcgcgatctcggctcactac

SEQ ID NO: 63172 - DNA, 2480 bp, Homo sapiens
tgggctcaagtgattctcttgcctcagcgtactactgcatctgacttacagtattttaaaattaaggtttgtacattggtgttttagacatgctattgtatacttaatagactgcaaacttctatatgcatcggataaccaaaaaatctgcgttgcttgctttattgcaatattctttattgtggtggtctagaaccaaacctgcagtgcctccaaggtgtgtccgtgtatcataatttttcctttataaagttcctggtatcatggggctaaatgaaaactgtctctcctaaatgcctcaggattactttgtctacctcttgcccgtaattgccttctggggacctattgacatggatgtagttaacgttttcatttttatggcatgacagaaggggcagtggagcagcttctaatttttcaagagtatttctcagtaatttggggttaatgagtaaaaaaaaaagtgcattgaaatttcacaatatttgtacttgcagattactacaatgcagctagaacgtgaaaaggctcttgaacataagaatcgaatgtcacgaatgcttgaagacagagatttattcgtaatgcgactcaaagctgcacggcagtctgtttatgaggtgagcttgctgatttttgggaaatgtttattcatgagctttctagtattggcctaagggttctcccttaacaaattggtatattctttattgagttactatgtgtaacggtcattcaaataatagaaatttttggatgatatttcataagcaaaacaatcatcaaaattgttctaaaggtgaaagttgaatgcataatttaatacaagttttgtttactgtttttgttagaaatgaaaaaactagatcaaaatgtcctgggcttagattctaatttgaccattgaattattttgtataaagacaaacccactggaggtaggtaatatcaacaatttaaatgttttaaaatttggcctgctgacaagttaatggtcatttggaagttagagtttttgtgctgagaggttgctttcgatgattctgatacacttgagagtcttttgtaaacctaatagctttctgcgagtttgttgctcttgacaaagtgtgccctttttgggttgggggttacttcgattgcaggaaaaacttaaacagtttgaagagcgattagcagaagaaaggcataatcgattggaagaacggaaaaggcagcgtaaagaagaacgcaggataacatactatagagaaaaagaagaggaggagcagagaagggcagaagaacaaatgctaaaaggtacacaggtcaaacaggattggaggggtgctaatgcaaggttggtgttaagatctagtttttagtgatcttatgtagaaaatacaggaatcaaggtaattggccttttagcactgtaattaactggatctcagaacccagtttgctgtatgtgaagttgttacatcgtctgccagcatttccccacacatttgatgttcttctagaaattaatactttttttaatcaccgtattctgtgtattaacatttattgaggaatacattccagatgatggctgttaaatgatgctatatctggaatcccagattgctcagggatgggggagggattctagtatcttattacaaaactatagttgaggggtgtagtacttattttcttgactatgttctgtcctgtagctgattacaaactattttcaaattcttttacttgtacattatgctacctgtttaataccagaaaagtggaactagcactagggggaagatatggctgggaggcacacttagtaacctaatcaatggtctagagcgggaagagagagagcgcgccgaacgagcaaaacgcgaggaagagctacgagagtatcaggagcgggtgaagaaattagaagaagtggaaaggaaaaaacgccaaagggagttggaaattgaagaacgagaacggcgtagagaggaagagagaagacttggcgatagttccctttctagaaaggtgagtatagggtttattgattttattttgttttaatgtgactttttttttttggttgaggcacagtcttgctctgtcgcccaggttgcccaggctggagtacagtggtgcaatctcagcccccgggttcaagtgattctcgtgtctcagcctcctgagtagctgagattacaggtgcataccaccatgcctggctgatttttgtaattgtgatgtatttttatcacccagttctcttccatgatacctatgtaaatgtatttaaatcagttattttcacatctctttctcttttttttttttttttgagacagagtctcgcttcattgcccaggctggagtgcagtggtgtgatctctgtctcggcttcctgcaatctctgcctcccaggttcaagccattctcttgcttcagtcttccaagtagttggaattataggcgcccaacaccatgcctggc

SEQ ID NO: 63173 - DNA, 5581 bp, Homo sapiens
ttcttttttgagcatttttgtttattttatgaatacaccatatgtgaattctccccagtttggggctattagaaatagtgctgccatgataatttttgtgtgataatttatataaaagtaaaactggtattttccttgttattggtaataaaatattctattggccacagtagttgtctttgtgaatatttaattggttgtagttgtgttttttagagtttcatttcctttttacatacttgtggggcttttcacggtaggttaatgtgcatagtgtggggcaaaagacccagcatagttgtactttggattcatttttggtaaatttagaggaggttgaggcttgatgattttttaaatcattttccagatttccaatgctatcatttatactaagttcagaattttagttggaaaatttcctttggcagttacatcttttgttttgcttactgtaggtcagatttaatgtactacaatatgttgtcccagaagtgaaagacctttacaattggcttgaagtagaatttaacccattaaaactctgtgagcgagtcacaaaggtaagcctttgtatttaagttctggttgttaccacagagttggccttcttgcagttttgggttgtattcatatttgttaagagagaagttttgtcctatgtgttggaattcagtgcacatttcattgtcttttttctttatttcaagagaaaagatatatctgatgtgctcagcaaacctttggaggttaattagcagcatgactaatttagccattgctgccagtcaccttcaaacaagtatcagtagcttcatgatacattttgtatttctttgcattggatgatgtttttgtatattaaaaaaaaaagagttttagatgttttagtatctcttatgtagaaagtgtgattctctttcaatttaatggattttataggttctaaattgggttagggaacaacctgaaaaggaaccggaattgcagcagtatgtgccacaactgcaaaacaacaccatcctccgccttctgcagcaggtaaaaataaaaaaataaaaaaagttttgtgatgttatgtgctcatcatgaaactaaaaactggaaaaatctagaactgcctaggaagtgagaacctccccaagttctgcccctggcaaaaattagtctatttattaatttgaaaatcagaattattatatttacatattttgtaacggacgcttttgttttttggctgaacactgtctttgggcatttttccttgttagtaatgtagggctaccttattccatttaaggtactgtggtgtatttattcagactctcttgatgaaaacctgtattcctagattttttttttccctgttagaaatcttgtagcattgagcatctttcatacatgtatctttgcatacttctattactttctgtggcataagaagtggaattagtcatagggtttatggatttaaagctttaatagctattcagaagcctggattaatagaccccccaccatgagtgaatgagacagccttttcatatattttagtccaggggcttaagtcagtaagtgctcccattttgttttccatttgttgcatttgggaaggagggcgttttattatattttcatctcagtatttgtgcacatttcattgacctgctttcttttatgtgagtagtgttatttcttatgtgctatacaaataattgaaggctaattagcagtataactataaatagtaatgctgccagtctccttcagacaaaaattctataagaagtgtttaaatatattcggtaagtagcaggtttttaggcttttttgttttacaacaactaggatttgaaaagattataggtttgaggaatagtatgataatggttctcaaagcatggagtttagagtcgatggtctgggattagcattctggctttaacaatgtactgctaacataaattctctggcataatttctacttcccatgactgtcatgagattgcacataaaaagtgctgaataaacagtggctagtgttattaaccctttgttttctatgcaggtgtcacagatttatcagagcattgagttttctcgtttgacttctttggttccttttgttgatgctttccaactggaacgggccatagtagatgcagccaggcattgcgacttgcaggtaggtatgtgctgtaaggagacaggagaaggcccttgagggctagaaagacacataccttctgtttctcagcttttggtacagtgataccattttaaagtttactgagtgaacttttccagcttttgtatatgacattcttctgttactttttgacttcatgcttacttgtggatttaaccattgataatttaattttcaaaggttcgtattgatcacacttctcggaccctgagttttggatctgatttgaattatgctactcgagaagatgctccgattggtcctcatttgcaaagcatgccttcagagcagataagaaaccagctgacagccatgtcctcagtacttgcaaaagcacttgaagtcattaaaccagctcatatactggtatgcatcttcccggggaaataaatcccagaagttttgagggactcttaacgccatgccatgtcttttacaaaaaggtttgagacaatatctgagagaagggatttatgatatgtttcctatagaattgtacttggtagttttgttatttgatcaaatacacaaatcattgagctttcttccattgaacaaaatactactctgtgtaggtaatgtaatagggtggattatgttacagaaacaacagagtggacataggattcctcaaatagtgaaatacagtgactggatttttccctcctgcttaagttatttcttttttttcttttttgagatggagtctcactctcacccaggctggagtgcagtgatgccatctcggctcattgcaatctctacctcctgggttcaagcaattcttgtgcctcagcctcctgtgtagctgggactacaggcacgtaccacgtgcacagctaatgttttgtatttttagtagagatggggtttcaccatgttggccatgctggtctcaaagtcctggcctcaagtgatccacccgccttggcctcccaaaagtgatggggttacacgcatgagccactgcctgtaacaagttatttcttgtatgtgagctctgttaatgaacacctaaggtaggtttggtgcagagaaaagttgtcttatctaggagagcttctttagctgcgtcattgctattaaaagactgaataggagcaacaccatagcatttaataccgaaaacaaacagcttggatagtgtcatcttccattatcaaatgcagatacatagaaaggcagtacatcaggattattttgtaatttctttgatgcctaataccagagaatgttaattttggtcatgtaaaaaaattcatttgtttttgaagcaagagaaagaagaacagcatcagttggctgtcactgcataccttaaaaattcacgaaaagagcaccagcggatcctggctcgccgccagacaattgaggagagaaaagagcgccttgagagtctgaatattcagcgtgagaaagaagaattggaacagagggaagctgaactccagaaagtgcggaaggctgaggaagagaggctgcgccaggaagcaaaggagagagagaaggagcgtatcttacaggaacatgaacaaatcaaaaagaaaactgtccgagagcgtttggagcagatcaagaaaacagaactgggtgccaaagcattcaaagatattgatattgaagtacgtagcatcttagttattaaaaaattagttttatccaggtattttgtactcttagaaccacagtcctttaccatttgttggcttactgggttatttcatgcattttggtacagctggtcatgactaaatctgtgagtaagcatatgtttattgctctgtgaagttttgtgttttttttgagacggagtattatcttgtcgcccaggctggagtgcagtgacgtgatctcagctcactgcaacctccgcctcccgggttcaagtgattctcctgcctcagcctcccaactagctgggattacaggcgcctgccaccatacctggctaatttttgtatttttagtagagacagggtttcaccatgttggccaggctggtcttgaactcctgacctcaagtgatctacttgcctcagcctcccaaattgctggggttataggtgtgagccaccacacatgacctgtttcatagacaccttatacacatagcctgaaggtaattttgtacactattttacataattttgtgcatgaaacaaagttttgaatgcattttgactgacctgtcacatgggtcaggtgtggaattttacacttgtggcaccatgttggtgctcagaaagttttaaaattgggagcatttcagattttgggtttttggattaggtttgcttaccctatttagtagagtctgggtagatgtaggttggagtagtgagaaaaggatgtatggatatttttttccttatggtcaaatggaaataaggctattgtataatatttttacatttcctaaattatcacccattgtaacaataaaagcaatgtaggattttattctagaaagcagtgagttatgttaggcattgcttgtttctctttattaacaattgtgcatttgtattacctttcaggaccttgaggaattggatccagattttatcatggctaaacaggttgaacaactggagaaagaaaagaaagaacttcaagaacgcctaaagaatcaagaaaagaaggtaaatgaaagggttggtaaacctttaacataccaagttaagagagattttttaaaactacgtgtgttttcgtgtcattcagattgactattttgaaagagccaaacgtttggaagaaattcctttgataaagagcgcttacgaggaacagagaattaaagacatggatctgtgggagcaacaagaggaagaaagagtaagttttttatttaattgtaatatttttagattgtaataaaatcctctgccagtaatggaaccaaggattcagaattgctttattttgtattcttctgctagaaatggtgctctaatggctgcctatgaacagattggtagaaagagggaaaatttcacaatagagattacaaacgaaacttggaaaacaaaggacaactgaaaagcccattttataaaaaactgctttatatacactttaaatgggtaaattgtatggcatgtttatacatctcatagttttcattttacttgcagaattgtgcagccatctccacaatctaattttaaaacacgtctcaaaaagaagttctaaacccattagcagtagtcatccctattcttccccaccaccccagccctaggcaaccgctaaactactcctttctctagatttgctgattctggacattttatataaatggaattgtgtactgtgttgtctttcgtgactaaacaggtcattccatagttttgttaacttatagtatat

SEQ ID NO: 63174 - DNA, 1060 bp, Homo sapiens
cttggctcactgcaagctccgcctcccgggttcatgcgattctcctgcctcagcctcctgagtagctgggactacaggcgcccaccactacgcctggctaattttttgtatttttagtagagatggggtttcaccgtgttagccaggatggtctcgatctcttgacgtcgtgatgtgccccccttggcctcccaaagtgctgggattacaggcgtgagccaccgcgcctggtcaatcacaatctttttctgaagctagaaaacactgacagtactgagtggatagatgaagtcctgattctccaagtattcgtttaaacacagcccatttctcttactcccatgctttgatggaataatatttatgagtatagtgcaccatggtgatgtacacgttctgtcactagcacgccttaccgtaagattaaagagaagtgcttttctgcttaccaagtatcatttacaaacctaacagatttaaaactttgttctccatagaatgtctactagagtccttttagccactctttccatccctattactcctgagcgtacggatattgctcgacttctggatatggatggcattatagttgaaaaacagcgtcgccttgcaacactactaggtcttcaagccccaccgacacgaattggccttattaatgatatggttagtattaatttgaggatttttgtagctttgggcagaaaactttgtggtcaggtttaataactcatgattaaatactgggaattctgattcagtgccaagggttctgatgtatggacagggaagcactggtgtcaatcactgttcacttgaggcagttccgcgccagtgggtgagcaggggttaaattggtgggagttttgatctagcaggacttgggttggctctggggaataccgtgggccagttagtaagagaagaagtaatgatgggcaagaagagtcatggcttatttcatggaggctctaggaaaactaattaagctgtgtgtggtaaatatgaagaggctaggtgtattagtatgttctcgcactgctatatatacccgagg

SEQ ID NO: 63175 - DNA, 3264 bp, Homo sapiens
taaaaaagagctgggatcttgcattgttgctcaggctggtctcagacttctggactcaagtgatcctcttgcttcagcctcccaaagtgctgggattacagctctgcccagcctgaattttcactttctttctttttttctttcttttttttttttttttttttttgagacagagtcttgctctgtggcccaggctggagtgcagtggcgcaatctcggctcactacaagctccgcctcccaggttcacgccattcttctccctcagtcttcccaacagctgggactacaggcgcacgctgccatgctcggctaattttttgtatttttagtagagatggggtttcaccgtgttagccaggatggtctcaatctcctgaccttgtgatccacccacctcggcctcccaaagtgctgggattacaggcgtgagccatcgcgcccagctgaattttcactttcatacaagtaaatttggactttttgatagctgttgatacaaatattaacttgaagttaaactgcatctctgttttaggcctgttaaaatagacataactatttttaaggggaaaggaaatctaaaaaataatctaatagtgcatatgtgacggtaaaaaaattaacgtgtccagttaaatgacagaacaagtagttcatctgtaatcagttgaaattaggttactataagccctcaatttgtattatgtagttttaattagtacagaaccttgtttcttactatgtaagttagatatcaaagttcattatatttcatactagatttttttactcctaggatttaaagtggtgggtctttgaaaggtgacccctagatctaaattctagtttcccatttgtaaactctgccagcaccacattttagttgtaagcaaggaccagtgattatgtctttggttttgttagggctcactcaaaaaggtagtctggatgaaataagttgattctcattgcatcacaaagactaatgatgagtttggtgaatcctgttaaaacaactgatcttaatgtgtgaaataaaacctattcaaatatttaagtagatagtggaaggtacctaatatattttacaattatgcttatagctttcaaattctgcctccaatacacgcgtaaggctgaattccgtaaactgtgtgacaatttgagaatgcacttatcgcagattcagcgccaccataaccaaagtacggcaatcaatcttaataatccagagagccagtccatgcatttggaaaccagacttgttcagctggacagtgctatcagcatggaattgtggcaggtatgttggagctattagcttttcttcctagaaataatagtctgtgttacttttctccccccttaatgaatagcttcatcttggtatgcattggttaatttcaataaggtaaggaattaaagttgcctaatggactgggaaaagttctgaacaagaaatctcagaatattttgtttctagttgccttctatgaattctggaccaaaccatataatctctttcagacccagtttcttgacatataaaacaatacattgccagtgctgctcgaagtgtggtttcatgactggtgtcatctgtaaactatctggtctgtgatgaaataagtatagagtagaaaagcatatgcaaagtttcttagtagcaattttattgtacattttgtgtgtttttactctgataaaaagtgagctttttctgtttcatttttgtggtaattttgtattttatattcttcggtaagaggtcagaaatttaaaacaaaccgaatcctttactactgattgtttggagaagtgctgctgtagattattctagatttcttagtggtgctttagctgcctgtcttgcattggagatcttgatggtgttaggaagctagtcctctccctggccctttttctctaagaatcctacaaagacgttccatataattttgtagtcatgtgaccttgaagtcttttgtatatttgacggacaatatttgattgaaattatagaggaagaaactaaaaattgggagtctttgagccaagtgaaagtgtgatttgatgtcttgttcttgcccatgtttccttttctatagggacacccatcttaaaatactacctgtagaagataagtaaacatgcccattatagaaaaaaatccataagttaaaagaagagaaatattcatccattatcttatcactcagaaataacctgttgtatatccttctagattttttctttatattgcccgaagtgatgggataatatgcaaatattttcttgagtctgctctgtctacttcccattatttcctaaagaactttaaaacgtttaaggagttagtgtttttgtaattatggcagttttctaaaatagatatacatgagtaaagagaaccacacaaaggtattttatttgctatttttatgttttctgtgttgtaggtttcatagaaatttgaattagatttttttcgtgttatagaatgcaatgactttaatttatactcctaattttaggaagcattcaaagctgtggaagatattcacgggctattctccttgtctaaaaaaccacctaaacctcagttgatggcaaattactataacaaagtctcaactgtgttttggaaatctggaaatgctctttttcatgcatctacactccatcgtctttaccatctctctagagaaatgagaaagaatctcacacaagatgagatgcaaaggtaaaaatgttatacttggataatgttgaaattctgtaacaaatatcgtctattatatgacatggtatattttaggccatggtttctcagcctctgcactactgacattttgggttggataattcttagtcatggggctgtcttgtgtactgcaggtggtttagcagtttagcagcatcctcagcttctacccattagatgccagtagcaaccaccgccagttgtgactattaagacgtctcaagacattgcccttcctgaacagtattcttggactttagtagttggtcttgaactcctcacctcaggtgataagtaactccgctaaaagcccaattgagaaatttgaatattaggaaaaacacatttaacggatgagctttctatccacatagaggtggagtctattctcagaacaaatagaaaattaagaaaaatacttttttttccttttctttttttttttttttttttgcaagacagagtcttttgttgcccaggctggagtgcagtggcacg

SEQ ID NO: 63176 - DNA, 1911 bp, Homo sapiens
cgcctggctaatttttgtatttttggtagggatgggtttcaccgtattggccaggctggtctccagctctagacctcaagtgattggcccacctcggcctctcaaattgctaggattacaggcatgagccactgcgcccggcctggaacttttaaatcacagtggaatacagtgattcagttttacttgtagatcatatttcaacacagtacaggtctttctgttgttttacttttgataattatggcatagctttagaagtcaaaaataaatgtaacttggtaaaaagttggtaatgagttggggaattgaaatagctgtttaaaaaggtaaagtttagactcttgtatagtgtacataactaattttaattcttctgaatttttcagaatttcttgaggttggcaaaaagcagcctgctctggatgttctttatgatgttatgaaaagtaaaaaacatagaacatggcaaaagatacacgaaccaattatgttgaaatacttggaactttgcgtggatcttcgcaagagccacttggcaaaggaggggttataccagtataagaacatttgtcaacaggtacaaacggaactgggttgtatatttttaacaagtgtttttagtaatctgccgaagaacttacctttcgaagtgaatatattgtatttctcttaaaaatttgcctttaaaacatcttatggttcaatggaaaaataagttctgaagagtttttgtttttttggattaggtgaacataaaatctctggaggatgttgttagggcatatttgaaaatggcagaggaaaaaactgaagctgctaaagaagaatctcagcagatggtcttagatatagaggatctagataatattcaaactcctgagaggtatgtgggttagacctctaataaatgctttgatagttaacttggtgttttcttttacatgggtcttcatttccttttgaagtagatgtttatcagaaaaaaatgcaaatctttgaagttttaaatgcatagtaaccagttaatttatgtaggtaataaaaattcatagaagtggaaaatgacagccttaagatagaggggcaaataccaatttaaatgaacataatgcagattgggaattcagggagtagatagtgacacctttgcagtgtgtacatattgtgggaagaatttgcactgttttctgatgaacattgttttggtttttaatcacatggcaaagtaggaaactgtctaaaattgttttcaacatttttttctttgtagtgttctcctaagtgctgtaagtggtgaagacactcaggatcgtactgacagattacttttaactccatgggttaaattcctgtgggagtcttacaggcagtgtttggaccttcttagaaacaattctagagtagagcgcctgtaccatgatattgcccagcaaggtaagatgagaagatcaaatctgagtgaagtgctttgaaattgactgaggagtaaattttctgaaaagtacttaaaatgaactagtttttatccttattgaaatgttggcattcacatgagtattaaatgactgcggccggatgtggtggctcacacctgtaatcccagcactttgggaggtcaaggtgggtggatcacttgaggtcaggagttcaagagcggcctggccaacatggtgaagccccttctctactaaaaatacaaaaaatttagccgggcgtggtggtgtatgcctgtaatcccaactgtttaggaggctgaggtggcaggatcgcttgaacccaggaggcggaggttgcagtgagccaggatggcactgttgcactccagccttggtaacagcaagactctgtctcaaaacaaaacaaaacaaaacaaaacaaaacaaaacaaaaccaaaatgactgagtaag

SEQ ID NO: 63177 - DNA, 3266 bp, Homo sapiens
tccttcctttccgtctctggccggctgggcgcgggcgactgctggcgaggcgcgtgggaccttacgctggttccccttcgtctcctctcccggcccgggccactagagagttcgctgacgccgggtgagctgagcctgccgccaagatgccggcctattttcagaggccggaaaatgccctcaaacgcgccaacggtgagtagctgatcggggcgcgccgggctggggcggcccgaggcctccgaggtcgagagcgcgggcctgcttcccactgctccgccgcccggcccgcgcggggagaggagaccgatgcggcctgcccgccgctgtcccagccggtggttgggcatgggtttccttctcactctatcgactggggtctgggaggcgcgtagcccggaaccgtcgccccaggggcctttccttccccctgccgcctccgggtgcgtcgcggggaccgcagcccgggagacagcccctacccggactggagctccctccttgctgcctgcgtcctctggctctccaggtccctggggctttggtctgcttagggcccgcgtccccggccgccatctgggagtgccggggagtaagaaacatggctccctcccggggacaatgcacgcgagagcctcggctccacctcctgcccgggccgggagccctacggacccacccccggccttcccgcagccacccccgctctccaagccgcgctcagtgctttgctgggtcggcgtccacttaccctttacccagctgctttatatccacttaggggcctctgacccatttaacctgattcctgttgttttgttttgtttttgttttttcatttttcctggcattgattagaagcagtcctaaagcctgtttcgaatcactggaagttggaatagagttaatgtaaagggacttcaggtcgcctcttaaagataacgaaacaggcctagagagaggtttccccaaggtcactccgggagttgttgagccaagagacttaaaaccaacgtctcttgacatccagatcagtccttttttctctttttttctgccacagtgctgctgtctgcgatttctatttctatatgtgtacttcagccattggcgcttgagggaaaaacttgtgtgccccgatctctccaaggcatttattacattggcgttctggggatgcacatgttcttggctaggctctgggcttaagaaactttgtgtagggttttttttttcccctctaaccggacaatttttctaatcgttagggcatggatagctcttattttcatccttccttcaccgaaatagaagtttcgggttttacccatgttgtagatgaatataccttgtgagttacagttttatgtttggagagcttattttgttagcttctttgaaaattcatcttatgaaaatggcagtttgagtcagcacataaactgataatttggcagaaccagagatatgttggtcatatactttttaaagtaaaagtaacactttttgtcggggagggaactggtctgtggaataggataattccacattgtgtggaatggagtaattgttttaaaaacctattgaaactacaacatagatgtgagcactaattcattctaatgataaccagtgatctaatggttagaacagacaagcagttttaggatgtttattaatacatcggaaagaagagattgaaatggaactttgtcactataaaccaaactgtagcaaagtttatgacttttcgtcgtttcgaaagttagaatttgtagtatacaaaatgatttgcatgaaattactactctgcatggctgttgtcgatgttttacagtcatttgcatgctttgcccaacaggtatttttttttccccgtgctagtaggccaaagcattataatggcctacatattatatatttggtgtgttcgggtcttgtttcctttatcgcttctctttttggaaccttcataagaacttcatatagaaaagatatgtaatgtgcatcaaacatttttttcctgtttctaaattgacacaggcttgattcatgaagggcaggttaaggaaaggatctgaaattaaagtaggcaagatgagggacactgggggggaaacttgagttttgtttgtgtagctttttaaaaaagactgtggtcccttgcagccctttgaagctgttggatggggatgcatgcgttcccttcagagtagaaactcatacctttggattgtgagggatcccttctcaaagtgagcagatcgtggatggtccagggcactgcttccaaaacataagtgaaggatcaaagggcattcccctaattggaaataatctcattttatctaaatgttttacatgtaatatttgtgatcctaacaatatttagacctaatttattgcattgtcttaataaaatgtaaataaatttaagtagaatagtcgttcaggtcaccctaagcatatatatgagcaatttttgggggaaaaattatagtagtcattcaggaaggtgagaacttggaccagcagttacaggcaagaatttcgtatcctgtaatcatttggagaaggcccctttttcatattatatcattagtggtgccacactaactgctgctgaccttattatagtttatgttctacaaccagtgcctttgaaaaataaagctattaaggccacaaattgagtaacatagcatatccatttggtctgttgcacaaataaactagcaaacatcaagggctgatgtaaacttctttatacatactttcagtaatgaatttgaaaggtatgctccaaatgctcacccatccagtaaggtttataattctagattttaatttttatttctataatattaatctggaagtcaatatttaagtattgaaatagaacctttagtttatcatagttctttccagtctcaaaagcttcccccggccactattaaataattcagaggaggccgggcgtggtggctcatgcctgtaatcccagcactttgggaggccgaagcgggtggatcacaaggtcaggagatcaagaccatcctcactaacacagtgaaaccgtctctagtaaaaatacaaaaatattagcctggtgtggtggcgggcacctgtagtcccagctactcaggaagctgaggcaggagaatggcatgaacccaggaggtggagcttgcagtgagctgagattgcgccactgcactccagcgtgggtgacagagcgagactccttctccaaaaaaaaaaaaaaa

SEQ ID NO: 63178 - DNA, 1014 bp, Homo sapiens
cctgctgtcagtgctggacgaagtgctataactactttatgtaacattacagaacagctagaggtcctggggtaagagaaaaaaagcacatcacaacaaatgtgaaagccttcattattacacgttccagtttgtctcgctgtgtaggcataagctaatggtttattttcagaaagctgcctgaaacgttgctttgtattcttctaggaagaactttaattcctcctgaggaactctactttctgagccaaactgctaattttctgcggaactgtctagaagatcattcaagagaccctgcagttgcactttctcgtaaaagttaaaaaaaaaaaaaaaaaaaaaaggtttttcccggcctttgaacattttgcctatgagagttttgcatatattttatacttgagtagacaactttaataatccatatttatactatcgcagaagtaagcatttggcaaacgttcagccattagcactcatttaaccctgttagcaatattcttttgaaaaaagtgccagtccttatgtgataaactaagaagcccattgaatataaaagtgtgtaggactgaaacagtgaccttatattattgctaagggaatatgagattaacttcctacaggggccaaaaccagagaaaggcttccagcaacttcgatgaaagtagtttggccacatgtcaagccaattgtttgtactatttatgtacctttttcataactggaattgccaaataagcatggagatctaaatgatgtacttgttagtgtattcattcatattgactgtaaaggattatttttcactcagtactgatgtccttggaaatcttacctggaaacatgtttgcaaaaaacattattgggtctttcatctttttcttggtattacatatttgttcaataaaaattaaacaccctcccttttttttgagtgagggcagggagtacctgaaataagacaatgtttactaaggcaaataattgaaaattaaatctgcactttatgga

SEQ ID NO: 63179 - DNA, 1050 bp, Homo sapiens
agtagctgtctagaatggaggacactgagtaaggaaacaagattgcttttggggttggagggcgtaaacagcgccccaggggtacgtgttccgcttgagacggcctatccatttaacacctgtgtcctgggcacggtggactctgtgttctttcttcaaatcctcaacttgagacaggtttattagttaattagtgatttcacagtatcctttcgcaggccgatccccactccaaccgttccctcagcaaccccaggggtgtcagacggggcaccctcccactgtcttctccagccagccttaaaaaccccagagacgccagcctgggaacgatctcagtatggaatctgaagtcgccttgtcagcacagacacctctggggtccccagaagacctgtggcaaagttctctaaaccgaacctggagaggggaaggttttcaagcaggaaccacataaattcacctaaaactcacgcctacacccctctgtgataaaagatttctgtttcttctgttggagactgaattttctcttcaagactacagtactgtatctgaaaaatagttaaattcataatgtttctattaatagtttttcttgccttagaagccaagttaaaaaaatcattttctgaaagcaaccatttcacagtccatctttttcaataatgtctaatctatagcagaaaatgtaacctatttttttttttaatcacccaagcagtaaagaaacttcttaaactttttttttttttttttttttgagacagagtcttgctctgttgcgcaggctggagtgcagtggcaccatctcaggtcactgcaacctccaccctccaagttcaagtcattctcatgcctcagccacccgagtagctgggattgggattacaggcgcgcaccaccatccttggcccattattgttatttacttatctctacatttgtttataattgaaagtttccattaaaaagttttaagatggctgggcacaatggctcatgcctgtaatcccaacacttagggaggctgaggcaggtagatcactt

SEQ ID NO: 63180 - DNA, 1062 bp, Homo sapiens
ctataaggcctctaactgattggatgaggcccacccacattgtggagggtaaccttcttttctttttttttttttttgagacggagtcttgccctgtcacccaggctggagtgcaatggcgtgatctcagctcactgcaacctccgcttcctgggttcaagcgattctcctccctcagcctcctgagtagctgggattacaggtgcgtaccaccacgcccagccaatttttgtatttttagtagaggtggggtttcaccgtattggccaggctggtctcaaactcctgacctcaggtgttccgcccgcctcggcctcccaacgtacggggattacaggtgtgagccaccgcgcctggtggtaacctgcttttcttaaagtgagctgattgcagacgtgccctgtgtctgcagagtacccctacagcaacagctagatgagtgctggattaaataactgggtactgttgccatggtgacccgtgaggctgactgccacagacaggcatctgacaagtgctgggtacctctgagagtgagatcctattcttcaaatccaatatctgccctcccagtgtgtgctgattgggggccactcccctcccagcctgctctgcacttacagaggtcagtggacacccctttctggggttaaaagagcccctgcttctcccattcagcagatgtccttatagtcttcattgctaaggactacttttgtcaagaatggacttagaacattgaattctctgatccaaaactccttttcaaggcctcaattctgaataatttttactattagtttcttctttttcttcttctttctttttcttttctttcttttttttttttttgagacagggtctccttctgtcgctggagtgcaatggtgtgatcacggctctacagcctcaacctcccaggctcaggtgattctctcacctcagccttccaagtagctgggattctaaatatgcaccaccatgcctggctcatgcttgtgctttttatagacatggggtttcgccatgttgcccagtcgtgtctcaaactcctgagctcaa

SEQ ID NO: 63181 - DNA, 1042 bp, Homo sapiens
gtaagccaattccttagaacaaatctcctaatagacatgtactgcccaggtgcggtggtgcacacctgtaatcccagcactttgggaggccacggtgggaggatcacttgaactcaggagtgaatgggagggacaatggagacagaggtgcatgcttttcttttgagagatttcaaaaaggaattgggggccaggcatggtggctcatgcctgtaatcctagcactttgggagaccgaggtgggtggatcacttgaggccaggagttcgagaccagcctggccaacatggtgaaaccccgtctctattaaaaatacaaaaataagccaggtgcagtggtgtgtgcctgtggtcccagctacttgagaggctgaggtgggaggaccgcttgtgttagggaggcagaggttgcagtgagccaagactgcaccattgcactccaggccagtgcgacagagcaagaccctgtctcagaaagaaagattatgtacatatatcccattggttctgtttctccagagaacccagactaatgccccatcttatcagggggcaaaatgagaaatttctctctcagcatgctaaggaaagacgggtaaagaaaggttgaaggcagacatgaatttgtcaccggctttcaaacagaaaagtctagtcgttgcccaaaaggcaagcagctatagcttcatcctgtctcttacctttgtcccagcaattctggaatgacccaggacattgccttccttgtccatgaccgcaatccccttaatggattcaagacttcgggacatgtagacattcattccactggcttgcactgtagatgtaaagaagtaaagaacacccaagacgggggtgagtcttgttccagcaaaggaacatctctttgggtgtctgccccctgcaagcctctttctctgacagctggcctttcttgaccctcaggtggacacctgccataggctgggccaaccaagtgctctcctggggctgtggaagtaggctaagaactgctggccactcagtcttggatcctgaccaca

SEQ ID NO: 63182 - DNA, 1064 bp, Homo sapiens
tctgtctccgtctcttttctttcttttttccttcccttgggagccactgttctattggctattaatgctgtcattgttatatactgcccagaggaccagctttgcaaaactgggttagttttttaaatgtagttagaattctgtcccataaaccagacagcaagtttcctcctacacagtggatatttgtggggattccctgcagctgattcctggagcccagtggcaaaccccagaattcagacagggctctgacgtcagaattcattctccactgcaggcagcgttcctgccgataggctcaaacggactgttccttatctaccttgcagtatgtggggctttctggagctcacaaacaccagctcctcaagacagcctatggagagctcacatatttaactttttctaagaatgtgctggggaccctgggctgacagcttggctctgttgcaagtaacttgactgatggcatggtgtgtcatcagcacacagcctgctctgctctgagccagaggcaagccggattcggggactcatctgagggataagttaggtgttggtattctccaagggtagagacaggactttttaatgttctggtccatttctctgtgtggctcgtctctttgcttgtcattagttcatttgtttattcatatgatccatttattttgatttgttctgtcaatgtggtaaataacagctctggccttcactctctgaaaggtagaacaaatgtggtcccagaaatgagacaggcaaagaaattctttgctgttgagccacctttaaaagctttttttttttttttgtttttttttgttgttgttgttgtttttttaaggctgggtgtgatggcttaaccctgtaattccaatggtttgggaggatgacttgatgccaagactgcaagaccagcctgggccgtatagcaagaccccatctctactaaaaattaaacaactagttgggaatggtggcgtgagcctgtagtttcagctattcaggagggtgaggtgggaggatcgtttgaacccagtagttcgaggctgttctgcagt

SEQ ID NO: 63183 - DNA, 1448 bp, Homo sapiens
aggccttaatgaaactttcatctttatgttttaaaggaaatctttaaaagtttaaagaactttaggttaaaaattgggagattgccactcacttttgggactattattatggtaaagtcacagttacctaattaagcttttgtattttcagatcaagccaagtccagctgcttccaaagagtactttcagaaggtaaatcagtagatcacccatgtgtatctgcaccttctcaactgagagaagaaccacagttgaaacctgcttttatcattttcaagatggttatttgtagaaggcaaggaaccaattatgcttgtattcataagtattactctaaatgttttgtttttgtaattctggctaagaccttttaaacatggttagttgctagtacaaggaatcctttattggtaacatcttggtggctggctagctagtttctacagaacataatttgcctctatagaaggctattcttagatcatgtctcaatggaaacactcttctttcttagccttacttgaatcttgcctataataaagtagagcaacacacattgaaagcttctgatcaacggtcctgaaattttcatcttgaatgtctttgtattaaactgaattttcttttaagctaacaaagatcataattttcaatgattagccgtgtaactcctgcaatgaatgtttatgtgattgaagcaaatgtgaatcgtattattttaaaaagtggcagagtgacttaactgatcatgcatgatccctcatccctgaaattgagtttatgtagtcattttacttattttattcattagctaactttgtctatgtatatttctagatattgattagtgtaatcgattataaaggatatttatcaaatccagggattgcattttgaaattataattattttctttgctgaagtattcattgtaaaacatacaaaataaacatattttaaaacatttgcattttaccaccagtaactgttggatcagcttattttgggctctcctttccttctcagattatcaacaaacatttattgagcatttacctcaggggccacaaagagaataagatgctggttccgcactcaaggaactcggtttaggggcaagacagatagggaaacattttctcgttgtttcagtaaatccttgagtgcctaccccgcaccaggtgctgttttccaggcacaagagcgaacaacggacaaacccctgcttttaagctcttacattctagaggggaaacacctcatacatgtagtaaaagtagagtgtttggaaggaaaataatgtggagtgaaactgctgaagcggagttgtaggtgttctagatggggttgtcaaggaaggccttaagggagagcctctctggatcaattttctcattgtaaaatgaggacaataattgtacttatctcagggttttgatgagcatcg

SEQ ID NO: 63184 - DNA, 1023 bp, Homo sapiens
cttggcttcattaatagacaaaaaccaaattttaaatttgtcccagttttcccaattttgggaagagaggccaaatgttagaccacacacaattccagcggatttcaggccaacaaagccttgatgtgtctagcccacttagcttattaacggactaaaactgcatttgtaattaattccatttcatacagaagccggaagtctctacctgaggctgaaataagaaagggatcctgtcacagaaatactagacacagtaatccacacaaggttaacaaaacagtgggaaatatggaaacaaatacctaatgccccgcctggattcgttcttttaaggttggggcgacagtaggaaaaccacgtgtcacttgcccaagcattcagccttaaagggaatttctccctcagggtctccaggaggcggggaggcggtggctcctccggccccgcccccccaccagcagagggcccgctcaccaccccgtaggccccgcccctgcgtctctgcccgccccgtggcgcccgagtgcactgaagatggcggctgctgtaggacggttgctccgagcgtcggtgagtggctgtcggctggggacaggcgtggagacactggtggctccgggaacgtgcttctcagacaggaccccgcgcttctgggcatgagggccattcgcccttcttggagggtttccgcgggtaacggacccagaggcctccctccgggaaggttccatgcgcctgcgcagaaccgcccttccccactccatcctcgcggtctcttccccgagtccctcctctttcggcgtccccggtccccaggcccatctccacttaaggtcctggccctgattctgccaccgaccctgtgatcttgggcaagcgccttcgcctttctcagactgtgtacttaagatggaaagaatgatgcctacatcaaggcgttgctgtgaacagccccttaaatactggataaaaacgcgcaaagtgctaaaaaactcacaaaggctttccctcccaatccca

SEQ ID NO: 63185 - DNA, 1059 bp, Homo sapiens
gtcacttgtcactctaaagcagccagtgggcaagaaggtttatttcagaagccccgaagggaggcagtgctttgaaaaccccagcagagtttaaaatattcaggttagtctccctcccattgcttagctttggtgggaataaatttttaggagaggcttgttacttggtgacttcaggttctaaggcctgagctgtgtgtgtgtgtgtggtttttttttttttttttttttttttttcctaacctgacatttttagtggacaggatctaggtgggtgctggtaggctctcctctgggttggggaatggtcctgaaagggaggaagcagagaaaacagccctccacctcccccgcccctctttcagcctttgcagctggccacctagtggtgggacacggttgtgtatctcaggattcgggggctgggaaagttttcactctcgctccattctgaaattatttcttgggaaatcactgggtctgatggtactggagccttgcaagtttcgctggttcctcctgttgcccagggaatctgcccccgacatttgctgctgtagatatttgtttgcctgatagatgctttttttcttccctgagcatttggttgcttcttttataatgctttgcttagagtgggcaaagtgatatcaattccacccgccccctccaaattgttctccccagtattttttcaccaacgtgaatttactgtctgatattgttgttcgttaggccaacaaattgggtttttttcccagagccttggagaagagagctgcaggctggaagcttgtgtggagtgaccgactcccattggggcagaattacagtgattgaaagtgctcaagaatgtgcctttcacttttttttttccttttaaaggctttttcaattttgctgtgagagtttggtcgtcatctcatggtgagaaaatagctcttgatgatgccttggaaatggagagggcctgcggaagcagggagagactgacacgtgaacaagaaaaattaatcatttaatggaaacctcatttacaatttgcatctctccccttct

SEQ ID NO: 63186 - DNA, 1033 bp, Homo sapiens
aggagaaggagaaaatagggaagggggtgcggagagtgaggaagagactgaggaaggggagggggctgcaccatggaggaggggtgaaggcaggggttgggagttgggactgactcacctaagaggaaattcaggtcagggacaatcatggatggtggcgggggtggagggggttaagctaccatatcctcccccaccccctttttcaatatcttgttgggaaatttgcctaaattgagcaactgactttcctgattcaaattaagtgcatgatatagatacatacagagccccatgttccttcttgaaattcttaatgtggggctattttaaagcagtcattttatttaaaaaaacaattaagttgcataagtgcggcagatctacagaaagaatagaaagaaacctccacaggcaggtgatctaaaatgggggtgaagacaggcaaaaccattttaagggttttcattttttctgagctgggaagacatcaggaagaaggtatacttaaagatgccaaagaaactcactgttcttgtatccacttgaaaatggttttctccttaaaaactgtttcttgtgagatttgaaacattttaacaataactcagagcacacttagaaagaaagtgtttgaaacaataaaacagttcattgcttgttccctggtgtccgaagcaagggagtctatctgacgtaccagagtcaactggtgacatcctcctaaactaggccagttttgatagggcctactgtgtttctaagaacttgtaatctgtggaatatcaaaaatttttttaaaaaggtaatgatgaaatgaaccccaaggacagcttctggggcctgtgcagaaagcaagggtaaacagataagctgagataaacagataagaacatgcctctgtcctgaagtggcagaggccacagggccactggtgcctcggcttccctgagccttctcagctgatctgctgccctgtcctctgtttccggcatagaggttacccttggtttaacggatggggaaactgaga

SEQ ID NO: 63187 - DNA, 1086 bp, Homo sapiens
gtaatcccagcactttgggaggccaaggtgtgtggatcacttgcggtcaggagttcaagatcagcctgaccaccgtggtgaaaacccatctctactaaaaatacaaaattacctggatgtggtggtgggtgcctataataatcccagctacttgggagactgaggcaggagaattgtttgaacctgggagtgccactgcactccagcctgggtaacagcgaaactccgtctaaaaggtaaaataataatttaaaaaaaaacataaaaataaaaaaagggagtcacttgttcaaggtcacttgaactgtggacttttggggagcaattgcaagtggatctcccctatcctccaaagtgcttttatgttccaaaataaatctttcttccttcctctcataatatatgccaaaacaacaaactcttctcgagatggtagggtttttaagtgtaaatacccatgaggttgtaattgtggaagagaaagagtgtctttgtcagattccctgggaaaaggggcaaattgggaatataatttctgtctcagaccgtgatttcagctgagggccagtttgagagcagttgggtaaattaattcctactaggttgtaaatgactgataggtgaatcctcaaagtagatgtttccattttaaaagtagaactgtgtatcaatacaactgaatctgtgtttgaggacaaggcaggatgcctacatgccatacataagtgcctgtacacacataagcacatgtgtacgtatgtggtatgatcgcctgtggaggcccattacctgtactctctcgctgcctgggcccctcctaccaacacatcggacaagcgaggccagcctcttgcgttatttttcccctcagcatggctagtggccaacgaattgcccccaagggactggatgtgaagccccatgggtggtggtggtggggacagtcatgggagtttaggtgtgggccacatcattggcagcagcaccacctcctttccttggcagaggcaagaggtgggcagcgggcatgccagttcctgctggctcaccacacatagctcccatctgccctgcaccctgcttccc

SEQ ID NO: 63188 - DNA, 1054 bp, Homo sapiens
aggcggcatagcacgatgttgaatcaaaggctgatggggtgggggagagagagagagtcctcattgcattgtttcattttggtgtccagccattctgggggccagatgtacccccctggtttcctgtttgggtgaacgtgtgacttgccacttacagtcaaaggatcctgactcattcagggttaaaagtcacatccttaggggatacctgccttaaagaacccaagacagcaggccagagacatggggcctgggtcaggaggagccagccccctgagtcaaggaaggctggatgtgcacctttgtcccaggctttgcttgagcagagggccaggtgtatttgatatttgccacaaagaatacaatccttaacctggctgcccttgtgagactccaactgtagcaaagaaagattaggaaacaaacatcccagtcaccatggaaatgtgaacccaaggtgttaggaacaatagctgtgtgagtccggaagtggattctgtccacacacatgttggtttgatcccccatctatttccttgtgggggcctgggcatatctgtgaacgtatgatatagccagctgctctagggctgggtgccacctcccattagccttggtttcatcatcaccaaaatagctgtaaacctaatacactgcttatgcatgtcagaacctccttacagcctccctcggaggtaaatattatttttatcttaattccacagatgagaaaacagaagctcagggaggttcctaaactttcccaaggtcacagttgttgatggaagagccagggtttgaacccagcccgttgagtctgtgcttttttaaccaccacgttcctcacgttggtgttgacaaaaaatattactaaaagtagttcattcttactctacatgtcttatttcaattctgccacaaacctatgaggcaagtacaactggttaattccatcttataaacgaggaagctgaggcacagaagacttaggaatcttgcccaagttccaccgtcagtaggaggcaaaagtacatttgggggttacttttttcag

SEQ ID NO: 63189 - DNA, 1025 bp, Homo sapiens
tctgttgtttataaattacccagtctcaggtattctgttatagcaacacaaaacagactaagcagacttctgggttgaactcaatggaaacttcttgttctaaccttatgatctctgagcagcatttgaaattgactcactgtctttgcttgaaattcatttattgctggggctcaggaccctaccctcactgggacctcactttgtctttctagctatgtttcttcctgaaatattgacagccctggactcaggcctcagcattctgggggaagtgcctctactcagagttaacatttattgagcacttactgcatgcatgtgctatgctcagcactgtacatatcttgtttaatcctcatgatgcagctctctgaggtcagtactatttggtcatttattcactcattcaccaagatttttgggctcctactatatacaaggcacaattccaagtgcctaataaggcagatgtgttcctacctctggggagctgacacctagtgggaattattcaggttaacaggaaacagagtggagacctgaggcttcttacccagtcacagccctggtgggcagaggagccaactctagtgccgtgctcttgaatgctttgtttctggtcccaccgatggccgtgaatccctcacttccagtgcacatatctctcttgatgccattgactctgccagggtgttctcggcatctcaaacttagcattttcgataggttttattgctagtgttgtttttgttctctctgaatgtgctctgccttttcaccctgcatccacaaatggcctgggagcctgtctcaacaccccctcccttaatctccaaatcctgttatcaagagtggtcagatcagcttcttcagtgcacccccaggaccccattcttactcttcctgccatggttccagccccgcacttcctggacacccttcgttcttttcatgctctggcatgttcagctttgctttctcttcactgagcctttgcacatgctgttccctctgccaggaat

SEQ ID NO: 63190 - DNA, 1017 bp, Homo sapiens
ctgctgggggctcagtgatgagctgggtcacgctgcacagccccttatggttgggagcatttgcacaccttgtcagctctgactacatgcccaggccatggggactgtcattatcaatgttttgcagatgaggaatgaggctcagagaagccaagtgacctccatgaggtcacacagcctgtaagtgacacagtcagaagtctcatcctgaacctaggctcattcaccaccttccagctcagccacctccccaaaccaccagtgtccaggtagccctgagccaggtgcagcctggagggggcagcaggtcacacactggggcacagacgggctgccagatgtaccagcacctggagcgtggctggttcttggcccaacacctgtgggcaaacccggccgcactgctgctggctcctcactgaccacctcccttcccttccttcttccagtcccctgttttcatagcccaagttggccaagacctggtctcccagacggaggagaagctcctacagaagccgtgcaaagaactcttttctgcctgtgcacagtaagtgccgtagtcacctggcctgtcctccccgggctgcccagagatgggatgccgcagctctccacctgaccatacagggcactgaggcaggtcttccatgcctgacagcttcagccaagttataccaactgtttgtatacttcccacgaagagaaaaagatatcaaggtgccaagtccaaagaaaacatctgctgcaaagggtattgaaagcaagtggctctccaggctgttgagacagaggaatgtgcaaacatttgaccctgtctgggtggtttggaagtctttcccagggtcctcaacccccaccactgccaccaacccgagccagtgctactgatgcagggggagcttctcagccaaaccccatcaccttgtctgcaggtggcacgtctgccgtgcaggaggtgacacaagtcgatggccatgctgccagcagagcaccaactaaacccccaccccatcc

SEQ ID NO: 63191 - DNA, 1059 bp, Homo sapiens
tgtgcatgcacgtcctcctgaatacctgtacttccaagaggtggtctcctgttttcataacccaacactctgagataggatcttccaactttttagccccggctgtggaaagatagtgagtatgaagtctttgtgcatttggaagtgacatcgctgtgtggattatgaatacagagagctgccatcttcctgatcacaatagaccacgattgcaaagcctcctctcccagagaccccttctgcgcctgccctccccacccaccacccagctgttgaagctcagcgtgtgcaagtcagaccctgcacaggccgggggtgtctcacctggcctaaacgtaaaggcttgtgccggagacagtgattgaaaacatttgaaaagccagctctccctggcagagaaagacacttcccccccaaagtggaatttagatgtctttccctagtccatcaagaagtcatttttgtaacagtccctaagcgagtgttctcaattagaagagtttagtggcttttggtgttgttaaaataataagaatccttctagcatccaaagctttctaatttttttcagggagatttggacattaatgaatggaaacttccacagtggcggtcactcctgaaggcagcggcttctgttctcccgctgctgtaactctgtgtgttccgtctatcgcgtcacagtgccgctggatctagatggagccactgttgttgtttttaaaagagaaataaattccttaatggaagtagcatggcatcggcatctctctcctgctgctgagctcttgttctgtttcttctgcatacgacagctgtccccaagatgcctgtggcctttgggctaaccctttcctaaggttgacagtggaacccacccaaacccggcccccacactgaccaccccctgaactgcccacagatggcccagctccagtgggcggggcccaagaaaacctgaattcttaccaggccgccggcttctgatctcaaacccagcagatggttctagaagtgctctggccacttggcaccaaggaggagctgggtgacaagggc

SEQ ID NO: 63192 - DNA, 1866 bp, Homo sapiens
ctcagcctcctgagtagctgggattacagtcacgtgccaccatgcccagctaatttttttgtgtttttagtagagatgggggtttcaccatgttggccaggatggtctcgatctcctcacctcgtgatccgcccgcctcagtctcccaaagtgctgggactacaagcgtgagccacggtgtctggcttttttttttttttttttttgagacggagtcttgccctgtcgccaggctggagtgcagtggtgcaatctcggctcaccgcaacctccgcctcctgggttcaagctattctcctgcctcagcctcccgagtagctggactacagatgcatgccaccatgtctagtaaatttttgtatttttagtagagacagggtttcaccatgttggccaggatggtctcaatctcctgacctcgtgatccacccacctcggcctcccaaggtgctgggattacaggcgtgagccactgcacctggccattaagtggtttttaaaatacaaagctacttatccaaatgaaatgtaccatttaaaaactacaactgggccgggcgcagtggctcagcctgaccaacatgatgaaaccctgtctccactaaaaatacaaaattaagcgtggtggcccgtgcctgtagtctcaactactcaggaggctgaggcaggagaatctcttgaacccaggaggcggaggttgccctgagccaagattgtgctattgcactccaccctgggaaatagagcaagactccgtctcaaaaaaaaaaaaagtgcaactgttgccgggcatggtggttcacacctgtaatcccagcactttgggaagctgaggcgggtagtggatcacctaaggtcaggagtttgagaccagcccagccaacatggtgaaaccccatctctactaaaaataacaaaaaaattagctgggcgtgctggtgggcgctggtagtcccagtgacttgggaggctgaggcaggagaattgaacctgggaggtggaggttgcagtgagctgaaaatgcgccactgcactccagcctgggcgacagagcgagactccatctcaaaaaataaatgaattaattaaaagtatggctgttgagctaacagatgattttataacatgacccaatgctatcttgatccaacttaagcctaagaatcgttgctccccaccccgttcatcaaaaacatcagcagagactttttgggcatgcaaggaaatgttttttatttcataattattttgagatttattttggtgatgtgtttctgactgactgccatattctttgttctcataatttctctactagtattttcactcccaacccccgtgccattcccacttgatttttatgtctgctggcagtgagaggctaaaatggccaacttaagccaaagctgtaaacaacagttgaagtaagtctttcaataaagactagactatatgataagtggctttttcttattgtcgtttattacataattattctaccaggttgccatgaaataagcaactgggttttaagttttcagtagttatgtggagtatgtatgtagtcaggacctatttccatgttctgtgtaagtgttaacaagtccattagctttgctgaatttaatctctggatatgaaggagtagaaatttgcatccttctaaaaatgcatgctctgtttaatattaatatattaaaatttattaatttggagtcctcagatacgggaactaattttactgtctaggttgctctttggtagtatctatgagtaaagatgatacttgacaaaaataatttaataaatgttttagatactttactagtatgtccaaattaaattttccctattaaaagcatttga

SEQ ID NO: 63193 - DNA, 4488 bp, Homo sapiens
ttttgaggtggagtctcgctctgtcacccaggctggagtacagtggtgcgatctcagttcactgcaacctccgcctcgcaggttcaagcgattctcctgcctcagcctcctgagtggctggaattacaggcgtgtgccaccacacccagccaatttttgtatttttagtagagacagggtttcaccgtgttggtcaggctggtctcgaactcgtgacctcgtgatccacctgcctcagcctcccaaagtgctgggattacaggcgtgagccaccgtgccctgccttaatttttgtatttttagtagagacaggatttcgtcatgttggccaggctggtctcgaactcctgacctcaggtgatctgcccacctcagcctcccaaagtgctgggtgcccggcctgaggcatatcttaatagtatatagtaattaacagaagagtttcatagtacaatataacagtcaacgtttttgttttgtttctgcatacagacaacactaagcagttgagatttgaagatgtagtaaaccagtcaagtccaaaaaattgtactgtgtactgtggaggaattgcgtctgggttaacaggtacaatgtttggttttctaatcacctctgaggagcttcatcactgttcatatgaatttcatgatacacatcagccatgttttatttgtatgttttgttttatagatcagcttatgagacagacattctcaccatttggacaaattatggaaataagagttttcccagaaaagggctattcatttgtcaggtaacactctacttgaaatatcattattactcttatatttgattcattcctttcacttatgttctccagggtatcagtgtttgttattttagtgcttctttgcagtatagaagtttaagctacctacctaatgtactttagaaaaaaaataccaacttgcaggtgtaaactgatgagtttccatgttatttattgtgttaggttcttaaaaaataaaagacaaaaccatatcatttttctttcttagattttcaacccatgaaagtgcagcccatgccattgtttcggtgaacggtactacgattgaaggacatgtggttaaatgctattggggtaaagaatctcctgatatgactaaaaacttccaacaggtaattcgatttttcatagcattctttaaggtttccatcttacatgtcacataaaagctttggaaactctgtaaaatgaacaataaaataaagcatatagctactttcagttgattgtatttcaaaattgattatttgcggtattaactgaatcttaatactttcttttcacaggtgtcaccaccccaataaacttagacaatgataaataacagagtcctattcacataagggtgcttacttagtttttctcttccttgtctcccactctttcttcatatacggtgtttcttatgtgttccctaaaacaatactttgctttttcctaggttgactatagtcaatggggccaatggagccaagtgtatggaaacccacaacagtatggacagtatatggcaaatgggtggcaagtaccgccttatggagtatacgggcaaccatggaatcaacaaggatttggagtagagtaagttgtttgggtttttccagtatagaaacgtatggttctgacaaaataaataaaagtgtgttttcctagggagaatctattttaattatatacattgagctatttggcattatgagcattatagaaactaatctaacaaaatatgatttatgaggctaagaaattacttctcattacctaggtggaaaggggggattggggtaacatttagtgtgtcctatgatccctgtaagcagttggtagaatttgatttacatttctgatacacttttatttatttttgcatgtaaaagatctttgtccagatatattcaaaagtttgatggttttatgcctatgtggtatgtgtgagaaatctgaggtttgtgtgatacaaagtaactggccttttttttttttttttttcttttgttgatagagtggtttcctcctttgtaattcccctgcccagggccagcccatagctttattttcagatttcttcctttgagactgtttccaacatgaacttgtttttaaaatttcttatgtaatagatgatgtgttgaatcattcacaatttttaaaaaattagtttgcagatactcctcagacatcagtgtgttaagttgtggttatcttaaaaatatcaaagactaatactggaatatgtattctacacatatatcatttatttctttgatctttctatttgttgtaggtgtgttgatttctggttttctattctgtgattaggctctgcttgatttttgtgtaaatacatatgtgattttttttttcttgtgtttgctgaagattttttctttttcttccaagtcaatcaccttctgctgcttggatgggtggatttggtgctcagcctccccaaggacaagctcctccccctgtaatacctcctcctaaccaagccggatatggtatggcaagttaccaaacacagtgagccgggactctaaaaaaaaattgtaattcatgataggcttcgatttcctgtgacactctgaagacatgaaagtagacatcggaaaatgaaaatatttattttaaaaattgaaatgtttggaacctttagcacagatttgctttggtgaaggacacgtgtcttctagttctgcctttttaagtttttgttcatgatggatatgaacatgatttttctttatgtacaaaaactaaaataaagtcaataaagacaattctgactacaaattttgatataataggaaaaatggctaatacattttgattcttagatactattccatttttatcttgctgttcagtattttaactcactgtgtttttaaaagagcaaaaaagggaggatcgtgaaaacctgggaatcacatataagttcatcctgaatcctgatactcccctccccttccctgaggtggaccacatttgaagtcagcagagaaaaagtgtgatattcagaagaaatgcgtgattttggagtcgctttggaggaaatattttctttctctatgcctaaagaaactgaagccagactgaagttttgcaccctaaaaaaggaacagcattgtttgagttacttgagcaaatgttggtggtccacgttaagacatatttttaaaacttccaaaagtgtcgattattaaaattgtagtattttacatttcattttggggggaaatccaagtatggtgtttgtattgaagtcagacagtcatacttgtgcttttacatgaagtttaaatgatacatattgtaaatattcaataactacagtgtttaaaaagcatgcttcaacatagaagtagcagcaatgtaattatttgaagtaacacttaacacactccgctgcattgaatgcagtggattgatcagaatgttaagactgacatttccaaggttggctactatgtaaaattaaaattacacaaattgtgcagaaaaagccttaattttaatttcatacaatctttgatgcattagtatgttctaaaatgtcattgggaattagttttttgtttttgtttttttttttttttttttttgctttacattacttggtatgtaaataccttgattaaaaccttgtaaaccaatttcaaggttactataagttgtatagtacaagtgttttttaaaaatcttggggtgtttttaaaaattaagatatattttgcccaagaatttttttaacaagattgctaaaaacatcttatttagacacttcaatgtaccaatttataattggatattcagtttaaatagtacacagagttgtggcttttattttcaattaatttttttccttgtgggcagtgtgcatggtataataagcctgagcagaggcttaagttgtatgtgtgcagagtttgtaaaggaatcaattggaagatgcagaagaccgaggtttgctttcaaggtatttttcaggctgtgtgggtaaaatttgcctcaaatttctatcaaacaggaatgtaaaatagataaaatcctatgtatttgaattgtcagagctagggagtgcaaatgttttggcaatgtattcaaaatgctggcctgggcaccaaagagaaaatagccttttacagttacatagtaagatgcgattagtacccacaaattactgttttctaaacatttgaagttttacgattagctttaaaataatgattttataaattggtggtcacaataattttggtattactttcctccttttcccacttagcaatatagccaaatgtattcaacataaaaattcatagggtctgaaattcatagctgggccaaattttttatggcaccttagttttaccataatggtcatctattacactcttctgttataaaatatacccttatttcttttgtttatagtatctttgaggaat

SEQ ID NO: 63194 - DNA, 4448 bp, Homo sapiens
atcccactttttttccctcaaggaaatgccttctggttcctttgccactattgtttagacgtcttattttggatttttcttctaaaactttcctggaatgaaaaactgttgtggttgaaaagatctttattttatctggtatatttatcccttgtaagtccaactagaattccacattttaaatattattcttatagggcattttacattgaataatgatgaatgtttttagccttacataaaaatatgtatttgtacagttgtgcagctattcagtacaggttgcagtttcatagaaattcatttctagtttggttgtcaggtgagaatgttgctatagcttaggtagtactactttcttcacatctttataaatgtgttttaggtaactactgtcaagcacagggttgcagaatatatttaatatagattttttatatggtgttcttatgatgtaaacttatagctttgtcttggaatattttattcagatacattttcagaacctcttttcttgatcaccactgttatttctctgatctttggaagaccaaattcaaagtatatagaatcttcagtacattagactattttggaaggtagggaattcatttcagtagctggttataaagcttaagttttcttgtttttattttcattctttccatatccagaaaagaaatcaataaaattcagtctttgtagcagcatagaattccatcatttgtagtattgatcctaattttgatcagtagtttatgaagttggttcttgctgtatttctgtatcctgggataccacttatagaggattatgatgcataagtagaacgtaatttaaaaataatattggagaaggaaagtagtggtaaggagtggtcctcatcagatctgagtttgaggttttgtttggtttaatataatcttctattttatatttaacacacttcaccagaattctttattttcatttaatactgatgctcatgattctacaactgcttttatagttccgtttgagttcagcagtattctgaggtgcaaagtcaggtttagctttaaatcttatttaaaaagtgttaggctttcataagcttatgcagtctcaccttgtatattcccagctatcagtaatgttttttcctggattttcttctcagcaacccgatagcagaagggtcaactcttctgttggattttctgttttgcagcatacaagcaatgacccatattgctttgtggaattttatgaacacagagatgcagctgctgcattagctgctatgaatgggagaaaaattttgggaaaggtaagataataggatgatggcaccttatgagtacatatatttgcatgtcaaactagtttgtattctttctaggcaaatttttgagcagatattcggctgctgagtgatggttttgctttattcagcttagtgcttttacaaaaataaccctgcttgataaatgatttaataagtggtaagtgttgtaactcatgacatgcctaataattttattaaatataatctttatttttaggaggtcaaagtaaactgggcaaccacaccaagtagccagaaaaaagatacttccagtaagtactcctgctgcattttactgtggaagagttctgaaattatccaggaggcattaccagcttaaataggtttttttttcctcctctagagttgccttaaaaaggttttagtggctgacttcttaagtatttgattaccaaatgctctgatttcagatcacttccatgtgtttgttggggatttgagtccagaaattacaacagaagatatcaaatcagcatttgccccctttggtaaaatatcgtaagtatcataatcagtactacactcagtcatgataggcagaattgtatatgattaacttgtaattgaattaagattttctttctctagttagtatggttttgttttgtttcttatttttcatttatttattttggtttgttttgagtagtggatgttgttgaaaatgttaatgtcatttcagtgtcttggggtctcgttttcatctaatcctgtgtataatatgttaaaaaaaatttaagtgattctgtttgttatctttgaagcagatgtttgaatggtaaaacttataaagtctagctttttgtcatatgttttcaaaatttgatggtttaggataatgagttaatcaaaagtaaatgtgatctatactgtgtaagagttcaataacttttataggaggaatttataaatgggggagagtaggtaaatccttggatatattgtgattaaattggaaatgttcatgttttattatgataaatgtgtttttgatattttagctataagtgaaaagtactattatactattaaaatgtttcaatgtatgagtcataaatgtgggattaattagatgtttttgttagtgatatttgattctactagttaagaggcaaatgtggtttgatttttaacaaatttatgctcagattttactgttgttacttggtaaaaaatatattggaaaactaaaaatggttatgaattgtagaaaatgtttatcataatttatctttctgattaaaatcagtttattttgtatatttcctgtagatttaaattaaacatcttagtactactttacaggaaagtgtttcaactaagaacaacaatattttctctatacaatttgttgttctatagatttaatttctttaaaagatgtaattcttaactttctgttttgatatttgctttgctttttaatctaaatgtggtaagtagtactattttaaaaatcaatataaaaataatacaggttgctgtttttcaatctttatttatacctgagacctgcagtttttcttaagtccaagtcacaattaaaagtaatagcattctggttattttgcagaattgctcataagaatggacaggatcttgaaggctaactgcaaggaactgtgcacactggaactcagttgtagattttttttctcatttctatttattcttattatacattatttatatatacatattttagtatttacattttaacattctatattcagtggagttctatatttccaatcatttaacttactcactaaaatttctgtgtaaatttgttgttttcgtactggtgtgcttagcattgttgttagttttttattctcctttcttaaatttctgaaaatgtcaatttttcaaaatttacagctgcccaaactccaaaatgatggtagagaattgaccaagaaaaataaagaaatctgttaacaggccatgtatgcctttttaattcctattttttcctctttttcaattttttaatatttcatatattttgtatcactaggcagaagacatttaactatttagagattgcatggtaaagtagttagtattgttacagtaatttatagaatcagtaaaccttagaggacactagtaaatagaatattagaaagggaaactgttgttcctattaatcttcaaatttgagcatttagtttagaaagcacaggctatttgattaggttgcatgtttattacatgtttttgtcctactgcttttttctaacaggtaaagaagcattagggagagttcaggaatggttgtagttaattagggctaactggaattttattttaaaaatgctcacaatacagtgtgtgtggttccttttagtttttattttgagggtggctcttacttccctcatttagctgtgcttcttttcacagggatgcccgggtagttaaagacatggcaactggaaaatccaaaggctatggttttgtatctttttataacaaactggtacgttcttccatctcaatttatattttttaatactaaatttagtcattagttacttaatgtattgaatctgaaacttgaatatacttgaatgttaactacaaacacaacttttatgtaatgttatgtatgttttaataatagagtataatttcattcctctttcataaactcgaaaataaatagctagaaaaagaatgattatactataaggaagattattaaaattgtgtttgtacattggtaaaggtcagatggatttagaagtaaagcccaagtctaggacagatgagctaatctgagaatttagaggttaggtaaattatattcagttttaaccatgaaaatctcagttttaactctaccttttaaattattattcatactcttatataactgggatgtgaatgactacaacaaattatgtaaataaaaatttaagcaattcatcttgatttttgcatatattctttgtaaaaggggtaccaaagtaagcatttgcattaactgtaacattaaataataaagtgggctttgattttaaagcagtttcaataacttaaatcaatgttttgttttgttttgttttgtttttttgagatagagtctcgctct

SEQ ID NO: 63195 - DNA, 3435 bp, Homo sapiens
cctaaataagggttaatcttactttcataggatcaggtttaattggagaaattttgttgaaaacagaggaagttaaaatgaaataaaaggtggccgggcgcagtggctcacgcttgtaattccagcactttgggaggccaaggcggacagatcacctgaggtcaggagttcaagaccagcctgaccaatacgatgaaaccctgtctctactaagaatacaaaaattagccaggcatggtggcatgcgcctgtaatcccagctacttgggaggctgagacaggaaaatcgtttgaatctgggaggcggaagttgcagtgagctgagatcatgccattgcactccagcctgggcaacaagagcaaaactccatctaaaaaaaaaagaaagaaagaaagaaagaaagaaaaggtgatgaattagatgataacacattagagccagagctaaaggaaaaattgctgataacgtatttttttcttgtgcagatacgtaggtaacctttccagagatgtgacagaagtccttatacttcagttgttcagtcagattggaccctgtaaaagctgtaaaatgataacagaggtaagatcttcccagttccatgtgctgacaattagcatgatgggttgattagcatgattttaaaatttcattgtaagcctcaagttattctggtggagagatttgtgttgtgttgacttattactttgatttggctgacaaactaggcttagaatggagttttatttaagagggcaaagtttccgtgctgttaagctcaaacggtcattcttcatggtgtggttatcttgaagtgattctgctttcagaacattattagagctcatttcagaatggtgaaaaattggaaagtatttcatacaattccaataagaatgttaacgatttagacagcatgtgttcatgtgcgagaacacgaagttattatgtgtgtagtgtgcagcaccgttcgtctcgtgtgtctgtagcaaatacttacctttttatactttcctgctaagactgtagcagcacccaattagtcatgttttaggcttttcttccttgtgtttttgttcattgatcagctttcttttttttttttggactatttcctatgtactagatactgcagtaagtgctagagatacactggtgaataaagatagttccttggcccagagaattttacagtttagtagggagacaaaggagttagcaggcacttaggaagtaggataataaatgctctagaagcagacaacttaaagtgctgtgggagcaaatgtgtatccagtgcagccttaggtcagtgagcggcttcttggaggactcactgcctaggcggaaaccttgaaaggatagtagtacatactggctagaaaggaattgagggaagaagggattccaaataaagggaactttgatccaggttggtagggagagcaggagtgcttgagacagagagggaaaaatagaacccgtagcatggttgtagttaaaatggaattagtcgtaagagatggcaggagtttatggaaagggctagaaactgtgctaaagagtttgttttatcctgaaacggagaactgttaaaaacctttaaagtgcattggccttttgattgtctttcccaagtaatgacaatcatcattttgttctggtgtattatatttttccttcctgcctttaattatttatttgtgctttcatcgatcaaaaatttcctttgcactaggcactatacaaggtactggagatataatggagagacagccaaatgagtttcccaagcaaatagggatgtaagccatgaagagaataaaacagagttctgtgatgattggagggttggtgctatataggctaggtgatgagagatgtcacctctttgagctgagatgaataacaagatggtgctatctatggtaagagctggaggcagaggaaacagcaaatacaagtcttgagttggtaatgaacttgtgtttgtggaatcaaagaccgatggctagagtctggtgagggatggaggggagttaagggaaatgagtctaacagcaggattcagaatcacaggacattatggtccatgacatagtttaggttttactctgattgctgtggcagaccagtggaggggcttaagcagggggatgaggtgccaagatttgcatatttaagcttactactctatgtagagaatgactgttttatggagaatagattgtagcgggcaagagcagaaggagaaaaaccatctggatttacttcactagtctaggtaagagatgatggaggcttattctcgaaagtgctagccgaagtcaagataaggacagaggttgatagatttggaatatattttggaggtagaattgataggactgggttggctgtgggacatagggaaaggaagaaatcaggaaataccctaagattcatgttaatgcagttgtatagttggtaatgctatttatttgctaaagtgggggtgacctgatggatgtcaccatggggagtggtgggaatcagaaattgtgttttggatgttagatttaagacatgaattagacatcaaagtggacgttagattaggcagttggataaagtagtttgcaactctagagagaccggtgctgaagcttgcagtggtatttgaatccatgaagccatgggactagatgagttcacagagagagaatgatggtaaagaagagcacagaggccgtgaggtctgagccctggacaagctcaacatttagagtttgagtaagggaagaaagatcctacagtgaggaaacaggaaaaccagagtgtggtaggagacagaagagaatgtttaaaggaggatggtggtcaactgtagtgaattctgcttggaagtaaagattaggatggaaaaggaatcacagaagcagcagagaggtcattgttgagctcaacatgcagtttcagtggcatggttagcttggaagctgacagaagtaggtttaggagagaacgggttgtgagaaagtggggaaagactcactagaaaatttttgagaaacatttgtaaagatttattttaactattttttaaaaccccatgtatacatacagctatttgaagggtagagggactcgaaatgaattttcataacatccatattctagaactcctagatttgagcttgtaaagtctcatatttctctgtcttgacatttatgtcatccaacaaaaattggtgacaacgctaaataaggtagggacataacggattttttttttttttttttaagagacagggtctgactctgtcctccaggctggagtgcagtggcgccatcatggctcactgcagcctccacctcctgggttcaagtgatcctcccacctcagtctcccaagtagctgggacagcaccgccacacctagttcatttttaaat

SEQ ID NO: 63196 - DNA, 3981 bp, Homo sapiens
tgaatgaattccatcttccaaccacttaattctggtttccttcctttccaatgaagagtgatgactcagcatttgcattcctttctgaatagtgtggcactccttttctctgcatctttttttttttttttaagtctgaatactttttaattaaatgtttaaattgggcaccctaatttcccggcctctccaggtctagcactcctaccttgagtaccaaggagtcagatcgctgctttgtttctcttgcctctcctggtattgataggatcatagtccacttggctctgctctctgatggggaaattgctttttagggaatagatgaaggtggaggggcactcgagaagtttgactagcttcacatctcttcactcctaccaaagaaaggatgctcagtaaagaagatagatgttcagtattgatagagatttttttggtgtggccttgtacaggaataaatgtgttctctaacgtctcactgaagtatccgtcccgttttgagaatctgaggcctactgaagcacatccaatgcttcaatgaaacgcctgcttaatagaacgtctttgtgttttgtgttgtcttccatttctgccttctctccctagaagaaagaattgggacacacttgaaatttgtccttcaggccgggcgcagtggctcacgcctgtaatcccagcactttgggaggccgaggtgggcggatcacgaggtcaagagatcgagaccttcctggccaacacggtgaaactccgtctctacaaaaaacacaaaaattagctgggcgtggtggcgcgcgcctgtagtccctgctacttgggaggctgaggcaggagaatcacttgaacccaggaggcagaggttgcagtgagccgagattgcaccactgcactccagactggtgacagagcgagagttcgtctaaacaattaaaaaaaaaattttatccttcaacatctgttgaagccaagacttggtgttgagttacaatgtgtactttgatataagcatctgggaaagctaggcttaaagactagctaacatgtatttaacaaagataaaagttacattgtatctaaaaatctgaagtatcatcacacactgaatgattgataaatactcatggcaggggtctcatttactgtatctgttccttaccaagaggaatctctggttttgtagtgctaaagaatgtgcttttttgatgtcttttatttatctttgcatctgccttgccttcatccctatcagagtttctccaggggaataataagctaacttctttgtcacttatttccttcctctaccttctctaatctcttgttctttctttgaaacagttaagttgtctatgtttacagttctctaaaactgtgacatgttcatatgaataaataaacatcttaactctgttgttttgtatgtcagtacgtgtttactattctgtcttcctttttccttctcccacccttttccatagggcctttttttttttttaagagaaggactactacatcttcctaggtcttacccccacagcacttagttcactgcctggaacataagaggtactcagaatttctacagtgattatacttctttcattaaattagtattaagttcttttttaaaagtcctggttgaactaagattgtaggcagacattactgtcacatgtggtgcagtctgttgacttttatatattttttaaaaccttcaaatgtaaaatcttgagataaaagcaaatgtttaacaattgggatttttattagagtttaatacaaataatgcatagtttttctaagtgtacgttttacatattctcaaagggttctattagatataagtaacatgatgaaaactgaacatgattttagacgttgatatctagtagggttttttgtttatggagatcttatattttacattgtgagctatggattaggtttttcaagtggccagtatgttttaaaagaatgtgttcttaacaaagcttatcttaaattgtttccttaagatgcctgtgtgttactagtgaggtttttttcctgcagacacacacaagctaagacatatggttctatcttcagaaaacaatatggtgtttagagcctaggtaggtctttaaatattcattacctacagtattactaatttatttgatggtatttaaagtggcaagaattgctttgatgttgagcctaaatttctatttgtcatatagttgctttaaaggtctgttttctgatgttcttcattctcatttgacatttattttggggtattatgcattgagtaacttgtgatctaaaaaaacaaacaagatcatgctgtgtaatactggtgttggaactggactgtctgacacctgccttgtgggacacacatttcaggcttgggttgtgtgtatctttgtagtgcagtgatttgatccatggtatatctgaatctacaatatgacactaaattgtaatagtgttttattgtagcttattttattttcttcatctatcggatgcaccaaaattgctaggaattcgtgtaataccatgttacacaatcccttcctttaaggctattctttcttcctggaaataagctaatgatttagagtataatctgaacatctaagaacaaagcagaagaaaattctataaactattacaaaattgactggctataccatggatttggctatactgtggctataatcaagcccctcattcaaattcaacttaatcatattctttgtttctttaaagtaagagagagagagtgagtgtgtgtgtgtgtgtgtgtgtgtgagaatatctcatatatatagttggtcaatttagttgtacctcctgcagctatcttccatcatgcctccttcctaaaatgaaatactgtaccgacaaattgaacaattaattagagatctattgaaggatattattgcaaaatctcttcttgtataggacttgtcaagaacaaaagcaaaactattatggaaatttagctatagttttttgtgtgaaagtgctgataatttcagccttggtagggctactcttttcagagtgagagcacattcagtgttgaaaaagtgtcattagtcttctgaaaggcatgatattcttaacttaaaattctgcccagtcggacacaggaagtagtttggcaatgtgaatttctgcctactgtgaaactgctaagtttttagccccaaattggattttaaccctgatattagagataaaggtgtcattttcagtttttaatgcttcagttcctacagttcctgttcttagaagacaaaatagactctaaggtatgcctcttctgaattttttcgttgagttaaaaatcattttggaatttcctaagtgtttactctttgaattgacctctcaatacaaaaattagagccatttatcttttttctgttattttgtgtatgttctttaggtagcaattatatatttaaagacttggatctttagcttgactatttcataaccagagcagaaagaaagtgaagtgtagaagctataatttggaacgaataaagatgtcatttcaatgaactaccaagagatgatcttactaggtcaggcattgaactttgtcttaaatatttttgttagtatttactttgggacagattattttatgatactgtaaaagtacttaaaatagaatagtacagtattttaaaagctatacaatacgtctctcaagtgttatgatgcacgaaggcaaatgtaaatgaagaggcaatctgaaatttgggtacaagaactcagtaaaagaaaaggcagtctgaaatttgggtaaagtttaggtgaaattatatagtgaatcatggccttttaatcctggtaaattaagatattgtatgtgttgttatggaaggcctttcatgttagtttttgaaatttagtttgctgcttaacatttaacttttagtggagataatttgaaaaataggaaacctt

SEQ ID NO: 63197 - DNA, 1372 bp, Homo sapiens
cgctctcgggctggacgaaggcggagcagcagctcagactgggccaacagaagagccttacaatgcctggagcagtccgaggacagcccccggcgcgaggaactctgggacttgtagttcgctttcccagacagcgcttttccccacttggtctccccgcctttcaatgtcgcttttattcttccctttacctcccagcccgccgacttcctggtcgtcgcacgtcctcacgtatgactacactacccagaagtctcctcttcacgtcccagcgcgggtgggcgccggcggctcctcttaaccacaggttccagaagtcctctgcagaagtgcttccctctctcatttccaggaccacaattcccagagacttcggcttcacgacgtttctctttttgcccgatctctcccggagctggctgggcttcggccggccagaggcccacagcgacgacgtgatccgtcgtgagcgggtcccagggtttcctcggcggcccttttttctctcccctcggtcgtcccccttgcaggctgtcgcggctggcctgagcggtgacctggcgggtcgcgcctgcgctctgccctgtttcctgcctggctggtggcggcggccattttgttcatcctcctcctcctcctgctcctcctggttggagcgcagtgtccggagcgggctggggggagagagcccgagagcagggttcggtgccttttcctctgtccccagccggtgcccagagcccccctccccttcctccccaccccctcccctccccaaccctgccctcccccttgtcccgggatcgctccgtcgcacccaccatgatggaagacgacgggcagccccggactctgtgagtacccgagacgaggggtgccaggcgccaagaggcccgggcaccgcgggacgctaagggagggagcaggagagactgggccgaagccgggactctaggcggctccctgaccagggcggcgtggacgcgaagtgcattcctcatctgtccccttttccttgggaaggaaatcctcccttcccccaaacagtcacttcctggggtctggggcttgtctcgacctttttctctggcgtccttctttgcatgccctccctaggccgggtttctgcacggctgaggctgtcaggcccaggagaactcctgcaccccctccgcgttggacgccctgggctgggcctggagctgccggcgcccacgggggaagggcctggcgggggtaggattgggggtgggcccgggggtgggccccgcgggccctgaggaattagcactcaccccttccacgtcctcagctcgagtcgctcccagctcttctccccagctaagctctcggaggaagcaggacactcttt

SEQ ID NO: 63198 - DNA, 2135 bp, Homo sapiens
ttagttgtatatttattcttgaaaattagtacaagaggctgtaattagctgggatgggcacagttacatatacctttttgtgtgtctgttccacccatttttgggtgaaactgacactcatttcaaaccacctttcttaggagtctgcgtggatgtacatgatctttagtgtggtttacaactattattttgaagccttcttcctgtagacatagggatagtggtatctgttggcagcctttgttgtgagtgaagatcaagtttgaacataaacattcccagcactttgttctcagcatgaaacttacccagcaagttgagatcttcctgtacccacctggtgcatgggttaggctgtgatttcataaaccttattaaaagaaaaaaagcaggtttagttaccattattcttgtcagcaaatacaaagaactactaaatcagaagtctgatgctgggaagatttatttgaaaatttcacggtcaaaattttaaagttgaaatgtccttgaagatctcttatgttaggcttctttattttctgaaacccagagagttcaggtgtgactttgaaggtcatccagctagtaccaacaacagggagagaactagtgtcaggaaagtcctaataagaggcagtgtgtctcttcagaagttggaagtgagtgttttgggaaactgaggcatgcaggctagaatacttgattatttttgtgccctcctggccaccaagttattgggtcactgacctctgtgctgaggttgcttggattttgatgatgggactgatgaactcaagaaaagagttccctttaccaagtgaatgacttgagacttgtcagcatggcaccaaaacttaaggagaaaactaacattcagcccatgagctgtttgtgcttcattgctttcaatcctgtgctttgacacacacaatatcaggttgcacttgtgtgagttacaccttactggagactaaatgtagtggaaaatccttgaatatcattttgtatttgaaattggcttctcaatgcataatgagaaaaaggcccttgcagaaaacaaagggcgattttggaggagctgagctgaggcccgtctgagcatcatcatcttcaagaggaaatgctgtcaatcagtaaaaagctgttcattgagcatgaggagctcaagagacgacctctcttttgggggaggactcagcttcaggatgtttaaaatttaatcacgttagtaagaaaatggaaagaaaagactagacctttgtattttatttcgtcttctactgccgtcttgcagttgatcttccgccttctcctgaagtagttaggacaactccctgttttcacagaggggcagagcgaaagcaagtatcttctgtcattgctgaagcaggacggctcccggcaaagatgctgggcttcatccagccccattctaagcagctgggcctccccacctgcagtcttcctggattttgattttctgcacacttgggcttcccactaatttggcaagttcataccagtccaggccctttcctggcagaggatggcattcagtgctggtgcagccactcctccaggctcctccctgaataaacagaggccggatgttctggagtgctgttcccgccaggcctccttgggatgagagggagaccttcctccctcatggagcagggccgctctagctccatggatcttgggggttaccagtctggcactctccagggagtcctgttaagaacacagattgtggctgtgtctcatcgcctccctgccccaaccccatgttcaaatctgaattgctcagtgtagggcccagaaaactattaagtccagaaagcttttttggtggttctgattctgctgcactggcagtgggagccacggatggccagtgatcccattttggggaggaggagctgcggcttagtgcctcctgaacatctatcctgcagagcattttcccaagcctccattttccttcttggggaaactccccaggtacgcgggcttctggaggtgtgaatatggggatgacatgggaagcgagccgagacagcaccttgcaaagtctggcagggtggctggcagtgcgagagtggggaggtggtccagagatcttcctggacccc

SEQ ID NO: 63199 - DNA, 2272 bp, Homo sapiens
cttccttctttgagacaggatctcgctctgtcactcaggctggagtgcaatgacataatcgtggctcactacagccttgaattcctgggctcaagcgattcttccgcctcagccttctgagtagctgggactacgagtgcaagctcccacacctggctaatttttaaagattttttgtagggttggggtcttactatattgcccaggttagctattttcatttttgaaaattttattgggtttcttttcattgccattaagaataccatctacagagaaattcagtgagaggtaatagacaaatagcctggggtgatcaatggaagcctgactaatgattgggttacatacatgattaataccatgtttttattttgtaacagccattgattgactttgaaaatcttttatactattaaactttttttaaaaagccatttctcagttttctttctaatctgtactagctacaaacaatttctgtgactttcagtcagttattaaaaatatatttttgtgtccttttttcagcagcccatgacccatcgagaaactgcacctgtttcccagcctgaaaacaaaccagaaagtaagccaggcccagttggaccagaactccctcctggacacatcccaattcaagtgatccgcaaagaggtggattctaaacctgtttcccagaagcccccacctccctctgagaaggtagaggtgaaagttccccctgctccagttccttgtcctcctcccagccctggcccttctgctgtcccctcttcccccaagagtgtggctacagaagagagggcagcccccagcactgcccctgcagaagctacacctccaaaaccaggagaagccgaggctcccccaaaacatccaggagtgctgaaagtggaagccatcctggagaaggtacaggggctggagcaggctgtagacaactttgaaggcaagaagactgacaaaaagtacctgatgatcgaagagtatttgaccaaagagctgctggccctggattcagtggaccccgagggacgagccgatgtgcgtcaggccaggagagacggtgtcaggaaggttcagaccatcttggaaaaacttgaacagaaagccattgatgtcccaggtcaagtccaggtctatgaactccagcccagcaaccttgaagcagatcagccactgcaggcaatcatggagatgggtgccgtggcagcagacaagggcaagaaaaatgctggaaatgcagaagatccccacacagaaacccagcagccagaagccacagcagcagcgacttcaaaccccagcagcatgacagacacccctggtaacccagcagcaccgtagcctctgccctgtaaaaatcagactcggaaccgatgtgtgctttagggaattttaagttgcatgcatttcagagactttaagtcagttggtttttattagctgcttggtatgcagtaacttgggtggaggcaaaacactaataaaagggctaaaaaggaaaatgatgcttttcttctatattcttactctgtacaaataaagaagttgcttgttgtttgagaagtttaaccccgttgcttgttgttctgcagccctgtctacttgggcacccccaccacctgttagctgtggttgtgcactgtcttttgtagctctggactggaggggtagatggggagtcaattacccatcacataaatatgaaacatttatcagaaatgttgccattttaatgagatgattttcttcatctcataattaaaatacctgactttagagagagtaaaatgtgccaggagccataggaatatctgtatgttggatgactttaatgctacattttaaaaaaagaaaataaagtaataatataactcaaaatggtttttgtggtttctaaatctttgaaagcagtggcatcatggagattgtctgtccctggtttcagtcagaataaatgacaggtgcatttaacaagcctgctttgggttttgtgacgtctccaatagcccggctcaagagagaattgtcttggtcacctttcagtctcagattgcaacaggaacctgggaagactcagggctgtgaactccggtaatgggaacatgcctgctgcatccgttcggaccgacccagccaacagccaaggtgccagttaggtagcatgtctgcccacctgtcctcaggcctcaccaagaagctgagattgtccaaaagtgcccagagggcctggcgcaatggctcacacctgttatcccagcacttt

SEQ ID NO: 63200 - DNA, 1067 bp, Homo sapiens
tttgagatttttgtgtgacttgatgttgtgcgacacaaaatgtattgtgggtccatgtttgggtgtcatgtaagctgttcggagaggcttaagtctgcaattagcttgctttaggaaaatgtgtgtgcagtcgtggtttaaacagagcagtccctgccctcagagcgctgacagtccagtttcttgtaagatggggctgggtggcacctgccccttttggcttgctaatcctttcctcatatcactcagagattcttccactttagggaaagcgagaggatagagttctttaaggaaggagccagagcttttcagacttacttgtaattcttatgtgcagtctagacagaaggattacatgatatgaattgaaaaggataaaaggttcagatgagcttttcagatcacagcgtggtatcacttataggatggtttttaaggacaggccctttaacatattatttccaatccccacagcaaccttacaggacacgtgtgggatcctctttttcaggtgaggagaaaggagtgagaggttattagtaactcgttcggggtcacagcctagagttgagacactgacacagggcagttctgtgacctccagaacacttttgggcaggccccactgctttcttaggaaggcctactagttgctttgccagagcagtgaaggataacttatttttttcctcaggctctgtctatattttcttgctattacgttgtatttcctcttttcagaatggaggataaactccttggcccagataaagttcttgatgatctcgggatagagttattatggataggctaattttggccagtcttctgtcattctcttctctgatttgaccatttgtctggctttctccccttccctcctttcactcccccaaatttgggtaaggcttcagtacagcttgaagtaaagcagatttcaaaattcctaggttgtcaaaagagtcaactccttggattctaaaagcttagactattagaactggatgggacttaagatcgtctccaactcatctgacaacaaacttttctacaccccagtttct

SEQ ID NO: 63201 - DNA, 1098 bp, Homo sapiens
atagatacaggggagatctttgagcagatgcattgacatgtgtactcattgggaactatttcctccagtggtgagcaacctgaagcctttctcagtgtagcttttcaagagtcctagatccaatttcatagacatcctttcagagcatgcacagcagaggtgaaatggaggagaagcgtgtagggcaaaactaccttcttcaaagaagggagaaactttgtagaatcactggttcctagacgcttgtgttttggccaggccctggccagcaaaggctagccaaaggcatgctttggaggagaggtagtatcaagtttttttagagtagaccgtgaaggtgccagaaactaaggtgcactgacagcttggtctatggggaacctggctgcattggttcaggtccccacttgtcccacttgcctggcctaaacacacccctggcacggagaaagaggatgagactcactgctggatccctagcacctggcccataacaggttttttgtgaaagttgtactgaatgaattgaaataattctagtccctggtctaccttctatagtttaagcagcaaaggggttgtagggacgtttaaagggagaatataagaacaaaagactagaacacactgcctctcttgccacctaaaaaagtcatgcaaatttctcactgtcattttattcagtgaagcaggaatctcactcttaagcctgtggaattcattaaatttgttttctttctgaataaaaataaatgggacccatagacatctttgtttttttccaaaccggcccttgtgcagagaaggttgttgttgctaattttagtccttgtgatgtatggtggaatttattcatgtatttgcagataatactggactactggaaaatcaaactagtttgatcaaactagtttggggtatatcccaacacattgccaacacatgtttcttgggtgatgcattatgaatgcattatccaaggatttatctaatctttgtttgaggtggttgttactttcaggttcttagggtaatgagtttggaaagttgtaatttaagctgtacttcctttttcattcccaaaccatgacttttctt

SEQ ID NO: 63202 - DNA, 1050 bp, Homo sapiens
tagaattctggggcatatctaggcattaagatatttgcgtgaagcatttattactctgagaaggctttcaggaattatggtcctaccatgaggtttaataattgaaaaatgtattgaagttgggttttttctttcatacttttttctttttttttgagacggagtttcactctttcgcccaggctggagtgcagtggtgccatcttggctcactgcaacctccgccttctggtttcaagtgattctcctgcctcagccttccgagtagctgggattacaggcacctgccaccacacccagctaatttttgtgtttttagtagagacagggtttcaccatgttggccaggctggtctcaaactcctgacctcatcatcctcctgcctcggcctcccaaagtgctgggattacaggcgcgagccactgtgcccggccccatacttttttctttgaagccatatgaagacccttaaattatggagaggttactgaatggtaggagcctggagttttaaatacatacacatttctcaacttgatgtgaaagttactaacatttattatgtgacggatgctgggcacttttcacataatcctcatgaaaacctgggactacaggtgtccggctaagttagatggaattctgtttacgaaggaggaaactgaagctgagaggggttcagagactgtagtagagctaggattcttcacccaggacaccaaatgcagactacatctatagcacatccaagtagctgaattctgtccagctttccagttctacagtcagccccaggtcacccttgcacattctttcctgtcacctggctctctggcttcaggccccttcatgttcatcctctacagatttgtcctgtgttctatctcaaatccaaatctgccctgctggaggaagcggctcctgaatttactacctgttgtcccgctgagtgggttcctgtttagttcttcagcctcattcttcctgctccctgtcttattctgcatggccagcagtaccaaactatttggagtcttctttgccttcag

SEQ ID NO: 63203 - DNA, 2033 bp, Homo sapiens
tttttttgccttccattgaatgtatcataacaaagacattcaagatgcaatagtcaaaactcaaatgaatttggaggctaaactattaagtgtataattactctgtgagttacagattgagtgtaagtttcactaaaataaattgtaaatgataataatgaaaatgtaattttaattttctgccaagacaaatattgttttcattcttgataatcttcacctgtcgaactaccacaaatgttacgtttattaccacgtatataaccttttgcaatctgggccacacaagagaataaaccctgtccttaggcatccgttgcatgtaatgaatttgcttctctcttgtgtgtctagaatggaaccagcttgtgtcatctaatttctcatatggaagaagtgagaaaactgtcacccaaaacaaatcactgttctgtggtttagatgaggaaccctgattgagatgcctggcacgtagaaggcactcaaacggaaacagttcctattgtatttgtcctggaagtcagataaaagagcagttgctttccggatttctttgtttggtataagcatcttcgggaaaatgtattttccagagtgtgatccagtaagtggacagctctgtggcaatttcttaggccctgtctttggatcctgtgctgtaggaccacacgcagctcctccgtttgtcctcttgtagtgtaatggccctgttcctccactgtagggcgccaaggtactgcttcctatctgggaagagttttctgaatgttactgctttccccttaactgtccgaagccttattgtatcccaagccttattcaggcctcacatttaatactttgtcacaaattgctttatggtaatgtattccatttggatattcatactgcttttttgggacattgattttttttcaatacactgctaaagatactgttttaatatattttctggtgaatgttttctcatcactgcttcctattttattttagctactgatctacttcttgcctggaatcccatttgtttggggttggtagaaggtgttattgggaaaattcaacttcattcaggtatgtttctataaactccttaaacttgtcaaatttattgtagcattttttggtgttttcctctttgaggatacatgagattctcttatagctttgattcctttgttttaattttgggtctgctcaaagtgggtgtataatgagcgaagacctgtttctactcttatggagcttacagtttaggaggaaagacaggtatcaaagagtaatcatggaaataaacgtatgattatttggaattgtggaaggtgccatgagggaaagatatagcaaatgcattgatctcaaaggagagtagtaggaataaagctggagaggcaggcaggtggcagaccatgactggttggctttatgtcagctgactgttcctgatgcagtcagctctgccagagacgagtatgggtctcttagcacacagtgtggtcctgtcagggatccctatccaggacaggcagattgatgggaagtccaggtcactcaccaggccctcacttggaatgacaggcacctgtgtcctcagtttaaagggaattttgttggtgggaaagtataacaggtattatacaggtgggtcccaaaaggctaactgaaaggggccaaatgaaattttattttttcttttttggtgccttacccttcagggagctttttaaaattagagatgggttcttgctacgttgcccagactggtctcaaactcctggcctccagcagttcccctgccctgggctcccaaagtcctgggattacaggcatgagccaccatgcctggcctaaatgaaatattttaagcactacatttaaataaatatttttcctttggtatcaattttgatgagttatgaattataggaggctttgccattatttctgtataattgtgagtatatatctttatagtgtgtcctttttatttaaaaataatattaagcatttgggagctagattgatttttgtgt

SEQ ID NO: 63204 - DNA, 1061 bp, Homo sapiens
gtctcctacaaataatgtacaaatgtaagtttgttaatggttgatgagtttacgatacagtcaaagtatggtcatttaggaggcggtgaaggtatggtcatctgtggtcagccccctttatatgtacttctcctccttgccattctttggtcccaaaataggtgattgataggcagtgagaatacctgtgatgtaggatattttgaaagaagggagaggtggagggtagagtgaactggagaaagaaagtataaaaaaggaaaaaagggcagggaaattctcttaatttttcattctcctaatccttggacattttttttccttcttcttgtcacgtcacttgaacggtttggctcttaagaaaaagagtcgggaggaagcaaagggaaacacttttctgggcccctgctgcttttccctccctcccaaccctctccatgtcactctgcccccagccccttgcctgtgagcacccaccttacttactctcctcatctgtcctcagggatgcctcctcctctcctctccctgcccccgattaaagctcttgccctgggtcagattggctagaagggaggtatgtgcctgctgtgtgtgagaaagaattgagaaaattacttcaggggcattttccccaggaacatcttatctttggaggataggggatgaggggaataaaatgtctatactgaaactctctcctgtttccctcctacttattctccacatattaatgcacaaatttttcttctcacctagggagatgggaacataaatttatttgaacagatgtcattgacagtcttaaagtggcgtgggtgagcaatgccgctgttcctgactgtcactgaactctgagctctgtggaatgagcaagtgctcgtgacttaggaactgtattagtttgctgtcatagcaaagtgccaccagctgggtggcttaaacaacagaatcatattttctcacaattctggaacacagaagtctgaaatcaaggtgttggctgggttggttcctcccgaagcctctgtcctaggcttgtacatggccaccatcccctt

SEQ ID NO: 63205 - DNA, 1022 bp, Homo sapiens
ctctcaactaaaaatacaaaaattagctgggtgtggtggcgggcacctgtaatcccacctacccgggaggttgaggcaggataatcgcttgaacccaggaggtagatgttgcagtgagccaagatcgcaccactgcactccagcctgggctacagagcaagactctgtcaaaaaaacaaaacaaaacaaaacaaaaaaatagaacaagtcactaaaagactacattgtgaaaatgtataaaaagtaatgtttttggtaacaacacattagtagcgttagtgaaagttattttgtaatccacacatttcttttaaaaaatatatgatagaagaatttcaaactatttctgtgcgtgttatcctttgttgatgattgcctgcccttttagcaagctctgccacaaaaaaaaaaaaaaaaaaaaaggttctatttgccctaatgcctagaaaatatctatttagaaccattagcctatttttgggttgcaagacctcttcctcagacatttgcaggcaggtggatttcagccagggtgtaatgtagtctgtcttccgacaactcaaacgtgtctgactttggtttgaccagttgagatttctttactttatttatttatttatttatttttgagacagagttttgttctgtcgcccaggctggagtgcagtggcacaatcttggcttactgcaacctcagcctcctgggttcaagcgattctcctgcctcagcctcctgagtagctgggattacaggcatgcgtcaccatgcctggcttatttttgtaattttagtggatttccccatgttggccagactggtctcgaactcctgacctcaggtgatcggcctgcctcagcctcccaaagtgctgggattacaggcatgagccaccatgcccgaccgagatttattaatatgaggaacagaaagtaggagggatgtgtaatgcatcaaataggtgaaagaaaagtatagatctgtgaaaaatcaacattaaaaaaattcattgtagtatccagga

SEQ ID NO: 63206 - DNA, 1055 bp, Homo sapiens
agccaaatctctgaggccattgctgtactaccagtatttgatagggggaagatacagaatatgatgagattattgcaagaagttcctttggtttgatgattatttttttccttttcttggtcatgtatgttggaaaattgactgtctaaagacaattcattcaatcaacaaatatttatggaaggcctgttatgtgccacttgtcttttagacattaaacaaagcaggcaaataggtgaataaagtcatatgttatcttttaacctttcagaaatttcacaccttttccttttggtttctcccctttagtggtggttagtatcaatgattttcacataatctagtggtgtcttcgctagatacccatcaattgcctctatggagaatgaggcctgagattattcttacctctgtttgcaatgctgatcaaactgtgaccaccaaaacccagtggtagaggagaaaagcaggggcatctgtaatgagcatttgtcctgtgtgctgacaatatcgagctctaacatgttttgccgagtttttgtcagaatgcttttacattaccatttaaaactgacgacttgaagtcgtcatattcaaaggtgacatttggcagcataaatttctctatgcctgtcaagagttttgcatttattgctagaacagaaatacaaataatgggaatggtgataagaatgcaggtagatcctttacctcactattttcaactttagccaccttcctaagatcctatctgcaggctgcataaaacaaaacaaaacaaaacaaaacaaaacaaaacaaaacaaaactgagataggacctggagtgtttggtgatggaagaagaggtggatttgaagtggatgctgagattaaggctgggtacacttacggagataagagagaaaggacaaagaagaactctctggagcatttttatcctttactgtctctgcagataataagttgagaaatctgtcttcttagtctgaaagagacagaagaagaaatctttattttatttatttgttttttttgacacagtatctctctgtc

SEQ ID NO: 63207 - DNA, 1059 bp, Homo sapiens
ggaacacaggtgaaggagcctgtgtctttttcttcctcctgtctcatgggcttccttgagtgcctcctattggcagatccagcaggccaagcagaaatgtggtgtgtaggctgggcgcagtggctcatgcctataatccaagcactttgggaggctgaggtgggtggatcacctgaggtcaggagtttgagaccagcctggccaaaatggcgagaccccctgtctactaaaatcccgtccctactagctgggcgtggtggccgtcatctgtaatccccgctactcgggaggctaaggcatgaaaatcacttgaacccaggaggcggaggttgtagtgagcccagatcgtgccactgcactctagcttgggagatagagtaagactctatcttcaaaataaaaataaaaataaaaaaataaaatacataaaataaccttgtgactgtactttgaggacacgaatctgtttatcttatgtacagtgtttaagcagccaggtttgagtttaagccctggctctaccacatacaaggttttgactctgtacaaagaacttaacctttccaaacctcagtctcataatttgtaaaatgtaggtgataacagtatcaattacatagtggtgttaggactagtgaatgtgaaaaaactgtgtaaaaaagctcttagaaccctagccttggcacagagttaacatttactaggcacttaactattctgccactattagtattgtttctgtgtgcttttttgatattcagtttcacttcataggcaaatttaaaacaaagacaaaatataatagtatgatcctgcacattaaaaattgtaccaaaacagtataaatatttcattatatttattcaacttgtagcaatttataaagccatctttcaagcactactttattaaaaatgagtctgaaaagaccatttctcttatttaagggtcctaaattgtatatgaatatgtttcctttttctgcagtacacattttttgctatggtttcctggcccatatacagttaatccaccaatgtgttcattttagctgaaaaa

SEQ ID NO: 63208 - DNA, 1048 bp, Homo sapiens
taagtcaccacttctctagggacttgctctgacatctttgttgtgaaaagcgcaagggaaacaaaacagtttaagttgtcactgggttgttctacaggtgctggtgatgtgcagcaaggtaaggaaactcctgcttttcctccctgtgtagagctgctcatctgcacacccaggctaaaagcccattgtgatcaactctagggaactagccacattttcccatgtcagaaacatcggtttttgaatattacaccagtttgagatgtaaataatttttattgttttggtgtttgtcatataatttgttttgacctgtaaattctagaaattctacaaattgccaagaatggctttaccctaaagcaccatctaactgtgaagacttgatgccacaaatagcatttgacaagcttagatcagggtagaatactagtagatattttaatttaactatactatttgaaaattatagaagtcagaccttggaaattataaaagcctgtagaattctagacttgaactgaaagcccacaatttattttgggggcattcttgtgtttaaataagatgtcaaaatcagtttttgtttgacagggtgactttacaaggacaggagaaaggaagttagcaggagttatgaaagatggagtgaactcagcaaacagatattacctcaaccgatttaaggatgcttataggcaagctgttataggtaagaagcagaaaagcttttctttcctcaaaatttatgtcttctgtgactaatattttacagaaaccagcttcattaacataattcatattttgtaatatacttgtgtttctgtattgagcatcttacccaatatatcaaattcaaatttttacaagattagaatttgacaaatatttttggctggagcaacaaaagaaaccatctattttccatgcatatttgtcagtttattactcaggtaatagaaagcagggtttgaagctcctggagtgtggaataaggtgccctaaaacctcaacaattaaaaacttcatattccgtttgttttctcat

SEQ ID NO: 63209 - DNA, 1031 bp, Homo sapiens
aaaaactaaatgtgtaatttactttgtagaggtaagaacacacaggaatgaactgacaaacagaacaaattatgaaaaacgctaatcccctaagcatctgcatgtccagcccttgtgtctactgtagtctacccaccccactccaaaaaaaggttcaggttatatcccaaagtgacctgttgctgaattactttcaaataagcaaagtgctctgtagtgtataagctactcaggtctacacattctagaatgatgcacttctgtagtcctggctgtaaaatttggaaatctactcaggttccgactccgtttaaaaccctttccaatgaacagaatttgtgatccctgggttcagacagtacaattaaaataccccaagaggtgaaaatttcatatttttaaataaaagccatggaaggattcttatggctaaaagctaaatctgaattatccgtgtctggcattgtataaacatctttttaagttcattttgctggacttgattaatgatttcaggttctggaggactcttctgaacttttgacactgcaaagtttatcccatgggttaatccagcttgggtaatactagcaacctggaccatggaacttcgaatcttggcaaagggagagactgctctgctgctactgctctctgaaggagaaggagttacatgaagccctgtctcaagttcaagcatgctggaagcggaggtgggggttttttgagatgcaactgaatgcgctggctcaactgacaaaaactgtgggcctgttgcagaaagagagacatctaattgcgatggccgagaaggtgtctgttctgttgattctgattgggtttcatttgaaacttgattggtcatttgatttctttcctgactagcctgctgagacacagatctggtctctgataggtgggtcactttgttctgtgcatcttgcacaaatctgtggcagtaaatatccataggcttggcaaagccagtcaatatgtgtacgtcgccagcagaaggacttttcttcaaagga

SEQ ID NO: 63210 - DNA, 1069 bp, Homo sapiens
ttgctgttttcaggaatgtaagaacacccatattggctactggaaattctagaagtcagtcaggttttaatttattccaggaggggcatcctcgacatcttatgtagatgatccacaacttcaaaatttagtctgggcctagtgcagtggctcacacctataatcccaacactttgggaggccaggagttttgagaccagcctgggaaacatctgtctctacaaaaaaatacaaaaattagctgggcatagtggtgcatgcctgtgtttctagctacgcaggaggattgcttgagcccatgagattgaggctgcagtgagctgtgatcgtgccactgacctccagcctgggggacagagcaagaccgtgtctcaaaaacaatttagtctgaaacacaattgtgctgaatctgtctgactataactctgaccacacagaaccagggctgcccctgtaatccccacagtaagaaagttgtatggcatattccaacaagtattggttcgtctggtgtctttagagctttactctgttgaagtgactgattctcaactgaacattatgtcgttactttgataagcattccacttttgttatttattagtgctatcttttttttttacgtgttaaatcttgtgattattaaaataaagtaccattgtaatttaaagtgacaaatgggtatgagaattccttgcataacagattaaagaatttgtaaacggcagatttgctataactgaacacttggtctagctgttgccagtatgttactcctttgaaatatactcatgatgtaaaaagggaaatggatcagaaactatactttaaatccaaacattcaaaactgaatgcttgcttctaccaacttttcttccgggtcctgaaaatattaagggttcccaacatgggagaaaatacaacccaacattaggtgataaaatacacgtttaaactctacagaaattagttcgaaagagatctttgaaaaatcattttaagaaggcaaagttccaaacagggttacacaggagtctactcagtttcctggccatacaggattaacgct

SEQ ID NO: 63211 - DNA, 1129 bp, Homo sapiens
atttaggagtaggacatgttaaaatgctgccaggctcaacattcttaccaataatcacctggttttcttgcataaatgctctctggattgctgcaagtatggttttatttctagtttttaaaaagctgattttgatcagtgttaacagtagagacagttttctgcggtcccttctctgccattttcactaacatcactcttcctttgtggaaaagcattgtttcctatgccagttgctgatttatatgtttgcttgaccttaaatgaatctgagtttcattattttattttcatcagcagcattatgtatgtatatgctttggtactttcacccatattgcctcctttgtctaagaggctgacatgcaccttactacatcagtcaaggaaccatgttaattttcttttccttacaaaaatgcacatcatttacatttactcttttgataaaggcagttgaagatgactttgtggaaatgcggaagaacgaccctcagagcatcactgctgatgatcttcaccagctgctcgtggtggctcggtaagtggcgcacgtccattattgctgtttcggtaagcttgtgtatatgtcttctgagttattcagcagtaactgaggcagaattctaaaaacggaaatgaacttttccttttaaaaacgctgtatgaaagggctcattgagggggaatcgagtttggctggtgatctcttcagtggaacaggcatgctgcttgttctctaagcttcaaagagtgagccactttccaattctgactcttcaacgatttctttttagaagcctaacttggctgttgacttgtgtgtaactaccatacggtcttgtctcctaacgtgctctgtgttttcacaaagtattcctaggtcttaaaaaaaatttaaaacttactatcccagctctagacttaaatttgtttctgtgtttcaaaccaggtgtctgtctctcagtgctggtcagacaacgctgtcaagagaacgatggctgagagcaaagcagctagagtctttaagaagaacgaggcttcagcagcaaaaatgtgtgaatggaaatgaactttaaagatgtaatacctatgaagagtaatgggcaaactgtagccacataattgt

SEQ ID NO: 63212 - DNA, 1061 bp, Homo sapiens
gtattgatagacctttttaattagctgctttttagaggttggctacatttttgtgtgcttactgataccattgaggaaacataagtaaccaagaaaaagctttcataattatttctgaggtagttataaagcatgtaaattaatattaaaaatagatgctcactggctgcggtggctcacgcctgtaatcctagcactttgggaggccaaggcaggtggattgcgtgagcccagaactttgaggccagcctggacaacatgacgaaacttgtctctacaaaaaatccaaaattagtcaggcatggtggcgtgcacctgtggtcccactactgaggaggctgaggtgggaggatcacttgagcctgggaagcaggttgcagtgagctgcaatcacaccactgcactccagcctgggtgacaggacaaaaccctgtctcacacacagaaaaaaaaacattattccctccccctaaataataagtggtattttctaattcccataggggctgacagagatgatgcatctttctttaaaaatgtagattaatttaggaactcagaaaatacagtgtactccttctcttttcaggcagactgccagattcacttacagccccagctaattccaccaaacatggaggagtacatgaacagccttctctcagcggtgctgccttccgtgctgaacaaattccgcatttatctaactcttttgagattcttggaatatagcatatctgatgaaataaccaaggtatgtctaggttaaaataaaggatttccctgtgttgaattgcagtatgcaaccaatttacatttaccataattactgataaggtaattttgttatttgttttctgtcatgtctttttttattcctctgttactccattattgtctttttgtttgaaataggtattttccagtgtcccattttaatcccttgaagtttcttaaagttattttcttagtagttgtctttgggggataaacttaacatgttagtataatcatctattagggattaatgccagtttgtttagttatttttaatttaaaaa

SEQ ID NO: 63213 - DNA, 1815 bp, Homo sapiens
ggattaataggagacaatggatgcttgtatctgcttctgccttcagtctattgtagtctcaggttttggttgaagtatatgaaggaaagctggcctcacacagatggaaaagtagatggtaaaggaaggatggtttcgatagcctttgcagataactgggtggtggtctttgatactagaccaaaactgtccacatgagattttcttaaagatagttaagtgtggaatctgaaatcctattcgtaaactttccatagtctgctatggtaaaattcattagtctcgcacattgaaaggatcttttatccatgcatgattttgacctgattgaccctgtaaaagggtttaagcaattccctgggggttctcgggaccacattttgagaattattgaaacagatcctttgccctcacagagtttaggtagaagaccaacaaataaattaatacatggtaggtcatttaagcacccctaagctccccgttttcttagaatcactgaggtaatacacaaaactcctctaaattttcgcaatatatcttacctcttccttgacagccttcccccaccataccctcttctccatccctgccacattgtttgaggctggagggatggaagaatggattggtgtataaggcagagcacagagggtgttgggaatggtggctcaagagctggaggaggagcatagatggttcgcttactcgttaaacactgagtgagaaggtgctcgcgtcctggaggcacctcctgagagctgcaggtccatccacagctcagtgtgctctgctccttgatttttctctgaaaagtttgttcaaaaatgtctatgataaatgaatacaattttaactcaaagaatatagaggaaaattaagcttttctctccctgtcttgaagagtaaaattaacattttctttttgctagctagcttgtgttaggtgaaagaggttaggttttggggtatttaatatttatatgtcagttatctaccatttgtttcattggttaaattaaaattgattttcaagaatattgaacaagacatttgagaataaagtagctcataaaatggatgaaattcaaatgtaagatctagatactatttttgcttctggagttcaagaaaccatatcactactcccttagaaatttataagatcactttttccatatgaaacacaatgtttaattccaagtacatattttcttaaaacagggaaacttaaattcttgttcactaaaaaatttctctttgcagtcttttcgtctgcagatgactatagagaacatgaaccatttgaaattcattccccacaaagactacacagccaatcgcttggtcagtgggctcctccagctgcccagcaatacttcccttgtaatcgatgagactctcctggaacaggggcagctggataccccaggtacgtacatagatgtttctcttccatttctgacttccttcgcactaaagccagatctaggaataacttttagaagagtatctatggacaaattcacatttaacaacgtaagataaaggcttggcatatgaatttgattaaagcatatgttataaactaattatatacaccaactatgttttgccatagtattctgaaagtagtacaatggaacagatatatatcttatataatatatcttatataatatatatcatatataatatataatgtctcatttaatatatatcatatattatatattttatatattatataatggagcaataatataaagggtagtattagtataatggagcagtaatataaagggtagtattaga

SEQ ID NO: 63214 - DNA, 1165 bp, Homo sapiens
gtccatcatgacagacaattttgaaaggtttttttttttttttaaattgtgaaaaatcttctggccattccaagttttgtgttaatccgatgttgcagtttatgaataaatgcaaagttaatcatcttgtttttgttttttccttttcttggtgtggtttaataggttttgagatagtgcacagttctagttttaactgtcagcctttgggaaaaggctttttttaattttaggaaaagccttttttttttgtagtactgtggtatattgaaaacagacattagtctggaagttaggcatcctgtgttttggtttttcacttatttgctaactagcagaatgactcttggtctcaatttataaaaatttataaaataaaggacttgctttaaggtctgtttcctgatctaaaattccaagatattggtacttcaagactaatatcttaagctttgtgtctgttctaacagtgtgatttcatgtggtctcttgttaggtttatgaagattgggattgtttcaaagtaaatgacattcttgagctatatggcatactgtctgtggatcctgtgctgagtatactgaataatgatgaaaggtgagtctgtgtgctctttttttggtctcctttatttttatataatttcaagttttcaggagagttacaggatggttttaaagaactcccttttccctttctcccagatgtaccagttgtaaacacttgcaccccatgtgttttgtcattcatttgtgctctctatgcacacatttttctgaaacacttgaaagtatgttgcagaaatcaagcccttttacccctaactgcttgtcaacatttcctaagagtactgactttctcatatataattagagtacaggtatcaaaactaggaaatttgccacaaatatacaatacactaatccacaatctatacttaatttcactaattgtcttaatcatgttctttcttacacgtctcccttctgcatcccccagtccagggttcagaagctcgctcattctctatttctactgagttcatactgtatttctgattccagttcagcaccacaggtgtcgttctgcttgttctcctttctgtattagtgtaactctcttaaacttgattcccatttttcacaatcttatcatttgcacattt

SEQ ID NO: 63215 - DNA, 1073 bp, Homo sapiens
cctggtacatactggatattaataagtatttggtaaattaatttattgctgtatggttttattctgcttaattaatagaaaaagtatgttctaccaaggagttttgctgtcggtagaccatgtattccttaaatcaaagatgtcaaagtaaccatattgcaaatcaacttttgaaactggttatacatgagatttgatgggaggaatttgttgatatcttacagtaagggaaaaaaaagtaaaatttttagatcttcatgtttatctttgtcctcttacagatcaaacaaaagactttgttagtatgtgctgtttccttaaaaactgtaacaacttgaactttgcaagctcagaagcatcacgtatatcaaacttgaaaggcacttatggaatgttctttttctccaggaggccttagaaatgactaagtgcaatgctatcctttgaatttagggagtgttggtggtcttcaatggtgtggagagccaaaacgtttagaaactgaagcttctactgggcaacagctgaactctctgaacttgtcttctccttttgatttgaattttccattgccaggagagaagggccctgcatgccttgtgaaggtaataaaacctttcgtagatccaacactgaaatgttatgtgtctcagaaagtagcttagtgtctgagcatttgcatttgttcccttgtgctgggctagctatagcaaatcactgcaaatttaatagcctaaagcagcaaaagtttatcatcttacaggctttaggtcagaaatccaacatggtctcactggggtaaactcgaggtgccagcagggctacattcctttctcggagcccctaagggagaatttccttggccttgtggctccttcttccatattcatagccagcaacattgcatttgtctgaccatttttttcatgttgacatctcatctgaccacaaccaagaaagtttccccaattttaagaatccgtgtgattacatggggcccagccagttaatcgaggataatcccccccatttcaaggttattaatttaatcacacctgcacattccttttgca

SEQ ID NO: 63216 - DNA, 1028 bp, Homo sapiens
gaggctgcagtgagctgaaattgtaccactgcactccaacctaggcaacagaacgagactgtctcaaaaaaaaaaaaaaagaaaaggaaaaaagagatgagttctcactgtgttgcccaggctactctcaacttcctgggctgagtggtcctcccacctgagcctcccaaagtgttggatttacagatgttagccactgcatccacctgggatttgttaggggtggtgtagaacagcccttgttgaacagtagatcatccttattcatgaggtctgctatttctgggtcttacccaaatgcctaggatgactagtagggtccattatagtattatactacttccagagtctccatttaactctctgccaactagcagctgttctctgctagtcctcagggagtcttgacttgtatatccacaatttagtgttttgtcagagatccaaatggaaccttcagggtcttttatccgtaactacttcctttctagtacttctctgcaaattccagttgcttcactagccctgaaccatgtgctctgtcttctccacccagtaagagagggcctctactgctctttgttgcagtttggagaacgtctccaggagagagctgggagaatttggagtttacctgctgtgtttctcctcattcaaggatcataaccttatgctccctgttgtccagtgactgaaaacagttgcttcacatattttgtccagttacattgttgtttacagcaaggatagcagcataaggttgatacctgttattctcatgaccagaactggaagtctagcctccttttatgaaaatgcattctattttaactgaattgccaaactagtaattttttataagtcatataattagcaaaactttaggatattcctcagtttatgatagtcttttcttaacttttcgtttaacgcctatgttaatgcaaaccaagctcgagtcagtccctcaacatcctacactcctagtcgccacaagaggagttatgaagatgatgacgatatggacc

SEQ ID NO: 63217 - DNA, 1077 bp, Homo sapiens
tgtttaatataatctttgcagtaaccttccaaattagggcaatttttctgtccagatctgcctactgaactagaatatttaatgagcaacaacttctgttgtgaattaacggactgatattggggtttgataaatcagtttcctaaggtttggataagccaagagttagactctaagaatataaaaaggcctagataacatcataaaagtaaggttctagatccacaaagcagagaactagacccagattataagtcactccagaggtcccatttttctggatttgagggaggaagtgtttgatgacagtatttgaagtgattttatatccattttcttttaaaaagtaatagtttggaattagttacttgttaattaatctgtaaaatatttgctgtggtgttataatgtgaaaatgtggttgctaattttaaaataaattttgggttttttaaagtaaatttttaaaaacactttttatgtatatcacagcctcaacaagaacttgatttaaactctccacgaaataccactttggaaagacagactttctattgtgttccggtgcctggggaatctacgtgggtaaaagaaatatcctttatctgaactttcttactgtgttgatggtttctaaaaacttagcctttaattattcttcctttgcaaagcttggctttattttaataaagtgtgtttcatttgttctaattgagaaaacccataaaacgggctaagtatttgtcactgagtaatgctaaaataacagtacattcctatagtgaaatactgttaaaatgattgaagtaattttttttttttttttttttttttgagatagggactcactgtcacccaggctggagtgcagtggcacaaacatggctcattgctgcttcaacctcctgggctcaagcagtcctcttgcctcagcctcccaagtagctgggaccacaagcgtgtgccaccatccctggcgaattttttgatttcttgtaggaacagggttcactttgttgcccaagctggtcttgaactcctgggctcaagtgatcctctcacctcagcctaccagag

SEQ ID NO: 63218 - DNA, 1990 bp, Homo sapiens
gcatacaggtgttctttccaacttttttgaatctggaattattcccaaatgaagttataaacaaaaaaacttaggctctttatttcaggatagttgtaaagataaaaaaactacataaaaatgtattgaaagaacagaatgctttacaagcagtgcttcatatgctgctgaatctaggtggccttgtagcacattctgtaggtgtccccagctacactgtgggtgctagagagcctgcaggaggtcagcatcctcctgatttgtaactgccccttcccctgctcagtacagcttcttgaatgtgtcttgtgcagtacttcagacacactgaagcataaaatacaccctatctaaaaattcattctatcatagtagctaattttagtttgttttttgctgactaaactattgtgtgactcacctgatcatagtcttttattatatattgcatgtacattagctttgaaaagtatatttctctttcagcccaaaatggagttaatcctgactgggagaagaaagtaattgagtattttaaggaaaagctgaaggaaaataatgctcctaagtgggtaagcttattgctattttcgagggagagggttggacagactatacagtttctcttagtagagtaactaagtaacccacatgtaatttaaaaatatgtaaattaatgtacttctgcttcaagtacatttgtattaaaagattttggtcttttgctaattaagtttaagcatgtaaatacttatacattatgcctctaggtggcagtaactgactgttacttcctgagacaaatctttagttgcaagagtgtcagttacctttgttttattaccttcattttaaaagaattggcatgtgctagttttaagagaagagctcaacaaagtaaatgcctttttgatcattgaaaagtgttctgaatgaaaagcattttttagcattcttttacattgtggtcaaatgttatctaaaacttgaaagaaatggaagagaacttgggttccagcaattatattgaccattgagatcatttggctctctgatgtggcatgggtgtgtgtgtgtgtgtgtgtgtgtgtgtgtaacagtttgagtctggatataaagtttgtgtatatatgcttaatgttgtatagacaggatatttagttgactgacttgattattttcctttaaggtaccatcactgaacgaagttccccttcattatttgaaacctaatagttttgtgaaatttcgttgcatgattcaggatatgtttgaccctgagttttacatgggagtttatgaaacggttaaccaaaacacaaaagcacatgtaagtattgctgttttcatgaatttgtggtattaattttgtccttttactgttggtggtagttttggttcagatatattgatataattctgtttttctatgtttggggtcataggttcttcattttggaaaatatagagatgtagcagagtgtggggtatgtatctttaatatatatgaaacatttttagtaagaattttttcctaaacagagaatttgtttagctaatcttaaatttatttatcttgtgtataagttacaagaaatcatgtgaaatgttttccttatttggttttatttaggagtttgatgtgacttttttttaatcctctaaagatcttttgaaggggaaatactgttaatgccaaaattaattcctctctccaatatctgtatataatatatgtaaaacaaagaaccctaggttgcaaaattaaatcctttttaattccttcaaagacaaagccaatggtaatctcactgtttctttcatagaaagctgtcagaatcagcctataatacagaaatttaatgaaatattcattcctaggtagctcggagatgagattcaaaagtcatatattattccctaggaaaggcatgttctctttcagatatacttagaaaactctaagaagtggaaaggacccaggagacat

SEQ ID NO: 63219 - DNA, 1064 bp, Homo sapiens
agaggggcagagcagactattttatcactagcattttagagaatttaaagcaataataaaatgaactaaaagttagttggtctgctttttattatcaccatgaatctaaacagacaatctgtgcccttattgtctgtacccagcttggacctcttctaccactctgtccttggtaggccactgaaaaaagttaatttatattaaggctataaaacccaagaacaggggaagtggttgggtattcgaagagactgagtggaatcaggaactggaaagctagcaggaatccaagcaactcagtatttcttctcttgggatacattaatctctgcacactttctctttctctactccatgtctcccaaatttacttgttctcggttccaacccacgctagctagcatctttattttcaggcatagaaaatctgattggcacaacatggagtcaggaatccattcactcagggatcagtcatctgtggccatggcacagagttaggtaggacaatcgtgactgttatccacacctcaacattgggggcgttctcaaagaagaagaatagctccggcagccatggcagatggcatacgtaggagtttttaagttataataacttacacatggttttaaaaaaaatcaacatgatggtatgaactgagtgaaagtacgtgctccctccattgaagtaaccactttttttttttttttttttttttttttttgagatggagtctcgctctgtcgcccaggctggagggcagtggtgcgatttcggctcactgcaacctctccctcccaggttcaagcgattctcatgcctcagcctcttgagtagctgggactacaggcgaccaccaccacacctggctaatttttgcatttttagtagagtcggggcttcaccgtgttggccaggatggtctcgacctcctctgccctcgtgatccaccaccctcggcctcccaaagtgctgggattagaggcatgagccaccgtgccctgcctgaagtaaccgcttttaactgtttttgcttttagaggtttttttctttgagacagag

SEQ ID NO: 63220 - DNA, 1785 bp, Homo sapiens
taggagattgttgtgatacagtacaatatcttctaggttacagtaagatatcttataagatggactgtgcccctcttctagaagcctgtaatatttgtgaagtagacatatacaatgcattccttatctttttttttttttttttttttttgagacggagtcttgctctgtcgcccaggctggaatgcagtggcgcgatctcggctcactgcagcctccaccttccaggttcaagtgattctcctgcctcagcctcccgagtagctgggactacaggcgtctgccaccatgcctggctaatttttgtatttgtagtagagacagggttccaccatgttggccaggatggtctcaatctcctgacctcaagtgatccgcctgccctggcctcccaaagtgctgggattacaggtttaaccccccacccattcctcatctttcaagacaatacatcacttcttccaagaagctgtttcttgttctcttaggcccccactcctatgtgcactcctagctcttttttcatatttgtattattgtccagggagattgctttttgatgattatgtagcattgcccagagcatagtgtttaagagcacagactgtctgtattccagtccttgccctgccagtaacttgctgtgtgactgtaggcattttactttacctctctgtgcttcagtttctatgtatgtgtagcctcacagaattgtaattagaaatgctttaatttttgcaaagcgctaagtatagtgcgtgccagacagtgtgatttaatgtttgtgaaataaacacacctgcctctccatttggactgcagtcttcttcagcagctatgacctaattgcctttttatctccaggatcttatttagggcctagtacatagatcctctttggatgctgagtttccagtgaataatttattcttgtttgaaggatgaaagacagtttcatggagaagcgaagacaggcacactgggaacagctgtacatgaaggttcccctgcccatgtgttatgtttcttcttgatgcttgtcactacctgacatgtacacatatttgtttattccactgcactaggatgtaagaccatgaaagcaaaaacttacttttattcacgattatattcccactgcctagaatggtgtgtggtatttagtagaccaattattcagtagatgtttgttgaatgagtgaaaggatgggagtcaaaatgatgtctcattttgacctgtggttgaaaggttaggtgttgctgtctttggtgaagaaccagcatggttggagcagaatgctgtgggaggatgcaggaataaatagggctatacttggggttttctaattatcctctgcaccattaaagttgtttggttatgtccgtcttccttgctatgtagtgtttggtttgtgtgtgtcactgtgaattcatgctaaacgttttcattgttaagtctggtatagctacacctgtctttaatgcttttgtttcttggagacagtctgtgtgtgtgtgtgtgtgtgtgtgtgtgtgtgtgtgtgtgtgtgaatattaataattttagaactaaaattcatctctaaaaatctcagaaacccattcagagaatttccagagacaaaagaagaacctgtctccctggaagcaacagttaatcatataagtggaagagagacacaggaagcaatttcatacattcagcagacatggaaggcctggcacagtggctcacgcctgtaatcccagcactttgtggggctgaggcgggtggatcacctgagg

SEQ ID NO: 63221 - DNA, 1068 bp, Homo sapiens
tgccgtcccctccaggttccttcttcagtgcagtcaccggcacagcagcaggtacctgccagacctggggctccctctgttcaagtgccatctccttttctacttcaaaaccaatatgagcctgttcagccccactggttttactgcaaggaggtagaatacaaacaactgtggatgccttttagtgtgttcgactctttgaatcttgaagaaatctataattcaggtaaacattggtcatacatcattcatatctgattttaggaagagaaggaatgagatcatttattcatgatctattttctgtgaatgtcaaataccttaatccttatagaccccagactctgtaccttaaggtgacgatattagtataagtcctgagttacctgggtaaggtatttgaagaaatgttttagtaatttacttcgtagtttaaaggtattttgaatcagagaagttgagcagttcatataatccaggtttcaatttttctgtttcccttgttcatttgtagttatgggggcatttataaagggcattctgtggaactctctatcctggagatgctctgtgaaaaaagggttccctggtcagatgagttttggaaatgctgctctctgtatctaggtcttgagagagatggtgtgcaggagtacattaatgctttgagaagtcctgcagtgtagaaatgtgtttctttgtttatcctgatatattattatatcactgtattattgtatgtagatattattgttctgataaaaaaaatccatcagttctttgaattatgtttttaaagtttgccctagctgtttcttttctacttaagagtcataattttgagcagcacagattaatcttaaacttctattttgaaataaaaatgagcctagttttttgtctttaaagattgagtagtcaccgtattcattatttattatttcatttttattttcttgagacagagtctcactctgctgcccaggctggagagcagtagcgcaatctggactcactgcaacctctgcttcttgggttcaaactactatgcctcagcctcccaagtag

SEQ ID NO: 63222 - DNA, 1055 bp, Homo sapiens
ataacagccccacctactgtcagacaattgtggaaaaagtaggaatggagataaaccatctgcatgcactctttatgagtcggaacccagacttcaaaggaggtgtctctgttgctggtcacagtttaggtaaaactgtcaaatattcacattttaaatacaatttttgttgagtcataactgctttcagtgtaggtgatattgttagtgcaaaattaagaattacagattttaagtttcagaaaaggtagaaatgaatgctctgagtttagattctgccttttctatattcacctctagtattacctagggaatgctatgtattttactttattctgctgtttgataaaataattaattatcaggtcttgaataacatgtaacttctgtatgacttttgactatagacagtgaaaaaagaattagtgttataaaagtacctactacattataaggcaaaatgtttctttttcataggttctttaatattgtttgacatcctgtctaatcaaaaagatttgaatttatcaaagtgccctggacctcttgctgttgctaatggagttgtgaagcagctacattttcaggaaaagcaggtacgtctgtacgtggccaattaacatttcgatttagagtctatggagctgaacaattttcaaaagtctgaactgtttcttgaaacttttgtttgtttgtttgtttgtttgtttgttttaactgagcctcattggttgcttgggctagtcttgagttccctcctggcctcaagcgatcctcctgccttggcttcccaaagtgctggcatcaataactcttcagagaatccccaaattcagagtacagttataggcccaaatataatagcttccgtgtccagccctgaaactggttttacatattaaagtacaccgaggtttagaaatggaatggaatcatatagctcattatttgagtttctcactcttcttctttatgggttataaatttaaatgtgaaagtttgtgatttttaaaaatgtaaattataggaaatggagacttgagtgatttattaaa

SEQ ID NO: 63223 - DNA, 1032 bp, Homo sapiens
cttttcagaatattcaatttttttttttttttgaggcggagtttcacttttgtcacccaggttagagtgcaatggtgtgatctcggctcactgcaacctccgcctttcggtttcaagcgattctcctgcctcagcctcccgagtagttgggattacaggcgcctgccaccaagctgagctaatttttgtgtttttagtagagacagggtttcatcatgttggccaggctggtcttcaactcctgacctcaggtgatgcacctgcctcagcctcccaaagtgctgggattacaggcgtgagccactgggcctggccagaatattcaaactttgaatggcaaagtactgtgcctaaaattatgatttctgtgtaaagcaaaattgtttgagagttttcgtagatcagcagtcattatatgggagtttttctgagcttgtaatgtttttcatacttttttttttaaagatgcctgaagagccaaagctgactttggatgagtcgtatgaccttgttgttgaaaataaagaagtcctaactttgcaagaaactctggaagcacttagcctctctgaatattttagcacttttgaaaaggaaaagattgatatggagtccctggtactgatcatagtttgcttcattttgtttgaaattgtttttcttgtgtagattgaaaattaagaataaacattttcgtatcaaaatacactccagagtagacaaagactgaaatgttttaaaaaattgaaaaacacagaagaatatttttttataatctgaaaggcttttctgagtatgatgcaaaatccagaagccatcaaagaaaaaaattgtataacagtagacaccataaacaacatctaaaggccagtgatacatttgcaacacacattatagacagagggcttacttcattgattttcaaagcttctacaaatcagttacagaaagaccatcacatcagtgtgatatgtaaataggcaaagaatataaacatgatttacagaaaaggaaataacaaatggtgtcttc

SEQ ID NO: 63224 - DNA, 1033 bp, Homo sapiens
cctcctgagtagctgggaccacaggtgtgcactaccaggcctggctaattttttcttttttctagagatggaggtctcactatgttgcccaggttggtcttgaactcctggtctcgagctatccttccaccttggtctcccaaagtgctgagattactggggtgagccactgtgcctgacctggacatttttttaaattagctgaagcaaaagctgcagagaataaaaaggcattttttaaagtaatcacaatgttgttactattcctaagaagtagctaatcattccttaatactgagatagcatgttttgtaatgatagctgagagctgaactttttctcatgattatgttactaaattttggtattttacagaaaaaagcagcgtcagaaaagaaggcagtggcggccacttctacaaaaggacaagagcaaagtgcccagaagactaaagacatggcttccctcccctcagaatccaatgagccaaagaggaaacttccagttggtgcttgcgtgtcttctgtgtgtgtgaattatgaatcttttgaagttggcgccggacaggtgagtttacatattgactggggctacatagttcatgttggaatcataatctttatcatttgggttggctttaagttctttaaatatttatttaacatttatttgtgatgtggaaaaaactgattttctcttagtgaaaatttttttcttcttcaacagtgctcacaataagggattaaatgcatacagaacgtgttgtctaacttttgaaattgtctctatttcagttttcccaccgctcatacttttatagcatcagtctcttatagccactaacaacagaagtggccatagttaagaaattatgttcagaatatacttcagtttctgtgagagcaacttggctgtattcactcaacttatgtttcctagtactcataattcttcccttggggaaaaagtcttataaaaattgaccaatgctgcatttaatgatatactttaacatacttgtatcacagtggct

SEQ ID NO: 63225 - DNA, 1002 bp, Homo sapiens
ctttaaaggaaaatctgttaagataaactgtactgtcaatagcattacttcaaaatccatgccatctttttttagtgggtttttatctgatagttactgaactttttcctctgcaatttaaaaattatattgagattcttaaggccagagtggaatatccgagttgagaactcaatttgttttagggtttgcattttaaagactcaatctgagaggttttcttcctgaaactgttgtttaactatgttacagacttgacatgcaatgtgaaggtcatcgtgctgtgatgtttttgacttcttcagattctaatcctgtttcctttctttctacaatgctttctcaccccttatcttcacaacttctctcagcttgttggctcttttctcctctctctcgggtaaccagcccctcttcccctggctctttggaggaacggggagtgagcctggtagctcctcaggttgctacatgcgtcaagcagtattctcattgagcccagaaagtcagctaaagtcaaaggataaagattaagtgattgactttgatattgaaatggtttaaattctagcagaaaaggttgttgaaagtccagatttttccaaggatgaggactacttaggaaaggttggaatgttaaatggaggccgccgaattgactacgttctccaagaaaaaccaatagagagttttaatgaataccttttcgctcttcagagtcacttatgctattggtaagtgttcttaaatttggtaacatttgagtgggcttttggtgctagcacgtgcagcaattttagttttagtgagattcttttactgatacaatgtactatgaatattcatttgaattactatatgttcagaatcgttatttttcccccttagttacccacaagatggcagtatgtcatctgcttttgaccaaagacccttggttcttgcacactgtttttgtgggaatgcctttcacagtgggagtggtagggactttgaaatgcc

SEQ ID NO: 63226 - DNA, 1025 bp, Homo sapiens
tttgagatggagtctcaccctgtccccaaggctggagtgcagtggcgtcatcttggctcactgcaagctccgcctcccgtgttcacaccattctcctgcctcagcctccagagtagctgggattacaggcacccgccaccatgcccagctaattttttgtattttcagtagagatggggtttcaccatgttagtcaggatggtctcgatttcctgaccttgtgatctgcccacctcggcctcccaaagtgctgagattacaggcgtgagacaccgtgcctggccgattgtctgttcttttacttcagaaaagacaacgatgcatggtatttgactgtaaatttgtaaagttcactgaggttttttttttttttcctttttaagactttcttgtctgcacagaaagtcccagtacaacttccattgctgagaaaatcctcagaggactttcccacttcgctcctgtgatggatgacagaagagtgattcattaacaattgctcagccacaattctcggatatagggattcaaaagacaggacacagaactaacacagtgaaaaaaatcagtaccacatttggacagtataggtgagaaaacataattataaaaatgatgccatgaaaaattccacagatcagtttagttgtatagttgtcaaagttatatgtgatatcaatgaagaaatatttgtagcatgtaaacggttatttctgtttcttaaaaagtattgttagtgggctattaaacttggatttttctttttattaatgcagtatgttctttttattcaagtatgaacttgttgagaaactatagtaatatgatttttaagagatttatgttctacttaaaatgtgaattgtacttctgagctgccttaatgcaaggtcatttatatttgttaagaggaaataatcaagatcactcatatcccaactgaatctgaggttttataaatccctcaaacgattgctgagagcctgattgtggaaagaagtgagatgcaccttattttcaagaag

SEQ ID NO: 63227 - DNA, 1469 bp, Homo sapiens
tgtaattcagagcgatttaattagctttaataatagcatccatgcttagtccttctgaagattcattgcaacatgagggcataaattggcaaatgtctacagtagggaatgcctggttataactctcacctctggactctcataaattcaaaacagcagtatcagtctcttccatcttcagttttcaatggatttttctctctcaactttccaggtgacgaatgacaccttctttggtctatctaatactcaacctactgatattgttgcagaaacaaacttccctggtttatccaaagcatatttctctgctttgaactgatatttatgtaggcccttttcatgtgaataaaaagtttgctagaacagacataatctaaatccatgtttacctgtgatttgccttgaagaaagccaaatggtttgtctgcctcagctcaagaatgaactttccctttcggccggaaccgccatcttccagtaattcgccaaaatgacgaacacaaagggaaagaggagaggcacccgatatatgttctctaggccttttagaaaacatggagttgttcctttggccacatatatgcgaatctataagaaaggtgatattgtagacatcaagggaatgggtactgttcaaaaaggaatgccccacaagtgttaccatggcaaaactggaagagtctacaatgttacccagcatgctgttggcattgttgtaaacaaacaagttaagggcaagattcttgccaagagaattaatgtgcgtattgagcacattaagcactctaagagccgagatagcttcctgaaacgtgtgaaggaaaatgatcagaaaaagaaagaagccaaagagaaaggtacctgggttcaactaaagcgccagcctgctccacccagagaagcacactttgtgagaaccaatgggaaggagcctgagctgctggaacctattccctatgaattcatggcataataggtgttaaaaaaaaaaataaaggacctctgggctacaaaaaaaaaaaaaaaaaaagaatgaactttcaactcttttcgcttgggaagaaaatgttccagatcattggatcatttttgtttgtttgtttgtttaataatttggagttatttttattcaatgatttctacttaatctggaaaataatgaaagcttttgtaatgagacaatatttagaaagattaaccagtttatatatttgtcaatggttttaagaaaacaattggaaggtgaatttaaaaatagaatgactccacagatgcttgcaatcctctccagcatttcttcttgcctgaattttggggaaaacaaaaagccattttaactggggtaagatgatacctcgttgtagttttgatttgcatttctctgatgatctatgatattgagcacgttttcatatacctgtttgtcatttgtatgtcttcttttgagaagtgcttatacagatctt

SEQ ID NO: 63228 - DNA, 1294 bp, Homo sapiens
atgacaaacaggtatatgaaaacgtgctcaatatcatagatcatcagagaaatgcaaatcaaaactacaacgaggtatcatcttaccccagttaaaatggctttttgttttccccaaaattcaggcaagaagaaatgctggagaggattgcaagcatctgtggagtcattctatttttaaattcaccttccaattgttttcttaaaaccattgacaaatatataaactggttaatctttctaaatattgtctcattacaaaagctttcattattttccagattaagtagaaatcattgaataaaaataactccaaattattaaacaaacaaacaaacaaaaatgatccaatgatctggaacattttcttcccaagcgaaaagagttgaaagttcattctttttttttttttttttttgtagcccagaggtcctttatttttttttttaacacctattatgccatgaattcatagggaataggttccagcagctcaggctccttcccattggttctcacaaagtgtgcttctctgggtggagcaggctggcgctttagttgaacccaggtacctttctctttggcttctttctttttctgatcattttccttcacacgtttcaggaagctatctcggctcttagagtgcttaatgtgctcaatacgcacattaattctcttggcaagaatcttgcccttaacttgtttgtttacaacaatgccaacagcatgctgggtaacattgtagactcttccagttttgccatggtaacacttgtggggcattcctttttgaacagtacccattcccttgatgtctacaatatcacctttcttatagattcgcatatatgtggccaaaggaacaactccatgttttctaaaaggcctagagaacatatatcgggtgcctctcctctttccctttgtgttcgtcattttggcgaattactggaagatggcggttccggccgaaagggaaagttcattcttgagctgaggcagacaaaccatttggctttcttcaaggcaaatcacaggtaaacatggatttagattatgtctgttctagcaaactttttattcacatgaaaagggcctacataaatatcagttcaaagcagagaaatatgctttggataaaccagggaagtttgtttctgcaacaatatcagtaggttgagtattagatagaccaaagaaggtgtcattcgtcacctggaaagttgagagagaaaaatccattgaaaactgaagatggaagagactgatactgctgttttgaatttatgaga

SEQ ID NO: 63229 - DNA, 1076 bp, Homo sapiens
aaacctgggaggtggaggttgcagtgagctgagatagtgccactgcactccagcctcggcaacagaataagactctgtctccaaaaaaaaaaaaaaaaaaaaatccctccactatcttcaagcttacatagtttctgatgaaaaatttttgtttttgtttctctgcattatatcttttttcctccgattatcttcaagatttccttaaccttggttttcaatagtttgattattaaaatatatatatatatggcttggagtttacctaaatggaattcaacatatacatatacaaatatatacacatatacaaacatatatatacacatagagacagtcaattcttgttatttgtggtagctatattctgtaaagttgttgtatacactgaattagtgaatactgaaactttgtttgctcctaggggttaggttcttgtgaggctctggtcacaacattttcatcaactgatcaatagataaccttgctttatatgtgtttccgtttaaagacatattaatatgtcagttgatctattaacattgaactcatagccaacaacacatgcctgagcaaagattatcacatatatatatatgtatgtattttttgcaagacacatcacaacttctcatacttagaaacggtaggcagtatgcttggggacctatttaaacagtgaagtcaccagcaaaaggaacaaaaatgtgaaaaatgtggtactaaataaatcatgagatgaacacttgttttgccattggaaaagctaaagcaagaattcttgtttgacttcagctgggaacacacatgtatgttcggtgacatttttttcaccattctgcacttgtccacaaaagcactgcaagtattgattttgaggttgcaaattatagtgagtaggtaaattgacaaatacagaatctataaataactagaatggactgtgtacacatatatacactatacatattctattcatacacattctatacctatgaacttaaacatatacacatacaaatatgcatacacacatacatatgcatatatacacatacctcatttaaaaatttttg

SEQ ID NO: 63230 - DNA, 1009 bp, Homo sapiens
tttaaaaattctattgttaatcatgttgctataggcatgaagcatttttttttttttagagaaaaacttaatgttttgtgaaagagagagacagctagagttttttgtttgactttgccttctcctgactttccctctgcaaggtttttgtgtttctaagttgtcttcttttagttaggagactagaatacagaaaaacattctgctaaatatgattttaggtattttgtcataaattagatcttaggaaaactgattttcaaggcatcctggggttttaacctaaatttcccaaaatattaaggctgtgaatcatttttcatcacaggatctttgtgatgtgtcaaagaaaacaattttgtaactgcagttaaagatatctaccaaagtaacacaaatgctgccttcaaaatgaaaaccagttttctgtttattcttgctaaatgtttatgtaatataaatgtagtatgggttctggttgatgttttgtgaaaattatgttctgtttcatccagcgcaagtatttacttgatctgatttcttcttgatacaggttaaatgggccagggaaaactatcaccataacattggctcaccatattgcttacggttagcttctgctgatgtcaatgggaagatcatcgtctgggatgtagcagcaggagtagctcagtgtgagatccaagagcatgccaagcctatccagggtgaggaaagtctgctcagctaagtgtgtatattgatacacttactcttggagtggttttttggttttgggggttttcccccattcatttaattttatcaattccaagttagctcttgattgtgttttgcctattctgctgatctaaatctggctttctgtccttactaatacacttctaggcatatttcttcaaatctcaactgatttgtgctttggtaaaactcattaattgcaatatcagcctcattcaagcatgataagaaaaagtaagtggtacaatcttgtaatctaagctacaat

SEQ ID NO: 63231 - DNA, 1814 bp, Homo sapiens
ccacctgtttctcttcaacttagagaacattcccattatgttatgaatgcataacattgccagttatatattattaaaattatcactatattgctctcaaaattgtattggaataaaactgtatgctaaacttcattaaactttaatcagagttttgcttttctcaatatagtgcttaccagcgagggtattgttttcatctcagacttctccccatccaagcctccctcaggccctgggaaaaaagtttacatatccagcccacactctagcccagctcataacaagctggccacagccacaggtgccaagaaagctctaaataaagtaaaaattttaatcactcaagagaaacctaggtaagttacaagtgtaaaattaacattcatctacttatctggtatgaaagcatcatttttggagatgtacaaagactgatgtttttcttcatctcactttttctcatttctaattttgaatttattagaggaaaaaaatatttatttttgtcccctgccctaagaggagattcagcatttaacattgcctttgtttccactagctgtgctaaacttccccactgacttttatagattaaaatttttgaattctgatttttacttgtgaaaatcgcaatgatcctaaagttcaggcaattgaatgcattaaaaatttgggcacaaaagctggatactcattttaaatacattttcctgacttaggtgctgtgcattctcattcagcagtaaaatcggagtgtttttcttatgcaggtgaagatgtctcccatcctggttaagagccaaggctccgggggaagctttagctatgagactgagaaacttctttaatcttactcaaatttctctctcccagtctctaaaataaggctttaaagtatttcatagggttgttttaaagatcaatagatccaataatgtaagtaaagcatgtaatgtcattgatacatagtaatttatttagaagatgtcggctgttattaagaaattacaactgaataaaagtttattttaagtaatttgatgtattcaaaataggtttctttctttttcctatagcaataatctgtatattattgctttggcaggcttttttgtttgttttggcattcattttcagatagcctttatttttaatatgccaagattactctctctaggcttggtgagtaactacttgaaaaatatgtggtaaaaatataaattgctctacaaatacattttgcacttgtgtgtaagtatcacttctatatattaagccataggctggttaagttcactagttaatttatctctcaccctgtgccaaaatgacttaagattacttcttaagtatcttaagagaactttctattttttatgtattccctctcataaacaagaaattatttggcagtctgaatagttttataagttatgttttatatttcttaagttttctctcatatgaattatatgtatatcttgagtattggggaaatacattatttcttcaagtagaaccgctctgggtgctttcacatctattaattcctggactcttactacaattctggcagtagtaatattcccattttacaaataaggaaaactgagtcccacaccaatttaaataaagttactcaagctcacccaactaggacatggcagtcgggattttaatgcaataaaaattcctctttctagtcttgtgaactaactttattttaaatttcaaagccttttaataaaattatgtttgtaaaatgaaatgtaaaatgaaaatagtacataattgtatgtctattcctattg

SEQ ID NO: 63232 - DNA, 1069 bp, Homo sapiens
atcctcccaagtagctgggattacaggtgtatgccaccacgcccagctaatttttgtattttttagtagagacaagatttcaccatgttggtcaggccggtcttgaattcctgacctcagatgatctacctgcctctgcctcccaaagtgctgggattacaggcgtgagccaccgcgccaggccaggttaaccttttaagtatcacagcttctgattgtgatggaaatctctgaaaagtttgcattgtcttactgtttcaagtgcattgttgtgtggtgcagcccaggtgactgtttattgccaccttacgctgttcctatacagcatctccccagatacatttacgtggaataataatgtctttaaaagctttgggcttttgaggtgcagtgacacaggtatctgtttggactctttcaggctgttattcatctcttctcttctgttgcagtgtctgtagcttgccattctggcacttctagtagtctctgcttacactgctgaatcttctctctctctctttcccatctcctcttctctcgacatttcctttcaccctgccttgtgtgtctggtgtttccttttatggtcagcactaaccaatcgaaactctccatttaatcactacttattctagggattatgttaactattaatacttcacacgtatcatttcattgaatccccactacaatcgtatggggcaggtattgtatttccagtctacagagtaagaaactgaaaattacagagtaatctgtgaaggagctagatggaattcactctgggcctttgaagcctcagaacctgaactcttcacttatacttacagtgcatgtgctgcatctcctgctaaaatacgcacataggttagtaggaatcatgttggcagtaaaattaaaatgttggctgagccaagatttgtgctaagaatttcacacatgcttctgaaaaatcaaacatgttgtcttttcaaacacagaaagttttaatagctaattaatcagagaggtattaattttaagtaaggtttattatcctggattagtcaggttatagatgtcacta

SEQ ID NO: 63233 - DNA, 1020 bp, Homo sapiens
tactgaactttttatttgctctaattcatggtgaaatttttgcaaaaaggggcttatttagtaattttgtttattttaggcagtatttggcagtcgtattcagagataaacccctggagctatgggatgttaggacttgtacccttcttagagagatgtccaaaaacttccctacaataactgctttggtaagttacaatttaagaatttaatagcttatttaggtatatatgtatgtggtgaatgttttgcttaagcttgaatcaaaatcattactgccaatgtcatttttttggttaaaaatgtgtgttcagagaagatgatctaaataaatggagataattcttattttcttggataaatcaacctaatatcatattagtgcaattccaattcaagtttcatttggatattttgaggaatatggtaaacatattcaaaaatgtttatgaaagaataaaggtcctaaatagctaagtcatccttgaataaagaggagtaaatgtgggaggtgtgggtggggttggcccttcctacctgatattagtacatcttacaaaaccatggaaataaaatcagtattgtattggcacaagaatagaaagtgagtcaacctaataaagagctcaggaacagacccatgaatatttggggacttaatatacagtaaagtagcacaaatcaaagaggatggacagactgtgtagtagacggtgttgggaaaactgtctcactttatggagaaaaatacttgatctctacttaataccgtatagagaagtgagtgtcacaggactaaagacctaaatgtaaaaatgtaaagctataaaattgaatataacaaaatacaaaatattgctgtgacctagaggcaggaggagacatcagaagctcaaaccaaaaggcaaaaaaaaaaaagaaacaatgcatttaattaatcaagattaatgctttttgtttgatgaagatgtcaaagttaaatacagaagacattttgggaaaacaaattttccagtgtct

SEQ ID NO: 63234 - DNA, 1109 bp, Homo sapiens
atatcttaaaatgttgcttcatattatatacagaatttcatttctttaatatttttttttattaatggactttattataatattgatttttaaatccagtttttgttttgtttcttgactattaccagagtttttacggtattcagtgtgtgtgctagtccactaatggtcaattattcaaaccactagagttttcttactttttaccatggataccatttgaatttttatgttgtacaataaatgcaaaaataaaatttcttttaataaatagagaagtaattgagcagtaatattatttaatagctaacatgtattgactatttactgcatggcaggcattgctttaaggcctttgcctttataaatttattaatactagcaacaactcaagtttcatgaacttaccctactttatggacaataaatccaagacagaaaggttaagtaaacatgcctcaaatcacataccagtttcaagctgggattcaagcccaggcagtgtgactgcagagcccaggctgctgagccctccatgataccacctctgagcatctattagaactgcaagttcctttcttcctccaagttagattgactacagcagcatttcattcttatgttgtgcttctatatgtaacttctgagcaaagctttctgtgaatttaaactgcatatgcctttagtaaacagcatctcttcaccttcatgattccacaatgttccaaaacgtgtcagtgaagctctggatccttttttcaatagaaaaatcacggcacaattagttataaaagagctttaagtttcccttggaatggatttagttatccttttgcagtgagagataagtttgagttggctctctggaaaaccttccctttacttctctgtttttcttactttaatttcccccttttttttttgaggtatttgttcctcaaaagacatcccctctctttaaatctagttccagtaactacttaatgtctatgaagttgaaatctcctatttcttcatagttgaaattgataggcaatgtagctctttgttagtgtctaaagtctgttttaggatttgatgactaaaagcatactaaagcacagcccttt

SEQ ID NO: 63235 - DNA, 1102 bp, Homo sapiens
ttatcccagaggaacttcttcctaatgtgaatcaatggcccacattgaaaggtgtgctaatggcaaaccaggtaaataattgttcttaacacagaacagaaagatgctggagtctgaaggggtcctgtgcagtcaggcccccgtattgttgaaggcccagtagcagggcaggagaacttgctgcctccccctttcaccctgtcaggccccatgccagtatcccagtggatatgtgacaacactcccttccagtccctcagtctactctaggaagccatccaggccaggtgtgctgagtgcagtcaaaactttgcttcatccttgccaggctctatggtgatgaatcggagctgcacttctggactgtcgctgcccactacctgcacagcttatcccaggaaaagtcagccagcacaacagctcctaaagaagctgctcctcgagacaaactgagcaacccactggatatatgctatgacgtgctctgtgaaaatgcctactttcaggtagtctgcttcacacagcaaaacctttagagctgtcatcttgattacttatatctttgtcaatatcttaaacttgggaaactttcaaactaagttactgttcagtaatagaaataagcccttgaaaattagctgggtgtggtggcacgtgcctgtagtcccagctactcaggaggctgagggaggagaatcacttgaacccaggaggcggaggttgcagtgagctgagatcacgccactgcattccagcctgggcaacagagcaagactctgtctccaaaaaaaaaaaaagaaagaaaagaaagaagccctcggtacatttgcattaaaaaaaaagcctgatcaagatttgaaaagctcatagacagttactgcgttgtttactaaacattaaaattttattattaaacaggcttgtttaatttgtcttacatttttaacttggcttcattttaattctgtcattaatttcctataaataacaaatactttatacacttggtttgaatttgctgttcacatgataatttctttaacctcctgcagaatccttcagtgcacataggtttttcatccggctctacttaagtgtcagt

SEQ ID NO: 63236 - DNA, 1729 bp, Homo sapiens
gcttttcatagcttcagaacaggggtcggcaactgctttctgtaaagggccagggagtaaatattttcagctttgccggccctgtggtctctgttgcaacttcgccactgtagcctcaaagtagccacagacaatatgtaaatagatgtgttctagtctgtcttctagtaaaattttatggatcctgaaattggaattttatataattgtatataaattttattcattttaatcctataagatattcttcttcttttgattttttttttcaaccgcttaccaatgttaaagaccatctttagccctcaggccatacaaagtcgtctgtgggcacccaagtcggaggaagtgtcaccctggggtgatccagagggctttttgcagcaccagcactggatgccttggggagcaaaggacactttctgaatctcgaaccttcaaaactttgaaacttaaccgatattttcctgaagtttcctttaacagtgcattatggatttaacatacatgagtatgtctaagccttttttgaacctgtttacattttcaactcggagagcttctgagagtaatcagttacatctgttaaattacccactgaatgaagaagtattccccttcaattatccccgaaactacaatagtaaaatgtaattcagaaaataaatattcatagtctcaactacttaaagggggtctggggacccacaacatgttaccggttttcattttgctggggctcgcatttgaagcaagggctctagtgaggaggtggtgtagactcagcgggttatttaggtccgtgtgaagccgagttgcctgcccagcacctatagctcaactaggttttattgttctctacctgtcaatagttgatttatgatggattccaagagaaaagctaaggacagcctggggtacatcagacgtggtctcagggaggtcttcgtggaagtcaggtgggctgggtctctgttcaccttctaggggtctcctgtcctgtcccacgtccaatacccacatctcaagagtttgtgtttgaaataaaactcttctcttcccttctttcaggaatacttggacctcagtcagcctctcgaaccgtattcaccttgttatcctgacccaagatgaaataaaacgtctctcttcccttctttcaggaatacttggacctcagccaacctctcgaacagtattcacctagttaccctgacacaagaagttcttgttcttcaggagatgattctgttttttctccagaccccatgccttacgaaccatgccttcctcagtatccacacataaacggcagtgttaaaacatgaatgactgtgtctgcctgtccccaaacaggacagcactgggaacctagctacactgagcagggagaccatgcctcccagagcttgttgtctccacttgtatatatggatcagaggagtaaataattggaaaagtaatcagcatatgtgtaaagatttatacagttgaaaacttgtaatcttccccaggaggagaagaaggtttctggagcagtggactgccacaagccaccatgtaacccctctcacctgccgtgcgtactggctgtggaccagtaggactcaaggtggacgtgcgttctgccttccttgttaattttgtaataattggagaagatttatgtcagcacacacttacagagcacaaatgcagtatataggtgctggatgtatgtaaatatatt

SEQ ID NO: 63237 - DNA, 1063 bp, Homo sapiens
ctgtctcccaggttcaagtgattcttgtgcctcagcctcctgagtagctgggactacaggtgcacaccaccacgctcggctaatttttgtagttttagcagagatgggattttgccgtgttggccaggctggtctcgaactactgacctcaagtgatccgcccaccttgacctcccaaagtgctggtattacaggcatgagccaccgcacccggccacactgtatttcttatagtataccgcaactggtttttaacatcagctatattttctatctgcattttaagaaatgaacatatttcctttttgttctggcggtgttttgaaattagttatttctcttgcttctttcttgatttcagtgtattcatcgagatttagcagccagaaatgttttggtaacagaaaacaatgtgatgaaaatagcagactttggactcgccagagatatcaacaatatagactattacaaaaagaccaccaatgtaagtcgatggcagtaacacagtgggcaggggcgggggtgaggctcagaatgttccaggaagaaaggccgtcaatgttgagagctgggtgggatggctggggacccattcccctgccccgattcccgttcttttgacttactattcacaaactctcaatatgcaaatttagcctctattatgtcaattttagtaaatgtgaaacacttatatacagaataatcagcaaccgctaggattttcttatggttctcatcaagaactttcatagcaaaaactacagcttggaagttactggtttaatttttgcctaataactggtcaaggagcatctgtgtgctagggagataaaggatagaatccaaggagatggcattttattaacggcccagacctgtgcatctcacacattgttcatggtcctcattgggactgatttctgctctattgactgactagtaaaaaccgagaatatcagctcttaaacagggcatagccctattgagcctgctaagataaattcttttaaatatatttagtttttgcattttcctctacatttgcaggggcggcttccag

SEQ ID NO: 63238 - DNA, 1064 bp, Homo sapiens
ccgggatggagtactcctatgacattaaccgtgttcctgaggagcagatgaccttcaaggacttggtgtcatgcacctaccagctggccagaggcatggagtacttggcttcccaaaaagtgagtctttcacattctacttggctgggtggaatccaactaaaaatgtctttaaagaaaacaggcaatttggacatgctcatttgctagatcaagccctcgcatgtcttgtacaacctggaaaatatttattgcgttattcccatttgagtttaatgaactgtttaaaaccaaagcagcctcataaacctatagcatcgctgcagagatgagcagaaaagatacctcttctttgagacaggaccatgtgtgatttccctcggaattcagctctccaggtgggaaatggatggttttaaaggccccctttaattcggatgattttctttctttcttttttttttttcttaagcttcatttattttgtggttactgagtttttgaacatagactttaggtgtttagtgttttgggtttgatatggcattaaatattctaagagtaaaggtcaaacaaaggggtattttagtaaccttgcgtcctggagctctgcgtttattttgcctcgtttggcgggtgaccctctgtggttagaagttggccaggtcccctgaggtggactgcctgcattccaggcgtgccacttaccgtggaacttgaaacatttcagttattctgagagtagttagacaggtgcccagatgtcctcggaggcattttggatgacccaaaactcccttgtcagccccacacatagggaagcggaggggcggagctgcctcctgtgcagaggtgggccttgctcctacctgcattgcagtttattgcagtgccaggaattccttgggtccccaaagaggtgagatcctctggtcggcgtgcaccctctgtcactgggggtctgggttgcctgaagagtcacaaactcaagtctccatggggccatgccagtcacaccaccaaggcctgcggatcactcagagtgcagagattcgagggatggct

SEQ ID NO: 63239 - DNA, 1047 bp, Homo sapiens
ttccactttacatttccaaagacagaggaaatatggtagagccaatttcctaaaagttttcgtagaatttcataagcacagcattgatccatgatccgggtggtctgagaggggatccattatccagggctccagtacaggtgcaggtacaaccataaaggcactaatgaagccagagaggactgtctgcatgtcctcaagtgactctctggaggaattaggacagaaagaaaatttacattgtgatcagatggtatagaaaaatttcatagaaaaacctgaacataggaacataaaatttggatgaaatctggtactgcatggactggagggcagaggagttagattccagtggttttctaatttggtttctgacttctgccagcccccaacccattcctttctaagattcgatactctggctgggctctggctgacttccagccttctcagatggagccaggattacatctgtgtctttgcattttgtatccaggtttcggctgagtccagctcctccatgaactccaacaccccgctggtgaggataacaacacgcctctcttcaacggcagacacccccatgctggcaggggtctccgagtatgaacttccagaggacccaaaatgggagtttccaagagataagtgagtacttctcttggccatgtcccaggatggagactcagctataaatggggatattggattaacattttctttttatgacccttagccacaaaggtcttggtgtgatgatgtcagcaggagtaagattgtatttctaaataaccaactcctggaaaagaaaaaaatggatttaaaaaaaaaaataactccttgaaagcagagctacttgcccctggctggtccccaaagaagatggcatctggttatcattttttaagtgtctgggcaattcagactccgtcaaatggaataaaagtagaattatccaatttataaaacagatctgacattctagcttttggttactagaacaagactgttctctgttcacttctgtggagaaattagatgcagaat

SEQ ID NO: 63240 - DNA, 1039 bp, Homo sapiens
atccagggtggggcttatgcctagtctgtgacctcagtggggagcaggacggattccccaggagcacccacatttaccttctcgtcttttcccgcttgcttctgccatttgcttgtgcaacccagacacttgggtgtgaggatctcagctccacaattaatgattctttagttcccgcttttaaaacattttgaccatacaatgaataaatgttgctcatactatctgcataatgaagtttaggaataactgccccctgccaaaagattgaatggaaggctcaggaagtgctcatgtacgttttaaaagataataggaattctatgtgaaaaatggcccacttctttattttaatactgaaaacaacttcctaatcctaaaatgattttcttcccctaatctattcttgggcatcttcttgaatttccagcctgctttgagggaagtctgggtttacaaaggcgagattcaaagcttttcaaacaggacaggtcctctggttccctgtgagaagagcccaggacccaccctgtgaaagttcatcccacctaaatttgttcatctggactcagtctttgccagtgtgattgaaggcgtttgtaagcacatccaggagtactatccacctgggcagtcacgcaggagacagagcccagggtgggctagttgcctgcttggagatggatcgtggttaacttcacattcttgttctcttgggccaaagtcttgttcatggtttagaataagacagtgttcaagcagcctgtggtcagactaagattgcgtagtcatcctcaaaagtggccttccagtgtgctctgtgtgagtctttttttttccatagaaaccagccaaaggacagtgatatatttaagaaataatcattttatcagacacactgaaatggatcaggataaacaagaaagtaactcggtggagccctgtgtactgccaggtgggagaggagttctcttgtgtggttatgggaaaaggtgtattttctttccattgatgcttcatcccacgtgtttagtgcact

SEQ ID NO: 63241 - DNA, 1088 bp, Homo sapiens
ttcaccatgttggtcaggctggtctcgaactcctgacctcagaagatctgcccaccttggcttcccaaagtgctaggattacaggtgtgagccactctgcctggcccctgtcttgtttttaacagatgaggaaacccaggtctagaaaggttaagtgatttcccaaagctcacacagtgagtgagtgctcaaactgggacagggaccctgacaatctgaccgcacagtcccatgttattgcagttggtcaggatgcagcctgcctaatgcggggcctcatgttgtgaatgatgagcacaggaagggcagcaacgggattggctgttgcccacatcgaaggatgcagagatgccacaaaacctagcctggtagcagaaggaagggccgaaagcagtgatcttgtaagttttcactcattttagaagtcagcatatttcaagcatatgcccttcgttttcttttccgttgttcatgcctcagctcagatccttattattctaaaaaatatttttgttaaataaagtacttcttctagaacataaaagaattacatacacatggtcataaaatccaaatggtctagaaagttctgaaataaaatgtattttctaccccctctctcaactcctaatctctctgcccacaggtgatcactgctaagtctcttatatatccttccagaaacgtttaagtgcccttgttctcacacctcgctgtgggacagctgccttccccacatcctattctgtgagcctcgctgatgagagcggtgattttcagggaggaggcacagaagcccagccatgcctctgcctctgctgggtgttaacgtcatccaggactgcggtcccaagcaattgcttaatcggttcccactcctctattgattgcagcttcctatgcaccccatagtggaatcctggaaactggtatccagtgatgaggggctacgctgcaggccatgcagagagtgttctggctgtacaacctgccagaccctggccatttgcggaagtcgtcccattgctaggcctctttttttttttttttttttgagacggagtcttgctctgttgcccaggctggag

SEQ ID NO: 63242 - DNA, 1026 bp, Homo sapiens
gtggtcaaatgatggacccctggttattcattttcatttgggagtttttgggaagcccaccttgccttgagaatggtcgtcgccttttggttcctttggttgtgctatgatgcgtcagtctggtgtgctaactctatggcctgcttatctgttcctcctcctgtgatctgcaatctagcgcctggaagagaaaaggagattacagcttccccagactacctggagatagccatttactgcataggggtcttcttaatcgcctgtatggtggtaacagtcatcctgtgccgaatgaagaacacgaccaagaagccagacttcagcagccagccggctgtgcacaagctgaccaaacgtatccccctgcggagacaggtaacagaaagtagataaagagtttaaagaaatttactcctcccccatgacccagccagcttgtggatcttgtcctctgctttgatgccatcgacttctgtgagcttccatgtgcgagtgattctggtgtgatgcttggcggtcacccagttagtgtttggagcttggagagtctagtcatggtgcgttgcttggatcaatggggtccagttccaagggcaagaaaggacaatactgtcagaatcagaaaactaatcagcaggactggaaataactggaggcaaatccccctgtgtgtgtttgatcagactcaagtacagcggtctcttcgaagctttagccacattcgtgtcctgtgatctaataccttttttaagataagcatgaacattcgcttgggacttatgccactagtacgaaagagactctaagttctctgacttattttttaaagtcaagatcagtatcttatgccctgggggtgcatctgaactgtttgatttaaactgttgcacaataactttctacacagaattttggcttaacctctttgcaatttacaatagaattgtatgcatctattatgtctcattgttagtagttcacaggtgtggctgtggatttattagtagaatatttgtatggaaccag

SEQ ID NO: 63243 - DNA, 1048 bp, Homo sapiens
gtttttattgctttcatcccactttgtatttttaacgagatgtaaatagagggatgtgtatggaggagcctggggagcggcacctctgaatgtcagatgcacagaagcagtgtgttgcctaccttggggatcggtggcttgctgcatgttgcgataggatggactttcggtttgctttcattgcaaagcatgctcctgccatcttgggcttgatgttatttctgcctcacagagaaataaacatcattgcagccctgttgcctaaacattgctgctgtctgaatctttaaccgacatctctattctagtgaaactttcttgaaattaaacactgtcctctctgatgcatctgcctctttgtcatttcctttgtgaaactgcagagactgtggtttgctagcttatgatgttccactccagttattaattccttgtttttagagtacagtgcttacctgcatgcttattttacatctagtaaaaataaaatagatcgtttcatttttgtgctgttgctgctgagagttttgactatcttgcaagtatttttctgattaaaatgtataagctttcaataataccattgcatccgtttttccttttgttgcgaatctgctctgtgaatatttgctttgaaacaaagagatgtctcttatgttgaagcttgcttttatttgcagtactgcattctgtggtgcctaactggcacttcttaaccagtttgcctgacagtgctagcacttaactaagaatgcagtttgagaaaaacactatttggaaatacactgcttgtagatggatcatcgaggactaagaagaagtcagacattggaagttgatataaaaatgtgctaaattaagtaattatatgtatactcacacataatacctttatgttttttctttaagagaaaagctgtagtgacataacaatataaccggatatgtataaacttaaaaggttattaaagaatattataatctttatgtattatggatctaatggttctatattataagcaattcaatctgtgtatttaatgcattg

SEQ ID NO: 63244 - DNA, 1047 bp, Homo sapiens
ccaatgaagtgttctcaccagctaataattccaaggatcaaaggcattgggaaaagatgaccaacctggggacccacccgacctatccagttagctatcgctcacaccctcctgcccttctctccaccaggtctttccgttgtccaccactggactgattttgttctttaaaatccgcagccctttaatgccgctgtttagacgtaatggagtttgttttcttgcggtgtgttggtggtgggaccatagacaatgctaagaccttcctggttggccgttatattgttctcctgtgtctgttctagcactcggggataaatagttccaatgcagaagtgctggctctgttcaatgtgaccgaggcggatgctggggaatatatatgtaaggtctccaattatatagggcaggccaaccagtctgcctggctcactgtcctgccaaaacagcaaggtaacaatgctttcatttttgtctttttttaaaaagaaagctggatatagaagctgaaaagacttggtgctttgggagactgcaggcagcttataggataactcttgtggccttggtatatttataataatctttcttcggtgatgcagctggtatgatgccagtagccatggaaaaatgcccacaacgttcaaagtgcttgctccaatttcttctagagattagcctccacccccacccagtttttaagttgttccttctggttgatcttgtttaggctgcacatttcccatcattactgcacattaacaccatttaaaacacacgcttccatgcctgtttaatacggggcatttgagtatcagcagagtttgtctccttctacttcaagtttttagggaaatattggcaagatgcaatttgttcaacaaagcatcatttctttggttgcatggttgatccttatgagttgctgttcttgaccttgttgcaccaaatttgaggggagctcatcttaatgaatgtactactggacgctactaaaggcaaaaggttgactttttaggtttgtcatgactcacatccaaatgttta

SEQ ID NO: 63245 - DNA, 1095 bp, Homo sapiens
tttacaagggtcgcgctccggcagtctcctttgaagtcgtttctgttattcatggggccacagtgttatttcaaaggtgtcagccagcaggcttgaggcttttctggcatgaggtcactgacagccctctggacaacacagcttatttattggtctctcattctcccatccccactcctcctttcttccctctctccaccagagcgatcgcctcaccggcccatcctccaagccggactgccggcaaatgcctccacagtggtcggaggagacgtagagtttgtctgcaaggtttacagtgatgcccagccccacatccagtggatcaagcacgtggaaaagaacggcagtaaatacgggcccgacgggctgccctacctcaaggttctcaaggtgaggactttctgaatctaaaggtacccacaactggggtctccttcatgggtttggccacaggttctttgatttcctgttggagttgagagaggatgattctcttttttgactagccagcagagagtgttctaaggaattaacagatcattacacttgctagtagaatttcagaagggaactatggagtaggggaagaactactaaacttggggaagaactactaaacttggagagagaatagttcagctatttatcagccctgagatcgcagacatttaggcttagctgcgcctctataaaagtagagatcgtgatactctgtcccccatagggcggttgtgcagaataaatgggatggagtggatggaaagagctttgtaggctcaaggcattgtgccagtgttgattgttactctgatgttgttttctattaataggacattaggatccaattttagtagccacgttttagaaacaatttggattttttttttaacaaaaacaaaacaaaacaaaaccctgacctttgaaatccattcagaggtgatttagacaataaactctaggtcatatttctgcaccagtgaaatgttgaacaaggaaaatatctttccctccttatttcttatttgcaagcccccattttcatagcatctgcctcttttttagatctaggtttgctcttcaggagactgagga

SEQ ID NO: 63246 - DNA, 1989 bp, Homo sapiens
atctccagacagagccgtgcaccctgagcccatcctgatgaaaggaggggtcagtcctgtcctttcctccaggatagagatttcaaaacttcctttggtagctactgtttaatgagcttttgattgctacaaagcagcttttcattcctgtttcacaacagggatcccggggggcaaaggctggttagtggcagctagatcactccaaacgtactgactggcaaatacagactctcccgcagaactgaccccagcaagaagcctttgggagcaggtggtattctgcgggtgccagctccctggggtgggagcaggcacacgccagcctggatggggcatggtagaactctgcgatgtcagcttttttgtcacattctctgcaggctacccgttgtcctttgccccaccattgaggaaggaagccttattgattgctttcgattcttgcagggggcctgggtgaggtggctggagagagggctaatatttggtctggcatttaatcttggcatttcatttatggtgtgggcaaagaggatgtagaagtgttaaaatcaagttaatatcttacagttttatgtaagaagaggttacctggagattcaggtgaggatggggcagagagaaagctgcttctgtcagagcttgggcaaataaacttgccatgaaatgtcaatttagtgatggcagtaagagtgtgcagtaatgtgctggaacttagcgaggtttctatcagcgtgtgctgaattgaaataatcaaaaaacagtttaataagttgcttatatttggagttttgtggttcttaacattgcaaattctgaagcaagaaattagagtttctctctaaactcatttactcatgtggctttatcaacggctgcctttgtaaaccgaaagacctcagttgggaagttttatgagacggagtcttgttctgttgcacaggctggagggcagtggcatgatcttggcccactgcaacctccgtctcctgggttcaagtgattctcctgcctcagcctcctggtagctgggattataggcggacatcatcatgcctggctaatttttgtatttttagtagagatggagtttcactatgttgcccaggctagccttgaactcctgacctcagatgatctgcccgcgcaggcctcccgaagtgctgggattacaggcatgagccaccgcacctggcctgccaactcttgttaagatgtgagtgtggaatgctgtgtgttcttccccttttaaaagatgtgtctgttggtttgctttcacggattccctctcccttaggagacccggctgttgtattcatggtcttcatgcttggtttgttttcacagtcagagaaggtaggatgctgtagggttctacctacaggtaggatgtgctccttacttagagatttggaagggtggcatcagagaaccactgtgcgtctttcatgatagctggtcaaatgtgggtgtctgtgggaaatagatggccaagggtgtcggtgttgctgtggggaggttgttctgtttcctcttctgagaagagacagatgaggcgatgaggcaatgggagcctcattgctttggcttggagggagaaaatagagcagagctctctagctgggattttgtgtatttgctgagttgcagtggttaattctctatccttgaagcacgtggcacgctcacgcagcctttatgtggtcgagagggtgacagtcacttgaatgaggtataaggctttgccctcatggagttcctcaggtcacattttgaggtcgaagaccataaattgggatggaaatttctagatcttgatggaactccaactttttctctctttctcaaagcctctggattacaggattctctcaaacaaggctggcaggaattctgtccatcccaaataagtatgcaaatctacaggtcaaatggtgccccagacatattccccactggatcagggagattgtggtcttttgagag

SEQ ID NO: 63247 - DNA, 1220 bp, Homo sapiens
ggaggctacaaggtagaattaagctttcagaacatcacatttcttacatttttgtttatttatttatttacattttttttttgcgatggagtctcgctctgtcgcccaggctggagtgccgtggtgcgatctcggttcactgcaacctccatctcccaggttcaagcgattctcctgcctcagcctcccgagtagctgggactacaggtgtgtgccaccatgcctcgctaattttttgtatctgtagcagagacggggtttcaccgtgttgtccaggatggtcttgatctcctgacctcgtgatccgcctgcctcggcctcccaaagtgttgggattacaggtgtgagccacgatgcccagccctacatttttgtttattttttgaagtgctcaaaagttagcaggaattagaaggaatactttaacaagaatcaataattgtcacaattgcccatgtcagggtttgatattaaaaaaaaatattaccccggacttgcgtgtaattttaaagtacaattcccgtttgtgttgttcttcatatgaggagagtttaataacagaagggtcgaaagttgagagtctgttttctatatgctttatagtgtataaaactaaaacgggtgtggagtttgagaagcgtcagtatagtttccctgtcagagcaggattgcatgaatagtgaggggacttggattagagactggagtatgaaatatgatgcattaagggagagtgcgtggagatgacagtggcaatctgctgtcctccttgaaggattcttgagagcacgtcacacaatgccatgaaattttagtctcatcactccctagggagtttgaaattggcagctgtctccctgcagatgcccgcgcatgctcctctagcctttgttcatccacttagcagacattgattgagcaccctgtgtgccaggcacactcctgggctctggggagatgagagggtgaggcatggccccagctccaaggggctcttagtccagtccagcaggagaggcagaggagaactctggcaatgggagggacacaggtttggttgaagttgcaggagcatgttgcatcccatggatgtacatggaaaggtgatattggattggcgtttggaagaataaggagaaaggaggtcaggaaaggattcaggtctgagttggaaggaaagatgtctcagaaagagagagatggaatttccaaattattta

SEQ ID NO: 63248 - DNA, 1020 bp, Homo sapiens
gacatcagattctgtcagcttggtttttggatgcctggggaactgcgttgtcctggttgtcggctacctgcctaatagcaggttaccgtgaaaccatgtgaagcaatagaatgcaacagcaaggtatggattacatgacaggcaggctgagtggttcagaaggattatatgctgtggaccttatgctttgcattgtgaacagtgttcctaactgcccagcgcccatgcagaagggccagggggtagagcacccatgtgatgaatgccaaccaacagtgtacttgccatgccttcaccttgcaagcagggttcttttgtaattagctctcgaatgacagcaactctgcccctgaaatgggtgctctgcagtgattaagggctagtgttagctgtaccagggagatactgctgtgaggaggtgcctctgtttggtgtctgtgaaacattagatgctatttaaagtgatagcggttcttagctggctacttggcctctgccatctgttagtgtgattaggctggtctgattcacaggtgcagcctggggcggctgagattaagcagctgtggtctgtgtggacagaggaatgccacggccggggtaattggcaaggcaggaaaggggacgttgccattaaaacaattttttgccacctcaagtgtcaaatgcctgacccgattaatagggaaaattgcagaagcaccaaattctttgtattttcagccacctggaaaacactcatgtgtccagattgatttctttggtgccttctgattgtctgaaaatgccactggggtgtgtttgtatgttcttctttaggaactttgacaaatgatgctccagtgaccctgtgttgatggtgacgtttttgggcttttttgagttttttttttttttttttttttctccttttggattgagacattgaaaatttagttctgtatcttccagttggaaaaatatattgcaggttattccctctgctgatttgctagattattgatctaattttgttggtta

SEQ ID NO: 63249 - DNA, 1255 bp, Homo sapiens
ggtcattcgtttttcaaagcagttactacttttctttccttgattttcccttttccctttgacttctccctattcagagacataagaatagtagaaccatgtaacatcttggttttccttgtaatcagtgattgtgcttggtttaatccagtggtgtgtgactggggcaattgcctattcttgctctcccggcacattgggcaatatttggttgtcacaacagagggagggggtgctggtggcctttagctggggaggggccagggatgcagagcacagccccataacaaagaattatctggtccaagatgtcaatcatccctagggtgagaaacccggcctcctacaacacacacctcatgctgagtgaaaatgaaggacgtgtgccttactttgtagaccacgattgaaaagggagccaagggtggcttgcttaatgagggccatgaacactgagcgctaacatgggagaggccatttacttgcgaggaagaacatggcgtagcctcttggagctgggcaacctgggtttgaatcttgctccacaacttctgagttgctcatttcacttctgtgccttagtttctttataaaatgggagtaataataataatactattttctggggttgttatgaggattacatgagttcctagttgtatagtgctcagaagagtggttgcttgcaaatgtttattcaatacacaaaatacaatatagcattacttgcattttccaatgacttggctagaatgttcctaaagtgtttgtacatagggtattgggattctctgcttacatggtatattctacatttttcttaaaaggattttagtcaatttggtacatttaaacaaggcctaagtaatataccacacccggctaatttatgtatatatatatattttttcccgagatgcagtcttgttctgtcacccaggctggagtgcagtggcgccatcttggctcactgcaacctgcacctcccaggttcaagcaattctcctgcctcagcctcccgagtaactaggactacaggggcctgccactacacctggctaatttttgtatttttagtagagatggggtttcaccatgttggctaggctggtctcgaactcttgaccttgtgattcacctgcctcggcctcccaaagtgctgagactacaggcgtcagccaccgtgcccagcctaatttatgtatttttagtagagacagggttttaccatgttggccaggctggtcttgaactc

SEQ ID NO: 63250 - DNA, 1028 bp, Homo sapiens
tgtgtgtgtggcgcacagtcacgtttcacgtacaaatgtgtaaaactcggcattcttacaaataaaacataccacaataacagatttttgcaggtattacagtgcaagcacgctttggcaatcaatttaaacattttcttgtggaatattcttccatgctatggtttggtttgtttctaaagccccataggatgtggaaactaagtcaggacagattttctgggggtatcctctggttgctcttccagatacttcctgacttcctggggcttggggagaggtggatgcctgctggggccatttgcagagcaagaacagcttctcctgggaataagcaggcctccactgacctttgttggacgttctctcctctccctccttcccatctgtctccgtcttctctctcccacctttctgcagagccaccaaccaaataccaaatctctcaaccagaagtgtacgtggctgcgccaggggagtcgctagaggtgcgctgcctgttgaaagatgccgccgtgatcagttggactaaggatggggtgcacttggggcccaacaataggacagtgcttattggggagtacttgcagataaagggcgccacgcctagagactccggcctctatgcttgtactgccagtaggactgtagacagtgaaacttggtacttcatggtgaatgtcacaggtgagttggcccgccagcactatgctctctcttctctgtagccattacatttttttggccaagtgaaaaggtagtgagatctctaattgtaattggatgccaggcatacagcttcatagtttttgaaattcttctttgggacctggtgcaccagaaaggccgatcattaagaatgatagaattcttgtgcacaaagtaacatttttcttaagatagtacgcttttatttaagtaaatacatgcttttttttttttttttttgtaccactgacatctctggcatttagaatatagggttgaaatttggatactcaagatttctgattcatttattagagttt

SEQ ID NO: 63251 - DNA, 1051 bp, Homo sapiens
ttgaacctgggaggcggaggttgcggtgagccgagatcgtgccactggattccagcctgggtgacagagcaagactctgtctcaaaaaaaaaaaaaagaaaagaaaagaaaagaaaagaaaaagaaacccagatgttctgtgattatcctctgaaaatcgtggtgcttaaaaaatcacggcaagcatcttccgccttgaagagtaacagtaatagtgacagtcattagcccgacatgttgtagttgatgatcaggttcatcttcgttggctcattggaatcttaccaataataaaccagtatttgggtactcttaccctgcaacagatggggaacaccaggccaaaaggttaagcaggaatggagaggcgtgggaactcagggcttcatcctcttctcgtccagggcagcacccttcaccaggcatctcccatgtccagctccaaataagacacaggtcctcgctgtcccctgtacttccttctagaacagcacgtggtagtccagcagctcagatacccccagtttcagcaagattttggggtttactgattttaggtgaaggaaaggattctcaatgaaaacactttcatttaaaaacaggaaatcatacatcataactcctcctttgccgggagagagatttttttctgcatcacaattgcaaatgccttgcttatcttttttttttctttttttccccctaatggagtcttagagcattcctctgcgtgacatagggacatggttgcaccttatctgagggtcaggatggagcagattggtgtgtgggtcccaggtgccttccctgtgagggagggaagctttgctgcttctgctcagcggctgccctggtgatcaattctggctaagaggaaagtacattccataacatttctggtgacttgctgatcatgtgatgttgtcataatagacattgatcattttatgacccagactgatccaatgtaaattcattctaacatggtgggtgctgtttcagcaatgagttgttggagacctgggactcaaaggacatctggtccttgcct

SEQ ID NO: 63252 - DNA, 1036 bp, Homo sapiens
ctggtacttcccaagtatttgaaacttctgggagaaaattcacgtggatgcaactgagctttatgcagcagggctgcagtagtgtggccacggcagtagaaacgagtgttgagctgtgtcccaggaaggagacttggtgccttgtttgtttaccagttttaggaaacagtgacaaagattggccaatactactgtgaagcttgcttgcttcttttcgacttttaattcatattgtgaaaaatacatggaaacatattctctgtctgtggaagcctctgaaagagcatttgtgcatagcaaggcggcttctggaaccttctccccattgcgttttggcaggagatgagggagatgttgggctgtgcacccctggtggattcgcacaggaaaggtgaaaagtatgccacagcaatgggaaaaagtaaatccaggaagtgctcacatgactataaaaggagttatgtacatttcctggggaattctttgctctttcacagagcaggctgtgcagcctggtggagtcagggagaggttgtccatccatggggggtgaccagagttagggaggcccctttgcacatgcaggcacaggggattctctgattgtcctggctccgcgcagcctggggccaggtcagtacaactgtggggatgaacatggagggctcagggagtgcatgtttgcagggagtgggcagcgggtcaggtcacctgcagcattcaaacccagaagagaagctaagccctgtggacggcaaatggacccaaggacacgggcagggacagagctgcttccactgagccagctgttaggtgcttgtgttcttggccccctggccggggttgtctttgatatgtgtcgtgtgtgctgggccctgcaggctgggcttggggggccactgggtggcctgggaggctaccagtgtggcatttggcccctccccagcgtatggccccaccccatccctgcctctcttcttacttacatcctcctctttttattctccccaacctctttctctcttgtgtgtttatt

SEQ ID NO: 63253 - DNA, 1050 bp, Homo sapiens
attcccattcagctgattgctgccggctccccaggccacaactctgtgccttcaggcgtctgcacgggtttcgagatgctggccaggcctgaacttggtgagcctcaagcagaccgttcaaacccattcaaatgaggaagaccatctgtttcccagtctccagctgctgctgcttcatttgcaaatggctgggatgctgctgaggggatcaggcggggacacatctgcagactctgaaggagtgttggaaccgagatcctgctgagagaagaaaggccgagccctttaaatcaacttgccaaacagtacccccagaaggtcctgagttgagaaagcaggaggcagccttgccctcctggaataactcttaaccttcccttttcttttgtagccttggccactttaaaagtatttctttattcagaaagtgcgcagtgtgggagggcctgctctatgggcttgggggaaaatgtcaaacgggatctggacatctatctgacctttcagggccatacagggcaaacgtatccgctggagtatgcaccatttattgaatgtttacatcaatatcagggaggtgagcttgtcccagcagcagcttctaggagccacaggtaacagtaagtgtggcaaggtgactgtccctgaaaacctgcttctggaatgagtcaggctttagggtatgctctctggaatgcaggccagccgccccaactcgcagtaacgcaggcccttagctctgtggactgcgtgaggcacagctgtggggactcttgcccatggtttggtgtttgcagggttattctcggcatgctgtggggctagggtaagttatccggctcctgagccctgctggggttctcatctcaagggaattctgtggtgtgttactgtgccccacatgcaaatatcagctactctcaaatgtgttggatggatgaatagtagaaggtattttaagaagccacaggcctctttgtaaattaaacaggcatcatacatgggtgttgataatgatgaatctcacaaaatcttcagatgtttagtctc

SEQ ID NO: 63254 - DNA, 1058 bp, Homo sapiens
ctataaaatgaatgtcaagatcattgcaatggttaagtttaggttttaaactctttgaacacccttaaagttcagattttcagttgacagtgggattgcccccaaagatgtgtggctgccttaaggagccttcttgtcctgctaagcctcctggatttccaccaatgcatgttgcatttctacctggctgcaatagacgcacaactgaatatatatcgtggacatttataaatgtttcaaatttaaaaccactcaaatttttaaaagaacaagaatcttctgtgcatttaatctaaattctgtatcagccattcttaaaaatagaattgaataaaatcattttggatggcatgtggtatgctttctggagacataaactaacagagggaacttgaccttgggaggtaggtttgaatctctctactatctactgatgctgtgatttcagaaaagttagataacctctctgagcctcagagatagtatctatcttgaagggtgaatgtgcagattaaatgcaaatgaaatgtaaagcccctactgaatttcctggcccagagtaggtgttcattaaatgctgatttcttccctgtcccacttcctgtcaacatttcctggaccaacaagatgtttactctacaatattaccaatatttcctggaccaataagatgtttactctacagtgtatagtgataattgtctgatgagaagcatttacattaattaaaatgtaaaactggctctaggccctggatttgtccaaccctttttattatcttgggcttttgcaagtcccatggattttagaaatgggatcatcctgctgcttgcagtccaaatggttcaaggttgaaattttttttcccctctgttgaaaaaagtcagttgcagctctgtaataataacagcagacacatacttcatgaggaacaatgtattttggcaaaagagttttctgtttgaagcttcaaaatacaaaatactctgccacattgccattaggcccggcgaagaacattggagaggggttatggaatcggttggggtggggtgcgg

SEQ ID NO: 63255 - DNA, 1379 bp, Homo sapiens
cgcacatttgagaggctgaaaaatggttttatcccacttgggctggagtgatttggcattggggaagattccctgactcgccaatctctttcctttagtgactgcagcagcagcggcagcgcctcggttcctgagcccaccgcaggctgaaggcattgcgcgtagtccatgcccgtagaggaagtgtgcagatgggattaacgtccacatggagatatggaagaggaccggggattggtaccgtaaccatggtcagctggggtcgtttcatctgcctggtcgtggtcaccatggcaaccttgtccctggcccggccctccttcagtttagttgaggataccacattagagccagaaggtaagtcatttaatttcacttttcaggtttgttttgggatttgtctgggggcagattgttaaggcctgttttagaatcagctacccttgcattgtaaatggggcttctaagagcaccagatcgtggtctcttggctcccggcaaggcagagctgatgagagaaggtcctttgccgcagcactgcaggcaggatggtatagtttggtggtttcttgctgtgtgtgtttctctgtgctgggtgagggagacagctgggagttggcctttatccagtgcccgagagagctgtggaagggatgaaccttgggaggatgaatgtcatctctagtctcccccagcatcattcctactgcttacaatgtaaagaattgctattttcggacaagatgaaccactaaaagaaattgccaacatctgaaatgctgacatcttattttcattgtttaaggagaaaagaagtttctgaagtttagcacagagagagaggcttgacatctcagaatttttttttagccattgtaattcataatacttaagcaatgcatcatcacagagtggcagattctagtttaggtaaacttgaaagtgaatgtgccaggggatctcctccagctccgagaacctccaagtatcacagggcatgcgccggtgtcacagctttggaaatttaattttcaaggtgtaagtccaattacgaggactacatgaggctgaattattcagcttagcagatttggaacctctctcccagccctttggagacaacgtgagccaagcctctacttggtgctgcactgaaatctgtcatcagtagggaatattggtagctgagttatttttcgagtggtaatccgagaataaaacggcagatcccagcactcatcgccacttaatgaacctgtttgtggagagtccacctggtgcctgcctggctttaggaacccgcagcagtccgagtggtgtctggggtaagctgagctgctctgggaacacatctcgtgcgtggggtgaatgaacagcac

SEQ ID NO: 63256 - DNA, 1093 bp, Homo sapiens
tacgctcaaattctcctgtttgtattttgtaaaatgaagaagtgaatctaagtaacttaatcacagttgtgcattttttttggttctgttagagaaattaaaacagactgtttcctcaggcccattttaaactgaacttatgctaggaaaccttaagtatggggaaggtagaaagttcatttcatcacttagaaaatatgtcttctcaagaacaaaactgtgctgttacaactcagtgttcaatgtgaaattgctgccaaatgttatgtagtttaatagagaacttgaaaaaataaaacattaaaatggagcttgtgttagcatcaggtatccatttgttcaggacagtcctgttcatgtctgttgtcttggcatagttttttcccctagaatatagtactcccttttactctaaaaaatatcccagtttggacaataaaatacataattactctagttatattatttgctttacttctaaaaatgtaagaaattgaatttttttaaagaaaaatgttggttcctgccttgatctaagtctcatccaaaggaaataaatagtcactagttttttatcttacaactcaggacatttgtctttggttattaatggaaattagtatgtgattactttcatagttatgccacaaatcacattgaagaaggaatcattccgacctctgttccaggacaagagctagaacaatccatttcttgtcctttgatttgagagtcacagtcagggtggcttctgccacccttagtaactcagagcagaggccagccccctccttccctcactttcttttgctgagtcctttgcccacctgtcaaggtggcaggcactgtgctgggtacaggaggacagtcagacatgtcccttcttagctatagtcgagctgtctgggaaacaggatgaaaaacaggagggttattttcttgtgccctctttgtcagctgatcccctcttctgctaccagctatttggccagcaagccgtttttagtccccactttgcccatttttctgttttggttcatcgtttcttaaaagccatgttataaaacatggtagtttgaatcctgttgctaat

SEQ ID NO: 63257 - DNA, 1336 bp, Homo sapiens
ggggggggtcatttaattgtaagttgcacagataatttcatcagcacagataatttctttgttgagcgaacagcagagaagtttaaatacaggaatctgagccttgatgtcaggaactttgagttctaattttacatttagatcgaagttcccttagtaaagaacacagtttctgtctcttccagagtaagttgtgaagtgtgatgattgcttaagaaagaatgtaatgaacgtgctctgtaaagctctgtaataatactagagctgtttgaacttcttcattggcatttttctcacctgccatctgtactgaccttataaatccagagcaaatgattgcttgtatgagagctttgatcttcattttaaagtaatgacatataatttctcaaaccctcaaattaaaccaaaaaatttttttctaggttaatgacattgcttaattttctgaccttgacctgtgcaaactttgaagttagagagtattggggaggaggggggattagataccatgatatactaactgaatgtaaataagtatatttcaactcgcttaccaaatttgcataatcatttaaaataatgcgtgtttttaaaagttcatgcagtccagtgattgtaaattgaactgtattttaatgtctctttttaaaaaacatcctgttcaagaatccattattgcgtatccattgataaaccaaaggctctcttgcaacgaagctgatcaaccactgtgttatattgtcatttttaaaattagggttttggaatatgttttcttaaaacatttaaactgcattcaagatgacaagaaaaagtggaagtaccatttagttcattttcacgttttgaatttgctggtgttactagagtttgcttttggagcatagtcttgactttgtagaaactacagccatttcataactatgtacttgaaaatatttttgaaaacaaataatgctttaaaattgtgatttttcaagaagaagggagtatgcagagtggaaaaagctgtgctttatagtactgttttgtttctagtcacaatactttgtttttcaaaatacactcaaggaataattggtattttaaaaaaatatttcacagaaatgtttgaattaaaaggactgtgcaatactgctgtatataggaccttctgattctgtagttttctgttactgttatataataggttcaagactttaaaaaaaaagtccctggatgtaagaagagttcgtaaaggtttgttttaaatgcccaaaagctggaatttacttaaagtctcaacctttagggacttgtgaataaatcatgtaagctgagcattgtgaagaca

SEQ ID NO: 63258 - DNA, 2713 bp, Homo sapiens
tggtaaactgtatgcccttaggcaatttaataatctcccttgtctcagatttctcacttttaaaatggaggtaataataggacctactagctgtaatgaggattaaaatgagataaacatgctaagaacagccccctattactgttttttggtggtcactagccaaattagaatgctgcatcctatatatgccacaggcttttgtctgcatttacttttatttactgtgatccctctctgcaaaatcgtgcagttttgtttacctccctgtagtctaagtaccactcacagttcaaagtagccctcctccacacagcccttgtagtcctcacggcatttagccgtggctttgtaagacaggcacaggtgctgatgctctcaggatgggttgcattaagttgacatgcttgtcttccccttaaagttccttgatattctcagttgtgcttaattgaactttgaggtctcacagaaccccaccacagaggagatgcctgatccatatttcttaagagtataaacatttttctagctaccacccgttgtctaagtttgggaaaaaagaaggaaagatcaatggaaagtctggaggagaagagaggagtagatggagcaaaaccaaatgaaagataagggggtggggaaagggacgcagtaacttcttcagttctaagatgtgcatttgtttcacaaatcaggttttttgtgtaaaaaaattggcccatgtaatgtattttgttacctccttgaaaagctgttatgaaatcaagagtgactctttcttacacatgatgataccttagaacctgatgacgagtgaccatagggacccagctgactcatatgccaggtaccctggcattagcccctgtttttctagatgtttaggtttcctagaataaccagagttttatagttcccacacctgaaattattagccagcgtctgatcgtttcattctgagtaaagttacacctcattgatcagatatgttgcttaaaaacaaacattaaatttgtcaatcaattttggagtcaggctcagagccaaaggcaatagtattataagagaaagcatatacttatctactctcctctcttccctcaaaagaaatttcccctctagcttttttagggtcagtcagtctagtccctatgatgaaaactgctgaacatcttactaaaagatttcatattcacatataaaactgtttctgtataagttgcattccaattatattatgatcctaaatttcttatcccccaacttacgatagcttcaccttctttttttccttattggtcagttttaaaggttgcatttcttcttacataatacttagagactaaacaaattctccttttataaagttgagaaggtgactgaataatttccatccattgaatagacattcaagtaaacattcatgttaatagattttaaaattattttccagaataaatactaacaaacatggcaaaaaagatttaaagtctcataatgaccatttttgtcaagaacatactgtatcctggtgagcgatgaatatattgtatgttcttttcctgtaactagtaggttacatttcttatggcagtagctttagctcttaacattgtttagaattcatttagaaagaagtaaatttctttgagaataagtgctttgaagaaattgaagatctttttttcatatgctgaatctgtggaactttcaagagaataccacacagttttatcagtattgaatatcacagtccagacactatttgaaatcagacttatatcctgtggttttaggaaattaaaatgcagttacatgctggaatgtattcagcctgctgtgaaacatggtcatttgaggtttaaatggcaatctgtgagaaacggttctcttctctggggccagttttacttttacatgacccaaactttgactcagaaaatagagcttaatatgggcaataattgttgttcgtcagcatggtgcttttttcactaaatcttgtttctctttccagttgttgagtagttaaattactctgcaaaggcacagttgatcactataggcttcagttaaaccaactgtggcttcaaggtgtgtcactggccagtgttaaggaaaatcacgttttccccctatccttttgtatatactactttgcggtactgtggggggagggattgacaagctgcaataacttggaaaattctaaagaaatccttttgttcttaaataagtactttgtttttcaatgcaggacttctgcctacttcaaagaaaggggttcaaaagtttctcaaatgatttttaagtaaaagtctgttagattttttaaattagtaactgaatatgtatagatttcaaaagttctatacacatatatatatacacatatctgtgtgtatttttttaaaacctaaacgagaatattctgcatccttacgttgtcatttttacttaatactttgtgttacttcttacttttgataaggtagaaacttgcttttggtaaaaaacaatttgaccattaatttggtcataagaaaacaaatgctgctaccctgtgatgcccagtgtctaataaagattttttttttttttgaggccaggctggtatgatcttggctcactgcagcctctgcctccagggctcaaacgatcctcccgcctcagtctcttaagtagctgggactacaggtgcacatcacca

SEQ ID NO: 63259 - DNA, 1029 bp, Homo sapiens
gaaactatgtccaaatccttaagtaattacattcttcatacaaacatttctcattttcttatactagctgaagaggcagggtagctttcaaccccctgtgttttcgtttgtgtgatggtgactttgaattgagctttaagcactttggtcatttaactctcgaccagcttagtttagaaagcataacatttcaaagtggtttatttcataaatctcaattctttgacggcttgtgagaatatctgaaacactgaaatgagcctgtacttagaagaaaaataatgttttaacctagtctaaaaacgtgatttcagatgatgagcagaagttaaaatgtatgcatttatggtcttcgagtgagataaactgagtatttaaagagttaaaaagtgaaatatcattgtatgagcaggtgttaccttcttagagcactgtgaaaatttagaaacttgggacagttgtacactgtcatattttttatgttttatgcatacttcatctttatccagctttatcactcccagtaggttgtgaattatcgagaggcatgcatttgttcatctttttgttccagcctttagtgcctgttacatagtgaggatttatgtaatgttcattgactaaatattctttttttaaaaaatttttatttttattttttttgagacagagactcactccattgcccaggctggagtgcagaggtgcgatcttggctcactgtaacctctgcttccggggctcaagcgattgttgtgcctcagcctccagaggagctgggattataggcacgtatcaccatgcccggctaacttttatatttttagtagagatggggtttcgccatgttggccaggctggtctcaaactcttggcctcaagtgatctgcctgcctcggcctcccacggtactgggattacaggcatgaactaccgcccccagccgactaaatgttcttgatggtcagcatcgttgttaaatctaggcactggattcaggtggctgttgatgaatctgcgtatccgcaa

SEQ ID NO: 63260 - DNA, 1124 bp, Homo sapiens
acagttgtttctcatttcatctcctgtttggtgaaattttgatggacaggtatttgagagctcaggagggagacagctgtatgggtcttggatctgtatttgctattggtgagtgcctgtttttttttttgttttcctaaacatggtgctacttggcctgtaagacatattgcaggagggacctgttctgaggaagctccagctgctgcttcagagaaagctgattctttcacctgtgcattctaccacagcttgttgacagctcttgttgctgtcctcagtattgctggctgctccagctccttcgtgcttctgtagcagcctgtgcccaccacccgttcttgatcatggctgtgaacgttattggggccaactgcctcctcttccccagcagagaatgagcacctcacaaggcttttttcgtcttttcctccttgatgtcaagcggagtccctgtgtatattgaactgagttgtgatttttaaggttttcggaagttattttgaaaatacatttaaaaattgtgcttttgtttttttaaggtttaggcaggaaatgagaataggaatagagtctagctctcagttcatcactactattttatcatcttattgttttatctatacagtagaagtaatgtctgtcttcattacctttttttttttttttcttgagacagagtcttactctgtcacccaggctggaatgcagtggcacgatcttggctcactacaaactccaccttctgggttcaggtgatcctcctgccttagcctcctgagtagctgggaccacaggcgtgtgtcaccacgcccaacaatttttgtatttttagtagagaaggggtttcaccatgttggtcaggctgatctcgaattcctgacctcaagtaatccacccatttctgcctcccaaagtgctgggattacaggcgtgagccactgcacccggcctgtcttcattactttttaaagttattgtgagatttaactcagacaatgtgcagaattattatgaggactatgttcttaacaaatacagagagaagtaattattgtctttgttgttacccaccaaagtggcattgttcaactctcctaacagatgaagaggccctttcagaa

SEQ ID NO: 63261 - DNA, 1016 bp, Homo sapiens
agtactattattattttacaaacacagattctattgggatttgtaatatccagactcatttaagagcattcatgaatttttagtgatttatctcattgtaatttctcatcaactgtaactaaaattacaaaaggcccatgtttttttttttttttaactttaaaaagggatcttcctactttccttatagatattggagagccagtaagaggttttaagtagggaacttacatgatcagttctctctagcaggagtaggaggatggatgaattcaaaggagaaaacttggagtcagccccctcactcttgtctaggtgagggtggcctcagctagggtaatggcagaaccagtgattctaagtgctgttttccaagaaagagccttaaaaaagcaaataaacacctaaattggttcttcttacaaacatggtgaatgccaaatttatatatagacacatatatgaatattcatatgcatatttaatctttaacagaaactaaagaggcttagagtttttctttctctctttatattatcttctttgtcttcatctttcattctatgtcttattttaaaaatccttttcaacttacgacccttcagtttgaaattaaatttgggccgtaagttgactccttgaatctttgcttcacaaggtttctttgtcttttttagaagaaaaaagattaactcagggtttccaaaataaaagcaaagattgtgattaaaactgaattagaatcttgattctctgttatttgctaatagtaaaataaatagctcagtcttaaagaagctttaaagtaagtcccggagcctttgagaacgcttggattttaattaaagaaatacagaataccgtcactttctgtttgtcagtggaaaaaatatgtatttttaaattttcaaagcttagcctagcagcacatggagtacatctgttggctttcagaatttggggaacacaaatggattcagatgtttaggtcctttgtctttactggtctcagctca

SEQ ID NO: 63262 - DNA, 1028 bp, Homo sapiens
gaatgttgaaaaataaaaccaatttgtttctgaggggacagatcctaaatgattctaattaggcagatctttataaacaggaacataggacattgctgacacaatttaggtgttcatacttatttctgattttaggttgggaattttaacagaaaaagaatattaagattgtggttctaatcttggttttgccagtaattagccttgatcaagtcacttaacttttctatatccctccctcctccttttaaaacatatttaaatgcaactagggaagtctgaggtccaattttaagattctgtggttctctctttttaagaaatacgattggacagaaatcagcttaactgaataagtatttattgagaattcggtccatacaaggaattcttcatatgcatagggaacgtaaagaaattgatgtactcccagctcttaggaaactccaagtttgaattttaggtcagggggtggaaggggaggggtgatgtaaaaataagagaaacacagcatataagcagacaactccaatagattgtattaagttctagaataggcctctgtggaaatctagatatctcctaaagacgtcaacgctgacccttccaatctaaattagatttccccattgtattggtatgctttttcttcatagcatttatcatactttgtaataacatttctgtatgattatttccttaaagtttgtctccccttttggactagaaagtccctgagaactgaacctggcagtgctgttgttcaccatggcatgcccaggaccttgctaaggaccatgcttaagtccttagtatggaacgtggaagacggtaggcatttaataatgagtcattgaatgcaggactggcagcacaggggatggttcagcctggggatgggagcagtgggtggtgaggtgaagcagagtcgaaggaaagcttggtaaagtaagagtaggcagtttttaggttgggtctcaaaaacggagtaggggccaggtgcggtggctcacgcctgtaatcccagc

SEQ ID NO: 63263 - DNA, 1446 bp, Homo sapiens
gaggattggaggttctagtattataattttccattttagtggggcagagatgtttggtatgtcctgtgctcatgtgcttcaatctcttagaaccaagctgatttacccaagtttacgtgcatatatatgtgtttagaaattgttgcctagtatcctactttgctggtgatgttagaatgaaagccagtttttccacccttcctcatcccgccaggatgctccatcacagcttaggtcttctttccttcttatatctctatctgttctatttgttcttacgtctttatcttcattctataaaataggataactgtagaattttttcatacttcacactttcagatgccatattgtccaagtttgtggcagtagctaatgggaagtgaccttgagtaacacagtcatgtgtatcttggatatgcagcagtaagttggaaatgacagtgctgagaagtcatcgtcaccagcttcctccatcctgccatccagtcctgtgtccagcctcagccatagtactgctcaaggatgatttacattgtgtgcgaatcattttgctagaaaatctgtggtgtttcatatagctctcttaaatccagattcctttgcttgatctttgagggttcccttttcttcctgatcccttcctgtctgcctttagacacaccattgcccaatacaggcatcttcctttcattcttttcaccagttcatttctcctctttctttgacattccttcagacattatttagtcaattgagaggtgtgcatttgtgtatatagtgtatgtatgatttacgattgatctgtcagccctgtagtgatttgcagtaatcctcccatttttttctgttgtgtttgtcttatacagggaagtccgtttcactcagatgtccgccatgcccacaccccttttctgagggacactgctattcccatagactctgctgaagagattagggcttcataaacatggatctgagaagttttgaattgtaggcagacttttgtacacagccacgtttatgtcaaagatagagtccctgggttactttcttctggttttcaaaggagtctgtgaatcaaaaggtatccagatgagagagcagggagctgggaaggggagcaaaagcagagccagtgaatagcagatgaaaatacaggctggggcctcctgctgctgaggggacataaataacctcctgttccacctgcttgccagttcttgaattatgatctcttatccatgaggtcttcatctagcctgggtttcctcctcttcctagatagcctggaattctctggaggcctgaccctacatgactaatatttctgtcctcatttccttatgggcctccctgtaatgttatgtttccctctaacatgagtatgtgctgcttactggaagcacatgagtgaatttctttgtttcttcacccaaagagcca

SEQ ID NO: 63264 - DNA, 1038 bp, Homo sapiens
aaaaattaccacaggagaatttagtaagggatttttgatgccccctagaggtagtgggaggtaaaagaattctcatggtcatcacaaattcttatttagaacactgtcacatgtggggaattttgccacaccagagtcaaagcagttctttactgttctaagcttctcattacagatgagaaaattgaagctcaagatggttagcttgcccagagtttgccttaactcacattttaattttacccacgagaagagtttgaacttaagaattgaaattcatgtaaatggcattgcttatcagatatatgataaggtgtataaaactttcaattttggagtatcctaaagcacttgccatgttaattaaaggtaagttttaaggggaattcaagtacatttaatcgtgtatatttttctgatcctttgtctaatctctctctttacaatgaactagaaagcttgatgtagtgcctgattcccaaccttggaaaagaatcagtatctgtggagctttctagaaaatgctaatgtctgagctctaccctggcctactgaagaaggaaatgtgcttccttctcttgcatagcccatgctctggctgctgggcactatctgtgtgcacggaaacttttctgcctccaagctctgtgtgttgtcttgcactgagatgtttttcacttgcccctgcgtgtagaagtacgaactgcttttccagaccaagttcatgcacaggttttcccaggaagtcattctctgtgttttccccacttcaccttcaccttctctactccctacattctaaagctggaggtaatctcttcacttccatgacctcttctcattatttgttttgttttgttttgtttttgtttttttttgagaggaagtcttgttctgtcgcccaggctgtaatgcagtggtgcgatctcagctcactgcaagctctgcctcccgggttcatgtcattctcctgcctcagcctactgagtagctgggactaaaggcgcccgccaccgtgcctggctaattttttgtatt

SEQ ID NO: 63265 - DNA, 1015 bp, Homo sapiens
gacctttatctgtactgtactgtcgttttttttccccttccctttgcccctcccccaagcttgcaaattccccatcttatcatttttcaactccagtaatctctactggactcttaagactagatttcatcattcacccacctaccccatagcagtttacatttcttcccagaactagtctatctcctgtgcatacattccatgagaatctaattgacatttaacttcttgtgtcccaggtggcaaacaatgtgcctgctacatagtaggtatttaatgcttaatatacatttgttgaactaatgaatgaaaatactaatgcagagagctgacgagtatgtaggatagtgagaaatgccttctttttttttttttaacaaagatttgttgagcatgaatgggatggcttcccctttacaaataggttataacttagtaacagatacgcagttctaacagaatgtgataggtattgtgactgattatctttgagtattgataaatactctgatagcaaagggaggtggtgacacaggaatgtgtaacagtttggagaagttgcttgacttcatctggtctcagtttttgcaactgtaaatgggagtaatgtagaaattagacaggttgttatctgcatttcagtatagactctacctagttgggtagcattcataaaatcattacctgagcttttgttgggacctgtcaaggctctctctgtttgtatactgataaatgacatccaaatttctaaatgcctgctcttgttgttaaccagacttcttagattagtttagatgctggggaaaaggaaaggcatatattactgaataccaatactacctctctctgaaagttcccagaattgcggacacttgtcttttacttagaggccaatggcagagtattagtccgttttcacgctgctgataaagatataactgagactgggaagaaaaagaggtttaattggacttacaactccacatggctggagaggcctcagaatcatagt

SEQ ID NO: 63266 - DNA, 1115 bp, Homo sapiens
agagtaaatcagaaaatatacatatgtccacacatagaaatatgacttaacgggggttttcagacatgccacattaaagaaaaaagtgtaattgaacccctgtgtacccattacccagctttagtaattttcatgcatttatttcatctattccttcattgccacctccaccctctcttgaattattttggagcaaatcaaaagtatcacttaatctgccaatattgtagtgtgtatttctaaaagataagggcattttgaaaatgtaatcacaatttcatcatatacctagaaagtattagcagcgtttccaaatatcatctgatcagtgttcctatttcctgtttcctttattgtctcataatcttttttacagtcaatttgtttgacttaggactcagtaaggttcatacattatatttgcgatgtgtctcttaaatctctttaaatcaataaatccccacccccctcccccagccttttttctttcttacaaaggaataattcacaggacttggtgattaattacatttggggatgattatatttccaaatctttgatgttaagcactgaatgactggggagatggttcgatttcagaaattatggattctgaaagtaacactggctttgagagaccagtgaaaaagcagtgccttgctggttttacattgacagtccaggtaagctgatcaaggtgtcctggcatttggagattttcttttgagctcatatttcagtgtacattgtagggagataacccctgaatttggttatcttcaaaaacttcctttatgcctgaattactaattcacttgatgggccttaacatatgttctgtacagaaggaaaagtatgagcatatttccgttttgcctaaaaataatgatttgcttacgtttttactagtgttttatccttctggctcattttcatctggtactagatctaaattagttcagagcagaaaactctagtactcaagatactttaatgtatttataagactcaaagaaaactctggctgtccttatattaatcttcctttatgtagtacacgacccattcaaatgaagtattttcatactagacttaaggacttgcacagatttca

SEQ ID NO: 63267 - DNA, 1048 bp, Homo sapiens
ttcctgggtgacttcacttagaataatggtcctcaactctatccaggttgctgcgaatgccattattttgttcctttttatgcctgagtagtatagaaatggaaggacatagtttaatagtgattttcttatcctgtaaaatgctgtatttcctactgtcaagtattaaaacaagtaaattgaagaaaacataaattgatttctctttttgaattttgtatttagtcagtatttctatgatgaaaaagttttgcagcttaatatagggtgtgactagggatgatgatggaaacaaagaggaaagttaaggacttattaacctgaggaaaatgaaagtatatattaattataagattattttaatattaaaaaaatggctgtttgtgcctctgctttttcttaggcagagactccccctaatgggccagattgtggctatggctcctttcaccagcagtactggcttgacggaaagatcattgctgtgggggtgattgacatcctcccaaactgtgtatcatctgtgtatttgtactacgatcctgattattcgtttttgtctttgggcgtctactctgcactacggtaagattgctttttgccgttattgtagtgggttatatagaacttcaaataattactcatttgattatatttaattatgtaacagtagaagtcctaattgacagtgtattataatgatttgttgctagtctcttacatagaatacatactactatataataggtaataggtattctatatgagttaaatactcctatataatatatacttatatataatttgtaattttcatttaagaatatatttaaagtcacattgaattttaaaataaacatcatttaactagtttataggaaatatacatattatataagtatatagttatgtaatatataagtaaatattatgtataactagtatctataatctataatctctagtacttttatattgtatttataaggtactatctttagaactgatgccagtgtctgatggtaattctctagctttttaaggtatc

SEQ ID NO: 63268 - DNA, 1427 bp, Homo sapiens
cctcagcctcccaagtagctgggattacagacacctgccaccatgtccggctaatttttgtatttttagtagagaaggggtttcgccatgttggccaggctggtctcaaactcctgacctcaagtgagctgcctgcctctgcctcccaaagtgtgtgtttctatttttcaaacttcggtgaagtgtttcatgaaactgttaaaaaaaaataaaaaagcaaaacagttgcaggagtgagttattttaacacaatgcagactttgtatcaggtgcctaaaaggattacctttgggtgcctccattaactgttatttactaaaaattcgggacattaattgtctcatcatagatttttgtattgtacaggtacaatgtgggagaggtattttcagctgctttggaagagaagagaactcaggttctgctctcttaaagcccctgaagactttcagtcttcctatctttgaacttcgtagtaaatcccctcaaatactggcctgatgcctggcatatgactctccagtctcctgttcttttgagccttcactgtgttctgggcatagctaaggtacatagaagcaggtgggtaaagagacaggtctactttatcacagtaaatatgcacccattttgggagcagtttggctggaagccagaactagcctattaatattgatgacatttctacacagtgcctttggtattataccacataggtcattaatcacagaagtcattcctttcctccccaacatttaaggtggtttttcttctgtataggtagaggtgaaatttattattattttttcttgttatcagctaaatccttgaaattgaggaattagttaattaattctttcagatatccaaaatatgcaaaactgcagactggtaaagataaattactaaattttgctagtcacatgacagatttatgtatgaggaaatgaaagataactgctgtttaagtaactttgctgttaagttagctactcatgtaattttgtagactccatctcaaaaaacaaaacaaaacaaaaacaaaaactgacctagactttttatagtctgcaaagtgcttttatttgtatattgttgtttctcacaactaatgacagttgagactgaccggtagtatgattcttgtttgaaaaatgcagacattgaaacttttattttttatgtttttattttttgaaacagggtcttgctctgttgcccaagctggagtgcagtggcacgatctcgcttcaccgcaacctctgcctcccaggctcaagtgatcctcccacctcagcatccagagtagctgggagtacaggcatgtgccaccacacctggctactattttgtatttttagtagagacagggttttgtcatgttgccaggctggtctcaaactcctggactcaagcgatctgcccgc

SEQ ID NO: 63269 - DNA, 1030 bp, Homo sapiens
cgtggaacccaccgtgtacatgcctgaaaaggggaggaaactttttcctgggagcccatgggttacaccaagaacaaaggcttctgtattgggccttgctttcttacctgtgcagctgcagcccgagttttcgccaggctgctctatttgtgcctgcagcttgattttttagggtgtttctgtgtttgaaggagttttaccaaagacccatcctaactgtctgcctgaccgttttttttcctttctcattactaccatccctggggataatatatgggtcacgagtgaatcagaaacacaaaggcacaaacttagtggagaagcagaaaaatacatagagaaacagtgagcaaagttagagctttatggctgcatgagcatctctttgggagccaagaaaagttgtgttaggcttaacagactgtgaggtgtgtttctcatttacttagctccatctagtctacttgagcttctcagtggatgacctccagaactgctgactataatttttaaaaagataaaattgtgaccttcatgcaaatagaggacaaacacatgccaaatattgactcagttagtgcaaaaccagtaaggcattaaaactggtacaaagaacatttaagaatatgtgcagatattaagatatatgcatgtgaatgagatgagattgctagattagataaaaacaactggttattgtcttatatggtggtaaaccatgtaagggattatttgttccccacccccaacagaaatctacaagttaacctctgcacctgcagagttgtaaaataacccagtcaatagaaaatcaagcctagagcttcactgaaagaatacccagtgctgtagtctgaatgttggtagtcccccaaaatttatatgttagaacctaatactcagtgtcatagtattctaagaggtgaggccttttggaaagtgattatgttatacatgctctgccctgaataatgggattacgtgccattataaaagtggttgaagggagctaccttcccctaccatcatg

SEQ ID NO: 63270 - DNA, 1049 bp, Homo sapiens
gaacgtctgcacgttcaacactagccaatggtcatacatcaggggtccccagttcccagactgggaccagtactgctctgtggcctgttaggaactgggacactcagcaggtgagcagcgagtgagcgagcattgctgcctgagctccacttcctgtcagatgtgctgtggtattagattctcataggagcatgaaccccattgtgaactgcccatgtgagggagctgggttgtgagctgcttatgagaatctaatgcctgatgatctgacttggaacagtttcatccctataccttccccttctcccctctgacccttgtctgtagaaaaattgtcttccacgaaaccagtccctggtgccaaaaaggttggggactgctgtcatacattagctaatgagctctttgggaactgaattttaaattttttaaattttagttaacttaaggctaagtggccacatgtggctagtgactatactattagggcagattggaacattccaattaaaagtcagagattgtcaggctagataaaaggaaaaaatcaacatccatcttaaatacagagacatggataggttaaaagtaaaaggctagagtaaaacactactatacgaatacttatcctaggaaagttggcttatgcctgtaatcctagcaactcaggaggctgaggcaggaggatcagttgaacccaggagtttgaaaccagccagggcaacataatgagaacccccatttctaaaagaaaaataaaaaaattatctgggcgtagtggcgtgtgcctgtagtcccagctgtgagagagactgaggtgggaagatcatttcagccttgaagtttgaggctgcagtgagctatgattgcaccactgcagttcagcctgggcaacagagtaataccacatctctaaaaataaaaatgaaaaaaaaacttaagaattttaagtcagagtggctgtattcttatcaaagtagacttcagggcggctgggcgctgtggctcacgcctgtaatcccagcacttttggaggtcgaggcaggtgg

SEQ ID NO: 63271 - DNA, 1016 bp, Homo sapiens
tctgtggggctgacccttttacattcctgtaagctgaagactaatagagctcattaagctttatgggaaaagagcttttatcacctcgtcaagtcaggcaacatatttccattagatccctaatttcgggtggctctgtagctgctgatatgtactcccctgctaggcttacaccggaccccggccttacagacatttttattgacatttctaagtctgaattacattttgtgtggcaccacttacagatgtcttcaattaaatgtgggtaaataaaagggattatatatcagagcccgaaagattcttgaatttctcatctgagtcaaactttgccagctagtccagtagggcacagtctcattgtcacttttgtaggtagagagctataggagaggcatttataacaaaagttaaaccaggtgtgaatgtaggtcacctaggtttctcttcaggtgtgtccttctgttccttcatttcaaaattttctgtattaataggataataacttactgataagttagcacctctggtgtacaggtactgtgctttccacttcccttattttaattcttacagaatgtcaatgaggtagatattcccagttttcttatgaagaaaattgaacccagagaggtagattaggtaggtgctcaatatcacagctactagtatgtgacaataatcacaagataggaaggaaatagaatgtggttaagattctaacattacatgaagtgatatgatagtatttgaaagaagaccgtgattagttagggagtatttagtaagccccagagcagggtttctcaaccttggtactatcagcatggtgggctggataattctttgttgtgaggagctgtcctgcacattatgggaagcttagcatctctggcttctgctcactagatgctagtaggactcacccctctgagttgcaacaaaatgtctccagactttgccaaatgtccctagggggacaaaatagcttcctgttgaaaaccacatcccta

SEQ ID NO: 63272 - DNA, 1484 bp, Homo sapiens
acattaattttctataatctttgggttcactttaagtggatttactggaaaattgtataataattttttctttttctctgtgttcctttttgccgtctgtttactggatgaaatggattctgttcaaatttgactgcagttcacaagattcctttgcagttcacccttggaggtaagagttactcactgaccttaatattagaattggtaattgaacaccattgttgatatctttcattaggcatttatttgataatttaggagtgctcattttggtgggacacatatattcttcaataacagtaatggagtgagttactgcaggctttttttttggataaaagtttctagaagttatatcaatagcaattcactttcatgacaggttattgcctctttttaagtatattttctttctgaataagtagagagaaatcagtccttcattttaaagaggcttgttgtatcttcattactcctgtaactgtttatttaacagcagccttatgttctgtaaattgccatggtattaaaagagagctggaaaaatcagaggcaaaggctgtcttcaaggaagtttcagttagagagaccactttaaaatccatgagttgacaagagaagagcaaagttattgaggtgctgttatagcaaggcaatattctgggttcttcattcactttttcatttaatcctcatcatggttttcaatgtagaactgagaatccagtgataaaattgtgagataaagaaaaactattagatgtttagagaactagatatcgttatgagctgcatttgcagaaaaacttgtagatgatcatcaagacttggaaaaggaagtagagaaagggtggaagcagagttatgtgaagaagtggtgggacttagaaccgaaaccgggtaagaccttgccttcacttactagctatatgacattgggtaaatcacaactgccctgagcctcatttttgttatcttttagatgcaaataataattcctacctctcaaataagtgatggaaatgggagcagttataaactgtgctagtcacatcatggcactattttgtgttctcctcttaggcttcagctccacgtgatgagactctgttccttgccttgcacttgtccttccctttgtgcctattgtttatttcattttatgctttcccaacttcttcaaatcatattcgtcttcagggttgagcctcaatactgtgtccttcctgagaccatttctgcttttataacattttgtttatttgattattgaaactattattgctgataatgtggtgtggcctacactggcgcattgaaaacgtgtggtagccagcctgagtggtcaccaggagaaatggaccagaccagagagggtagtcccatccaggtttggtcacattgtctgagtatccaggatcaacggggaagcagagtggtatagtggaaagagtctaggctttgaaatgagagaggcctga

SEQ ID NO: 63273 - DNA, 2477 bp, Homo sapiens
aggcgtgagccaccacgcctggctaattttttgtatgttttagtagagacggggtttcaccgtgttagccaggatggtcttgatctcttgacctcgtgatccacctgccttggcctcccaaagtgctgggattacaggtgtgaaccactgcacccggccttgttgtcatcttttaagatgttttgaatcttaatgtctaaggtgccaaatgtaatcagaagaggtagcacaaacaatcctttctgctacgttgcttgcaattgggatagagaatagctataaaaaaatgaatttagggaattacttgaatctgccctttttactccccactaataggttaaataagatcttctcaaaccttagcttccactccttgttaaatacagatttaattctcattcttttgatgactttttaaatgggcgctagctgtgtcttttggctgctttgaaggttttatttgtctgcaatgaaatatgaaacaataaaacttttttcttttgtggaatcaaattaatttcttagagttgtagatttatcagagacattctttacataaaacctagtttgcactgccttagaactaccagttatttatagtgtaaatatgtgccagaaattgaacagggatgggaagggagtctaaaatgttaagttaacataatttagagtcgtaactgacttaaggcttccaaattcctgatagaatttagtattttacaatgaggtgtaatttagattgataattgcaaaatttttaaataaaggttttattagattataatctaaaataatcagacctgtcccctgacaaattataggacagtaagtggaagtagggtacaataagtgaaaagcccaggaaatataactggaagtatattttgttaatgtgaggaaattttggatatttgatatgactagttataagatttggaatttcactttggcaaatagtgacaccttactgatgttccttgggttaggaaaaaaaaatgttatttatctttgtaaaaaatgccttttggtgttgagtgtttcctttttctttaaaagataggaatttaaccacggttacttattaaacaaataaggcatttcaggagcaaagtggcttgaattatctgttgaatagtttatattacaaagagaaaataattatcatttttctggtaccttttttttttttttaacttaccaaaaaggaagtcattacatccaaattgctaggatcttttgacaaaattagcagtgtattttctttggtccttattccccctacccctatacttagaaaaagaacttactgattgtaactaataggaggtctaactacaattttgtgcacttggaaaatggtttagaaaattttggtaagcattaagtgcttctttggcgggaatgagaaaggattatgttatgagtcaggctaccgatgatgaatagaacaatggtaccaggcttggtaaatgagaatactttaagaaaagcaaggtcagtaagaagctgtggagcgtgagcactgtctgtgtgtatcctttttctttttagaggcctagaggattttgaaaatggtactgatgccttttatgcctggattctaaatatagaccataattcttcagttttttaaaaaaaattcaagacttgacagaataattggcatttagaatttttataaattttatcaagtgaatcaaattgacagtgttattaatattgttacaggtaacttagctgttaagtttaaaaagccaaatatcatgcaggttattcctttattgaactatgttaaatcaagatactcctagaagtaatctttaaaagtgggtacataggaagataaagaatatggctatgttaacctacgattgttattagaatgagaaaattatatgcccatctgcagaatcagatattttgtaaaacatattacattttttatgttttcaatattacgcccaaatattttgaaaaggatctttctcttaactactgttaactttacccattatttattattaagtagtcctattaatatagtcatatcagacaagtgatattaatgtgtgcaaccatctgcgtgcagccgtagtcttttttttttcaatagactttactttttagtagttttaggttcacagcaaaattgagccatagtcctttttaatagtaatcagacatcatgatagtgtttgttaaggaatctatttctgctttcaattgcagtgtatatagaaaatgtattttgcagtctcatttttttataattgttctttcaaagtattaccatttctactgaatataatatgtacagtttcattatgaaggaatttactaagtaattaactgaagtgaaacataaaaaaaaatgggttttactgatgctctaaaagagagaaggcattttttgaaatctttttcatgtcgtgggaataggagtgtcaatgtgtgtcttgtgatttgttattctgttt

SEQ ID NO: 63274 - DNA, 1246 bp, Homo sapiens
cctgcctcagcttcccaagtagctgggactacagtcacgctctagtgcctagtttctattaaaatacgtgtatttcttaattgctttacctagaactggagacaaaggagctataggtgtcctgtttttttattctggtggtagagcttcttgttcatacaggagcagatctctcgttttgataagttagctatattggggtactgtaatccatagcatactttgtgctcgttacactaacttataaaaatactgtatgcaagagtctgaagaaatacacaatgcccagcagagtgtctggaatggagtagaagcccagtgaacatgttttgaatgaatgagcagctgagttgactacttttaaaaaaacagctggagagagaattcagttgttgccaaattgaaagctacttgggaagaaaatagtgttcttgaaacttgtgacatgaagcaaaaaggaaaattcaaatgatgtcataagcttttgacagttgttctactataataagtaaaagctgctcttaatttcctgagtgagagtgttgagcaatttacatacaatgagttaagcacattttagtgagtgcaaagctcatgtgatagaaacaactttgctgtgagtgccatttgtctttagcttttgtattttaggtctgtttttcacattaaaactgaagagcatcaagttttatgacctcctggtaatcacttgacaagtgaacaatagtaccttttgatggctagtctaaacaaggaaagtttgtattttcactatggtcattcattatatatgccaaataattttaagtaactgcctgtatgattaaaaagcagttgattttcatctagtcagtagtagttaattataaaagtaaaacatatattacatatggttatttatccagagtataattctgcccttaagaatatgtaaaaatagggaatatatttgtataggtctctaaatatttatatatatatacatatatatgtatatatatatttgtgggcttttatgtgacatttattccagaaatagctcaaaattttgtaatggctttcatattactttttcctggactgtggaagaatgtgattcttctattcaagcagtcatataatcatttaattcggggcatgttccactcactgtggtagatactagggatgcatagatgaataagacatgtttggttcttgtatgttttagcccacaaataaaatttaaaatataagtgtcatttca

SEQ ID NO: 63275 - DNA, 1038 bp, Homo sapiens
aaatgaccaaagcttttcagtcatttactattggagagagacactgttatatctcaagcatgttcctttttggggagatccaaaggggtggagtcaaaactagcactgggaacattcatctttctttccttccgtttcttctctcccttccactcttttcccttcctccctctttttcattgtttgacataggctcttgctgtgtcacccaggctggagtgcagtgtcgtcatcatagctcacggcagccttgaactccagggttcaagcagtctctcctgccttggtcccctgagtagctggcactacagacatacgccaccacacctggccttttttttgagaggagaccttgctgtgttgcccagcctggtcttgaactcctggcctcaaatgatcctcccaaagtgctgagattacaggcatgagctactgtgccaagccaacatttaactcaaagttcctttcggtcagtaacttcctaaaacttgtctcagatcacaaaatcataccatcatacaacattggaggtgaaaggattttaggattatatagatgaatgtctcatatttaaagaattaattaatttgcctaaggtaacatgagtagttagtggcagagcaatgtcctgaaattgcagtgcttttttttttttttttttttttttttgagtctgggtctcactgtgtcgctcagactggagtgcagtggtgccatctcggctcactgcaacctctgcctccgaggctcaagcaattcttctgccttagactccccagtagctgggattacaggtgctcgccactaccgcccggctaatttttgtatttttggtagagatggggtttcaccatgttggccaggatggtctccaactcctgacctcaagtgatccacccgccttggcctcccaaagtgctgggattccagtcgtgaaccaccgcaccccagtctgcagtgctttttatactagacatgatgttgccatttgtaaaagttaaagtgggcctcagtaaaatatggagtgattgacatcag

SEQ ID NO: 63276 - DNA, 1588 bp, Homo sapiens
gttacttgtactttttgaatgtaatgatactcaggatgtatagagatcttttaccactgggtgtcgctctttcttcatagaattacgtctcacggcacacatgtccagtttccagctgttttcattgcattgcatttgactgttttactgttctgttttgctaatacattttaagtggctagtaaataatgttaaagtaaatgttagccattactgcgtgcaattactgttttaaacttatccttattttacaaggttacttgaccaagatggtgacattgtaagatttgaacaaaggaaatgtgacttcagagtcatggttgttaactatgctatgaagtaggaaaactttatgaggtctttttaactcaaacagtcaagttttaagttgagggttagcaatgatgaatgagtggccaaaaaatgtattcatatttttagtctttcttagaattactggtagttgtgcacaactagagggtatttatttgtgtgtgtatgtgtcgtgtgtgtacgagtgctggaaatactctgccagtttacagtagaggcaggcttacataattcagtcatgaaagctgaggcttatagtttagaggggatcgtcctcttcttaatgagtctgtaagttacaaaaataacttttttctttatttactaactggttggtttttaatattaaaatatttaggtgctttaataattgttgaaacttggtttcttggatgggagttactcttaatgcatattccacagaatgaataaatgaatgaattagtaaacttgtttttttaactgcttctgaaggtgagggtggtgagatcatctccaccaagttcgcagttcaaagccacacttctggagtcttaccaggtctataaacgttaccagatggttattcacaagaacccacctgatacgccaaccgaaagccaggtcagcaggccaagtgtaattttcctgtgcaaacagagctttcccttccacttaatatcatttaatgaaatcttggtttatttgtgctacattttatttgtgttcaatttgcagcatatctgcaaagacctaagactgaattaatggacattctgaaagtgcaaattttacctagtgccatgttaagtaccagccatgtataatttcagagtcaaagtaacatgtaaaattatttaaagtcactattttagatgcatttatctaaaagatagtaatagagctctaaattaaaatacctgtgaggaaaactcaggaaactatatttttatggtagatacgtactttgcctaacatgattttaatgctttatctgtatttgaaagatgtatgtaggaataattgatcccagttaaattattctttattaatgtgctacccttgcacaattgagtgggactaaaaaaggaagatagtagaacattttaatagaagaactcatatgctaataattttgtaagttaaatgacccaagaaaaatctgtaaaggaaaaaagcttaaaacacttagtataagtagaggtggcaaaagtagcgatcatcaccatgattaacaacaatattgactctagtttatgcagaaaactacaattag

SEQ ID NO: 63277 - DNA, 1072 bp, Homo sapiens
tgtccctcagaaatgttgggcagagatagcagtgtccttttaatgcagcaggtactttgatttgattgtgttcttcctcacaaaggcagagaagtggatgaatgtttttttttaaaaaaagatatttgggccgggcctggtggctcattcctgtaatcccagcacttagggaggccaaggtgggtgaatcacgaggtcaggagtttgagaccagtctgtccaagggagtttgagaccagtctggccaacatggtgaaactccatctctactgaaaatacaaaaattagccaggcacggtggcacacacctgtagtcccagctactcgggaggttgaggcaggagaattgcttgaacctgggaggcggaggttgcagtgagctgagatcatgccattgcactccagcctgggtgacagagcgagactctgtctcaaaaaaaagaaaaaaaagattttcagcagtaagagccaccttggaaagtttctgtgctatttactttctctagcaactcccacttctaaggtagaattttagatccacttacagctctgtatcaggatcctctgaaacatctaccccaaagctagcctaaccattgaaactctttggacttacactgtagaatctttgagacatgtgaaaaaacttttctagaaccaaatgtgattggtctaatattttaaaattctttttaggcaaaggggctgatttgagtaagcctccatgtcgaaaagcaaaggaaatccggaaagaaaggaaaaggttaaaactaatgcagcagaacccagctggagaacttgagggtttccaggctcaaggtcacccaccatctttgtttccaccaaaggctaaatccaaccagccaaaatcactcgaagatttaatttttgagtctttaccagagaatgcatcacacaagttagaggtactttggaggacttttgttgtttgttttattatgatttttttttgtttgggcatatcgtttatttttatttgaagttctaattagttgatgtttgctagttaaataatgagaatttaaaagaaattaaagagaactgggaagaa

SEQ ID NO: 63278 - DNA, 1088 bp, Homo sapiens
ggaagcttttctatcctctgttctacatttcatagtcagtttggctatgtgtctgtttttatccatcacagacaaactggaggggcccttcttatctgggggctcgtcccatcttatcctttagttcaggggaattttcttaaattttttattctatcttttcacctccattttcttttttaatgcctttatttagattttggaccttttaaactagtctctgactttaccttttctcttcagtttttcatcttttttgcagaatcttctggaaggtttcttcaacttcagttttcaggtcttctacttaatttttacatttctcctgtcatatttttacttttgaagttgtttttgttctcagactcttatttgtttatttaataacaccttgttattttatggatgtagtggcttaataaacgagatcttcctaaggatttttttaaaaggttctcttctttctgtcatggtctatgtcctccaggttactttctccagtttgttcggtacctatcttttcagtggaggctcttctcgagtgtctggtgattctgacttttcagtgttccattggaaattccgtgtacctgatgggtttggtttactgtgggtcttgggtgtttctcggccttgtttactgtgggtgatctggctgggctcttctgttggggaatccctgatgttagtatttttaggtctgatcacattctggagagaaagtatttcataacctgctgttgttctggacctgggttggtgatctcaacatgtactgtgtacacttttatttaagccgttttcagtagtaccgctgctttcagctgtggcttgcatccatcctgtaagaggctctatgttactctttcctgcaagtttgcagttttctgctgggttgagtagggagtcgtctagtcatctgcggatgggagaggggatctgacatctatcctaactgcttcgaaaacaagactttgaagggatctttctatttttagacctaactttcactcatatttccagagctatgaggtgtcaccaatccctaagacttttaagggtaatatagagaaaattggctttttttt

SEQ ID NO: 63279 - DNA, 1129 bp, Homo sapiens
agtttaaaatgactcccaggtctctgacttgagaacagaatgaacagttctgttagtaccatagacctggaatgcatggaaagaagcgggttagttttggggtactccgtgctggtgcatgtggaatacccaagtgtggttgtcacaggcatcacatacatgagtcccacagcatcgtgggcatttctctcattgcccttgtggtattggggattggtggcaggtgaaggcagagcaggggtggcagatgctggtgagaggggaactgagatgattggccgtggggtacacaagtaaagctttaggaaataaaaggcagggttctaaactttgctacacgcactttgaagattatttggcttatgaagagtaattaaacctacatgcatttctacaatgttgattagatttttaaccttaatttaatgctcctgtgctaggctgttttggtgcaagtgaaaaatatataagacattaacaaactatttttataattttagaagtggaaaatatgtgtacaaacctgtcatgaatcaaacatgttgtcctcagtacacaataaggtaagaattttaattagtagaaagaggatttatagtatgaagattgtgtataatattttagtagtctcttgtgcttttttaatgtttatttccgctctaggtagatgtcctttaaaaggaaaagtaaatgagttatgtcttttcttcatactgatgctgtatttatgtgctgatcagtaggttttagtaatattgtttgattggttcagatataaatatgtgaaaaaaataccctcttaatttagcaatcttgtcaatgaatgccatgaaatattgggaaaatgttggtaaatattcacattacttttggatattaaatattataggacttagcttagaattttctgcattctggtgtattgcttgacacagtgcttgtgttcaagcaatgctacaggctcctataaattacttggtaggttcacgttctcatgttgtgggattcaggaggacaagagagacctcgggttaaaacaggagaaactttattgagtgcacttaggcccagctgactcaacgtctaaaagactgggcccggaacaaagacttttatacacagttcacag

SEQ ID NO: 63280 - DNA, 1028 bp, Homo sapiens
ctaacagctgtgaagtatgtacaaacttttcatttatccaatatgagtgttttggaattttaacctaaacactcctatttttttttttttttttgagatggagtctcactctgtcgccagggctggagtgcagtggcgtgatcttggctcactgcaacctccgcctcccgagttcatgtgattctcctgctgcagcctcttgagtagctgggattacaggcgcccgccactatgcccagctaaatttttgtatttttagtagagatggggtttcaccatgttggccaggctggtcttgaactcctgaccttgtgatttgcccgccttggcctcccagagtgctgggattacaggcatgagccaccgtgcccggacacacactcctatttttaaacctcacactttgaatttaaaaaagaaaaaaggttaccctgccgtaattaacacactacttattttttcaggcatgtgggcacattccatgacagtacaggattatcaggatctcatagaccgaggatggcgaaggtaaagcttccagatacaaagagacttcctactgttactcaggttcttgaaaaatacagcatgcctttgaaatgctttcctgttggaaagaggtttaagaaaaatttttattatattcttttatgtagtgattttttgtctcctttttaaaaaactttgttaggaaaatgtcaaatatctataaaagcagagagtacattagaatgaacctcaagtacctatcactaagcttcagcagttattaacgttctgccaatcatgtttgattctcctgctccaccttttaatatttaacagcaaattacatcagtaggttattatgacatttatcctatcaatagataggcaataagtatgtatctctaagagagaggtctttttttctttttaacttatccacaatgctgtatcacaccttacaaaattaataaaaattctttgatgttacctgttacctactttttattagattttccagattgtctcaaaaatgtcttctt

SEQ ID NO: 63281 - DNA, 1315 bp, Homo sapiens
tctaccgctgcggctactgcaagaacgagtcgggcagccgctccaatggtgagcgagccgggccggcgggcgtgggaagccgggcgcccgggtctcgggatcccagggtcccccagcgaggacgcgagggggccggagcccctggccccagtgccacggccgagacggagggggcactctcgggagggccgcggcgccggcttagcggggcagcttcgcggtgcctgttctgcaggaaaatcctaaccggtgcccgtactctcgaaatcgtggtggtctccccagagtcgggagacggacgcccgtctggggtagattgtgtgaggtgaaggacggcgcgcagtgccagggaacgccccagagccgtagttaatggccggggctgaccggtgggtgctgcggtgggagcgtcccgggagcgagggcgaaacgcggtgcagagggagctgtgggtgtgcacacaggtgccggtcatgtatgaatcagacttccctggacgaatgtacaggaaggatgagccctttgcatctctgggttaaaaaaaaaaaaagttaaaaaaaaaaaggacaagaaactggtgaccgcggtcgctaccggcgagggattctgtttgtcctgatctgtttgaaatttttaccatttgcttatatgccgtgtctttcctccacccacccggacgacagcaaagccagcccacaagtttgttttgtttttccatcgtgattcagatttctttgggggagatttgttgctggtaaacaaaacatcgtgtttatttcctctcttgccatgcatttgccaatatagaatgtagactctattattttaatagaacagtctagctttgtggaaaacgagattcgcatgaaaacacacaggcattttccatgaaaaaggtgtaagtggggaatgatttggtcgataacggtgtgtgcatttgctccttcattaaaagtgtttattaagtgctacttgtgggcagcggttttgagtagacagttatgcaatcgttagaagtgaggattatgaagactaaatggaaaaatgcttccagtttggacttaaacggagaaaatcaacaggatgcaaatggcttatgcgacatgattacagttctgaaaggaagaaggcccggaagtacaccaaatcgtgacagtggtaatatggccttagagtattgtggatttctaccttctctttttcagaatttttgtattttggctataatatttatcaaatcaataagttacattaaacgtgcctaaaattaatattttaataggtcattacttatttttttccaataattgtgata

SEQ ID NO: 63282 - DNA, 1069 bp, Homo sapiens
ctgtctgatttcctgacatagaactgcgagatataataaagtggtggttgctttaagtcactaagttttagagttgtcacacagccagctgaaacacttggaaatactgtgcttgtggcttttttaatttttgccagtttgatgcacttaaaaaaaccaggggagtatatgttttattgcattaatgattaaaagtatgctagtctaaaaaatataaaataatttaaaccttatttttttctagttgacttctcaaaaatggtggcatactcaagagctcccttcagagtggtttcttaattttatactctcttttttcttatttctccatcagaatcatcactttcctaagtgctttctggtaaggttgcaaaattggataagctgtgacccattcaaactctttcaccttctctttttccacttgagattttaggaaagatggaacggggctggagcgcttctgagcgtgtctttgctttgagttctctccctcagatcattcggtcttggtgtcccttcatctgttcctttgtccatgccaccttgtgcttactggtttcagttttgtgtgttttctggatattttcatgctttccatccttttcccgtgttagtattttaggggaaagtatttcactgggaattctttgagggagcagtcggtgtttgtggtctctgaggcctctggtttgttcagcctggtatatgtttctttgtaagactcagttccctctcaggcactagatagtcccattttttagtatcttctgttttctcacgttgtgatctcttttcctcttcctctattttagtttcccattttggaaccatattgtatttccatgcttcttccatcatcatttcttgatgctattgatagtagtacgcctctgctttagcaaactggaaatcagaagacacggccttaagtttatgaagtgtttcattctcctgctgaaacttgtggactaaacagtttcctcacttctgaagaatggacaccacctaggctgggcgtggtggctcatgcctgtaatcccagcactttgggaggccgaggtgggtg

SEQ ID NO: 63283 - DNA, 1079 bp, Homo sapiens
accctgtgtaaataaaagatactagggaagtcttatctatatcatcaccttattattgctatggtgtaatttgattttctgagatactgaattttctgagtaattttttccatctagtgcgtataggtttgagtcttaaatgtttgtcttctcctaaaatcatgttttcgttttaggatggttttgcaagaataagacttgaccaagaccgactgccagtaataggtaaatgatactatgtttggaaaaattagttttagagaaaatatatttgttagtagaatttaagtattttactaaatgtaaatgaattttcaatgtagattaacttttacaatattgtatcttgctcaactacctgaagatactgaaaacatggccagcgtctaaaattttgatggattcatctatatcattgattcaacatctgctgtaaatattaacaaagaaatgatataatttccctcagatcttaatttagaaagttggtgattgcagtcatttttgtagtatccctctttctaatcacgttttgtcagatgccggcaccttcttttctctttgaggttctatgaatctttcattcttacctgaataatttcacactctccattactcatgtcctcctaaggtctcctgtggagagtgaatatttccatcgcacttacttgctactttcaatgttctcaatgtcctattggactcactagggcttagctctgtggttgacacatagatatgcagattttcaaatgtctggaatgtgttactctactacatgttttttgaaatggaaacagatggaatgactggctactgtaataatactacagcagctccataatgcatgaaatcctaaaaagtatgtaatattataagtatcttttcaatacaggtttcattgctattattcatcagtttccgtttagattacctgttccgatttaataacctttgataaatttgaaaaatttgtctttcaaacagagcctgttagtattaatgaagaaaatgagggatttgaacataacacacaagttagaaatcaaggaattatagctttgagttaccgtgactgg

SEQ ID NO: 63284 - DNA, 1105 bp, Homo sapiens
gatgtcggctcactgcaagctccgcctcccgggttcatgccattctcctgcctcagcctcctgagtagctgggagtacaggcgcctgtcaccacacctggctaagtttttgtatttttagtagagatggggtttcaccgtgttagccaggatggtcagcaagaccccatatctaaaaaaattttttttaattagccaggtgtcttagacaaggtagaatgaattaaaaaaaaaaaaattagccaggtgtagtggtgcacgcttctagtgccagctactcaagaagctgaggtggtaggatcccttgagcacaggagtctgaggttacagtgagccgagatcatgcaactgcactctagcctgggtggcaaagcaagaccctgtctcaaaaaaaaaaaagagttcgggtgtgcaagagagaagaaaaggagtttgggtgtgcaagagagaagaaaacgttaataggccagtaagtaggtctgtcagcttgataatgacttttttcagttaagaagaatggaagaatctcatcaagaagcaacagagaaagaagtagaaagaatcttgggattgttgcagacatattttcgagaagatcgtaagtgtaacaccattcaaagtggagcaatttgtatttatctgttcactgaggttacttgtatttaaaaggcaatttcagctgtatgtaatatttgaataaatacatatgcattttatgaggattcttctcccctttagaaatttcatgtgaaaactttgaagttaacgttttcatttttatctttaaaagatggggattttttttgttacaaaatgaaatatgccattcaagtgagaaatgtcaaaagtagctgttccacctcccctcattataaaatgtaatgtgtatattttcagattattttatcagttttatacacacctacctaaatagtttgttttggccgggcgtggtggctcacacctgtaatcccagcactttgggaggctgaggttgggagttcgatacccgcctgaccaacatggagaaacctcatctctactaaaaatacaaaattaaccgggtgtggtagtgcattcctgtaatcccagctacttgggaggct

SEQ ID NO: 63285 - DNA, 1050 bp, Homo sapiens
catggctgtgacttgccctgttatcctaagacagatgtgttctgtagtcctgggctgggagcctctgccttggcctccccagatcaaagtcttctgaccccactggagcttccccacatacatgttcatccttcccctgctcttagaagttggctttgcaaaacaataggttgggtggtgggaagatgtcacaggcatattcactggcctactttacagggcagtatgtaggtgtctgaggaggtatctgtggttgagtaaagctcctaggagttcttttagaaatacaaagaaggcagaaaggctgtcacaaaccttatcaagagtcttactctgatgtcagcttgtatatcactgatgtctggtctgaatttgactataccatgcaaactacttttagttagtaaagttagtttgtttaacaaacaacaggcaaaaaaaataaatgaaagcatacttttcattaggttgggttcaatatacggagagtgccctgtgccaaagccacgagttgatcgtccaagaaaagttcctgtgatacaagaggagagggcaatgcctgcccaggtttgttttaaaatgttgcttttaaaaaaacacattaaagttaaaatagctgttaaaataatgtgcatgcaatttggccattttttctaagtgtgcgggtctggagccaggttttgtcacttaaataatcattttatttaagcctttaagcattttattggattggctgcttgtctttgttttaactcatttctctagttttgatcagttctccgaagccagggtcaacctcagcactgtcaacatttacggctggataatgttggtttggggagctgtcctgcgcattgtaggatgcttagcggcatccccagcctctacctgttatatgctaatagcccccccgacccctgagttgtgacaaccaaaaatgtctacatgtgacaacaaatgttccctggggaggtggggggaaagtcacacccactcgagaaccactgtttctaaaccgcccttttgtattttgctattttatgttcaacc

SEQ ID NO: 63286 - DNA, 1144 bp, Homo sapiens
ccagcgtggagaggaggaggagagaagcgggagaaggccctctcttccagaggctccttttcagcactgccctccacccgcagtctgtcttccccaggatcacatggaattgttctataaatgtgcattggcttaaggttgggaacgccggcctgggaggcagtggcgtgtaagcaatctgacccaggccaggcagcggctttccagaaggctctgcagcccagagggagagggtaataaggagcagggagcctgcaggtgccgccagcctccagctctctgtgcttctcactacacatttatttgggatccgaagccagtgtcaactaccttgggctgcaatttgatttacttgacttatattttggctgggacaagccacttttcaaaacaaagcaaccataaaagaagaaaaaaacaaggcataaaattagcagtgcttctagtaaatagggacaggtcatcaccagcctcagctgacagtatcaagcagtccttttcaaacatgtcaatatgcctcctttagaaagggagaatgagcagttagttaggcgagttctaaacagcatgtcacctacagtttcatcagtagccagggaattaaagatgcaatcatacaatgggaaacgaagcggctggagaaagggtgaggagctctttatataccgtcactgaaaactctccaagatacatcaagtgaaaaatattaagatacagaacagtgtgtatgatatactattgtttatgtaaagaaaaaagaaaggggctgggtgtggtggcttacgtctatataatctcagcacttggggaggccaaagagggcaaatcacttgagctcaggagtttgagaacagcctgggcaacacagagggaccttgtagagtctactaaaagtacaacaaaaaaattaggcaggcatggtggcgcacgcctgtagtcccacatacttgggatactgaggtgggagtatcgcttgagccagggcggttgaggttgcggtgagctgtgatggtgccactgcactgtagcctgggtgacaaattgagaacctgtctccaaaacaaacaaacaaaaaacaaaaaacaaacaaacaaaagccccgaaaggaggatatacatttatgtgtaaatactacattataaag

SEQ ID NO: 63287 - DNA, 1018 bp, Homo sapiens
tgacttctatcaccattgattggttttgacagatcttgaactctatataaatggaagcaaatagtatgtatgctttgctctctggcttattttatacacggatacttgttgatttaaaaaaatttttttattgtggtaaagggcagaacataaaatttaccatcttaaccgtttctaagtgtacagttcagtagtattaggtataatcacattgttgtttgaccagtgtctctgtagtttcttagctgagaagctggcatcattgatttgagaccttattaaaatataggcattttagtgctataaatgtcactctgagacctgttttaactgcgtcccacaaattttgatatttctgttttcattttcattctgttcaaatactttacaatttccttctttctttcttcttttactcatggactattcagaaatgtgttattgtttccaaatagttggggattttccagatatctttctgttattgatttctaatttaatttcattgtagccagataagatactttgtataatttgaatcatctcaaatttatgcacagaatatggtctcccttgtacgtgttccatctgtacttgaaaaaaatgttattttgctattattggatggtgttaaaaaagtgttaattaagtcaagttggtcatagtgttgttcacgtcatctgtatccacactgattttctatccacttgttcaattattgagagaggggtttggaaataccagactataattgtggatttgtccattactcctttcagttctagcagtttttgcttcttgtgttttgaagctctgttatttgataaaaatttttagaatttttaatgtttattttagaatgtataaaattttagaatttatatggataaattgaatcctctatcattataacattatgttctttatgcctgtaatattttttgctgcaaaatctactgtcttaaataatatagacacaacagcctgattagtgtttgcatagtacatcttccccttc

SEQ ID NO: 63288 - DNA, 1044 bp, Homo sapiens
gcacctgtaatcccagctacttgggaggctgaagcaggaggattgcttgaatccaggaggcggaggctgccatgagctgacatcatgccactgcactccagccttgggcaacagagcaagaccctgtctcaacaataaaaaaaagaaatcaattatttttctttataaatgctccagtttcatgtattctgcgataagcaacagaacacagactaagtaagactgactagcctctgagaactgccaactcaaataaatgttaacagaggcagcagctgtggtggagatgagaggattcgaggactgaaaggtgatccccagctccccacattcctgcctgggccctcaaattagagactttcccaacacttctgagttctcagtgaagtatgatgcttctgccatattctttgcccccttatggtcacgtccattggaggagatttctccgagtggtgatatggggagagccagcccccgtgagtccagtttccccatgggtggggttaaggtgttcgaggtccttgagatgaactaccacaatgcagccccttctcctctcgcagctatttgccacgtgacgagctccctgggccagccttccccatccttcatggcacctgcactgatgcagcttgggacttggtggggaaggatggttcgggggtaggtaggaggattccggttttggcatcctgcagcctaaccttgccatgatactgctgactttctttctttctttctttttttttttttttggcagcaagatttattgtgaagagcgaaagaaaaaagcttccacagcgtggaaagggacccgagcgggttgccctatactgttgactttcttatctttctctgactgtggcatctatttcataatttagagtctggtggaaagggttgcgattaattagctccccaaaccccaccaacatttaggatgtccaaagtgctctatttcctcacacattctgagggcttgtcaagatctgaattggcccatgggatatgttgtgcgaatgacttcttcaggagaaggaa

SEQ ID NO: 63289 - DNA, 1009 bp, Homo sapiens
gtttagtacatggcaactctctatctttacggctttgctttatggttttgccgactcctgaaaacctggtcgtgcaggggccatgtttgtgttttctgtagctggcctccttcctccctttaagcattgcatgtgtgtgtgtttccagaactatgcatttaagaacccatctgcatccccatcatctgctcagaccttggttgtggcagatgaccccctgccagcccctgcccatgcttctcccttcactgtgctgtgtacatctggtctgtgatggaggctctagtccctgggccctccctgacctccacacagaggcagtgcccccagagggtgaaaggcttccattcggggtgctggcctgcggattctgagcagaggctctatcccacacatttcaactcaatctcgaagcataaaaggatattatgtaagcttcaactaatgcacagccctcaacagatcagttcttagaatttttcctgcccttaggcagatctgctcctggtgagcagctttaatctggctttaaaaattacttctgatggataatcaaagagattgctggtacccagcttatgctaaataaaccaatgtctgggttcttatttgggaggagttgttgtgtgtcccatactccatggaaaatttgttcctggttgctttctgataagaccgcacaagtttacaagatgccaaaatataatttatcatcttgttccagatggtaacgacttcagccagcctgaagggaagccacatcctttcctaagttggcagttcctgtcagaggcgtggacaagaaagtggcttcgtttctttccagcttgataaagccgacataaataggagcacttcatttctgaattacacaccattactcttatcacatactaaactgtttgacttcagttaatgggtgggacataatgaaatgtaaagtgcttgttacaaggaaaattgccaggtccagatgctgagcagcgaagggtgggggaggaggcatcgg

SEQ ID NO: 63290 - DNA, 1042 bp, Homo sapiens
cagcactcaagtgatcctcccacgtcagcctcctgagtagctgggactacaggtgtgcaccaccatgcccagttgattttcatatttctttttagagatggagtttcgccatgttgcccaggctggtcttgaactcctgagctcaagtgatctgcctgcctcagcctcccaaaatgttgggattacaggtgtgagccatgcacccggcctcttcctcttcttataaagaacaccagtcctatcagattagggcctcactactataacttcacttaatcccaactgcctccttaaagtgcctgcctccaaatacagtcacattggggattagggcttcaacatatggatttgaggggggcacagttcagttcatagcacatattttaaaaatttaacaataatgcacttcaccatctcactgtatgcatccctcatgtatgaatgcatgtgcactgcctggtgtggaaaactggaattttggtagcggacattgagaggagaatctttccactagccccctccagaacgctgtgggcttatgtgtgtgtgaatatgtgtgcatgtaacaaacagttacaaaaagattccataaattttcctttgatatttcccctataataactttaaagaaaatggtaaaagctttagaaaaaccatacttatgttaactttgtcttgaggaatttctcttgttaatagaatatatatgatcataacaagtatatagaatcacaattatgtaaaaataacaagaattgtacccccaaacaattgtgtaggaaaaatcaggaaattcactagaactctgaaagtggcaagcatgtagcagtattttttctgatttttttttcctacattttccacactttgtgttggccacatattatttttaaaattaaaaattgcacagcattgactaggcgtggtggctcacgcctgtaatcccagcactttgggaggctgaggcgggcagatcacgaggttaggagatcgagaccatcctggctaacatggtgagaccccatctctactaaaactacaa

SEQ ID NO: 63291 - DNA, 1082 bp, Homo sapiens
tgggggtctgtgtgtcccccactctgagaaacaggcactcttctcactctgagaagcaggaactcacaatgcatagaaatgtatagaatgaaatgtacagagagtggctgtgcatttctgtacattgtatgatcctccctgtggaagagcctgggactcagagacagcctcatgttagtttcaggttgttctgcagaaggtgcttgaatcaatttcacctacgtacatatacaactatcttccctgttagtggaaggtctagaatttggcattttggttacatagcactaatgttcagatgtgtcgttctggattaatcttggatatcaccaagcttgtcgttgctgaatatgtgtttaaaaggagtcgttctctctttgtctctctcttttttttttttttccatttagggaaatggttggaaaggtattttcaagtattagtggattttaagaggatcaaattgttcccagatgcttagggtctttgtgtaaacctaggctgaatggggaagggcaattggattgaaaagtggagggagggaggacagagaggacagctggcctcccattaaggaagccctggctggacctgaaagcctcactggagccgcttctctcttgtcctcccatgcctccttcccatttggtctctgtttcttccttttccctccactccgttctaaaattaccagctgtgacaccatgttttcaagtttaagaataagcttttagaggatggctacaactgtataaattaaggaaaagagaaaacaacattgaagcatggttctcttagcagataaagccaggacaacagacctcacccccgattttatatgacataggaaatcgacacttggtaatgtcacttacagcaatactcttctcagatgggaggcagttaagttagacagatgcattcacatctcattggcctcttattggcttcgttaccttggataagctgcttaacttttccatcctcagtttctctctctataaaatgggaagataacatctctcttttaggattggggttaggataaaattggaatgtttccaaagctcctgggataatgc

SEQ ID NO: 63292 - DNA, 1026 bp, Homo sapiens
ggcccagactgtaaagacataagaggcaggaactccagtgtggctgagagatgttggccagacccatgtgcccatgtctctgggtgacccctctgcctgccttgcccctccctctacttgtagcctgtgatgggaccacattctggttcaagaggctcagacaaacgttgttctgtgaagccttcccgacccttccactccccaggagtacccctacctcccaccagagtagcgaggttcctttctgtagcctgacaataattttaagacaggggcaagtgtattacagtttggtgaatcagattttctcatttgcagaagagattgggtgttttgagctggacagatctgggttcaaatctgctgcttattcattgtaggacatttgtcatattagtctcatgaggtctcagtttcctcacctgcaaaatgagtataaaattaatacttacctcatgaggattcagtgaaatagtgcactggaaatgcttgaccagagctggcacatgtatcacccaaggaacatctatcactattggaaggagtcccctgcaatggcagggactgtgcctggtccccagtccttagcacagtgggctgcacatagtagcccctcaacaaatgtttgtagaatgattgtgtttagctgggcagggtggctcacacctataatccagcactttgggaggccaaggctggaggatcacttgagttcaggagttcgagaccagcctgggcaacatggcaaaaccccatcttttttttttttttttttttttttttgagacagaatcttgctctgtcgcccaggctggagtgcagtggtgtgatctcggctcactgcaagctccgcctcctgggttcatgccattctcctgcctcaggctcccaagtagctgggactacaggtgcctgccaccatgcccagcttttttttttttttttttttttgtatttttagtagagatggagtttcaccgtgttagccaggatggtctcgatctcctgaccttgtgatctgcctgc

SEQ ID NO: 63293 - DNA, 1004 bp, Homo sapiens
gccaaaccctcacactactgcggctgatccatcaaatagtttatttttcacctttgccctgatgtcacttggacatctgactgtctcctagagaaagttgtttttctgccagagaaggtacagcaggcagggcattgcttcctatttagtcgaaggcttattttaaattgggactaggccaagttcaagtgcaggagcacactggcccctgggagagcctggccaggtacatttggcttgtgagaccagccgtcagcactttggctcatggaacacacgtctgtccgagcagtgcagacctggcttgtgtgaactgggctctgtgtgccctcagggaaaatgccgaggccacatctagaaattctggctgaggctgagagccgtgtgcagagctgcccccacacatttccttgtgtatattttgggttcaggctgacatttcctcttagcatgggtggaggtaatggctgaatttttaggaggcttgaatcccttctacaaatatgcctcctcgccctgtaaccaagttttgctgggttgcagttcaggaatgtatcttgctgcttgtacagcccatcatggaatgtgaggacttagctcagaagactaaagcactattccttctaggaaaaagaaaaaaaaagaaagaaagaaggaaagttcctcagagttcaccagtgaaatggatcttatgagtgtgagggctgaattcctatgatatggctgggttcctcatgtcatattcccctcctgacatgtctagagtatataagaaataacccacagtttagctgtggtcactgtagactggttaggagtttgagttctgcacacacagagcctatgtatgaaccgtggcactgctcagtgtggcctccgggtgagttcaccactcaaagcctgcttcctccattgccagctaaggacaacagcagtacctgctgcataggctcattaagagaattaaggcagagaagagatgggagccacttagcagagggcca

SEQ ID NO: 63294 - DNA, 1050 bp, Homo sapiens
caatgtctgtgaagttatgagttggtgtgctcatggcatctttttcctaatatgtaaatgcataactattgaaatactctaatctgagaaatcctaacgtggtaacactgacttatcctctaaaactcagcttaactattccctcttctggaacatctccccttacctcttccaacgctggttaaaatattcctttcccatccctgtcatgtggtagccatcgttatctgatgatagacgtaagcataagaaccatgttgcatctcactttttaaccctagtgctttgcacagggccaggatgtagcagcacttgataagtgactttgaataactagatgaaactcctttagtctagggaagttcatgctgtctggcatgcatgggtgcccctaacaggacgctccgtgattctgtgaagatagtgtgctgtcactcagggcgccagcattccgaagcttctctttggatgcccatcaacaaatcagatgtatgaactttgatttagactcccagctcccagcaaggaaccagtatgctctgtgtctggggagtgtttggcctctgaccttccgcatcacatattgcctgtcagttacccagccagccttggatgcttccagtctctggcctcatttcccaggattgataagggatgaaattgggcattggcagtctgggatggagggggaagtgatcaggggagaggcccttgatccagtggggcagaagtgagccattcgatggaatggaggtttccttcagcctcctgaagttactttccctaatatacatcataacctcaggttcttcctgctctgaactctgactgtacctggtgtctgctggtgttttggttccgtattcctgcttcttgcctctccagcatgtgcctgtctttccacgtagcgtcctgtcttaaacactttttttttttttgagatggagtcttgctcttctcacccaggctggagtgcaatggcacaatctcagctcactgcaacctctgcttcccgggttcgagcgattttcctgccccagcctcccaagt

SEQ ID NO: 63295 - DNA, 1966 bp, Homo sapiens
gaaggaaatcggagcagcaaataggccagcagccaccctccttgtgcaaatgccacagcaactcagctacccagagtcactagtctctcatcaaaagttacatcccaagcctcagaagtgtgatcatggaatatgacctgcttgtattatagttattcatataccggtgttatggaactgccttatggaaatcttcaggtcaaatgctgccgcctctgtggaacctagacaggattagccccttgtctctccgttccagccgtcctcttttctctcttaaaaaaataatgttcaagaaacgtgcttgaacatttaaaatattttagcaagaaggaaagttaaagatcaaggtttcgttttacagatacgaaaagagagactcaaagaagtccagggtcttggccagggccacacatcaaggtaggactccaaccccagaccgcagacacttgccctggtgttctctgcgccaagtcctgcggcctcgttggttttattcggctttgtatcctggttatttgtgtttgatgcttttatggagacagacactgcttgaggaaggatatgtctggttcacaatgccacgccacaagagtaacacagagcctgggaggtagatggtggttgaattgaatgacacagcccccaccttcaaggaggtaggtaggtgagtgtgtgtgtgtgtgtgtgtgtgtgtgtgtgtgtgtgtgtgtgtgtgtgagatacctgagcatgcacatatggggcaggctttgtggtgaaggataatgccccaggaggggatgtctggaaatgtgggaggatatttttggttgttccagtgactagggagggaactgctattaggaggatatttttggttgtcccagtgactggggaggatgctattggcgtctagtgggggagggctagggtcactctcatgtgagagtcctgcacagcagagaattgcctcaccccaatgccaatagcatctcaatagaggatgctgccaggctttgaggaatcatgagagacagttctaattgggaggatgaaagaaagggtctctgggcttgcccagctctgggctgtaagcgtagatgagactggaagagaatgagggcttgatggggagcacctgtgtgtgtgtatgtgcatatgtgtacatgcatgtgtgggtgtatttttttttttcaggacttggttccatagccaaaagcgaagcgttcttggatttactgtagctggggtttagcaggtccttgcaacttttgcacagatgatcaggaggtggtttaggaagctggcaataaaatcagtaactagtgctggctagaggagcatagagatggctgcagggctgggtgccctcatttatccccttgtgaccaaggtctgtgaaatccattttggtggctagctgtgttttttttctgcctctcccctattgaggtcgcagtccttggttcataaccccagtaatcatgttcacatcaactccctgcgatgacagaacatgttgaggattatgaaatcattcaggagaaacgagaggcctgagaaggaagacccagggaaaccaaagtttgcagagcaatgcatctgaaaaacagaggagcaagtgaaattctccagggaatgtagagcagccgaccctttgtaatggaggtgtcatttcagatgtgttgagtgtcagctctgtccccatccctctgtccgctatccacagtgttatagagtttcagtctgtcactttgcaagtgtattcatggctgctaattgagataaagcaaagtccccaagacttattttccttaggttggggaagggcagtattgagaaagcccagaatttatagacaaagatcctatattggagttcttgccctaccccttaccagctgtgtgaccttgagcaagtcgtgacgttgtgaactgtctgagtcaccttccttctcgtggatggtggggccgcttatccctgc

SEQ ID NO: 63296 - DNA, 1024 bp, Homo sapiens
aatccagaactgtgtgtgtgtgtgtgtgtgtgtgtgtgtgtttgatgttcaaatagtcccagatttgacagtggcagccccttttaggtggttcttatgtcctttgacgcgactcccccagctgggaagtaggtacgtgtatgtacacatgcatgtgtgcacacagccctccacaactagttctggatttgtctgattcctctgattgcagccctgccctgagggatctctggagtccaaccaccttctgtatatgcaagctcctctctgattgtgagaacctggctcctattatccttgatactggatactattctttgtaataaataacaaggggaagggaacagaagcctttctgacagaaccatcctggagagagggagggagaagctttttttttttcatctggaaagccctttgcacacatcggcctattgaagcactttgcttgattcagctattctcctctcaggacctgcctggatcatcccagcctgtagaatcctgggtttctgtggcagtttgttcttctggtatcacctgctatgctctgaatgtttgtatccctctcagccccgaaattcctgtgttgaaatcctaacccctaaggtgatggtatgaggaggtggggccttcgggaggtgattaggccataagggtggagcctttgtgaatgggattagtgcccttataaaaagaggccccacagcactgccttgcctcttctgccacgtgaagatgcagtgagaaggagctgtctgtgaactaggaaggggtcctcatgagacactgaacctgctggtgccttgatcttggacttcccagcctccagaactgtgagcaatacatctctgttgttcataagccaccccatctatgagattctgttgtagcagcctgagccaatgaagacaccacccttcacagttctcctttctttggactttcagctcctcgggcttgatgagcctgtcacccctggagtgtgtgatccccatggaatccatcccagtgcccgccttgg

SEQ ID NO: 63297 - DNA, 1052 bp, Homo sapiens
actgcaaggcagaaggtggcagggggaggcaggtgagtgggtaagtagaagtgacagctgacggcctgagagcgagggacaaggctgagtcagagttctcggtgatcaagtagtctggcgctttcacttttacagacagaaaggctaaagctcagagaagtcccctggcttagatcccatggtgggcctggactggaatccagtcccctcaacttcacatacggtggttacatttggtgccacagcactaatgtcactcacttatgtcatagttgccgaggacggctgagtgtcattgagcaagtatttaattatgttcaagatcctctgtctcaaaaaagtcagggaagtgtttatgatttgaaaaataattccattccaaagagtttaggtgaaaatgccatcacgtagaatatgtgggcagatatcttttattccagatcttctttgctgggacctcattttccagtggtgcctaatggacgaagcctggccgcgttcccgccctggaatgaggctgacaagcctaggtcctcccagtggaaaatatgagtacagaagtggggaaaagacagtggctttctgattgtctccatctctgaaagctttcactgagttatacatggaagttgttccctggcacttaaaataacttcttacatatggtttctaatttattttacttacaaaagtagtatgtgttcagcatagaactagaaagtagatataaatttcattaagaaaaaacacaaatgatttcaccaccgaaagagaattaccgttaacaccttggcaatacttgtccaaattgcttcattgttcaggctattatgcttgcgctgtctctctctctctctgtcacgtgctcgtgtgtgtatgtctatacatagactgtatagacacacatacccatgtatatcattgatacacataaaatgtggatcatgctgctaagttttttcaacctatgttcaattaataatggacatgtttgcatctagatacatgaagatctatcttattttaattattattattattattattattat

SEQ ID NO: 63298 - DNA, 1059 bp, Homo sapiens
taggaattggtgacttggaaacctggccaagggctgtctggatagacgcgggagaaacgggatgggagaagcagctgagcttcttgcagggaggaggaagccggatccccggtgctgggcaggaggcccaggagacaccccttgagaaatgctaccctgagctgcagactgtggcggctgtggcgttggctcttcaggctttcctgtgaggtgcccccacactcccggccccacccgccctgggcagctgccccaaattgctcccttccctctgtcaacacttctccaagactccagagtttttcctgcgcaggaggggaagggcagaaacctccccattccctccacccgagttagagaagtcagccctttggaaaacatgatgcatcttcgctctggagccagttcgccagtccgctccccagcgcggcactttgccttgtaggcggggtgcagatgagcctctctgcctcactagggaaaggggctgggttgttgggctgagggtctccggggattagactctgcgctgaccaaactgggctctcgtggcatcattccttggttacgcaggtcaagtttccattgttctcttgcctctgaggcccactgggtccggggcagactgagcataactacgctgagccacgtcaccggccggtgagacgcgcggaggcattgatgggtcccctggttcccgctcagtctccgaaatgtgagctgccgcggagtgggtgctgggctgtcccgctggcttcagcctgaggagcaggagcagagggcgtcagttagatggtggctccctcagttccgtgggcccaggtctgcagttcttttcctccttctgggaggggaggggaaggagagccggcagcagcggggctccctggccctactctgggggcacagctgggagaagctgcaaagcttcagcttgtgacgccatctgggcggcagtcccacggcccctagagcagctgggaaggggatcccgccctgaaatggggctcagggaggaacatatgggcaggcatctgtgagggcgtggctggacgtgct

SEQ ID NO: 63299 - DNA, 1106 bp, Homo sapiens
tgtaaatatgccatgcatttagtttttgccaaactgatgcctaatagcctctgcaggctgttaggaaaccttgtcatgcctgtgtccagctctctctcacaacgattccttaagctcagcaaagatgaagcaggaatttggtcagtctgttgtcacgggaagattttcttcccatgtacacatcaactgctgaagatctgagaatttaggaaaactaatctcttatcctcagacacaattgtatattaattgcagctggccacagttaggcagggtgtagagggaattatacagacagggcctctcggctggttatggaaagagggaaatatttttaggacttgcaaacacgcatgcaggcgcgcacccacccacgctgacacgctcattcacttactctgcccacggactttatgctatcaatagatgctcacggatgctatttctggcccggctttctggatttctgttccttcatggaggcttgagtcagcagttctgagcctcagcgcctggtttttgctgcctggctcacaagaagggcagccctgtgccagcttctgtctcgactgctgcgggcaggcgtgggaagaaatttaccccagatgctgcacattcaccccagggcagtcacaggtagctgctgtctctgttcaaaatgagggaaggacggagaggcagggaagttctgcatttgctttctgtgctttcgtctcggaagcatctccaccaccgggccactgaggggagcccctcccaccacagaggcgcagatccgcccttctcaacctgcctctccagtccggcctcagaaaccagctttgctgttgattttggcagctgggagacgccatctctgtttacacccaaatgttttccttaaaaggccttttattcctagtacaaagtagcctctagaaccagtgactttaaaccttagaggaactccgtggattaacacatcaacattcaaagcaaatgcgacatcaaacctctttaaacaagaaccagaacgtttttgtggtgcttactgaattttctgttcttcttggaaatagtttccggagaagaaagatggataacattggttatgtttttgatcctag

SEQ ID NO: 63300 - DNA, 1025 bp, Homo sapiens
gtagacttttttttttttttgagacagagtcttgctctgtcacacaggctggagtgcagtggcgtgacttcggctcactgcaagctccgcttcccgggttcacaccattctcctgtctctgcctcccgagtaactgggacaacaggcactcgccaccatgcccggctaatttttttgtatttttagtagagacgaggtttcaccgtgttagccaggatggtctcgatctcctgaccttgtgatccgcccatcttggcctcccaaagtgctgggattacaggcatgagccaccatgcctggccaacagggtcactctttcataaacagttctgagggcttctctcagttctttcatcttcacgttctctctttgaagccaccttctgtcctcatcctggctgagtttctcttcttcagttgctcacaggtctgactgtgccagctgccctttcttacagctttggggtaggttttgagcaattctctggtgtcactttaattgactccatgacatcctcctccttcttccaggtttgcagttttgctttctggtttttggcactgtatatttgctccttcaatcagcaagagactgccaaagactagacttgtgaggacatgactgggcacagtgtctcacgtctgtagtcccagcactttgggaggatcacttgagcccaggagttcgagaccagcttaggcaacatagtgagaccacatctctacaaaaaatagaaaaaattagctaggcatggtggcacacgtctgtggtcccagctaatcaggagactaaggcgggaggatcacttgagcccaggaggtcgaggctgcagtgagatgagattgtgccatcgctctccagcctgggtgacagagtgagaccctgtctcaaataaaatacagtaaaatagacttgtgaagacaggaggagcatacgagggaggatcaagtctatacatggttgctttgttgatgacattgtcctaatgctgccctttgtgttctcttatgtaaccttgttacca

SEQ ID NO: 63301 - DNA, 1095 bp, Homo sapiens
taatttgaaaataaaagtgagtctcgactggctgtgagattacaggtggctcacacttgtaattccagcactttgggaggccaaggcaggcggatcacttgaggctgggagttcaagaccagcctgggcagcatggtgaaaccccatctctactaaaaaatacaaaaattagctgggcgtggtggcgtgcacctgtggtcccagctactcgggaggctgagggaggagaattgcttgaacccaggaggcagaggttgcagtgagctgagatcgtgccactgcactccagcctgggccacagagcgagagcgagactccatctcaaaaaaaaaaacaaaaacaaaaaagaaaacccaaaaaacaaaagtcagtctcatctgtgtttactgacttcttttctaggacatttgggttacctccctgggtctaatagtaaaattcccagtcttccacctctgtcataactgaatcaacagggtttttcctgctgaagagtcacctgtagagctgtccttgcttgtgaagaactttgaaaggttccaggtgtaaatatggtgaaggtggtagaaagagatgccgtaaatagatcagccctttgcaaggagagaacaagagaaccttctggaaaagatggggcttcaccgaagcttgtacttaagcccaagaaaccacttagactcccagaggtgagcaggtgagatttaatgttggcatgtaagaggttaacagaatatctgtaccgctgcaaataaacgaacacaaccatcttctgccttttctctattcatcataagacagagttttgccaggaccttctccccatcctctgaggtctcgtgcggcatgtgtttatggggctctggctgtgcttggggcaccctgcatggctggagagtggagacaccagacacagacacacctgagactcttaacaaggcaagaaagcgccaaggcatcaatatgcaggcagccgaggggatgggaagaaagaagtctgggggctggcagggagcagacccctccagggagctgggggagctgggatgtgattttctggaggaattgagagagatgcagaagttgaggagggggcag

SEQ ID NO: 63302 - DNA, 1025 bp, Homo sapiens
ggaccacagttatgcaccaccacacccacctaattttgtttatttttttgtagagacaaggtctcactatgttgcccaggctggtcttgaactcctgggctcaagcaatcctcccacctcggccaccccaagtgctgggattacagatgtgagccatggtgcccagcccctctcctggttcttgattgtgtttttgacagccgtgagatggtgttgtcccactaagtaatatgccctgtcactacatcataactttgcagttgttgggattctacgtaaaagcacttcactttaatgctgccttaatttcctttatggtactatacttggggggaaattttttcttataaataagaatcctggtcctgggcattcatagatggtatttaatttactttttccaatgcccttgcaaaatagatgcttttcctcttttgccagctgaggaaataaggttcagtatggttaaacagtcggctcaggccacacagctaacgagggagaagtcaggatttgaactcgagtctcatttcaaaccctatcttgttatcgcagcagaacctttacctattaaggctaaggacgtttagatggctttgtgcttttgcacctcatctgaaaaatgtttttaaaagttggcagatgagttctaattgtggttcctcatttttttcctcatgtattttctgagtacgaggcttggctgaaggccagttcctaggtgcccagggaaagggccactttcttcaaaacagtagtagcccaggttagagcttacagatgtttcagctccacgtggtaagcttctttgggccctcacctgcatatggagccgaagaggtctgttttctgacagagaaacaaacccccagggtgctgagaatggtgacaggatgaacaggttgcaggatccttgccaccaagtgacatccaatgctgacagtgagtgacggcttccccgggaggtgctttccagagcacacctcgtcacaccaccccgacagccaccttccccgcaagattga

SEQ ID NO: 63303 - DNA, 1061 bp, Homo sapiens
ctgccataggccagggacagggatttggctgctgatgggtgacatgctgccagctacagaatggggctgactgggcactgggagcttggtgatggggtgtcacggacattcctacaggcccagcccgtgtttagaatcacagagctgagccgatgcatgtcacggagaactgcctttgccctgtacacgcatgctgcattaggggcctgccttgggcggctcagctggccgcgcctctgcttgtttagggtgagcctttgcacagggcttggctttgtggagctcatttggtggccaaagatggtgttgcagccccagcccgctcgcaggcccagtaccttttgctccctagcttgccccaggccctcagactgtgcggtgcaaaggtccttggaggctagccccgggctggctgtgaggggagagccaggtgccgcagctctccctggtacagacttcagctgcctccaggacccggggcctgaaggaggcagaagccggcggtggaaaagggcgcacgtctctcccagcgtcgctcccgctgcccgctgcccactgcagcctatttacctgttcctccagccatccccttagtcctgggccgggagagaccatttcctccttcctggagggatgagccaacagggctgagccccctactctctcggtggtcagcccgcccgaccaccacgcccctcctttctagggccccagctcccgggccgcggctcgtttgcatttcaaagctacacaatgcgggcggtcccggcgaggcgggaggggccggggcagagggagggtcttcgcctccccacccccagccccgtttccggagcccgcgatggagctttgtgaagatgcaggcgttggggctgctcggcgatgatgacatcatcgtgtcacacacaggagccggctgccggggggtttaagagaagagcctttcggaccacaccggcgctcacgctcatacccgcacgccccgggcagagccgcgcacgccggccacactcgggcgcgcgccggccacactcgcgcgcacacatacgcggcgctcgccc

SEQ ID NO: 63304 - DNA, 1050 bp, Homo sapiens
gtaaagggccgaaccgtcctgtcattggtggaggcagtgcttgactgtgcatcgatccaggaatccgatcttttctctcaaccacagagctaacgtgctcagaagtggcctttatcctggccgagtgtttattagaattcacgtttctgttatggtcgtctccattacctacccaggcatgtttggacgatggggcgtattgaatgggtctgccggccgggtcgcatttcagcaactcaggcttgtatccaaagtggacctcccagcctcacctgcccccacttttccagagagaagactatgtttcagagaagagtattttctggggacttgggggtaggggtagtaaagtgggttcttaagagtcatggatgtgtagattaaaagatggtggggattgatctgtgtgttgtaggagggatggggccccggggggtacttcctcactggtccctcgacccctgggcttcagtgaggagctggctcggcgtagtgatgtaatgctaggctgagcctcgtggttttctgggctccagctctttagcagggagtcattcttccgagcaggtgtgcacccatcatttgtcttcacccctgtagcttgagaaagcatcgtcttacaatggaggcacatcgcgtttgaggattttctttttaaatgttatgatccttgtgctgtgcctgccttgtttctcatgcacgtgtagtgttgctaggtgcatggaaatacaactcgagtctaggcagaaaagaaccactttaacctattttttgcaagtccctatagtggaattgagttaatcagtgacaggcactggccaactctcacggctcagacctatctagtgaagagcttaggaaacagaaaggacaatgtgactgtacgtttgggaaaatgtgctcctcagtcattggaaattcagctcgccggtccctaacgtccccgccctctttttcagctgagttaataaatgatcagtgttccgtcagctgagggccgagtttagatagcttctgttaggtagctgtgcctttttggataaggtccct

SEQ ID NO: 63305 - DNA, 1145 bp, Homo sapiens
tgttgtatttagagcaaaggctcttgtttggaggcagtgctccatgaaggtaggcctggttctatggaatttccagctctagctgtcatgaatgggctggttaccttgggcgagccactttagctctctgggctttagctgggataagtgtgttggaataggatatgatctctaaattttcttccaacttccaagattttatggcctttgcaatttattatttcaagcccttaaattatctccagtaaaacttgagcaaatgtaaccatttaatgatatactgggaaccatatctatagtacctctttattacaagatgcttatgttttagttagagatatactcacatgttcacatatgggtgtatatatgtgtgtatgtgtatattatgtatgtgtgtggatgctgatcttaaactattttgttgtcgtagttcatagaagtaaaaacctgaaaatatttaaaccagatcacaaatacagggaaataggctcttagggtctgcattttccagctacctgactcttgctttggggccaatttccacgcccttctttcacacggtgtgtcagctgtggaggtgtttaattcagcattgtgtggagcagagcttttccgactgtgctctgtgggactctagagaccaagaaagtacttgaaaaaacgtttttaagccgaactagtacacagtcgaggagctcggcagggtcctgttttcgtggccagcacagtctgtccccacctggggttacgttgttccctctttcctgcttggttgtacacaccgcactgtgtgctattggataccattagcacattgattgcctggtacggatagattaattcggttggtacagctggttgaccctcctgccctgtctgccttattaaaaattattgcatgaacacaggacaggccgttaaaaatcaggggctgtttgtgatgactcatgggtgcatctcaggactcttcccagtgatgtgcagcggggggagaaaccaacgggcatccggctacctcatgtctccagcccccagtgtcaggtttttgagttcctccaaacaacttaattgctctcgatgatggaccttatacaagcatattgtaaattgctattacattacatatcgtaaaatgctattac

SEQ ID NO: 63306 - DNA, 1098 bp, Homo sapiens
tcactgtagatgtggccactgtgggcaggtgaggtggccgtcctctcactgtagatgtggccactgtgggcgggtgaggtggccgtcctctcactgtagatgtggccactctgggcgggtgaggtggccgtcctctcactgtagatgtggccactgtgggcgggtgaggtcgctgtcctccccgtgtgaacacagccactgtgcgcaggtgaggtggtcgtcctctcagtgtagatgtggccactgtgggcaggtgaggtcgccatcctctcagtgtagatgtggccactgtgggcaggtgaggtcgccgtcctccccatgtgaacatggccactgtgggcaggtgaggtggccgtcctccccatgtgaacacggccactgtgggcaggtgaggtcgccgtcctccccatgtgaacatggccactgtgggcaggtgaggtggccatcctctcactgtaaatgtggccactgtgggcaggtgaggtggccgtcctctcactgtagatgtggccactgtgggcaggtgaggtggccgtcctccccatgtgaacgcagccactgtgggcaggtgaggtaactgtcctccccatgtgaacacagccactgtgggcaggtgaggtgcccgtcctctcactgtagatgtggccactgtgggcaggtgaggtaactgtcctccccatgtgaacacagccactgtgggcaggtgaggtgcccgtcctctcactgtagatgtggccactgtgggcaggtgaggtcgccatcctctcatgtctcctcacctggctctatgcaggccccaaactctccatcgtccttccagcctgggatgaacggggcttggatctggtggctgtgaacccatatacccctggctcgatggccagggcccccaggtgcagtgccagcctctgcctggactgcatcagaatctccagtggtctcacctgttccctggtcctgggcccatgaaacactcacattgtgaagagggagcagccggcccaagagggcccgagtgcctgtggcagccagatccaggcctgaaaaggctcggccctcagcttgctgtgtgctctggtccgaatgtgtgtgtccccg

SEQ ID NO: 63307 - DNA, 1051 bp, Homo sapiens
cctgggcagcatagcaagactgcatctctacaaaaaatttaaaaactagccaggtgtggtgtcacgagtttggctagccacttaggagggtgaagccagaggatcacttggagttcaaggttgcaatgagctatgataacgccactgcactgcagcctgggtgacagagtgagaccctggctcttcaaaaaaaaaaaaaatgacgtgtggcatgctctaggtggagccaggatcagcccagggctgctgaagtcccagctgtctgaaccgcccgcacagcacagtggggctgtcactccaacagtgctcctgggtgccttcttacttcttaccctacctagcaaagcctccccttaggtgctccccatcctcactatggctctgtcacttagatgctcacgaggcggactctgctgggaacaatttggtttatgtaaagacactttaatttcttcatcactaagtgagttagcacggtcagtaactgtccccacagtgcctcgacggcacttttccctcttggtttctgggaattgaacagaagtttgagagcagacatacgagagcaagatagacctcaggaagcagaggagcacagccccacccggtgggggttcctggggtctctgtgagatcctgaacacccactggtctgaggacagaaggcagccatggcacgggcctcctgctctcttgctggtcggttttgggtttggtttcttgagctgtctgttttggaccacatcagaggagggtgggcaccaaaggacagcctctgcctggtacttctgcagcactgatgcctcacgcctctggggtaaaaaccccacaggaacttggagctcaaaggcccatccaagcttatcctcaaagctgactcatttttgtggccaaatactaaagtgttacccactggaggtttaagaatgaggataggcccagatagaagcagatgaggtgagatagcccagttccagacttcccgatgaggaggcgcacctgtggcacctgttacgatgggggccctgagcccccaccccagccctgcaga

SEQ ID NO: 63308 - DNA, 1040 bp, Homo sapiens
ttatttgtggaatgaacaaatgaatcacacagttgattgtgtctgcattggtcttcatgcagatatgccgtgtggatgtttagaaatccagtaggggagcagggaggctgggtgtggtggctcacacctgtaatctcaacactttgggaggctgaggcagacggatcacttgaggtcaggagttcaagaccaacctggccaacataatgaaaccccatctctactaaaaatagaaaaattagccaggcgtggtggcacacacctgtaatcccagctactcgggaggctcagacaagagaatcacttcaacctgagaggtggaggttgtagtgagctgagatcgcaccactgcactccagcctgggtgatggaatgggactatttcaaaaaaaaaaaaatgcagtaggcgagcagggaggacttcgaacccagttggaccacaggagcccttctagccctgtgaggggccccgtggagcagcctgctctggtaaccaacacaataagacagccgttcccaaccagggaggattttgcccccacaagggtacatggcaatgtctagacacagtgttggttgtcacagctggggtaagggtggggcctactggcatccattgtgtggaggccagggatgctggtaagcatcctacagggcacaggacagcccccagcataaaaatctgactgcccccaaatgaccataatgccaaggataagaaaccctgcagcaagattaggtttcctggttcatgatgagctaatgagagcatgtcagttctaaagaggaaagccatgctaagcaggcagggagctctttcttctggaggaagcaatgagcagatggttaagctcattgttgcgtgataactgctgacatttgaagggcctccgaaggcttccttctgcaggctgcagaggcacgtgtaacggcctgagagggagagggttggtgtttgtgggccttgacgacgggataggctgaggctcgtgcttcctcctgccaaggcccatttgaaagcacctggtccccctcagcat

SEQ ID NO: 63309 - DNA, 1039 bp, Homo sapiens
gtgagaggcttgaaaccaggactagctcatagatgtgcttccaaatgatgctttcaatccaagcgtttattgatcctgtaagaaagtgtgaccagtcaagggggaaacaaagccaaggccagttcctgaactcaagaaccttgaagttttcttgtgttgtgagctgagttctctgccaggtactccaggagaaaggttgctatgagcaaagcttggtaagcactctgcagaatactcactgcccagagatttgcagtcgggagcatgaattgctctgagaaaatcgacaggaagagaccagttcaggggttaattgtgcatttcccaaaccttgtttgtttgttgggatgagagatagggctccctgatttagcaaatgaaaatacagggtgcccattaaatctgaatcttagataaacaaagaatcatcgagacatgggacatacttatattaaaaaacatgttcatttatctgaaattcaaatcagctgaacatcctgtcctttgtctggcaaccatgccggtggcagaaggggactgggggtacataacacctgtcacgaggcacacattggaaacgctgtcccaggtcttacctgtgccagctccgtttactcctcattctgcatctcccagtacttaggcctgcagaccgctttatcgtgtttgccctcttgtccaatgacacacttttagttttctggcatccttgactgcctggagcagctgtgacctcagaaatgcatgaaagatgccgctgggtgccagcagaacctagagtagccaagccaaagctggggctggccggatccccatgggcagtagggtggtggcacctttgagcatcatttggccaacatttgcagcatctgcagcatgtttgggaaataggagcaacctccttgactggcaggggctgatgaggtagaaaagctgagaggaggcagctgggagagcagtgagactaggcaagaggcagggccaaggataggcaggcaggactgaaggagaggttacaggtgatggctggagcggcagg

SEQ ID NO: 63310 - DNA, 1100 bp, Homo sapiens
agtccacggattccgtccccatctctaagtctacactgtcccggtcgctcagcctgcaagccagtgactttgatggtgcttcttcctcaggcaatcccgaggccgtggcccttgccccagatgcatatagcacgggttccagcagtgcttctagtacccttaagcgaactaaaaaaccgaggccgccttccttaaaaaagaaacagaccaccaagaaacccacagagacccccccagtgaaggagacgcaacaggagccagatgaagagagccttgtccccagtggggagaatctagcatctgagacgaaaacggaatctgccaagacggaaggtcctagcccagccttattggaggagacgccccttgagcccgctgtggggcccaaagctgcctgccctctggactcagagagtgcagaaggggttgtccccccggcttctggaggtggcagagtgcagaactcaccccctgtcgggaggaaaacgctgcctcttaccacggccccggaggcaggggaggtaaccccatcggatagcggggggcaagaggactctccagccaaagggctctccgtaaggctggagtttgactattctgaggacaagagtagttgggacaaccagcaggaaaacccccctcctaccaaaaagataggcaaaaagccagttgccaaaatgcccctgaggaggccaaagatgaaaaagacacccgagaaacttgacaacactcctgcctcacctcccagatcccctgctgaacccaatgacatccccattgctaaaggtacttacacctttgatattgacaagtgggatgaccccaattttaaccctttttcttccacctcaaaaatgcaggagtctcccaaactgccccaacaatcatacaactttgacccagacacctgtgatgagtccgttgacccctttaagacatcctctaagacccccagctcaccttctaaatccccagcctcctttgagatcccagccagtgctatggaagccaatggagtggacggggatgggctaaacaagcccgccaagaagaagaagacgcccctaaagacgtaagttcaggggtggaggtggtaagga

SEQ ID NO: 63311 - DNA, 1007 bp, Homo sapiens
gactctctagaattcacgttggaaacttgatttcaagcctggaataggagaagtctgcaatggctagactgcaaggccgtgctctctcatctggaatgagagccaaccttagccgccacctcttccttctccaagatatgttctgtgtctcataggcgtccccagtcactttcttgtttgaatattagagctaacaggggtcagggaagtttacccaactgtgtcctcacctctagtgcagacagggactttggcgtggaagaccctgcgtgggtctgacaaagctcttggggcaccacggctttgtgggatcattaggatcaagagaggaagctgttccccagcagctccttccaaaaagctggggcattgccctacagcggtggccgccatatcctaacccattaataaccagttgtctgcagatttatcttttttgtcagttccttctgtctgtctctctttttctttgtcttcttgtcttaggatggttgaagatgtgatgtctgtgtgttctctgttgtaagtaaatttaatgcaatctgcctcttatgccaaatgtgcttatttttctgccttttgtttctgcttccaagccatttttatttcccctctggctgctactgatgtgtttctgtggtgggcctgcgaatgatggggcatggggctccccagtagcaaagattacttttctgtttcatagtgatttgcataagagactgcttggctgtgaaaatgtgattatccagcatctgcctgcttatcaggaatggaacttttttccttcccttgcatattggatgtcttcatctgaaatcaaacattttttttaaactcttcattacattttttcattttaaactgggctagtgggcgattgctttcaacactactgtggcttcacgttaaaataactgtctggtctaaccacaggcagcgacggccacagcttattcttgctaacatgtaaagcagaaatatttgggccgttccaaattgaggcccac

SEQ ID NO: 63312 - DNA, 1461 bp, Homo sapiens
ctgcgattgcactgttttaatggcaaatattataaatgctgtaaatagccatttatttttttttcatgattaaatgccattgttggagtgatttgagagaacacaaggaaggaacttgaatgccaaattgctctgcccacccagttaacatgcaaagcaggggagggtggtgggatctaaggagagggatcaccccccaaagcctttgctttgctgggagtgggaccaacccatggaggggctggagacggggcaggggccagtctacagggtggaaagagcccccattctgactgtggaagtgacccccagactgctcggtggacttaatggaactgctcaggctaaaaggcatccctttctcctgggatctgcttccttgacccttcaggagtctgatttggtggtttcctttgcctctcagccccgctattcatatggaggagaaaaagggagagaagagctgtgaatcttgtctgtttaccatggttaggagaagacaaaaaaaatcatctctcccctggccctacctttagtcaggattccacctagaagccttcagagcatgggaatccattgagctcaaagatcctgtgatagggaggattcaggaggttctccttgaggaccccgaactttctatttctgcgtggcccccttcagttgttcattaagtgaggtgtcgccttgcccgtctgtaaattggtgtcctgagcctagagcccctcccctagccttagttgggttcagatacccctggaagaatccagataaattaatctgctcaccagaaatttgctttataaaatacgaacatttagttaaatttagcttcattttctgggtcattctccaaaatggcatctctttaaagatctccagcttgatggatctttcccttgggggcaaaaataatagctgttaaaaagtgagagtgggtagccggcgtggcctctcgctggtgctggagtgacagaggtgggagggtggcctgggccagatggctccgcagaggcagtagcttcggtccgctctgtactgctctggagtgttccgtccctctgcttgttgtgtttacgttttccattttgtttccagtgacacatttagggtgaaaaagtcgccaaaacggtctcctctctctgatccaccttcccaggtacagtgttcctttgatcttgatggttttatgccccccccgggggaggttttcttcgcttgttgacaaagctttgctttctgctcatcccgggcctgtttccaagaccctcttcttgcattctgtgtggagggtccctcgatgtttgcttcacattgttttggtcccttcactttgcggaagatcagagtgtgtcccgagagtgggaagacgttcaggaaaaacattagttgggctctggaggacccactctgctccattcaggccagttcatctgctgtgaacttctaggactgtcgaga

SEQ ID NO: 63313 - DNA, 1020 bp, Homo sapiens
gataagatccccctttttctgcctccagggactgatgagatgcttgtcaggtgattctggtgatattgatgtgcaggcctgaagcactgtgtgagcctcgcacagcagtcacagtcgtaaaactagcaggaatgctcaagtaactaagacacaaaatcctgattttttttttttttaaattcatggtcattccctgaaacaaaccatcataaaaggagattcatagagggaagaatctgtgtgtccatctgtttccttaatggaccatttggagcagagtctgagaagagcatgcagaggattgtgaccgggacctgtcctggctaatgggtccccagacctgagggtgggcacagtttctgaccaagagtctgatgagacaagaaacagtttctcttctctttgcaggaccccaccccagctgctacaccagaaacaccaccagtgatctctgcggtggtccacgccacagatgaggaaaagctggcggtcaccaaccagaagtggacgtgcatgacagtggacctagaggctgacaaacaggactacccgcagccctcggacctgtccacctttgtaaacgagaccaaattcagttcacccactgagggtaagcaactctgtagccagctggacccccactctgcctcggagaatcctgcccctagggagccaaaggccaggagagaaacttctcagccaggtaaccacgtgatcatcattgtgagatcgtctgcacgtctcccgctgcacttgcagctcaggctgtgtttgaaaacagcctgagacttgaaagcagctgtcccttgacccaagactcctgctaagagccagcacggtgccctctaactccacctcaggactccatcgagtgggtcctgagcgcccactcgagctttgcccatggcttatgtcccctctgtgattttgataaacacagctccaagggagtgtcattcaagtcaaactctcagtgtaggtcactgacctggactcgcttggtgccaccgttattcctag

SEQ ID NO: 63314 - DNA, 1097 bp, Homo sapiens
cacttagaagggtgacggtggggaagctgggagcagcctccctgtctctttccctggactcttttcttctcccctaatataatgtcacttaggttaaaagttccagaaatactagccatgagcaggaatatatctgatcatgctcctttacatttgtgttacccatcgaagggtttttatcttaaagtatttcattttagcctacaaaatataagcactttgagctccacttggaagataagtcaataggcaaggagatatcaggcgagttggcttccctgatcctagcaatggagacctggactcagtggcatccttctggcttctgcatggggctctttcctgttcctagcaagcccccagcaattagagacagacgaaagcagcattgaaggcccctcgctgtgcagtgcccccatatgaaataattaccaaaagcagccctcagaaacgacaggacccgtgaacgatgactgagcctcttcagctaggagcagccacacacgttagcaaggaccatctcctccagttgagaatatgatgtgccacttggtgtggtgacatcacccttcctggcctgccagctgtgtgtggcatggtgtgaaaatagggctgaaattggatgtggtttcacccccatgcctgccctttgaggcttaggatttgaagcagatgagtgaaattttgaaaaccaagttcaggaagatgttttctcaaaatagcagagatcacccaagatgacaggaggaagtatttattttttttacatcctctccaggtcattctgtaaattataaatcaggatcccaaatgaccgtgattgcaacaagcagggcgtgttctgaagcagcatctccaggcgtctgccactcatctgggattgatggggaggagtgcgggccttctgaaaccaggcatctcacaaatgcaaacactaatgtgggtgtcagagtaccccacttttgcaccgtcagttgctccttctgaagggaggaatggggacacaggacagtgggaagggacttccttttggcaggtagcagagaaggcagatgagtgagctccgtgacctaaaactcacccagattcagccacca

SEQ ID NO: 63315 - DNA, 1059 bp, Homo sapiens
ttagtttccaggtactcgaggcaggcagtggtgtttgccgtctccattgagtgtatgggattttcaccaatcaatttgaaacaggtcatttctccacccattggactttactagtctttgagtttgaaaatagatttggaccagccctgaagacactggtagaaccctgggaaaggctccaggtgacttacaaagcttctcttaaccagcagcgctgaaggaacaatatcgtccttccctcacttcagagggtggccagagctgaatacccagagagggacaagtaagggtccagttccaaaacatcatgaggatgtatcatcccacgtgtctcacctgacagttacagaggaaacccgcacccagaatgcacgtgctgtcttatgggaacactcagcgcagagtgctcaggtctggccacacttgggctgtgcttggtcgtgccatggaattcctcaggactttctcagcctccctaatggcagaagcccctttacagcaagacatttaccgtttgtctgaaaatagccgaactgagccttttcttcaggctatatgagaagtctctagacagtgggcaccgtcagaaagcccagagccttgtgatagctcccaccctgcctggctcagatcttcccatttttttcctctggcactaacctcaccttttgtttttttgtgtttgtgtttgtttttgtttttgcagagttggattacagaaactcctatgaaattgaatatatggagaaaattggctcctccttacctgtaagttcgtctgcctcgggccacttaggggactcgctttcctgccttcaggggcctcctcccctgtgcagagtgtctctgggagctcagaccccaaatcgagtgttttctgtgtacacagcttcccgggtgcacagcagtgatggactggggctggggggttgaggtttgtactcaatccacttcgtttgacattttcagggagaaaatgatagaatacaattagacgtcctgcagaattactttcctagactgagaaagagctagagatttctttaaaaaaaaaaaaaa

SEQ ID NO: 63316 - DNA, 1197 bp, Homo sapiens
gtggagggggtctttcaaggtcttcccatcactgagagatgccagtcccacagcccctgtttctagtccagctgagttgctctccaggccctgcccctgccctgggctcattcagctatggtcagcccaggtctaggctcttgccctacctctctgtttatctgcagtggccagcacagctcctggcccagagagcgtgctcagtaaatgttggtgaattgaacaaagtccagctcaccaacgccgtggcgtcttctcccctggccacgttcctacttgaactcagttgtactttctctgcatcctccttccctcctggcctccccacctcactcctaaccaggccccacttcctcctctcttcctggtggctccagaacaatgaaggcttttccctgatgggttatttgttctctgttgaagagtgctccagttttcatctccgttgcacgttcaggccaactgtacccaagctgatatgtgattttgatccctgcagcaggacgacgatgccccgaagaagcaggccttgtaccttatgtttgacacttctcaggagagccctgtcaagtcatctcccgtccgcatgtcagagtccccgacgccgtgttcagggtatgacttccatgatgagagagttacacatcatgctggatgttctaaagcctctgagcaccttcatgctgttattttgacttcatttcagtgcatagattcaggcggctgacatgccacatattttttttttttttaatagagacagagtctcaccatgatgcccaggctggtttcaaactcctgggctcaagggctcctctcacctcagcctcccaaagtgctgggattataggcatgagccacaatacctggccagcccacacttcagtctctctgaatgtccacagggacataaacgcattggttttgttactggctaccctttggactaaagtgaaatccttcagcagttgactgtgtgtcccactccctataatctcgcccagtgcacacacactttattccatcatttgtctaaagggggacactgtggcccagcattcaaagctcgaatcccacctgtaccccctcctggttgtgtgacctgaagtgaggtacttgcctctcctgggcctcagcttccttgaatgtaaagtaaaagtaataatgaaatggaccttgcagggatttgatgaagat

SEQ ID NO: 63317 - DNA, 1016 bp, Homo sapiens
atgtttgcatttatgagggctgatgtttggagcagtgcattgtttgatcaagtaagtgtgggcattgctgtgagatttggaccagcctatttttgtctgcctgcccctttaagcaggagtaaaagtgcttgcattgacttctcagacttacaaaagagactctgcaggctgcccagggtggtgagaacaatgatgatggtggttatgttgttaaaacagtagtggcaccaggtgacaggtaccacattaagtgctttacaggcatgcagcatctcatttaatcttcacagagaggtccattgtctccatcttatagagaaggaaatggaggcacggtatccagtcactttcccagagtccacaaccaagcagcgggtggtctgctgaactgcagagctcgggtctgtagccagtggcatctgtgcttctgcccctcccttgtcacttggtcctggggtgactgcccagcctagaggctgcatggccactggagacctggctcatatccctctggaagtccaggattccttgtgatattgacttggtcagggcatcctggttgatttcagtgggtttcccaatgagaagactaaagaaagatgccctttgcttcccccaggtcaagttttgaagagactgaagcccttgtgaacactgctgcgaaaaaccagcatcctgtcccacgaggactggcccctaaccaagagtcacacttgcaggtgccagagaaatcctcccagaaggagctggaggccatgggcttgggcaccccttcagaagcgattgaaattgtaagtggagttggagggccccagatcacaggggatgaggtgtgggccagctgcgtattgtcaccaagaaggccaggccttcagagcaacactcacctggcacctgccatgggtcccaccctgactccctgaccacagaagccaacctgggaaatcccataccatgaggatgaggggaaggttctctattcccaccagtatggttttgcatttcccacttaagta

SEQ ID NO: 63318 - DNA, 2061 bp, Homo sapiens
aattagtctagatgaaaccacaagtaatggcagctaattgatactctctttagcctcaaggcaaaaatgtccagcaaatggctgcatggcccttgcttggaatcaatatcactctctgttctcctctatttttcttgtgtgtcctcctctctgccggctttcagacagctcccgagggctcctttgcctctgctgacgccctcctcagcaggctagctcaccccgtctctctctgtggtgcacttgactatctggagcccgacttagcagaaaagaaccccccactattcgctcagaaactccaggtttgtagcccacgtgtgaccttttgggagtttgtcaaaacctcagtagagaatgaacccccgaggcccaaatgaaataaggcaggatttgatgaggaactgccgagaacgttcccagtgacatatcttcccctcaaaggatggtatatgtgacgttctttccccacgataccaaagtgatgtaaattgtgtgattacatattgaacaaaccatttctatttcaatttacaaactgggcccaaatagtcattatttagaagcattgatagcccccaaagcagtttctgtgatttattcactgaaccaagaatattagatcaccactgagccaagccgtttatatatacgtggctatctcagactcccagtgagataacatctgggctcagtcttgcatctggaaccaaaaacaatgatctactctgtgctttaaatttgacaacttaatttgatatcctctagactagggtgttcagagcaaacctagagagattgttaacagccatctgagagatgcagctccattcatggaaactattggccaactttaccttaagaaagaaaaagggaaagaaatgaaagaaaagagaacagtaaaaattttgatcccattttgaaaatcatttcgtattcaactgcacaatacttcctgacaatcagaagggtgatttttagaaaaggaaattaaatgcttatttcatgatctgctgaggtgctaattgtgagagaaaggcggagcgcgtgtttttcccgagtgcctgtcatgacacattttcgtggcacgttcatttctcggatgtggaaaccattgacgtctgtcttgatgcatttccctgcggtttgcccacactccctgtgggcaggaggagttagagtttgccatcatgcggatagaagccctgaagctggccaggcagattgctttggcttcccgcagccaccaggatgccaaggtaccggtttgctgctgcgtgcgccacctcctgagaatgtcatgtgtgccgctggggtccagaagctgctttgctaaccatccgccaggcgggcatcatcggtgtccagcaaagagtcgtttccaaaaagctgaaagcgtcactcttgcataaatacacactgagcacatagctaagatccatttaagtcgataatgctaaaccgcgggatagtaatgctggttaaatgagagagaatacagagaccaatgtatgggtcagtagggtaaagaaggctagcctaagatggcaaagttggatagaaaactggttagcaccaattcaacagagcaaaacaaaatcatgacctttgagggttttttttttctacagataccatttgcttctctattgagcaaacataatttgcaacttttctattttctgcaagttaacatctgactttgttgagacaaggccctaatcaataatacatagtaagtgaaaccaagacatttgataatattctagaccaggcttaagcaattctttctgtaaagtgcaaatgataagtatttccagccttgtgggccgtactgtctggcactgttccaataaaacttttatttgtctgtttgtttgtttgtttttttacaaaaaacggcagtgggccatttggcctgtggagtttcccaattcctagttttagcatggagtatgacattgacagggcatgcagaaatcttttcgcctggcttccaagtttggggtaacttttattaacaatttgaatgagttgctgatgacgtgcagaacgtgtgtt

SEQ ID NO: 63319 - DNA, 1038 bp, Homo sapiens
agctgctgttgttagctgacacttccctcttgcttctgttacctgatcaggtgctcccagcatctctcctcggtgggtggatccgggtcccattttacagatgggagatggagccacttgacagtgattcaccagcctgttggggactagaactcaggtctccaagtgagaggcccctcgctgggtgtggtggtacacacctgtagttccagctactcgggagactgaggtgggaggattgcttgagcccaggagttccaggttacagagagctgtgatcacttgattgcactccagccaaggtgacagagcgagaccctatcttttaattgaaaaaatacaaatgggagcccctggcctgcctgcctggagtaacagctcatctgcaggggggcagtgaggtctgtgtctctcatccttggtacaagagtaggagttccggctgctgctccagccctgagggccccgcagtgaggtctccttggccatacccaaaagagagacccctcccagagacagtgggtgcttacactgtgggtgtgcaggctgggaacagcgagacccaaggcagggacaagaatgtcaatacagattggggatgtcctcgttcttgttgccaaaccataagcttaggttgaatttccatgaaagcgagatttttagaaagcatgaagcagtgaggattttccccccactagatttatttctagacatccttggggcctaaagacagaatgaattgcatgcagtttggccactgtaagtaccatgtattcctgtccagagtttgaggtggaattgagcatgtttggtgagtagctcagggtggatatggagtgtgctgagtgctttggtccccctgccacctcctttggagagcggccagagatgactgttggcaaataatggccaggagttgactttttgtcaattacaggctgttctcagaatatgtgccccaattctgagttagaaaatagagtcatgtgtgttcatagtatataggtcggagaggcagcccaagccacctcttttatt

SEQ ID NO: 63320 - DNA, 1023 bp, Homo sapiens
gcactctagtattgataactagggtagaggttcgctgggcagccatgacagcgccacgaggttaatgcataggactgagagtgtggttggtttgatgtttcttttgcagtagaagtagactgacaacccggctgtgctggtcagtgatgctgctaacaccgcatttcaactgtgttgcaaattgccgagcattttgtgcaaagggaaaaagaataaccacagattcctcctcctcacctgtgggaggccagtatctgtcctccacaaaaggctgtaaagcctcaaccaacatcagttgggtgggttggggtggtggatcatgccacttgttcagggtctaatcagcagatgtggatattgtcattgacccagtttttaattttcccattaacgtaacagacttcatggcaacagaactcttacataactctaacataactccaacataactcttacatccagagactctacctagccaaaggtgatattggttgacaactacagtaggctttaagctttgcgtgactcacatcctttcaaacagagctaaacaaatgcccccaaaatggaaatgtaaacagtcttacaaaagtgatcaaatctgtggttattcaaaactaggaaaacatagactagaattcaacattattcaccattgagatctcattttggaagtggaggctgctgaatagtgccctgggttctcaggcgctgtgcctaagtggctcagtgagtgataaatggcagagataagcaggtaccagacatgctggactccaaggcctcggagcttaaggggcctctgccattagcccctttgtctgcctgcccaggtgcagaatgatagatctccatccatagactggactcggcatttccctgttcatcagtctttgcactttctcatacttttgatgttctttgtttcaaaaccatacaattggcccattcatgagagggtgagtgtaatcctctttgtcgtatgattaatgctaactgttttttttttaattaaaaacgatt

SEQ ID NO: 63321 - DNA, 1069 bp, Homo sapiens
tgccctccagatcgccagagcagaggtatcgtggcatgtggtgtaattaccctcttcctgccacttataaatacgtatgctcgtggtccacaaagccagagtctttggagacagactttgtcctctgaacgctgcaggcaaagatgtgtggcacaccatgcgttttgatcttcctagacgctatcgtgtaatgggccttttggccttgttgaatttacaacaaaaagcatgcccctttcagttgctccccagtgggcactgtgaaagtctgatatctggctgctttcttttttatgctcggggaagttctctgaatgtaattatggtttgttgtaggaagttttcattccacatttattcaccgtctccttttcttgatctatgaattgctcagagctgaattcactcatttggggctaacctttctcttcttctctctgaaactagatcataaccaaggagagagaggtctcagaatggaaagataaatatgaagaaagcaggcgggaagtgatggaaatgaggtcagttggggagctgggccttcctcgtgcctgagggatacttacctgtggtttaataatgaccggagctggtgtggtccacagaagagtgtcttctgtggaagttctctcttctttattacacacagttcatatttttctaaaagtatttttactctattactattactaaaatagcatgcacatgaattaaagaatgcattcaaataaatgtatgtacaatgcaaaacagatctccccactcagcctccagttccacaactcgcaggtgactatcttctgtttctggtggatccttccaagaattttccatttctcatcacaaatgtaacaatgagtgtaaacagcctcttttttctccaaaataaatgagagcttgcagtatacatcattctacactctttttaattaattaatttatttttttgaaacagagtttcgctcttgttgcccaggctggagtgcagtggcgccacctcggctcactgcaacctccaactctgccaggttcaagtgattctcctgcctcagccacccaagtaact

SEQ ID NO: 63322 - DNA, 1045 bp, Homo sapiens
ttttgtataggcaggatctggctgtgttgcccaaggtggtctcaaaatcctagccttaagtaatccaccagcctcagccttctcaatacctgggactgcaggcatgcaccactctacctggtttgattttttttcttagtgggcagtgagggatgttgaaggctttgcacaagggagtggcatatttagagtcacgcaccaggaaaatgagcgtgcagggcgagggctgacattgaaggtgaccctggaagttggggccctgctggacatgggtcaggctgtggcgtccagctgtgtgagatggaaaaccattctgttgtcatgactccaacgtgtctttacttctcttataggaaaatagtggccgagtatgagaagaccatcgctcagatgataggtaggtgtcctgacctgcgggggctcaggccggccccgatgtttctgaactatgaggaggccttggaagataggaggctcagagtgggtttctggtagagcgtgaagcctttcagggaaggaccagagcattccagaaaatatggctttgccccaggacagagtctggggcttcttggtaacacccccctgaactgtgccatagcattattcacacccatggaaagccatggcagtcacctgccagccaccatctgactcagccaaggactctctactttgtggggaaagagattccttttgggtgggatatttgggggattttttcttttcgcttgtgggagataataggaatcaaatccctagaccctaacttagtttagactcaaatgacacctcagcctttccacaaggacccagggacaaggacagtggaccacggcgtgattgtccgcctccttcctcccgtgaccatggcaggccctgttcactgaccccagcactgtttctcactgagattggacgctgcctcggaatccttcttaacacggcgtccctggcagccagtactgagaaatttgctttggctcacaataaaagaaggcctcaagttataagctacacatccctgggcctttttttcttttct

SEQ ID NO: 63323 - DNA, 1141 bp, Homo sapiens
gctttcacagatgctccacaccagtgtgacatcagtcctgccgttgttattcatttgcatcaaatgttactggagagatatgttttgttaagctcacatagtgactatttagaattcagaagagagagagacttctgtgctttctgcattccaggttgttgcaattgatttttttctgcttttctaacaactgccctgattatctgttttgcttccattttctgttgcttcttgccctttgcttgcaaaacaaacaggcaagcctggtaagtaaacgcttttccccctaatttgacacctgcccattgcaaccctttgtttgtttgtttttctatttttgttatttttgctttgtgtattgctgcattccccccacatgatttcatgatgttttgcctgaaaaagccagaaaagtcttcaggagcattgttttgttgttgagtgtagggtgtctttctcctgatttgaagaacctaactgcgtttgtcatgtacaaaaggatttgtgaagcattcttgcctcccccgtctcctgggaacggggtaattctatttttaaaaagggttaggttgagaggaaaggaaacctgaggcaggtgaagtcttggatccaggaaatcagatggacttggtttggtaaacagctcctttaccaagtcaggtgaaacatacacatgggctcagatcagcccagaatatacaccatacagcgtgctgggaactaagaaagcagccagaattccaagaataaaaacaagcatttgattattagagacatgttgaaaggccctttcttttaggagtgtgggtgtggcaagcaggttgttggcgattctatgttaaaaagctccctcttcgcaagccactgtgacactgttgctctgattccaggggtcacagagtttattatggacaatgaggctcttaataatgggttaccaatacgggactcttcctccttcttgggggctttatatacattttctcatttaatctcctgcaaatgccaggagatacaaatactctttcttcctattttagacaaggaggctgagactcagagagtttaaaaccctgctcaaggtcactcgtatggaaagtgtcagagtgagagctcgaactcaggcagttcagaggctcct

SEQ ID NO: 63324 - DNA, 1679 bp, Homo sapiens
ttttctaagcagccataaaaaaagaacaaagtcatgtcctaggtaccagcatggatgcagctggaggccattgtcctcagggaattaatgcagaaacagagcgccaaacactgagcattctcatttataagagggagctacacattgggtacacacggacacaaagatgggaacagaagacgctggggagttcacagtgggggtagaagggagacgggttgaaaacctgcctttcaggtactatgctcagtacctgggtgacaggctcattagaaatctgtaccccagcattagtcacacagtatggccatgtaaccaacctgcacatgtgccccaaatctaaaaatatacattttctagatatttggggcagattattagcttgggatggccaagggccggagaggtggggcagaggacaatggttcctctcaccaggatcagccactcggaactgagccaacactgaattaatattgtacatcactgagaagctaaccttgacggaaatagctccgtgtttcttggagttacaacacttgctgtatcgaagacgctatctgtgcctgcgtgaatggaatttcagaggagatgcttttttgggctctgggtttccagatgtgttaaggatctccaaagacctcctctctgtcctgatacataggagggcccatccctcacagcccagacctcacaccctttaatcgtcccaacgcaaaattcactagcgatgtcttcttttttactttacggatctgtctgcttgctgtcaacaaccacatagaatcaccagggacaccaatatagacctgtgaaggggccgtactgatcaggttaaggaatagtaatggctcatttctacctcacgcgaggctgcacaggcccgggtctgggaagccagggctctggtttttgttctgttagagacagtctgggagggctctggggcgtgggttcgtcccaaggaaaagctggggtttgagatgcccccactggtgaggctgagttgcatctgaggcctcggctggccccagagacccagtttggactttctgggctccatcatttggctcctggtctctcctgccagaggacgaacagagagagaagtcagtctcccaccagacggtgcagcagctggttctggagaaggagcaagccctggccgacctgaactccgtggagaagtctctggccgacctcttcagaagatatgagaagatgaaggaggtcctagaaggcttccgcaaggtagggctgagtttgggggccacggaggaggaggatctgattgggagagattgtgggagcactgggagggggtaggattccagaagttggtcttgagccacctgcgaggagggggtccatgcaggctggggaggcagacttggccgcctggggttacacctgcatccgagagttcctggggttcccaccagtgctgggcatttgttctcgtgggcttgacgcctgtcctctgccctgctgtgtcagaatgaagaggtgttgaagagatgtgcgcaggagtacctgtcccgggtgaagaaggaggagcagaggtaccaggccctgaaggtgcacgcggaggagaaactggacaggtaacatttagccactgggggtggctcccaggggcctcccagcagcccttttacccaggcaggctgggacctctg

SEQ ID NO: 63325 - DNA, 1867 bp, Homo sapiens
agaatttattcatattacagatcattattttcattcttttttttttttttttttttttttttgaggcagggtcttattctgttgcccaggctggagtgcagtggtgcagtcatggctcactgcagcctcaaccacctgggctcaagtgatcctcctgcctcagcctcctgagtagctgagaccacaggcatgtgccccctaccaggctaatttttttaatttttgttttcgtagagatggggtctcactttgttgcccaggctggtcttaaacttctgggctcaagcagtcctcctgtctcagcctcccaaagtgctgggattataggtgtgacattaatttaattttttacctttcttcttaggatgaaaaagacagatggctactagacagttttaatatcaaaattgcattagaaaatagtttggaatatgcatatgttcaactacctgttttgtaggctctgatgattgttcttagcagtatcctcagaacgacatatgcggtcacaactgtcaagtgcaagtttttgctcactcacccagtatttattgagcatcattatggttttagtgttgagtgtgcattttctattccttgtctcttgataatctatgtatggcatatttggtgacttgaaaaatggaatgtttcattaaaataaagatcatactagaagccaggcatgttggcatgcgactgtggtcccagctattcgggaggctaaggtgggaggactgctggagcccagaagttcgaggctgtagtgcactgtgattgtgcctgtaagtagccagctgcattgcagcctgggcaacacagcaagaccccgtctctaaaataaagaaataaaaaccatacttcacagtcattttggctattgtagcagttgaacatacaatgtttcttggtgagaaatgtagcaatgtgtgtgtttgagatggttcccccatttccatcagggtttgatggtgtttaaattgcattatcttaaactgaacttccagaggaatgaacaaatcacacaggttcttccctgaaagacctgagtgatatctaggggatagtcccatcttaaagagattcagaaacatgattcacccagacaattcttgaatggaggcgctgggcatttcgcccaatcagcgctctgtaaaggcttttgctccatgagctgagctttatgatgaggcagtttgcttagtggtggctgatgacgccaagagagagcttggaaaacctccgggaatcactttctaacgggtctgctgatgcctcttagccatcagtcactgtacataacgttgtttaacagttataatggcaaagccatataggagctggggcaacctgaatttgtgttccaggcttgccacatctgactggctgtgtgaccttatacacaacccttaacttctctgagcctccatttcctcactgaaaaatgaggataatactggcttccttgaaggcactattgagggaaccaggggaggccagagtgcctgggatgtcttcagcatggtgagcagctcacggtgggcactccaataagatggaagatcaccgttagcagccccagcaggggccatagtggcaatgagagttttttttttctttcttttttttttttgagatgaagtctgtctctgttgcccaggctggagtgcagtggcgcaatctcggctcattgcaacctccgcctcccaggttcaagcgattctcctgcctcagcttccctagtagctgggattacaggtgtgtgccaccacgcccagctaatttttttgtatttttagtagtgacagggtttcaccgtgttggccaggctggtcttgaactcctgacctctggtgatccacccgcc

SEQ ID NO: 63326 - DNA, 1035 bp, Homo sapiens
gcccaagccagcatgctgagtgttgttacatctcatcacttgcctagatctttcgaatttgtccatctctctttgctgttcttgctatagccttcgtctaagcccctgtgatctccctccagtcactgccaaagtctcccagcctccggccctgctctgctcggaggcctgcctcccacaaaatgcaaatttggtcttgtctctctcctgctgagaatcctccagtgtttccccattgctcttgggggaaagcccaaactccttagcacggctaaccagctcctgcatatttctgcagcctggtccctcaacggtccccactccagcccttctcagcagcctgcacctggacctgccaactgctgctttcatctcttgcatgcactgctccctctcccaaatgctctcctcctcgcctttccccttgctaagctcctactcattcttcagaataaacttcattgccgctttctctggggatgctgggccagtggctttacccctgcccgtcctgggattttccccttaaaactccttctggagtgtcttgtggctgcctgtttacttgtgtatcctctgcaagacagatacggcatgtgtttactgctatgaccctggcacaagccatcatgcaggtgctcagcaatattcattaatgaatccatgaccacatagataaacaccatggactcatcgtgttaagccaggaagtgaaacaaaatttgagtcacatattcgcagcttaaagacagtcatcccagaaagccagccagccaagagacatttgtgaccacagctgctctgtgtcatgcagtgtcaacttcaccacgctgtctccaacaatcccaggagaccccatgggtcagggtgcatgcaggaagcatgggtgggagcccgtgtccagaatattgccaactacgtgctgccctttccaaggggggaggatggctgccaatgactcagcctaaggcaggcagtgggagctggacttgcttattcaacaggagcagtggagatctgacccaagccaccctc

SEQ ID NO: 63327 - DNA, 1058 bp, Homo sapiens
tcaccatgttggccaggctggtctcgaactcctgacctcaggtgatctgccagcctcagcctcccaaagtgctgggattacaaatgtgaaccaccgcgcccggcctatagacgcatttttaaatacttatttactttgaaatagtttaagactcataagaagttgcaaaaagagtgcagagttcccacgtatccctcgcctaacttcccccaacgatcctacatagccctgtgcatggtcaaaaccgagaaactgatgctcacactgcattttacatatttatgacctcccccatcctttctcttattaggctttgagcagtttaagggcagactgaacctcagtcatttctgtaacccgagcacctggagcagtgcaggcaggcagtgggagtgccacctgctgcagggtgaacatgggactgaggtgtccctgtggtggctattgtcactctgccccagagagctccactctggggacccctgccaccaaggatttccaggaggaagggaaaaggtagcccaattcattgctagccaatgccatccactcagtcatcctcgaatgtgagctacagagtggcactgctctcaggtctccagaggtgccccacacccttggcacaaaagccaaggccccactagcagccccaattcccacatggcctgcaacccctgcccaccgctctgcccatcatgcccccacctagcccctcaccggcatgctcctcgggatggtgtggggcttccgccctcccttcctcatcgggggtcttctcacatgtccctccccccgagagggctttcctgaccccaaatgtaaggtagcaccccactcccctgctaactgattttattcttcttcagagactaatttgaccacgaccttctatttactactctgtgtccctgttgtgcttttcccccaagcagctcagctgaggtggttcacttgccgctccacccactgggcccatcccaggctcacacacactggtgctagtaaatatcagctgaatgaacgcagcacatggattccatcaccagggagctcaaggt

SEQ ID NO: 63328 - DNA, 1017 bp, Homo sapiens
gcagatggggtcttgttaccaccaacaaccacatccctggagagtagcttttactgagttgcattttggtgtgccgcttttgccaaaaccaagaaaaaaacattataagatttattattgcatttactctacagacattcttgaggacattgaccattaggttgcttggggtcatctgctgaagacatccacagttttcatactaatagtagttgtacttctcccaagtgaattgttttttaaactgttatctagtttgcatcgaatatcactgatcaagtttccctttttatctgccgctagcaagttcagagctgaatgtatggcctatcttaggaaaaaagtgtggttattagagttagtatacaatggtagcttctccatctttttcttcctccttaaaaaaaagaaaattggtgttctgtggcttcatttcatgtattcatggaagccactcaaagcctttactagaacaaggtaagaaatgataagtgaataaataatctggtcatggccaaggcactctacccccttgtgtgctaggatcggcccttcagacagggagactgactctacccattagaaggagttgtcttgagtactggggaaacctgtactgagtaaacatgaggcgctgctgtcatcccctgggcattttgccttctaagactgctgagtcctgtcaatcctgcatcttggctgtctcttgagcgtgcccctcctcccgctcccacttcccctgcctagttcagaccctcctggtctctcggctgagcctctgcatagcctctcaacagccagcctccctgccctgcagcctcccacatttataccacatccttcacacaggaggggctcagcctaaaccacagaggctctgccactctcccctcccaagcccaggcttcctgctctgctgactgaaccaagacctgctcatgtggctacaagatcctgcataacctgggctcatccaaacctctggccattgcagctgcattgggtcttagtggccag

SEQ ID NO: 63329 - DNA, 1056 bp, Homo sapiens
ggcttggggaaatgcatggcgatgtgaggtctgggacaaatcaacgtagattcgaaaagaaaatggaaaagctgtggtggtgagaaacacccctgtgcctgccactccagggaagagctgtggcgtctctggctcaggagtgcaagcaaaggccttggaaacagcaactttggcagggggcccacaccttaactcccttctcctcacttgcttcttccatattaaaaacacagctctaatgaatcaccacattctagctctttttcctatctcccagtgctaagacgtttccagtaggagagctgacctggagccaaacagcaattcctcctggtgtgcatgactcattggaaaaagtgtctcataggctattaaaagagtgggggagggcgggtaaaacatttgggttcaaagcaaattatatggaaactaaacacagtacatataattccgacactgaatgctgctttcctcaaataacaagacagagaaagaagtgggctctttacttaacgcagcgcacagatgttctgttccagaaatgaattacgtgcttcaaaacaatgcaaatgaaacttggcttaaacaggtcactacgtgaagacgtgtttatctgctaaactcacacatgcaaaagaaatgaagcatctttacttccacttccttaaactcgcctcgtcatgcttggaagccctcattcctgaggctgtggggaccagaaacacaaacctaacaaggtaataccaccagttacttccacagaaaaagtgagttttattcaacctaagaaagctgatttttttttttaatgaagttttaaaggccagggtagtgtggtcattttcctgaagagaggagtaccttttgcctcatgcctgttactggacacagcaagttcccagaagcacctgattatctcatagtacaacacctacatgttgtttacttttccaggtaatttggtggtttgaaagcatcctataatcttaggccctattaaaaaaacagtgccctctgaatgatgctatgaaaaattatatcactgatggttttccc

SEQ ID NO: 63330 - DNA, 2231 bp, Homo sapiens
tggggcagcgggagggggcggcgtcttcttcccgtgggtccccgattgttttcccgacgtcagccctcagcggcgcccggcgggggagggcgggaggcccgcggcggtcgcggggccgacgagctcctcggcgtctccgccccccgagaaatcccgctcggggcgcggtgcgcgcagctgcccggggattcccggtggcgccggtcggagcgcctccctccagggctgtgcccgcggggcgcgcgtccccgggcatcctttcctggtgtttaatgcattttggcttcaggacttgccgaggccgaagccggctccgccctgggccctgaagtcgggcggtgtccgcgatttacctccgcaccttcggggcaggtggccagaggcagcgttgaaagcgacttgcccaaggtcacgcaggtggcaccggggaggcgaccagacccaggtctttcgacgccgaggccagctgccaaccgcagagctttggggccgtcttgagtggtttgtggtttgtttcagatgctttctattgacctcctggaaagaggggaaagtgtgtcataatgaaagcggtcctgttgcttatagtgtttaccgcctttggtagaattctggtgaggctgtgcccccgcgcagagcatctaccgtggtctgggcgtataaataatgaaactcctttgctctctgggggcagtacaagaagaggttcaaggaacaaataaatatccaggcagtttctgcgttttcctcgtctgtttgtttcaccttccaattctgcagtactggttttcttattttacaattgatcgttgttttaataagattttctttgttttaatgaagtcattgccccttgtgagttagttttctaaatagaaaatcttatttcctgtgtgtttaatgactggaacaaatagtgcactatgaggtttacaccattgtctttcatcttagaactcctgatcaatctgctttattttcccaagtactcagcttgcatactttctatgttaatttgatgccactgaaaccatttacagcaaagtttgggtaagagttatgtgattgttttgtgaaactgtgtttttcttcacaatctgaagaacttgaagacccgttatattaaaataataagatttattctgatcaaaatacctgtttacttttcatgctcttaatttttcctgttgacacacttgtggcaaaagaaatatttcccctagtggagttaaagtattttttatcttggccaattttcccaaggaaaattgcattttagagtactgatacatttaaaaaagagtatttaagtttgacagaatttgaattaataaagtagttaatttattttatactgccgtaaaccttacactgtatctactgacagttttctcttgtagcgtatacctgtatcaagatatatggctgtgaatttagtgacattaagaagatatatatatatatatatatatatatatatataatataaatatatgtgtatacacaccgcgcgggcgcgcgcagagcttccaatctttatcttgttaattagtattttcattgtcgctttgggaggggggaaagtagcaggtttgtatctttttttctccccagttttagcagtgtaacaaaataggaaagatggtgtgtaaaattgagtttgtcatagactaggagagacagtgaaacaggataagtatacaattgtgaggaaactgccatgagttcataagccggaaggacctttttagaagtgtttaaggatgttaagaatagcattggattcttttctttaaaagtcattcaagtatcgtttgctaacatataggatatgacaatattgaccactcctaggaagatacttgggaaaggtggaaacattttacatttttatggggacttccccccacaaaaaacatttaatggagatttaaacaaagtggctttttgacttaagcctggaagttctttattattattagtcatgctgcaaatcccgaagttattttaattgtgtgataatttgtaacccagaatgaaatctaataaatagtttattaatataatttaagtcatactttgacattgacatattgcttgatgtcaagtcattattgtttaaataacttatttgagaatggggaagatagttttctgaatatagtgtagtaattatttgtgacaatagtaacattgcttttattagaaaattttgggttgatataactaac

SEQ ID NO: 63331 - DNA, 1211 bp, Homo sapiens
ctgactctacagatatttgatcctctatgtctatatatcctcagctttgtgtttgtcagtgattgtggggcaacaggactagtcccactcgacatgttttaacaaataatagtgaagtcttgtgggcctgttgaggtctcactgtacagaatttaatttttctttgctttttcttatatcactcaggctgtttctgtgttttgccttattttttggcttcctggttcctgactgatgaggtgttaactgtaattatgttaatttatgactgatttgtaagatctaactataccttagagtatgagtaaagctgaaggagaaatttgggttgggaggcatgttaataatataattgtgtctggttttgcctcatgtaagtttcactaaaaatataaatttaagtggaaatacagtatttgaaactttttccttccattatttaaataaatcagttaaatctggtaaatgattcttgtctgatgaggaagaaacaactttctatctggaaacttaacgttaatctttgatgcagtaattatgggttacttcatccgtcgttcaacaaatagttactgagggtcttgcatgtgacagccactgtgttaggcattggagaaacaacagtaaataacaaatccctgctgtcatggagcctacattacagtgtggggaaacagacaagaatcaggtaaataagtaaactgtatcattcattagataatcaataaatgctaaggagaagaataacatggggaaccaaggtggaagtagcaaaacggtttggaggatttgcaattttagataagatctaaaaggcagtgttcactgagaacgtgactttgagttacaagtccccgagtgggaatcttgtctggtgagtccagcggccaaatgaatgagtaaggtgggtattgggatggggtaacagggcagacgaggcttagtggtctttatgagggctttggtttttaggtttttactttgagtgagatgggatcccattgaaacaggttgtcaaccttggccgaacattagaatgattggggaagctttaaaaaagtactgatgcctggatcccatcccagaatttctgatttaattggtcggcggtggtgggggaggtggtgttttaacgtaggcatcaggaatttttaaaattcccaggtaattctgataagtggccaaggttgacatctattgcactgaagagt

SEQ ID NO: 63332 - DNA, 1057 bp, Homo sapiens
tactggataccagagaagatagtttcgtgtggtacatggataatccacaggtttgtaaaatcccaaggattatcttttaaaagcacagaaagttgtatttaagtatttaacatactatacaggctttagatttgtcttcttaagcagtatatttttagatttatttctactggctgtcctctctgccctgcacccctgacctctactgttttgtttgaatttcagaaggtgaaactaagtttatttgataaaaattaatgcttctgtatatatttttccctcgagagagaaatactctctctggtggcaaattaggttttagaaaattagaacttgagtcacagaaaaaaataacaattgaagctgtcccaaaaataagaaatactttttttgtaacatgtatttcaaacaacagctaaaataaagaccagggatagatgattttcttgcattaaggaggcttaataccagggtccctttagtgagattaaatttaggtttaagatgctgcatctaggatagagactattatttttaaataaataaatgacttaaccacatgatactcttgcacatatgtagtccttttattttgtagtgtcagatttgagtcagtcattgtaatgccatccatgaactgaaatgcagtttgattttattgttgccttgcaaaacacaggggtaaatgctacaatttaaaaaattggaatcccagccttaagaggcctgagattagatatcatctgtgaagtagttttaaactttcaactttctctacttttttttttttttttttttttttttgagatggagtctcttatcacccaggctggaatgcagcggtatgattttgactcactgcagcctctgcctcctgggttcaagtgattctcatgcctcagcctcccgagtagctgggactacaggggtgtgccaccacacctggctaattttttgtatttttagtagagacagggtttttccgtcttggccaggctggtgttgaactcctgatgtcaggtgatcctccagcctcagcctcccaaagtgctgagat

SEQ ID NO: 63333 - DNA, 1070 bp, Homo sapiens
gtcaagtaacaaattttgaatctcatttttttccagtcgaacctgatggtaatcatactagtccacagaaactgcgtattttgaatattgtttttctctcagctacttaaatttccccatagtgtactactattactgtgacactttatgtcatgctttggtttctcatttgtcttccttccacaaaggcttagagctctattcagcagttaaaataataggctcatgaaaaactgaaaagaaataaattattacccttaaatggaagggtaacagtttttgaaaaaatcactttggtggtagttagagattcttgaagacatatttacatttcttttccttctttaaagttaaaaaccaaaaacccataaatctaaaacgttatacataagaatacaaatagctttttaatgttatacattaatgaattataattttattttatatgcatatttactattgatgatttatatttggaagcttgtacgtagtatatagtttaaagcagaacataattaatggagttttacaatatataggtgtgaaagtttttaaaagatctgtccctgtcaacaataagcagttcatgtttgggactcttaagtctttgaaatgtctaggcttccagttacctcctaatcattcattagaacaagccaatagatttttatatttttaagtacgttattataaagtcagttgaaaagttgatcctgtcttatctccagcagaaataattttcaaaatcaactaaaactaatgttttcatttttacttctgaaatcttctatcagtcttttatcagtcttctatcatagaaatgaaatttatattcttgatttgttttccccagattcttttgtctggttttcctacctctatcttcctcttctataatcccttcagtttattataagatatattataaaaagagcataattttgattccagatctgctcataagccttcttcgttggcctcaaattctctacgatataaattctttgctacttttttatttaggtcctctatgattaggttctcagttcaagttttcagaccaccatttt

SEQ ID NO: 63334 - DNA, 1031 bp, Homo sapiens
gatacattttctggggaagcaacagtgaggaaggaccaaaaacagggactttgtttgcatatctgtatcagaaacaacctctgttccctacctccaatcgggcagacacccttcttctgtcccagcaggtaatgggatgtgtggtgtctccagaaatagaatcagtgaggctgtatatttaggggcactagtcccagagaacgaaaggaatgaggcacgaaactgaaaataggaagatatcttaaatgaaagtctgcacaatcagtgcaaccccagccccagagcactgggcagccaggtttaggtgagtaagatctgactaccctagagaaaagatccatagatactgactgacatctgggcatttctactagaagagcttgccatagttgactagtaaggtccacaatcaacagccctacgacaatgcaagagagcttttcatcagtctttttagcactttcttttaaaatatgaatagacagcccaggattactgaacatttgatgagagcggattatcaaacaggagaaggaacatgagacaatgcaaaactcattttgcatttctttgaaaaagtcaaagaaatctgaaagtacaacaaaggtaaagatagataatggaaaagagataaaaaccatcaaggaagtccaacatctgatagagactgagaggacagaggaaagtacagaatagagaaaacagagtggggaaaattgacaaagaatatgataaaataccttagaacctcttgatccaaaaccgtatattcataaccagttgatctcaggttgtgagatgatttttgtttgcagttaagctaatgtttatgcttcaagttttatccattttatgtattcattctaatcataaagatttgaagttaaatactcaagtggaaaagataggaaggatacaagcttctagggatgcatgtattattcacaatgaaacccttgctttagggtttttatggcaacttagcagtgtcagagtttttttttttttattgttcaaagattttatttctt

SEQ ID NO: 63335 - DNA, 1107 bp, Homo sapiens
gtggagaaatatatgtatatgatgtttcattgtgatattttatataatttcaaaaaccggaaatagcctaagtgtctatcattaggggattgactaaatgtattgtggtgtatccatttaataaacaaaatggccataacaaaataagagttttacctgtgttattgtgtgataaaagctgtattacatgtggtctgatatattttgtcaaatccacgagagtcacggtgttgaacttagcaaggtttttcagctactgcaaacataaatttagaggtaataagtacaatatttggtgtgttatttttttctgtcaacagttatgaatgcaggaatgaggaagtacttcctacaagccaatgatcagcaggacctagtggaatgggtaaatgtgttaaacaaagctataaaaattacagtaagtatatgtatttttttgaaaaacgttcgatgtctggaattaatcttttcattttgaaaatacacctaccaaatgttcccagcttaccaacaggtttcatactcaagctttgtttaaaagacaggtgttcagaatgtgaatatgttttcttgtacttggtgactgttggcactttaatcagcccatgattgtctttttaacttatgcacctaataaggagatatattactgcagatcttaatcacttcttgcaacgtttctaggagaaaatgcgcttagcacgtagagttctaccgggaggatatatatttttcttccaatatagtgtaagagatttcctgtcacctacctggggaataggcacttctctcttctaagccatgactgggattggggtcagatagggaaagagttgaaaacaggagcaggacaaggggagatgaaggctgaaaaatgagggttagggataggaatagtgtctgaagggttgcggcagccagagggtcctgtccatgtgacccttgagaagtttgtctcaggctctaaacttcttcccatgtctgatttttttccttgcattccagggcttggtacccttgccctcctttcccatgctacaatttcttgcttctaatgtgtgcttcttttcttttttggtttcctgatgaatatttattgattattaa

SEQ ID NO: 63336 - DNA, 1107 bp, Homo sapiens
gaacagcttgttaccacatgacagaaaacgcctacgcaccgcatctgatctgtacatgaagcagaagttattttaggtttgtgcagtgtcaggaaagcaattttttaacctgattcagacatacatattcttaaaagcttttagctaatcattttaactcttctaataaatattccctgcttgaaaaatttctttagaaagataatatctcgtaactgtactaaattcatgttttaccatttgcaataacaagcagcactggtttcttagtgctttaagagaaaaagtagtgaatggtctcaggctttttaccattttggggggtcttgaattgctatgtctgatttatcaatggtatgaaacagtcttatacaaatgacactggtaagcttttcagcatgaaggaaaaacaggttagagattctaaatagaattctaaaaagacttctaagtagcttttgtggtcttgcaattttattttacctgttgaaatttttatagtttttaagataaatttgttggtaaatgattttaatgtttttataattcacatttggaaaatataaatacatagaagttatagaaatccttattacttaataaagtggttataactgcattaaagtgagtatagatttgatagtacttattaaaaataaacttttgatagacacacatttaactcataggatagcaatgaaataatttcctatgctttaataagatgctttatgttaattttattccttaaaaatatcttaccagtttcatgtgcattttatacatttaagtgtattaaagtgtggaatctccaatttgttatattttcctgtgaacattgctgatgatttacatgtagattatttgaaaacttaaaatgtacattttgatgtatgtacttaatacataaatctttctatgggatcactctcattttggtcaactctaatttagtggtctgctaagtactgtgtgatatataaattttaaaattttggaaatccaaaattagagtttggaagtgtgtggtttcaaaatagaggtggttagagggcaatgggtaagggaatgatgatttttaaactatttcctagttataatatcttg

SEQ ID NO: 63337 - DNA, 2017 bp, Homo sapiens
gattcagtgtctgacatgtgccaactgcccagtgagatcacttttctgattttcattggacagttggatggtttggggcaggggtgtgtcctgaaaatgtctatcttaatggctgaatttagaccaagttttacagaggtacatattgtttttagaggagttatccatgttcatgggtattttgcttgaacttttcttgttcttagggaataagatgattacaagttagataatttttatagtaaaatgcagttctaagttaactactagcatttgattttattataaagacaaattagaagcagtgagcttaacagcataagcaaggacttttaatatactgtaatttaagaaaaatggaaaaaccaatataaatttcggtattttttagaatgattttaaaggtttttcctaataattcccaggtctgactaaacttcttgagagaataactgctagttttcttatgggtcacctcttagcagcacctctcattttatctagttgaatagattgttttctctctggtttcaggttctcttaatgctagttgctgttcttctcaatgagataactgggccatattttctctgtcagaataattgaaatatatggtgctattcattagaaaatataatgggcttccctagcaaatcattccagggtatactatcctaattttatttgacaaggaaaattctcttcattattttattgtctttaaaaagcactccaaagtgtgcaagttcttagaagaattcaagaggtattcaggattctcttctctttcctgttttctctctcttttgtttctgcggatgagggcattgtagtatgaatacgaaccagaggctggaggattgggcctggggcctgagagaaacctcttcaagggaggcaggtggagaaggaagggagagggagttttagaagtcacttaagagacaagtcatttattatatccataaattacatttgtgtggattgggacttactgtagctcagcatcctttcatatacacatggaccatgtttgctcaatattttgcagaaagctgctttgcaaatccttatctgcattgtataccctcttttctacaaatctggtgggagtagcatcgtatggaagaagagcacaggttttagagcagtgtttctcaaagtgtggtttatgaaactcctgcctcaaaaatgtctggtgttcttgcttaaagtgcaggtttttgggctgcactatagatatgttgagtcagaatttctgggttcgaagcaggggaatctgaagttttaaataatgttcctgggtgatactttatgcactctaaagtttgagaaatcacactgctttggaatcacactaataaacggtttgagcctttgaatacaatgtgagtggtgtcctgtagttctaccagtactctattaacaggaattagctatatgacaagcaaactatttaagttaaatgtttctacaccactacttcagtgattgtcagtagtatttgtcatagtgtttctgaaagactgcaaggttccacgtgccctttaaatcattggagaagactaaatcatgttcaacattataattgatgctgagcagattttattacattttattcacagccttaaaaatgtataatttaaatacagactatgtgctaaacagtctacagatagaaataatgattaactgagtaccttatttactgaatagatcacataagaaaagcaaaaatatatgttaaaaatttatgatacctctgattctttcatccactttagtgaggtgttaatgtgagattctgctgttaccacagtcattgttttcctgtacttgtgaacgatttatcattgatccaagtattggaattccttctttaaatttctaatgaaaagttttgttttgaaacttctgatttgttttaagaattttgctattcttttttctgctgactttggattcatccattgagtctttcaacatttattgaatacactatggttttggtaatagt

SEQ ID NO: 63338 - DNA, 2106 bp, Homo sapiens
tgatagctatattataaaatattattctaacagaaaaattagtgtgataacttaaggagtacatacatggactataatttttatatgtatctgtcaaccgtatgcaaacggatgaataattagaaattctgcgagaaaacaggttcacatgtataatgctggttgcaaaatgattcattttatttactatttcaggtaccaaagcagtcagactcacagcctaattctgataacctaagtcgccatggtgaatgtgggaaaaagcaagtgtcttacagaactgatattgttggtggcgtacccatcattactcccactcaggtaattaagtaactcttctattgtgtgagggtctaattattgtatattgatttttatattattaaaactaaaacagtgcatctttgcttaattggtataatatacaattactataaaatatttttgtttatttcaaaagtatttattataaaaaatttggaaattacataacatttaaaacttctcatgatttctctgagcctttcttcatgtacttttcacctcagaaatggagatatgagttgtatattacattttgtaaacagattttttcacttgtatcatgaacattttccaagtcatcagaaatccttttatatcatttttaatgagtgcatagtagttcttccatggatttaccataaattacaaatcctctattggacaaatagagttccttttcctttttgtttcttttactttataaacaatgctatgatgaatattcttaaaggagaaattcctagaaataaaattgctgagtcaagagtttgcaagtagtaatttttaaaatctattttttctacaacctggcctaagtgagctaaacagaagactggaattttaactaagttatatctcagaagtactaatatgctaaattaagtctttatttgagttttaggaaaaatataaatttacatacaatttttgatgaaattaaaactcttgtctgagcttgaatttcttgttttgctattgaaaaggatgaatttgtaatggatattaagttactagtagttgagaaaccaagaattttaaagtaatcaattggtattgccaagcttgggtattttcattaccagtgtgccttttgaactcaaaagactttgacactttataaatcttttaaatcaaattgtatcattccccacatttttcaggtcttttgctacgggagggtgattagtgggattagaaatcttacaacattaattaattaattaactattgagtgctttctttatgcttggcaaagggtatgttaatgaacagaaattccctgctgtcatagagcatacattttccaccaaagttggataaaaaaataagctaggattgtgtgtttactttttccaaaagtaatgattttaaactgttaaccttctggttactatgtacctagattaagcttctttcactggtattatgacctatgttgacataaggggtaagactattttcctgtagttgtgttaagacactgtattagtttgtatctgtggctgttttaattttgtctagagttaagattttgttgcattgtaattttggtatagatatttcagtagtttctaggattttatggagggtataattttattgcatcatttattttgtagtatagttttaaaaattataaaataatatatgtctatcataaaaggcaaaaattggtaaattggacctcatcaaaataaaaaatacttgctctatgaaagaccttcttaagaggatgaaaagaaaagctacaaactgggagaaaatatttgcaaaccacatgtccaacaaaggacttttatctagaacatagaaagaactcagaacccaacagtaaaaagcccaagaaatccaattagaaaattcatgaacagatatttcatcaaaagataaaagataaacagatggtaagtaagcacatgaaaagatgttcaccatcattagctagcagggaaaaaatacaaattaagagcacaataaaagatcactgcacacctctcagaatggctgaaataaaagtgacgacacaaatgctgccaaggttgaggagaaacataatctctc

SEQ ID NO: 63339 - DNA, 1058 bp, Homo sapiens
cttaaatgtggtagtagttacacagatctacacatgtgataaaactgcatagaactgtatagacacacatagatgaatgtatgtaaaactggtggaatccgaataaagtttgtgggttgtgccaatgtccatttcttgttttttgataatgttacgccgtttccctttgaggggaaactagtgaaagggtacataggacctgttgtactttttttgggcagcttctggtgaatccttataattatttcaaaataaaaagttaactccttccccaaaaaagagcactggtggcaggacttgtgcaaaacaagaggaatggaaatttgtgctttaatcagtgacaggaaaattaagagtaagtatctcagattaattagaaaactcttcaaaaatctgtttctgactaatctaaggtggattttaagattttctactgggataatatgaaataaaagtatgctaaacaagcaagaaaataatttatttattttgcttcattttagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtggtgagtagcttaacaaaatacatgaaataatgaaaaaggattacgttctagcaaactcaaattaacatggaaattgtttgctttattttatgaaagacccaaagtgagagaccggcatgctgaggagagtcaggagataaaataggggatattctctgtttataattcaatgctgttatttgcttggtttgcagggggccaggaaagttaatgcccattaccactgactttcagtttaaatgagctttcctaacagtttaatgttttagaaagtgtttctattcatctttactcatactcaggagtgggtcagggaaagagagctgttgtggggagatggcaggccagcggcaggagaaggagtggtgcctaggaggtctcttccttgtttaggcattggcctgacctccg

SEQ ID NO: 63340 - DNA, 1050 bp, Homo sapiens
ggggcgaggagtaggaggaaggggaagtgcttttaaaaaaaaaaaaagtttcaacattaaaaatatgaaataggccaggcatggtggctcacgcctgtaatcccagcattttgggaggccaaggtgggcggatcacctgaggtcaggagtttgagaccagcctgactaacatggtgaaaccctgtctctactaaaaatacaaaaattagctgggcatagtgatgggagcctgtaatcccagctactcgagaggctgatgcaggagaattgcttgaacccagaaggcagaggcagtgagccgagatcgcgccattgcactccagcctgggtgacagagcaagactctgtctcaaaaaaaaaaaaaaaaaacacataaaatcatacaataaaagatgaaagccaggcaccagaaattgaattaggaattcaaagcctgggtagctagagagggatgaggtttaatttatcgcatctctaagggaagtaatgagatttttcactgcttggcatgtctgattgtgggttcatatcagggtaattaagtggtgactaacatttgacattcttagaaacacaagtcttatgtctgtgttcatctctggtagatgaaaaactggaagagaagatattttcaattggatgaaaacacaataggctacttcaaatctgaactggtatgttgttacgtcataaatgttgctataagaatgtttgaaaagtgttgcaatgtagtgattatatataatttcttgtactgttctgtagtttcagaataagtctagtttttagaggtaaatatagtttatttggttgtgatgcttttggttaatgatatttttcttaaatacatttttaagtaaaaagatcctatcttcaaagcagcattccaccttgaaagatctgaagatctcagaatcctctagtctataaatttcctctaaaggggctgtcctcttggggggttagccccacgtggagtagggagagaagggcatccacatggggaaggggtggtggcagagatgggagaatggtcacatacacagtgat

SEQ ID NO: 63341 - DNA, 1100 bp, Homo sapiens
tagaagccaagtcttttcagagaaacaatactttttggtgaatgaatgtatatctgtatatatgatgaggaatgagatatttacatagtttcaaagtacctatctactaaaataggtattaagtattgtacaaggggaaaaagagtaacattacagtgaggaaagtggtgtaaagaattctgtctgtaaaagtcaatatttaaccctctgtatttctttctcttgagattttctttacctatttcacattgactcataaatcacttcacataagatgtttttatcttccctgaaggtagaatcagaaattgaaattccctcttcgccttgtttgagttgcatccttatttaaaatattgtagggtgatctgagtcctgaaatagcttattggagacattgaatgcaattctgtagtataaatgtctatcctacgtcttctttttgtatgggatctttgagaagggaacttatactttgtttgaatgaagtcaccagaacagcattgtccattagaactttctgcacaaatggaaatgtgccgtatctgtattgtccaagggcactagctacatgtagctgttgagtgctggaaatgtggctagtgtgactgaggaactgacttaatttcattttaattaatttatatttacatcattacacacaatggccactgtattggccagcagagcactagtgtataggaaggggatattttaagattcacctcaggagtcagctcttctgggaagcttttagactctgggttaagtgtcttctctttatatgccctgtggtaccctatgcatacttgtatcataatgctcttcccagagttttgcaatcacgtgcattcttgtctttgcaactaaattaaatgagcttcttaagggtaaagactcttgtagtcttttatgatcacagggcctggcacttgatagacaataagtgtctttgaatgaatgaaaaatggcatagcatagcaagaaatgccattttagtatggggctttctcaaagcttaagagcctcaactggaagtagtagttacttggttcagaaagtacctgccttgttgtctcaggaggctatccttgtgcttg

SEQ ID NO: 63342 - DNA, 1058 bp, Homo sapiens
atgtaactgttttttttttttttttttttttgccaggaaaaggaacctcttcgtgtaataccacttaaagaggttcataaagtccaggaatgtaagcaaaggtaaggaaccgctctgacttgatgcctggcacaagttataaacacagaatagtgccttagtttgagtaatgtacttacagattacatttttccatattaattgtagttatttttaactctttatagttgagatacactagaattttcaaaaccctcagagtaaagtattgaactactttgttcatttgaaaactaaaaattaggaaagaatcgtttatttgtttctttgaaaactaaaaatacagaaacagcttactaatggaaaggaataaatttaatgtgaacaacttatggttaggccatcagatttgacaaattgatgtattaagtgtttaaaagatgcagtagaatagagcttcacaagaaaatgtgttagctgtgacagtgtttcaccaaactgattactaaaaactctgaactttaaagttgctttgtgaactttttctaaaagtgaaactacatgaaatatgtaaaatcttacattaaaataaatgggaaaagataatttgggtttgctaaatcagtgctttacctcatttatttattgacgcatactgggtactgggtaaacaaatgaaagagaaactcaaacaactgctatttaagtataattggatttttttttcatacagcgacataatgatgagggacaacctctttgaaattgtaacaacgtctcgaactttctatgtgcaggtaagatgcttatttggcaattaatagatcctcctaaaaagaaattaataatattagaggtgaaataaacataaacaagcttgttgcacttgaggttaaaaaaatatgacaactgtaattcaccagcttaataaaagggtactgtatatagagttattggtggggttatatgttcaggaagtgggagtatttgttatgaattagtgaactagaactaagtatttagagaaagggaaatgcttttaatttagatgttaagtg

SEQ ID NO: 63343 - DNA, 1054 bp, Homo sapiens
ttagccagccgtggtggtgtgcaggcttgtaatcctagcaacttgggaggctgaggcacgagaatcgcttgaacccaggaggtggttacagtgagctgagatcgtgttactgcactccagcctgggtgacagagaccctgtctcaaaaaaaaaaaaaaaaaaaaaatcaaaaagggatgatttgtttttgttttattgaagttaaatatgcttattccagaaaacttggaaaatatagaaagatttcagaaaaatgtggcttataaaacattcagtcccacattgaggcaaccattcttatgattttgctccctttcttaaggtatatatttttataataggtggggtcatactaaatatagtgttatatcctatttgtttcatatattgttatttttttcccatgtcattaaaaattatctgaaaaccttttagaactgcaccatactccattgatgttccaccagtaaattgtgtctgtattactctgttgctgtattgtgtctgtgttactctgttcatgtgcatagtttttgtacatttactgtaataaaatgatgaaaaacatctttgtgcattactttgcctgatttctttagggtaagtttctagatcgagattaactatcagagcatgaccctttctattttgtcaaattgatttctagaattgtatttccattagtaatgaatgaagtatactctacctttggctacttgtatttttttttttttttagtctttgttaatattacttattcaaaaatattctgcattttaaactttttcatatttctagattctagaagtgtaagggattctagaatctagaaacaagaggcagtatctctgcaccccgattggggccttatttaattggattaatttcatagtaaggtttaaaattcacattgaaagccagacgtatctgtcaatacttattgtaggatttagggtactactagaaattatttccagaaaaatatgtaaaagaatgtcagaatttttaaaaattacacaactacataaatattcttgtagcagattcagacagt

SEQ ID NO: 63344 - DNA, 3776 bp, Homo sapiens
tagtatgataataaaattgaaatacaactaaacattctgctcagaaatatttttttaaaagatttttcttgtgttcaagtacataagaattagatttgcatttggaatactttggccactgatctcaggtctgaaaatttaaagtatcttaaaatgtaacactgccatctgcggaaagtagtctcatatgtagcatgatagcctttattatctagatttactatgacatatatgctagttacttacacttttaatatttttttctgatagtattataataccgccttttattagttttctggtagtgataactacagataaataaatagaaatcaatgtttctgatttcttagttgttaagtcattctctctttatatcctttttgaaatatctaagaagtcactttcatagatgttcattttgtaactgcctgtattttatgtgactttttcagcagtcaagtatgagactctctgcaaaaacagtgtctgttgggaagaggaaaagttggagaaggatgtttgtgttttgtgctttgtggtgggggcagattggactatctagctatgactgtcagcacaactttctcttttcctccctctacccagtataggttaactctaatcttagctttgcactgtgttccagatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagttgagttaaccaaactgccttttgcagttatcataactgattttgtcaatactaacgcaaactgtttcactgtagtcatcaggttggatatgtgtatttaaaaataaaaaataaaacatacaactttactaacagaaagagacattaacatataaaaattaatatactcaactgctgcaagagtttcaattttatattatgtatttaaaaatttttaagatacaatacttacgaaatgcaccattgttctaataatatatgcaaactaatgcatgcatatgcattggataaactgtacattactatagtttgcatggcatttaaaaatctctgaaatttagccatctaataggactctgtagtgttttggtaatttgtagcactttgatttcaaagccactggtatcataaatgaatataatatactagtatatagcaatgtatttagaatggtcatatttaaggatattttcagatttgatctagttagaagcatattgaaattaacattctcaactactaattatttcaccacagtttaaaatgtgataaatgtgtaccctttgttacctttaaaatattaagccatatgaatatatgacctattcagaactaaaattaagtaaaaaatgaaaagactgtgctattattggttgcagtgaaattcagggaagtaaaaactaagtcttatcagcagaataatgtttgaaagatgattcgtgcttattaaagaaatatggcctttcattgttatagtctatattttaatttttttcattctaaaatatgtgggataattcctagtgttgactgagaatatactcttaaataaaatgatacagctgggaggttctcttttaaacacagttcagttgcagctggaacactgtatttcagtttaggttggctgaatcttcaaagtgtcataggctgccaaattcagctttggtgacggaactggtttcctagtggaaatggtttttggctatcattgctttaaactcacctctaaaaacgcgttgctttgggaaagaacttgcacatttatgctgcatggcttctgctgctgcctttgtgtgtgtgtgtgtgtgtgtgtgtgtgtgtgtgtgttttatttgtttttcagagaatcaagtctcacactgagttactaacctggtcatgagtgactgaccgtgtctgactgccactcctttttgcaggagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtg

SEQ ID NO: 63345 - DNA, 1036 bp, Homo sapiens
cttggagagtaggcagtggcagagccagcctgggcccatctatgggaattctccatcgggattgactcctctggaaggaagacagttgacccacagttgagatcacagcagatgggccagccagggtgtctgtagaccatcaggcagtggccactccatgtagtttaatggacaagcccttttaatggaacaggaatctaacactgaaccaagctgcttttagacacacttttattcctcactctgaaatggcgtttggacaagccaaatatttcttcttctttcagttgacattttgtccatctttgaactgttagttgatgcttcttctgtttagttattcctgttctattttcctgttgccactagtccacccagggatggtaagaatggaagtcaatggttgctttttcatctgagatgcaccacgaaggcttgtcagtcagccttgtcatatggtctgtgctcccactgctccttctttctgtttcctcatctgcagaatttggagagtcctggacctgatctcaaatttcacatgttatttatcttcctgcagcacgctggggagaggaagagacagggacatagaaggttggagctggaacagacttcacatctcattccagaggcatttggtccatcttacagatgaggaaatggaggctgctcagtggactgaggctggaactgggccttccagtggccaggccagatcctccttgatctcccttgttgctttcctggtgggaagaccctggaaccactttatgtgactgtgtgagaagggaactgcctctcattttacccagcaaaatccaccttcaatccatcttcatttttgcccctggtgtgggcaaattctcccatacctaattcaggaagccagaaagaggaagtgagttaatgatccttagtgggaaggcgctggtaatggtccttcttgtgagagtttctgaaacaccacgctgtctctgtgttctggcctggctggagttaaacctcttcttggcctttccccaggaagctggtctga

SEQ ID NO: 63346 - DNA, 1007 bp, Homo sapiens
aataagaattgccacggacatctgtggtcattgtccacttgccactcacctacccccttttctggcagcaacagccggcatttcacatgtccatcatcggacagcgtaggtgggaccatcagtcatggtgtcctaccctctgtggccaaggagtggacacaggacccagttagggcaagcagaggctccccttggaatcgcaaagtgaagctggatgccacccacagagactaacatggtgaagctgctgtagcccctgctgttgagcccccagcactgcctgagttcttgcactttgtgagtccagtttaatatctgcttttcctcccattcttggagctcccctcacatctccagtggcttgaagttgccagagatgtttctgggcttgtgaccaaatgactccttttctgcttctcactgctgagcagacacatgtgcgctcactttgcctgctgagtcttgggacccggaagagcttttgggagacaatcacggaccagccccctcttgcctgccctgctgtctccctccaagcaggaggtgagaaggtgtccacctgcagccccggccaggcatccctttctgtgcttctgcccaaatctgaaattcccctctccttgggacccacgactggggccagcctgcctggggagggaatcccagctgcagaaagtcgggacagtgtgcgtgtaaacatgttaatagaaagcagctttgagggcagactagttcagcttcagttacaaactctttccaaatgcgtttaacatgagccactggctgtgcgcagcatatgtcaagctttcatccaatggtggcattttgtccctgcggggtttttttttcctgagcagtttggggcaggggtggggacagggagagagaaaagtaaaaagagagcagtttggtttcttcaggctggagtacaaggcagaggtaatgggatgtattgaagaaggtaggagggaaagttactttagctacagctatttgtccagctgtgc

SEQ ID NO: 63347 - DNA, 1013 bp, Homo sapiens
gtcattcgtactgatacattaatgataagcacgtaaggaaagaagtttgacttccaatacgtaagtattggttttctgattaagttatatggaccaggaattttagagctagaaagaaccttgctatctcacccaggaatcaggtctatagtcttaactcactgtagtgtgaactagagacagtcttttgagagagatttttggattcacaacttagttgagagaaaactttttagtatggaaaagactgaatttgtctgtatcttctaaacatgttcataaattctgttccagatgtagtcgagatgaaacttgtaaggtgtatcccttatttggacactatgggagattccagtttaatgcctttaaattcttgagaagtatgagctctgtgtatctgcagtgtaaagttttgatatgtgatagcagtgaccaccagtctcgctgcaatcaaggttgtgtctccagaagcaaacgagacatttcttcatataaatggaaaacagattccatcataggacccattcgtctgaaaagggatcgaagtgcaagtggcaattcaggtaagaaaaaagctattccatgatccaaaagcacatcatggctcataaaatgctgctcaaatccagtaactcttaagcatgtacagtttagagatttataatagtagctttagcaaataagttgaattttaagtatataggattagtatttatttccatcagttgataatatgcataccatgtacagtgtaagcagatgatacactgatagtttgccattattcatttggattttgagtataagtgtaatgtcctcatctctaaaaacaagtttcttttagttttctgactccttattatagatggcatagcagataattgaatcaaaagcaatgtgttttaactcctaaatgagtaaaacaaaatgaaccagcattccacataatagcctatttgaaaaaaagttattaaaaaaaaagacaaagaatctattatattaacataggctaa

SEQ ID NO: 63348 - DNA, 1037 bp, Homo sapiens
tgtaaagttcttttcctaaaacatgcatcatttacaaaatggatttgcatattctcagtattgttgggacagtaacatttggaaacagtcatttccacagaagagctttgagcctgatatccagtggggggtcatttctgactctgaaaatgagtatagctcaggaggcccaggtgctggggagtgacgccatcagctccactgcaggcctgcttgttatttccagccgcatatcacacctgtgaaagggaaagattcttcccactgtttgtccttctgatagccttctctctggactttgcatttccattccttttcattgacaaactgactttttttatttctttttttccatctctgggccagcttgggatcctaggccgccctgggaagacatttgtgttttacacacataaggatctgtgtttggggtttcttcttcctcccctgacattggcattgcttagtggttgtgtggggagggagaccacgtgggctcagtgcttgcttgcacttatctgcctaggtacatcgaagtcttttgacctccatacagtgattatgcctgtcatcgctggtggtatcctggcggccttgctcctgctgatagttgtcgtgctctgtctttacttcaaaatacacaacgcgctaaagtgagtcacaagttcaaaataaacaacgtactaaagtgagtcacatggggaaaaggggatagcacttcctcagtgggatacctgggcttcctgttggagcaaggtcattccttgctgctgtggccataccctgggtgaagtcaagaagaacaggcagctttgtaaaagcaaagacagctgagtgtagaatcttattttttttcttcctggctggggttggtagaatgttctcagctttggcctgtgagtgtcagcgctgcttggctgtcactggacctcactaagtttaccatcaggtgtttaattcagcaccttggccaagactccctctgtcctgggcactgtaggctgcagattctgtgggggaggctgcatgaacgagct

SEQ ID NO: 63349 - DNA, 2521 bp, Homo sapiens
taccttgtttagaattgtattcccattggagagcagcttcagtcggtgttgggcaattctggatacaagcatatgattggactacaatcctcatctaccttaggaaccttaaacaagtcgtcctccacaccttttccttttagaactggattgacatctgggaacgtgactgaaaacttacaaacttacattgataaaagtacacaactgcctggtggagagaattctaccaagcttgatgagtgtaaagttatgcctcaaaaccattcctttcttgaaaatgatcttaaaaatgcaatggcctctttcttaccaaagaaagtaagtgacaactcaaatatacccaactccgagttgctgccttttctccagaatttatgtagtcaagttaatcatctccatgtgggaaataagaccgagtgtcaggaaaacatcaccaagcatggtgaacgcattcttggtgttgggtaagtattattttaagacatacgagtttcgatttggtaggtggaagaatcagatgaaaggaaacagatttgtctcaatgagtactgcctaaaatttgtttccagagaaaattttagcaacttttacattttaccattaatacacttaaaggggataactgcagagtagaatggattactttgaaagaagtccctataactggaggttttgcacacttcccaggcattttgtggaagggtcacaagtattagttcacagttggaatagaaagtgatttgcatgaatggaaaggagctgtgggaattataatctttatgttgtttttatatatttgtactattttgtgcctgggtatgttaagcatgtcattgtgacattttccttgaagattatgtttggtctaggcaaattcctgattattaaaaaactatattaggataataatcacttgtagtttacaagctattatccccagtctcttaatcccttattttggcagtacatatttgattaagagatagctaagtattatgttcctaattgcttaagtagatatagtatgtcaaaatggtgttctagactagaattcaggactctaggtgtggttttggcttaaacatgttgccacactgtttagtattctttagcctaagagattttatttgaaaatgaggtagttggatgattttgtaactaaacgccaccaccaaccaacaggattgagttgacatttatagagaactctaccaacaatagcagaatatacacttttttcaagcatctatggaagatttgcaaagatagattatatcttgagtcacaaagcaaatctgaccaaattcaagaggattgaaataatacaatgtgtgttttctgaccataaatgaatctaactagaaaccaataaaagacaacaaaatttccagatttttgggaattacacagcattcttaaatttatggttcaagaaaaagtcttgacagaaattaaacctattacacagaaatgaatgaaaatacaacacatcaaaatttgtgggatgcagttaaagaagtattgataaggatatttatagcactaaatgattacattagaaaagaggattgttcttaaatcagtagcgtaaagctacagctcaaccaaaataaaataatctgaatagtcctataaccattaaagaaattgaatttacaattttaaagccaagcaaactgatcttaaagcaagcagaaagaaggaaataataacagaaatcagtgtaactgaaaacaagcaaacaaaatcaatgaagccaaaagccagttctttgaaaatttcaataaaattgatacacttcaaacaagactatcaaaagataaaaagaagatgcaatcatcagtatccggaatgtaatgagatgtcactactgatcctaaggccgttaaaagataacaagggagggaatattacaaacaaatttatgctcataaatttgacaacttaggagaaatggattaatttccccaaaaccacaaactaccaaccaaactcagccaacatgaaataagtaataaaatagtcctataaccactaaaaatatttgattaatgattggaaagctcatgaaaaagaaatatccaggcccagatggctacactgaaggtttccactgaacatttaaagaacatcaattttacatgcttttaaaaactagaagaggagggaagatgttccaactcattctgtgaagtcagtattagcctgacaccaaactagattgccccccaaaattaaaatacacaaaaatgcatgtaaatatatgtaaaatatgtaaatctataaaaaatacttataaaatatatgaaaaaatttataaacctaacaaaatatataaggatatgtgaaatgaaaattataaaatactgacaaaggaaaagaaaagccctaaaaactggagagacataccatattcatggatttgaagacacagcatagtaaaaacgtcaattctctcctagttgatatataaatttaatgtaattcctatgaaaaatcgagcatgattttttataaa

SEQ ID NO: 63350 - DNA, 1896 bp, Homo sapiens
tgctgcagtgaacatgggagtgcagataatctttttgagatcccagtttcagttattttggatatatgcccagaagtgggattgttagatcatatggtagttctatttttaattttttgaggagcctccatactgtttttcatcactgctatactattttacattcttaaccaatgactaattttcataatcagtgaattcttataaacagaatattatatgtcagaaaggaaaaatttacatagcaaatacctttacatttagatttttctgtttaaatgttctgcctacttaatgttcacccatacttttgacattgactgtagtgtaaatattattactcttaatgtagttttccactgtacattttgttttgaaatgtcatagagaaataaatgggctttcctgttatgactgagtaactttctttgagcttatggggagttgtccaatgttaacattttataaatataattttacataattcatcttattccaggaatatttaaatattcaagtttattcaaaacttgcattttataaaacaagataaacttacagtaggttaacatttctctataaagagcacttttccaaagtgcagtttggtaaaaagttagatggggacatgacattacaaatcttcccccagcttccctggcccttattattctcctttctcactttatttttccctaaagtatttatcaccatctccatttcatgatacattttttcctttcttttcttttcttgacttttttctcttcttccttcttcacttcttttctctttcccttactttctctttttcttttctttcccctttttccttcttttcttttgtagtttgtgtctccttgctcccctgtcatataggctctgtgaggtcagggattttaatttattttgttcgctgctgtatttccagtgcttgaaacaatactagcacagagtagattcctggtaaatatttgttgaataaattaatgttgttccggcttagtctagtaataactttttagaatatctataagtatatgaactgagtttcttcagctaatttacatattgctttttcagtctgtttcaccagctgttgaacagcaataagtgtgggatgataacccctgataagaatctatagtagacttttatgttttgaatttagagtggagccatatgccttaagacttaggctagagatattttcttttatccaatggaaaaattaaagagcataaaagggagatactgtaatcatcccttcaaggtaagccagaatcttctcaggaaataatactgcataaccagttgaattgaggctgcaaaacaactctcattatcctggaaattcttagagcaaacacagccagaagtagctaatttcagtcattgaaaatgtcacaaatgtacccatagagcatctaactttaaatagcatacctatctgtgtagtttccaggaaaaattcattgcaaaagatattactagatgaaagtgagtaacttaccgtattttgacagttgggaatgatataattgaattttaagaaacttaccggttcttgtgactcagttgagagtagtacattttattatcataaagagacatttgtagtggaaacattagtgtcagtgcagtttgactattcatgctagtatttatttaatttcttttgggaaaaactacaatgaaatgattgaaagtcatgactgtggagttaagtgacctgcgttcatgttccagttctgccacttactggctggttaccttggctaggtacctttagccttggtctcctcagcttaatattgggatagtattagtggcctactttataaggatgttttgaggattggatgaaacaatgcacagtgcctgactcatagtaat

SEQ ID NO: 63351 - DNA, 1018 bp, Homo sapiens
tgaatggtagttcatttctctgaagcaaaaaagtaataggcaaagtttaaagtagatttcagctagatcataaacagcttgggatgctggtttaaatttgtagatgtttttgacttatgtttcaagaaattttaagccactgtcaagtgtaaggtgaatctgaagaaagtgagactacaaggagaagatgagctgcacgtcattcccctcgtccagatgagagtgaatgaggtctaagattggacgtagtaacataatgctggatgctaaatgatgctaaaatgatggagccattgggacttgacagctaacttaatattggtattatgatagaaaaatcaagttaaacatgaaattgaggctttgaagatggtgatactaataatataaatgcagcccaaaggaggaggatgcttggaggaaaaaggaatttaattttgggaacattgacttttagctgtgaataagacattccctggaaggatgttgcaaacatctggaaacagaggattaggagaaatggaatgaaccttcagtggctggaagggaagtttaggggtgtacccacagtagctgacggagggtggtgaagggagaggaaaaaggaaccagaaacatagaaggcagcagtgtgatagagtagcaagagaaacgatttgatgtcaggtaaagtgacttcaaactcttgtcctgcctcttcttagttctgcatcctatggcaagttaattaatatttttttcaatatgaattcctcatgtacaaaatctaaatgataacactgtaaggatcacagaattgatgtgaaaatttaaaataagtaatgcaagtaaagaactccttgtagatgttgtgtggttcacaaatattaatgtagtaccagtattataatatgggctgagttaagagaaccaggagagctgaagattatggaaaccacagaaagaagaatttcaaaaaagatggaaatgtatacttttcttcctcccacaccatgttctcacctggatacctcaggag

SEQ ID NO: 63352 - DNA, 1119 bp, Homo sapiens
tttataaattaaactttatcataggtatgtatgtataggaaaaaatataggggttggtactatatgcaatttcagggagccactggaggtcttagaacacattctccacagataaagaggaactactatagtttatttttagttctttaaataggtaaacatttatttaatcacctcatttgttattttacatgaagtcttaatttttgaaaggactcttatttaaatagttcatctgagcctcatgataaattggaatttttcctgactattgctgttctagagaaaagtttaaaatatacttgaagttaatttttagattcttgaatacttcactcttgtttaggtcataccaagaagttacattaaatgattattgtttttaatatcattcttttctggaacttttgttttataatagttgctctcctttggcgaaaggcagtgtgtgttcatcagtaaagttgtggtacacatgagatcagtttttgcaaattcttcaacaagctctcctgctctaggatcaaggatagaccttgacaaggtccaaaccataatggagtccatggggtcaaagttatctcctggagctcagcagttgatggatatggttaggtgtcagcagcgggtaagtagaaatggatttctttccagataacattaatgatttcaaaaccattgcttttagtaaagaaatgtagtgacttaaaatttttctttcatactgatttaactgttatcttttagttttgtagaagttaacatttgttagatttgcccttctacaaagtgttttgactacacattttcacactttttatgaatgcattcattcattcagcaagatttttttcttgcagtaaacaaggcactggtttgagcaattttgagtgtgcgaagatggtcagttaatctgtagtctttaagaatttttacattctggagcatgtaagtggggaatgatgaaaacactaaggaaaggctcactaaaagaagtggtattttatctaggcctttaaaatgtagggtgggattagacaagtaaatttggaagaaggccatttcagacaaaaaataaggtgaataaaatcttcaatgctagaagaatttgatatagct

SEQ ID NO: 63353 - DNA, 1852 bp, Homo sapiens
cggccgggcacggtggctcacacctgtaatcccagcactttgggaggccgaggcgggcggatcacgacgtcaggagatcaagaccatcctggctaacacggcgaaaccccgtctctacgaaaaatacaaaaaattagccgggcgcggtggcgggtgcctgtagtcccagctgcttgggaggctgaggcaggagaatggcgtgaacccggaaggcggagcgtgcagtgagccgagatggagccactgcattccagcctgggcgacagagccagactccgtctcaaaaaagaagagtcatgttcagagaactatactgtgtgatgttttcaccaattttcttctcagtcaggatctggtgattttgaagagaaaccacaacaacaaagatgaaaacccctgcttcctttacctgaggtgtggccctgatggaggtgaagaaatcgcttctattggcattttaagttcagcaagaaatatggaagtgtacttaggagaggagtactgtggaaccagtaggggcaagaatgtttgtactgtcctggatgacaggtgtgtgacttgtacacgggaaagtgttcttctgaagtagtgttttgatttttctcactttttgcaataattattgattctctgatattgataccatatgttatgggagagaagataaaaatgtgccagtaggcatagaagtttacaactttagagatcttaaaagacagtgtagatcagcctagttatttttataaatgttgaaatttagaactaacaatcaaggtgaattggtaggaggtcatagctagttagtggaagagttttattagaatgaaattttgagaagtgtgtctctttccttaaactcacagcagtctgtcttccgaaagttaatttggtagtcagtctggaactttgaatacattttcttcttggaagcctattagaaatggtggagggatctaagactgtgctacataaacctatttattaacctgtaacgcaacttgtgattttttttcttacgaagatttttctccaatctgtctttaacacaaaatatgaactgttttatatcctgcatgttggaaacaattgctgtgtttattgagctttaaaatacagtctggctacatggttgtacatatgttatataatgtaattttctcattgagcctagtaagtggtagatgtaatcataggcagtgtgcttcagttatggagcccaactcttcatgcctcaccaggaaaactgaatcttaggatttcaatattgttctggaaacatttatttttaagtgtaactattaaaagtgacaatatatgtaagtaaaaaaaattaattcttttttatttttagtgaacatgaaaagatcattttgtataaaaaaaatctaaaattggagtcctccacacatgcttgtaaaataaaggtaagttgtcagttgtaaactaatttgacaactaagttgtttttgtactctgtgtatgcttgttttcttttggattagtaatacaattagtccaacttgcttgcttgcttttttttttcttttcaagacagtatcttgctctgttgcccaggctggagtgcagtgggacaatcatggctcactgcaacgtcatctcccagctcaagctaacttcctacctcagcctcccaagtagctgggactacaggcatacaccaccatgcctggcaaattttttaaatttttagtagagatgaggctcagaaatacttagtaaacatgtacaaagaaattacttttctaaaaaattatcagccctttttaacattgaattaagaaatttttttttttttaaatttttcacccggtgaccagtgagtagacttttt

SEQ ID NO: 63354 - DNA, 1210 bp, Homo sapiens
ccccgcccctccgtgctgaccgccggtcgcgctcttgccccggcgagaaacgcgtcgggcatgacgtcatcatacgcgacaacaccgatggcccaaccctgctcctgctgcagccggtgggcgagggcgcgcgcgaaagtcgattttcctgccgcggggaggccacagaggacgcagaggcctcgtttccgcggcccgtcgctgccggttcctctgatgttctcggcggtcttcatgctgcccggggagaccggaggagtctgggagcgtcgtctccgctctaccgtctgccctgcgcgcacgcgcagcgtctccgccgcctaccggcgcagtggaggaactggcctagctgggtttccgtgcggccccagaggcacctgctccaccggtgccctgcttgctcccagggaccagaggctggagagaccgcggcgctgcgttcctagctcctggacattcccaaggggtcccagagttaggattgatcttcaaatagaatcaccctccctgccgaaagttgccagccagtaggattggcgcctcagttttgttaggatgaggtctttctgcttaggaaaatcccaaaagagacgttgagcctttccctccagcaatctttcgaaaataagttactggaaatcaaagaatagaaggcgaggctgacagtccgaccaccgcgctcctttgcggttcccagatgtgaagagtgcaagggcaaagtaaacattcgttattgtgccctcacagcaccagtgggcagcaagcgtgaagaaatattgtcaggaaaggcacatccacagacctcaattccagtgcatgcagacagagaacaataggtgtttgtgttaaaaagtaatactaagctatggagaggtacaaaacaagtttttgttttttgtttgtttttaagacggagtctcgctctgtcgcccaggctggagtgcagtggcgcaatctcggctcactgcaacctctgcaacctccgcctcctgggttcacgccattctcctgcctcagcctccgagtagctgggaatacaggcgcttgccaccaggcccagctaactttttgtatttttagtggagacggggtttcaccatgttagccaggatggtctcgatttcctgaccttgtgatccgcccgcctcggcctcccaaagattacaggcgcaagccaccgcggctggccaagttttttttgtctgggggt

SEQ ID NO: 63355 - DNA, 1022 bp, Homo sapiens
ctctagttaccacatatttcatctattatataaattcagatttataatacattgactttactcaaattccatgctgatcttacacctggcccctgactacctttccccccttcttacctcaccccgtgctcaatggcctcttctcgattctgcaacactgcaaccagccaacctttgcgcttctgcacttgatgtgttcattgcctagaatgatcctccagatagctgcatggttcgctcttacccatctttgcttaaatgtcatctctgagaaggcttcctgattacctttttaaaaataaatcctcccatcactacactgccttaccttacttaaattttcttcagagcatgggcatatactcatgtaatcatgttttgtctgtctcctcattagaatgttctgctccctgccgattccccagcatctagagtaaggcctagtacagtaaggcaactcagtaaaaatttgttggatggatgaacactcagttccagaggtagaatttttagttacatttagtcaaattgcataattaaattgaaaacatgatgtgaacttttatgactgaaaactaataaactctgagtgtcgggaataacagtagcagtagaaagtcacaatcataccaactcaacacataactgacacatcataccttttgcttccttcattgtctgagatacaatccttcggagtgtctgatcagttttatgaagaatgttagttgaacaaataattctgtctgtgtcctatgttaatacagacattgttattagaagtcacatagttttataaaataaatggctaaagaataggtcacatgtatttgaaaggactaaaagaaaagtttaagcggcttttctgtttgttattcttccctacaagagagtccaaccaaatcagatccagtggtaaactgggttccagctaggcggtgatatgctggtgaatgtctaataattgactctcccagaaaaaaaccccagacctatctgtagtgtttgccaatttctgtgat

SEQ ID NO: 63356 - DNA, 1023 bp, Homo sapiens
agccatttattttataaaactatgtgacttctaataacaatgtctgtattaacataggacacagacagaattatttgttcaactaacattcttcataaaactgatcagacactccgaaggattgtatctcagacaatgaaggaagcaaaaggtatgatgtgtcagttatgtgttgagttggtatgattgtgactttctactgctactgttattcccgacactcagagtttattagttttcagtcataaaagttcacatcatgttttcaatttaattatgcaatttgactaaatgtaactaaaaattctacctctggaactgagtgttcatccatccaacaaatttttactgagttgccttactgtactaggccttactctagatgctggggaatcggcagggagcagaacattctaatgaggagacagacaaaacatgattacatgagtatatgcccatgctctgaagaaaatttaagtaaggtaaggcagtgtagtgatgggaggatttatttttaaaaaggtaatcaggaagccttctcagagatgacatttaagcaaagatgggtaagagcgaaccatgcagctatctggaggatcattctaggcaatgaacacatcaagtgcagaagcgcaaaggttggctggttgcagtgttgcagaatcgagaagaggccattgagcacggggtgaggtaagaaggggggaaaggtagtcaggggccaggtgtaagatcagcatggaatttgagtaaagtcaatgtattataaatctgaatttatataatagatgaaatatgtggtaactagagttttacacagtaattccattaggttttgaatactgtattgctatatttaaaattgtacctttaaaaaccagcaatgaacattttttgagcacctttctatacgttaagcgctttacaaatactgtttctaatcttcacagtcctataaggtaggtgtaattttacaaatggggaaatggaagttcatagaggaacaagtaacttgtccaagac

SEQ ID NO: 63357 - DNA, 1031 bp, Homo sapiens
gctggagtgcagtggtgcgatctgggctcactgcaacctctgcctcccgggttcaagcgattctcctgcctcagcctaccgaaaagcagggattacaggcgcctgctgccatgcccggctaatttttttggtatttttagtagagatggggtttcaccatgttggccagcatggtctccatctcttgacctcgtgatccacccacctcggcctcccaaagtgctgggattacaagcgtgagccactgcgcccggccactaataatttttaaaagcccctagaactaccgtagcttctaaaaagggaggaaaggaacgattcacaagtattgaattaagaaaagagaattcagttacctgtaagtccttatttggctaaatatgtttggaacaaagaagagactagatgtgaagagagaagacaagaagtacgaaaataagatagatcagtctgaagccaggaaacagggaaaacaaaaacagccctgttactgagtggttgtaaagtacaataattcatattaatggtatgtcaaatgttggtctatttccagtagatttcgagttaagtcaaagaagaagttttgattcttaaaaagttggtcatatttttgtaaattggaaaatctgcttttgcagaaccccctcattcctcaaccctacagttctactatttaaaaacttaggctgaaaaggcccaagaacagcctattcttgaagaagaaaaacaaagcagggggacttaaattactgtgatagcaagacttattattaagagtatctggtatggcagcaaggacagataggctagtggaacagaacagagaatccagaagcagagccacatacgtgcatataaccatttgatttaaaaagaagacatcagagcttagtagagaaaggccgatctgttaggtacacattgctgggacagttggatatctctttggaaaaaagtatgctttgactcttatctcacaccatacacaaaactcaagtccagataaaaatatgaaaggtaaaataaaaagc

SEQ ID NO: 63358 - DNA, 1007 bp, Homo sapiens
aaaccacgacactgcactccagcctgggtgataaagcaagattctgtctcaaaaaaaaagagaagaaaaaaaaaaaagaaagaaaacaatgctaacacagaactcacacttccaccctctcctcagatacaacctccatcctgaagctcatctgtatgcttcctgtttgtgtttttaaacttttactatatctttatgtcctcataagaatatgtactatcatttggtgttttaaagtgtacataaatgctgtcatcctgaacaaatcctctcgctaactgcatctttaactctatactatattttcaagatttgtccatgttgatccacgtagctccctagttccctttaactgctataagatattctgttgcatcaatatatgacaatttatgcatgctttgttgacaggtaattggatttttagtgttttgcctttacaaaaatcactgcatcttttgcacatgtctacttgtgcatatgaactgaggtaaaattgctgggccttactgtaaatatgttgttttaattcactttgcgctgctgtaacagaataccatagactgggtgcttataaagaaaagaaatttatttctcatagttctggagaatgggaattccaagatccattcacaggttcggttgtctggggaagactttcttcacacatcctcacttggcagaacggaagggcctgggttgatgctgtgtgaaacctcttttataagggccttagtctcattcccaaggaggagctctcataacctaatcacctcttaaaggccccccactcaatactatgacattgaatttcaacatctgaattttagaggggacacatgcaaaccatgtcatatgtctttatctttactatcactaaattgtccaaagtgattgcaacagtgatttatatactcaacccacagagtataagaatttctcctttctagctgggcacggtggctcacgccagtaatcccagcactctgggaggccgagatgggcgg

SEQ ID NO: 63359 - DNA, 1374 bp, Homo sapiens
tgcaacctctgccgctggggttcaagcaattctcctgcctcagcctcccgagtagctgggattacagttgcctgccaccgcacctagctaatttttgtagtttttagcagagatggggtttcaccatcttggccagggtggtcttgaactcctgacctattgatccacctgcctcggcctcccaaagtgctcggactacaggtgtgagccactgcacccggcctcgtgagctttcttttaaagataaacttaggtacaaaggtgatatattaactaacagacacatagaattctgtcacaggtttagtgaagtaaataatctcccttagaaataagaaatgtgggcaatgtattatagtttttgaaatgtaataggtaagtttcatgagcattttgtgaagaagcctagttgacacattctttcattcattcaaatatatatcaagaaccccattcaaggctccaccaccagccagtgagcggacttggcccccatgcttacttctcttccttctccaatttccattctttttttttttttttttttttttgagacggagtttcgctcttgttgcccaggctggagtgcagtcatgtaatctaggctcaccgcaacctccgcctcctgggttcaagtgattctcctgcctccacctcccgagtagctgggattacaggcatgtgccaccatgcccggctaattttgtatttttagtagagatggggtttctccatgttggtcaggcaggccttgaactcccgacctcagatgatccgcccgcctgggcctcccaaagtgctgggattacaggcgtgagccaccatgcctggcctccaatttccattctttcccccctttcttccttctttcttcgtgccagctgccactgaccattctctcctgctgctgctagcagcgttcttccccttcttgagcccctttgcacttcgattcttacctcacttctcctttacccttctttttaattcttcctgtccatctcatcaaggagaaaataccttatgtcccctttgtcctcctttctagcccaaagttttcctgtcccaactctgtctttaatgagaaaaaatgttccgtgcaactttgccccaaactgactcctacttctgaaaacaaaacaaaacaattagctaggaaaattgagacgcataccacttttcttctaactggccagtgtttcttgttcccgggtgaatccagagcagagtatgtctgctcctaggcacatagttgcaaagagtgaccaacatgcagcaaagattgacagtggtttcaaacgtagtgactcgtccacagtttctctttttcttgacttttcagcgtgtaatcaaaactactcagaaaacatattt

SEQ ID NO: 63360 - DNA, 3065 bp, Homo sapiens
tatacgcatacatatatatatttttactctgtcttactctgtcacccaggctagagtgcagtggcgcgatctcagctcactgcagccttgacctcctgggttccagtgattctcatgcctcatcctcccaagtagctggaactacaggtgtgcaccaccatgcctggttcatttttgtgtttttagtagagatggggttttaccatattgcccaggctggtcttctggcttctggatatcgcccaccttggcctcccaaagtgctgggattacagggatgagccaccgtgcctggctgggtatttatattatcattctagtttcagagtatacagaagtttcatcccatcatttggaaaaataaaggcatctgaagtacaatattacttatagaaatagtttatattcctattaaatcttaatcttgtggcatcagggaaatatttgttacatagtaggcaatttttatccagtactttatagattcaactctaagttgcaagcgaagtcaaaactgatgaaaatttatttagaaaaatctaaaaattctggttttaaatatgagaatcagtggaaaataagggtataattttgtaggtcatatgattgaagaaaatattattttaacaatgtaaagcaatatgatttgttactataattaacctgtataaaagatacattttatggtggtttcagtaggtcattttaaaaaccaatgtgcattagttttcaagtataaggtttaagtaatttggtttaataatcagaaaatattcaatacagtgttggatattctgtcatgcactatttttcagttgacaatttctgtattttaattgaatactgtttcttcagtcatggttattgcactttatcctgaataataattcagaaattgggttttggttcagtgattctcaagaaaaagatctcttgcccattaagaagtgtatcaaaatctcataaggaatgagggagagaagggggctgtagagtttgaaaaagcatattcaatattaaaatagttttatatttgggaaggcaaaaatgaatctattgttttgcaatataggttataaacaggcaaaatgcaataaaatatatatctggttgtattagtctgttttcacgctgctgataaagacatacctgagaccaggaagaaaaagaggtttaattggacttacagttccacatgactggggaggcctcagaatcatggtgggaggcaaaaagcacttcttacatggcggcagcaagagaaaatgagaaagaagcaaaagtggaaacccctaataaacctatcagatcttgtgagacttactatcacgagaatagcacaggaaagactggcccccatgattcaattacctcccccgggtccctcccacaacacatgggaattctgagagataccatttaagttgagatttcagtggggacacagccaaaccatatcattctacccctggcacctccaaatctcatgtcctcacatttcaaaaccaatcatgccttcccaacagtcccccaaagtcttaactcatttcagcattaacccaaaagtccgcagtccaaagtttcatctgagacaaggcaagtcccttccacttatgaacctgtaaaatcaaaagtaaactagttacttcctagatacaatgggggtacaggtattgggtaaatacagccattccaaatgggagaaattggccaacacaaaagggtaacagggcccatgcaagtccaaaattcagcagggcagtcaaattttaaacctccaaaatgatcacctttgactccacgtctcacaatcatctctctcaagttcgaagttccacaaatctctaaggcaagggaaagatgctgccagtctctttgctaaaacacagcaagagtcacctttactccagttcccaaaaagtttttcatctccatctgagaccacctcagcctgaattttattgtcaatattgctatcagcattttgggcaaagccattcagcaagtatctaggaagttccaaactttcccacattttcctgtcttcttctgagcccttcaaactgttccaacctctgcctgttacccagttccaaacttgctttcatatttttggctatcttttcagcaatgccccactctactgttagcagtttactgtattagtctgttttcacactgctgataaagacattcctcaagattgtgaagaaaaagaggtttaattggacttacagttccacatggccggggaggcctcagaatcatggcgggaggtgaaaagcacttcgtacatggtggtggcaagagaaaatgaagaagaagcaaaagtggaaacccctgataaacccatcagatctcatgagacttactatcatgagaatagcacaggaaagactggcccccctgattcgatgacctccccctgggtccctcccacaacatgtgggaattccagaagataaattcaagttgcaatttcagtggggacatagccaaaccatatcactggtgatgccacttcttcagtattagggattctcagtcagaagagaccccctgtgtggcctgagtcccctcaggaggaaggtggacaacagagaaatgagagttttgatattttctgaaagaggaacatgtgttagagatgaagaatcttccaaggctcatgcagttgcttagaataatcattactgttatatgagaaacattttagtaatttaataaaaggataatgtttatttaaaaaacctgacttttccagagtaattttgttttgcacattcatgtttattgaagtggactaatttctataatgcaaatcagagttaaatattaaaaattgtgtaaatacaattgacataggaattacattaaaatattaggaagaaacaaggacaaatttagaccttgaatccgaagagataaagcttacttgactttcaaatggagagatgatgaaaacccactcattcactctttcagaacaaaaagacagtcatctgataagagtatgacatggatgaaatgccctacaggggccttggacatctttaatttctgcg

SEQ ID NO: 63361 - DNA, 1765 bp, Homo sapiens
cacgtgaggagcgtttcttttccagtgttgggtagaggcgtctgtcggtggggttatttggacagttctttagcttttcaggagcatctgccttgaacctgtaccgttttgggttggagacatgcagacattggaaactccgtctccccttttctgttacacgcttgtggagtaactctaaactttctgaaaatacgatcattatatttgcaacaatactgttttggctgccgtattgaaaggaaccgtttaggggaaatgtatgtttaccctcagctagcgtgttggctaggataaagcagccctcctttaatttccagacacaggagtttagtgaccacttgcttttttatgctgttttttggtttgtttaccatgaatagttgagcccagtgcatatcccgagcataaactgaacacttgcttgtagaaataagaatgttgaaaccctttcaaaagttctagtttttaaacggttcaaaactattttataggatccaacgcatgcctggagtggaggactagatcatcaattgaaaatgcatgatttgaacactgatcaaggtaatgtgaccatatctttaccagtttgttttcttggctagtgttcttaagtataaatgtttatgtaggaagagtggttcctaaattgcttagttactaagttgcttaagtacaggtggcttgaatttaggatttttttaatttaaatgataaccattaagttactgattacagaatattatgcatgtatttttgcagtaaagccagttatggtcgccattgtcagtgtttacataaattgacactcaagtatttggcctttattttgtccttagaagtgggctggatcccagactggccagcgtttcattaggattttccactacaatgctgatgttttgagagttcagtttttagaagctaatttagttttcagaagctaaaggtagatttaaaacctgacaaaaaataggcaatcatgtctatattaattgtgtttgttttaggtatttagcaaaatatgtttccgttgcattttttgaatgagtaactagatgatacatttcctttcggttaagtaatttcttagagatccagatatgaaatgacttactcaaatttttttggtgacattggcacagtgttagagattggactggagcccaaatgcatagagctctctagctgaacatttgtttgcatgtgtattcatcagacataggtattctaaggagataggagggtacagagatatgactagagagaagatgagttgagcaacaggagaatggatggaggatggccacattttgtcaaaaaactaagcacccaattagaagaggcttttgcatgaaagctacttcttctgtaacttatactgcaggtattgggttttgtttgccagtagcttaccctgtgtaataagtaagcttgtaagtctaggttctatttgttcagaaacttgtaggggtagggagaaacactgaaaagcaaacgtctcgattttcagtgttacatagagaattagctgtttattctatgaaagtcactgccaaacttcatgaaatcctttctttttctttcttgtttttttttttgagctagagtctcactctgttgaccaggctggagtgcagtggtgtgatcttggctcaccacagcctccgccacccgcattcaggcaattctgcctcagcctcccgagtagctgggactacaggtgtgcgccaccatgctcggctaatttttgtattttttagta

SEQ ID NO: 63362 - DNA, 1086 bp, Homo sapiens
cttaatgttcaacataaatgttgttgatccagaagaccagagttctccattcatttgtttattcaacagatatttcttgagcacctagcctgtaccagaccttgcactagatacgggcagagatcacagaggtaaacgcagttcctgataggaaatctagaatcaagtgaggaagataacagacatgccactatgttaatgtaatctgaaattcaagacagcctttggtatgtgcaatactagtgagtcatgtgaagtgtgcactgtaaggtgaacagagaggaacggataactttgtagtcatggagagatttttctgtctgtagtagacatttccatggggttggatgaggcaaattcattacagttgaatgaatgtttcttttaattgtttattttaggaatctttagtaaaggtagtaagctagatgttggggttttttcccctttttttttctctatagaaaatcttgttgggacccatgatgcccctatcagatgtgttgaatactgtccagaagtgaatgtgatggtcactggaagttgggatcagacagttaaactgtgggatcccagaactccttgtaatgctgggaccttctctcagcctgaaaaggtaggctctttatattcattgcaggagttgatggttttggggtgatttttgtcttggtgcatgattgttgactatgcttgttgaatttaaaggtgaaaagtcaacatggggggaaaaaaggttgacagttggttttataaatccaactacatagaaatgctttaatgcaaaagaaaattaactttgggattttgggccaacttttatttgtcagttgttatatttgcttccatgtattgttaatgctttaaatcgcaaaattgagaagcaactcactgccttttcagagaagtcatttagcagactgttcgattgtcttaaattgacgctccatcccaaaccagaagattggatggagcatcacttattttcatttgttatctgaggtttctttgggttgactgttgagagggcaaaatgggttatcatttcaagttcagtaagaaaggtgttttatgttccctggcttg

SEQ ID NO: 63363 - DNA, 1886 bp, Homo sapiens
cagtggggatagaaagcactattagaagcttgtgtgtcacctatatagtaaagatttaagataaaattcccagtatgattgtaccattataaatcgatctctttctggattctttatttttaaagtttggtactttatacatcttaattttcattttactgcaaacattttgttttctgagtaagctatgataaatcttaacatttctgacatttatatctgcttatattaaatctattgttttgaatcttaattttaattccttatttttcccttggtcacattaattgttgaattttaaggccagattctagagaggggtgggacatggcgttgttaaagctaacttggttcttcagctgatggtatgtggttaacatactagtgattattaacatatggcttaagtactgaatgttgaagagacatcatcttaccttgccatggggcctctctgcattttttatggcagttcttcaggtttgaaaatgctaagtcagattagagtttcttattaattgaaaataatagagcacagttgtgaatcgcaagtctagatttttaaaaagtgactgaacatgatcaggagaatatttttttgccacctttttaatgagttggctacctctgttttgtttccaagtaacactatatttgcaaataaaccactaaatgtttgcttgtaggaaattctatggtttattataaaggaatttttgtggaaagtttaatattgaagaaagacattataaggggaaaaataggggatacactacttttaaaaattttccctaatgttgaacttctatcttgaatgcatagtattacatcagggcacaagaattgctttgtcatatgtcagaccactatcttgtcttttaattttgagtttgtatgccaccaaaggctgctaaacatctaattagtggtggctccctcacccttcctggaaaggcctatttattccatgtaacaactggggaaaaaaaatcaagatttttagagttgcaaaatgaaatattctaaaaggtggttttagaaaaatagttttgaaaatgattgttttatgaaaagccagaaacccattaagctctaccttgaattattttatggctctattatctcatttttgaatttttttttacacttttatgttgtctctaaatgaaacatgaaggctaggaaaaatagtttaatttgttttagtaatggagagaattaagacttcaaaagctcctttacagaattacttagaatgtacattatatgatgcttggtgaagtatggagagcatcatgggtttgctattttatgtgaattacttggtttgaataattgcagtatctaaaattgttatctgtgattggggaattcagtcagctaattttttatggtcttatgatcagatggactttattttggggcaaaatgccattttcaggcaagaaggtgatttttagcaagttttgatcttttttaaaaggtatataccctctcagtgtctggagaccggctgattgtgggaacagcaggccgcagagtgttggtgtgggacttacggaacatgggttacgtgcagcagcgcagggagtccagcctgaaataccagactcgctgcatacgagcgtttccaaacaagcaggtattgaactatacctcctcttctttctggaatttgaaaataatatgatcttatattataatgatttggccactagcccctaaagccttctttttttttttcagtagtgatttagaatttgctgttaggtgtattcttccttgatatttttgacagccatgtgttaacaggaagtgcgttaacccccattttagagacgaccttgatgttcagagagaccaagtaatctgctcaggaagtggtt

SEQ ID NO: 63364 - DNA, 3233 bp, Homo sapiens
gcagttatgtgaaacttcagagatttagatatgtgattaaaatatgcttacattgtgaacattattttaatgccattatatctaatattttatataggattatttctactttgtaatggaagttaaaaagtaggattttactgacttatatatttcttcataaacagttttcaggaataaatctttttcataccttgaaggattaaaaaatcatagatttcatatttggtgtgttagctcttattttttaagatactgtcatttcaacgaaagatgaaaaaacgtttaaaattgtaaaccacttttgaatgtccctgaaagtctttgtgcaaacctgacttgctgtattaaatgcaagaagtagtatgactgagatggaagactggtgttctagttgatttggattattgatgcccccaatgaaggaaacacaattcttaacagttgttcgcgatgaagaggcacagaacatagaagaatatattttaactgagggaacaaatttgagtctgctgggcaggacaacaaataagcgacactaaaacactttaaatttttgtttaggtttgatgcagtaactagatattttttattgtaatgtgcaaggccctggtacctgtgaggaaagcatgtgatgagtcttattttctttttaaagtcgtcataaccatgttagtacagcctaaacacttcattaaagcctgctgtacttctcatttctgaaataatcactctttagtgtgggttgaatttgggaattagcaccttgtttttggaagctggaatttaccatttttttcctctggttctctcttggcagggttatgtattaagctctattgaaggccgagtggcagttgagtatttggacccaagccctgaggtacagaagaagaagtatgccttcaaatgtcacagactaaaagaaaataatattgagcagatttacccagtcaatgccatttcttttcacaatatccacaatacatttgccacaggtaaagtatggcatgctgacctatatttaattattatactatttggtgcttgctttttatggtatttagtgaaaaaaaatctgtacagtgctttagggaaatgtaacttctatgaccttaaaaattaactgttaagagaatggttatttctgtatctggtgttaagaaccattttaactgttttgaaattacttccaggtggttctgatggctttgtaaatatttgggatccatttaacaaaaagcgactgtgccaattccatcggtaccccacgagcatcgcatcacttgccttcagtaatgatgggactacgcttgcaatagcgtcatcatatatgtatgaaatggatgacacagaacatcctgaagatggtatcttcattcgccaagtgacagatgcagaaacaaaacccaagtgagtatgcttcacctgtatttgagccttttcttgcattcaacccaggatttattaatttttctaaattcatgaatagcattgttgatgcctgctcgatattacagctgactgtagggttggagttgatgttatcatgttctcccaagctttcaatatccgtaggttgatagacgtctgatggataaaattgtgcctagttgttttgtagagaagaatgtcaaactcttattcttcttgaataggctctattatttgaatctctggagttattaccagctcattgcttcaaaattaagttgaggaattcaagaataatttattttagtaaattctatttaagatgtttaagaatttgaactgccaaaaatctttcctctccacagaggttgtttctttaatattaacacaaagtaagtgaccttcaggtcttattggaaactcagagtaatatggccttgcctggaattgcaaatttccttagttttgaaattttcatagatgtctttggttcttggttgtaactgttgactgagaagagccatttacattttttgataccaacagggcaaagctttttacttaattacctctaccaggctttaagggaaatctgatacttcagcatgtgttaaactataaaatacctactccaagtatctgcccagttccttgtcccctctccccaggcccttaaaggaagttctcgatacatatttgtagaataactgaatgttttcaggattcctgtactttgctgagttaaaatggatatggtacccttgctgattggttgagcccctaagagggggcagaatattaaatattccatatcagatatgcttttacaggtttgactttagaaaagtcttagcatgtgaagcctgttggataaagggctgtgtttgcatttaatctgtcacttttgtatctcctgtcctggctggccattttgatctcatgctgttctttttttcttttgaacttgtaggtcaccatgtacttgacaagatttcatttacttaagtgccatgttgatgataataaaacaattcgtactccccaatggtggatttattactattaaagaaaccagggaaaatattaattttaatattataacaacctgaaaataatggaaaagaggtttttgaatttttttttttaaataaacaccttcttaagtgcatgagatggtttgatggtttgctgcattaaaggtatttgggcaaacaaaattggagggcaagtgactgcagttttgagaatcagttttgaccttgatgattttttgtttccactgtggaaataaatgtttgtaaataagtgtaataaaaatccctttgcattctttctggaccttaaatggtagaggaaaaggctcgtgagccatttgtttcttttgctggttatagttgctaattctaaagctgcttcagactgcttcatgaggaggttaatctacaattaaacaatatttcctcttggccgtccattattttctgaagcagatggttcatcatttcctgggctgttaaacaaagcgaggttaaggttagactcttgggaatcagctagttttcaatcttattagggtgcagaaggaaaactaataagaaaacctcctaatatcattttgtgactgtaaacaattatttattagcaaacaattgatcccagaagggcaaattgtttgagtcagtaatgagctgagaaaagacagagcatatctgtgtatttggaaaaataattgtaacgtaattgcagtgcatttagacaggcatctatttggacctgtttctatctctaaatgaattttt

SEQ ID NO: 63365 - DNA, 1851 bp, Homo sapiens
aaagttaaaaagaaaaaaattatagtgagaatgagattcatttcaatgtaatgcactaaagcagaacacgaacttagcttggcctattctaggtagttccaaatagtatttttgttgtcaaactttaaaatttatattaatttgcaaatgtatgtctctgagtaggacttggacctttcctgagatttattttatccgtgatgtattttttttaattcttttgatacagagaagggtctttttttttttaagtatttcagtgaaaacttggtgtaagtctgaacccatcttttgaaatgtattttcttcattgcaggtccacctaatcatcctgtgaaagtggtttctctatggaaagctttgtttgcttcctacaaatacatgcttattccttaagggatgtgttagagttactgtggatttctctgttttctgtcttacaagaaacttgtctatgtaccttaatactttgtttaggatgaggagtctttgtgtccctgtacagtagtctgacgtatttccccttctgtcccctagtaagcccagttgctgtatctgaacagtttgagctctttttgtaatatactctaaacctgttatttctgtgctaataaacgagatgcagaacccttgaatgttggatgtttttgaatgttggtaattaatataatttacttaaaaaggcttgtgtaaggcaaaactcgtcatcacaggcatgttgggggatgacattttacctttaagtccactctccctcgtttaattgtctcctctgatgtgtgttggggattcagtcctgcataaagtgatttgttggagttcagccatttccctcatgcccccttgtgccctctcggtggatcagcagggcctttgagccaagtgtgcagcttcactcaggatgggcagagactatgtggcagcctctggggaccttttggctcagtgctttactagtgccagcgcagtagtgcttaggtagcttgtgcatccccgtgttgatgtagtcatagtccacacagagccaaataacagacccttctgtacttagccatcaaatactaaatcacagtgaagcccttgggaaggtaaataatgtaatagccagggactgatggtattagttctttagtgtgattatgtgcttctaaaagtccctaaccacttggttgaggacagaccataagtttaaaacattgtataagtgaaagaattaatatagtattgttataggtaaccaaattatagtaatgtggacttgtttttgaggtggtgagggagggcttattttgtggttccatctggatgtcctcttgtctctggaaatcaagtgtgcctccctgccatctctacataccccttaaccagctctccacaatttacttgtttatggttatagctaccttttccccaagttacccaggtgtagttaccttggccttctcattggtttccctcacccacattctttaagtgtctcttctgtttatcttttcttcctactgctaccatcccagggccttttgggtgaatgtggcagcctccaatttctgccttaagtcctccatctaatagagtagtgacttttgaaccttgtagttgtgacccaagtaagaaatacattttgaactacagttcagaacacagaggtcagtatattatacatgacagaaggatcctgaaatatgacttgcccttcttgcatgcgatgtatctggtgcatgtgtgcatttttttctttgctttttaagaaatcctggctatgtcaccttgaattgattttacaacaaatgcctgtcacctgtaatttgcaaaaactgcttgatcagattctaaaaaatttctaaaaga

SEQ ID NO: 63366 - DNA, 1083 bp, Homo sapiens
agctctaacttgtatgtgtgagacagaccaggcttcgggggtaggaggatctgcagttgttcagccgtctttctgctggtgttgtctttctgccatcagagaagggacacacagcccgttcgaaggtgtgcagagggctctgagcgccaggatggccagggctgtttttgctactgaaggagcgtgtgtcctgaactcccacttgcagggacagtccccaccttctctatagccggcactgggagcagccgccagcagggaaatctggcctgagcacaaggatgctttagggagagatcacttcagtgtgtgtgtatatttatttgcagtacagtgcgcgcgtgtgtgtgtgtgtacgcgcacgtgtgggtgagtgcgtcttctgagtgggttctgttcagttgctaatgaggctcctccgctctggacacaacccttttatagattaatttctctgccaattaacttgtcattttcagtacatattttactattccacaccaaccataattacaacaagggatttttcttatgcactcctatgcatgtgaataacatgtggtgtaattctgcttcttacagaagtattactgaaggtattatttccaatattatttggtttattatgcggatcttttttatatatgcagtcccatcccttctgtgccactcaatgccatccagacatggtttttccctccaggggcctttctctccagagggcacttcggctgcctctgcttcctctcattcgaggcccggctcttgctgacagaataggttccgttctgggcggtggttctcgagcctgccattcaaaaccaaagcaaattggagcatttctcacaacatggtattgaagttcctttttgttctcaaaagttgtgaccgtgttaaattgtactcccttagtcctgtaaggtatgttaagtgaatcgcagttacgctgtacttttattaatatttaacataattaaagatggacccataagagtgacgcctgtggagcgcgtgctcttcctctgcagccaagctcttcctggtgcatgagtgaatcgcagtggtttagtgtcgcacctgctc

SEQ ID NO: 63367 - DNA, 1115 bp, Homo sapiens
aaggtgccagagccctcccctgcaggccctgggaccactgagttctctctgcaggaggctgcctgaaaaggactgggaaaagtggggcaggtgtgggctttgcactggggactcctaggaggaagcggcttaagctgggctgggtttagatggacagggagaggcagggcaggggggaactcctgacccaaggcacagtttattttaatagctttaaatagtgtttcttgctgcagaagagctaatatctaatatgcacgtacagtctgcttgctaccgggcactttgtaccatgcagagtgtgccgactcccatccagcgccctgggggcaagcccttggatagtttctcccacacagaagggagggtgtgcccctgccctcctgctgcgggtcagcactccgactgtgaactggagagcacagctgaaactgagccataagttcatgggcaccatcgtgatcctccctgtgttgtgtatgcttgagtcttcgtgataaaaggtttctaaaactccatctgtgagaggtgaaagggatctaacctttgttcattactgccagcccctgtcccaagccctttcaatgcatcgtctcattagagatcccctgaaatccatccctgttttacaggtgggaagactgaggctcacagaggttagttctcccatccatagctggtatcaggcaggctcaaggttcaatcctgggtctgctggcgtttgacactcagggagtttttgccttccctagctggctcctaaaagcaaagggttttgctggcaggaggcctgggcttttatgctcaattttgcgttttgctgaggatgacaagacagtagcttagcaggtgcctctgctcagaggagatccccaggggcaggctcagtggacaggaggggtgcagcagtaacagattgtcccttaatcttcagtccctggagaactcacacaccagagaaagagccaggcaatcagaaaccctccttatagaggtgaattttcatttctgggaggagaagccggtttccctccagatgtgaatcccagccctgccacagccctgggagggcagctttgtaaggcaccctgggccccggcacaccctgctggagt

SEQ ID NO: 63368 - DNA, 1099 bp, Homo sapiens
atttggggtgagaagaggaacttttgaagaacagtgttcccctctcatgacaaataagattttgtctcctttagaaaaaattaaacaggtcgggtacagtggctcatgcctgtaatcccagcactttgggaggccggggtgggtggatcgcctgaggtcaggagttcaagaccagcctggccaacatggtgaaaccccatctctactaaaaatacaaaaattaccagatgtggtggcacactcctatagtcccagctactcgggaggctgaggcaggagaatcgcttgaatccaggaggcggaggctgcagtgggccaagatggtgcaactgcactccagcctgggtgtcagagtgagactccatctcaaaaaaaaaaataaaataaaataaaaacaaacaaaaataaacggaacttgcaacgttactgctgtttcttacgtaagtgttattcttgaggctgtccccactgagttgacacatgttgcagatggttttcttaaccattctgatcctggtctgtgtgacttcagccccagcaggcctgaccaggggcacaggacggttccttggtactgtcaaggcgagggaaacacccttagaatcaggggtgtaagcttctccacgtggtttaactcctagaattctgtgtctctccacgtggttgatgcctttatccttgtctgcgttgaatgtacagtttccagctttccttgagagaccaaaaggaagaacaatgctgagcagagcagctttgctttaagatcaagggtttcccagtgtgggtgaggccagggtagtgggatattgaacagccactatggggcggcctggctggcactgggcactgcttgcatcatttatgcctgtgtgaatgcagaatctcagggctgccaggacctgaaaattatttggtccagtgctccctccaatacttccacatcagagctaagggggcacctgtctaatccgaggccctctgagtcagggaattctccgcgcaagatggccagtgtagcttaggacagctgtgttcctattttgagaccaggtctgttttggggaaacatccactcattggtcctctttcttctccatag

SEQ ID NO: 63369 - DNA, 1086 bp, Homo sapiens
tgggccccatgaggaaggcatcatggagtttataggatactgcccttctctctcctgtgggcagccctcggtcctctctccctgtttgacacaacacatgcatcctgggtgtcatcgctgcccagccacttacgagtcccacctgtgcacaagttaaccagccccagactttgtccctccaagcagacatgtttctagctcttgagtaggtgttccagcctttaatctgccactgtctagcttagtggtggtatcttccagcccttgaagcatgcatggattgaagtgggtagccaggccgcatagacccccacccccatccccagcagccctttctgaagcttacctgggctgagcctcttgctgctgtcgccaggccctttaggcctttccatctctctttggttgctgtctgggaggccatcgctccagcagtagcaactttgtcctcagtatctcctgcttcttggttctcataggaatcgtccgcctaagagatgggctgcgagaccgctatcccgtggaagattatctggacctctttgacctggccgcacaccagatccatcaaggactgcaggccagctctgcaaaggagcagagcaagatgaatacaatcattatcggtaaggcgtctgtgtcactctggcagggctagcaccctccctggggtcctggctctggctccaggcctagcccagctctgcttcacctccagaacatttacatggtggcagcaaacttcttttgagcctccacttctccacctggctgtcactcttaccactacataaaatgttcacatcacttgaacattactataaagtggaaatgttgactttctaattctttggagacttaaggacagctgatggctttcttgagaagttgccatttctttgtttttaagaaattaagcagggatattgacttcttttcctgatgtactgatctgataagtttggatgggggaattataagtgcagttaactggttagtcatcgatttgctgcttggggcttttgtaatccctggccactgggaccatataagacggaggcagcttctcctgaaatagactcagct

SEQ ID NO: 63370 - DNA, 1149 bp, Homo sapiens
aattcttccacctttttttgtgccatgggaaaaacctgaagggcaggcagagctgctcccgaacttgtgaccttctctgaggttgcagcggctcttgtagaacatgactctgggacatcacttccttttgttttctttcggagctgaaccaaagaatgtgcaccctctttctctagtgctgtggtgtctgcttatttttgtatttgtgctttccatccatcttctgtgatcacaaggcattcttaaggttttctagcacgacttgcggacatccagactcgtggggggcccacccatggctcggtaagccagcagcccagggcactggcactaccatgaggcactgcattaattgctgcatacagctgttacccgacggcgcacacaagcagcaggtcaactgccaagggggcccccatcacggtcaccaggcgtgccccacgtgcaaaggagaaaacaaaattctgtttcgtgtggacagtaagcagatgaacttgcttgctgttctcgaagtgaggactgaagggaacgaaaactggggtgggtttttgcgcttcaaaaaggggaagcgatgtagcctcgtttttggactgataataatgaccttggtaatggcttcttacatcctttctggggcccaccaagagcttctgatctcatcacctttccattacggaggcttccccagcaaccccagcttgatggacagcgaaaacccaagtgacacaaaggagcatcaccaccaatcctctgtaaataatatttcatacatgaaggactatccaagcattaaattaattatcaacagcatcacaactaggattgagttcacgaccagacagctcccagacttagaagaccttaagaagcaggagttgcatgtgagtagctttgtgctaatcttgactgattggttgatttttagaaatgagtgcttttctttctatcaccatctttgggaacacagaaggaaaatgactaaaaaatgtcttagatgtagcaaggatcatttgacagccttatggatttgaatgcactgagagagtgctgtttgcttacgctatggagtgccaggaagggaatctgctgtcctgaacgctgggctaggcatgttcaagggccgctggctctcattattgcattccagga

SEQ ID NO: 63371 - DNA, 1087 bp, Homo sapiens
acgggtggccggtgggctgagtgatggctgaccgtgctccactgtgagccttgagttctgagcaggttcccctacagctgccaataacagcttcgttcgcctgctgcaggagaaaggtcacaggctttgcagccacacagaccagcggttggattttggccccaccactggtgagtcctgtgactcagggttatgtgtttaaccctgctgtgcctcagtttcccatacatgactcggggaatctcagtgctgacctcagagagtgccttcaagaagggacctagcatgatcctctgcaagtggcagacactggactatcaggcatttccttcttcttttgccgccaaccctaaactgactccgtgtgctgctgaaatgctttgcagctatatgactgtcctcgctttgttccctagagccattttggtagacgcgcttctcggcacaccctgtaagctcctcttgagtggcctctgccttattggaaaaccggagtcagtagatatacaagcatgagaaaatctagtccctacactggtgtgatttactactggaaataataaaatgagcactctgaaatagtttttctctccacttggtttcagaaaaaattattgattgtgtcacaaagacctttagagtcttttgtgcacattgaaatcattgggggggagaactgcagcatgaacatatttgaagtctctggtccaccctgccccttcgctgagaaaacctgattattttgtgcatttcagagagactgggacatctgctgtgtttggcccatatctcgggtggttgcacaagggaggtggagctgattaccctattagagagcaagctatcacagaataggaaaaagaccccattctccctcctgcctgccacggccagaggccctggttcactgaatcactgctgttgttaccacgcttgtttggcttcctggagcagagctagttcttctgcagattctctggggctgggtgggcttcacggctgtccttgaaatgggatatacagtcccgaatgtgggcatttttctggagcctctggagtctttgttctggcgttagatgggatgttc

SEQ ID NO: 63372 - DNA, 1106 bp, Homo sapiens
ttttaattaaaccatctacaagctgattttataaagaggcagaatccccatgtagtgagctgtgcctgcctccctctgtgctcaactctggagccgagtgaggctcgtaataaccagaggactgtgcgagctgctcaggctcggcctcatgggcagcattaattgtgagatgccaccggaacgagatgcgagggcattatcagcatatacttaattgattttgcattctccacaaaggaaggttaaaattaagcttgtttgtaaatggtgtttaaactgcacaggcttggggatgagttgcagaaactaacagagcagggcactggttggagggcctaattttctctttaggtggtggacagagcacatcactcaactaaggtaaagattttcccatttaaaggggctgaaagagtgtaagcctcggctcgtaaatttgacagacaaggcctccgcttgagtgcctcagggatggtctggactctggggatgaatgtgtaatcacattagcgtgatgagttaaagggccccatatttttaaatcctcaggcagagctgcattagagaagatgctgttcgagatcagacttatgataaacaggctcatggaaacagcctttgctatcctcattcctggtatagaatgtaagattctgattgtcattctgacatgccccaggaaaggtctctgctcaaacccaagatgagctttaaacctgaggtggaatgccgttctctaagtatctgttctttggctctaacatataccaggaatgagaacagcactctgggtgtgttctcactctcctttaatcctgataagaaaacattttaagtatctccagatccatctatataatttgcaagacgcagtgcaacatgaaatgcatattaaaaattattaagaattggccgggcgcggtggctcacgcctgtaatcccaacactttgggaggctgaggcaggtggatcacgaggtcaggagattgagaccatcctggctaacacggtgaaaccctgtctctactaaaaatacaaaaaagtagccgggcgtggtggcaggcgcctgtagtcccagctcctcgggaggctgaggcaggagaatg

SEQ ID NO: 63373 - DNA, 1385 bp, Homo sapiens
tcactgatattctaaagcacctttacaactgtaataagaagtaaacttggcagaaactctgtggctataaatcaggggtgccgctttgcaacccccacggagcttattgaaagaaatgcacatactttggtcctacatcagctgttacatcaagtctccggggatggatgctgggcatttgtgtgtgtgtgcacgcgtgtgtgtgtgcatgcgtgcatgtgtgtgcatgcgtgcatgtgtgtgcatgcatggacctggattcgttaagctctttagctaagaaacgctgagggaacttagcagtgattgtaatcattcttctaatgagaatttccagttctcctatggcaaagataagggacagataattagcacagtggtctcaggaatgagcctcatttgtcctcaatctgtgatgagactttgtgactgtctttgagtttcatgttcagattccctgattgtaactaacacacattgttcatcacttggtagcagtggtggaattttagatctgtttttctcttggggaaggaccccattctcatccccacagtggcccaggctggaggcccaggagtctcctttgacagatagctggtcagtgcagaattgcttcctttgtgtctctgccactggaaggttatctgttccttcagaacaggaaatgtgtcttattcaacgtggcatccccagggcctagtccatgggaaagaatgattgggccgatggacagacagatgggtgaaaggaaaacaggcaagagtatagtgaataattgaaaactttgacccatagtgcagggatggtgagtgtctttcagatcgtctgtttatagctggggaaacggaggcctgcagaagtcagtgacttgccctaatccttcagctttgatcaagaagaacattggggagcctggcccttcaatgtcttcaactcttctgactcaggctctgcacatcctcttgagagtcaccctccagtgaaaagaactctttattgaggccctgctgtgtaccccatgctgttctaggagctggggatctagcagtgagttagacacacagggtcccagtgctcacagagggcatatcctcatggagagagacaggcagcagacaaggtcgcaaatatcagagaatagacaggcataagggccatgtgctggagtgaccagctggtgtgcgggaaaggcctttccacaaaggtgacatctccgttgattcttgaatgttcagagggtgctgctgtctgatgcttggaaggagggaacagtcagtgccaggaccccaaggggagaacctgttgatgggatgggattcatttatgctcgggagaaagagacttggtttattggacgcctgggttgattttcttctcttctg

SEQ ID NO: 63374 - DNA, 2552 bp, Homo sapiens
gcggtggcggtggcggcggcggcccaggcagacaatgaacttgcgagctcgacgagccgaggcaggtttgggccccgggctccttggcccggcctccccgaggcttcagcgatccccagcgggaggagtcccttcgccattggtcctggccgcgctccgggcgccctgcgcgcttgaggaccccgcgggaagggttacccagcggcgacacacgccccctccctcgcagagaggacgcggccggagcgaggggacaggggaccgagcagtggcgtggtggcgccgtggatagccggaggccggcggggggcgcaagccgcgtggaacgcaccggcgggctgtccgggagaaggagcccagtagtcggaatcggggcgcccctgcaccgcccagctctgggagccgcaggcgggggaccgaccgacggacagaccagtgctttcacggtgtgagcgcgcgtcgtttggcggtaggggacggggattccccccagccttgcgctccgcccccacacccctatcgcactttggggaagtttccaggcgcggcccggggcaggtaagtgggcatccgccactctctccccggttgcgagctcggatgcgcttccagaaccctggctctagccttgcggcggttccgggcggggaggccagagctctcccgcgcctaagcccgtgggacccggttcagggaagggggatggcgggggcgggcctgggaagagataggggagcggctgagccccgagcggtgtgaacttttgctccccgccccctcctccttcctcctccccgccccgcccccactgctgtcccctccctgcgccccgccgcgtctcgggaggcggcgtgactcgggagttgccggcgcttcccggcggtggcggcgtctctggccggccttggtgcggcgagccgagcgaggcagctctgagccgcgcggtgaggccagaggcggggagccggggctgcggggcggcgaagctggggagccggatggcagcggccggggcgcggaggcgacgctggcggtggagatgtaatgcgagtctgttgggttgtgtgtgccgggagataggacgcggtggctgtgggtggctgggtggcgggctgtggcgcaattggccccctgggatggcaggatagaggcgccggggcgaagggaaccttgcctttgggaaaatgaatgaagagccgtggaagcaccttcccgactcctccaggcaaccgatgggccggcgtgcgcgcgagtgtgtgcgtgttgaggcttcggagccgcccgggtcctgggcacagctgcttgacctccccgtcgctgtccgggtgcccacgttcccgcccgccctgcgcccggggccggccggcgcggctgggacggcgggtatagaggaggaaggctggggctgggttgccggctgctggcggctggaggtccgcgcccagtgtagggaagtcttcgaaggaggctgccaggctggaggctgggaccagctcctgggggcgggggcccttcttcgtctgcctgcgtgcgcggagccgctgtgacagctgggcgccttcgccttgttcacgttggttaagttaattgtaccgagttctcgggaatgaagtgtggctccgggatgccccgcagagggatgtgacaagccggtcagtgaggctgagcaaaggggctaaccttgcctctgggcgccctagcagtgcccccagcccctctttatcagctgcaattcctgagtgttgtgggatgcctcggtgggttagggtagccacccagcgttggggcagaaaggcctcggagggcatctgcacccccgaggggccctgaagtaaactgaggcctagagatttgcccagcgtttctcctggaccctccttggaccttcctggaccattatccatcccccgctttcctgcttctcctcccaggaccggcaaccttgcaaaatcaggaaccctcccttccagaacatggcacttactaattttacaaactgaatgttgaactaggatctcttgattgatacataaagacatacatagatcatatatgattttattcaaagtagtataggaataaaaatgccttctaagtaggtaggtttttgcaaacaagtttttctcccccaagttcctgagaaactgtcagaagattttctttcttgccacctcctagatgggcacacagagctggtgaggtaaagtggcttgttatggccttcctgtgggcacataggtgagctggaggtggagctgcaggtctgggcttccctccaaagtccagctccggaggagagccagctcaggagccctctgcagaagtccaaccctgtctttgcggctctctcctctgggctttggatgattgcagtgagctggcttgtaggtgaagcatgcaggggtaattcatccaggatattgtccaggggggtggcaggcaggtcggcccacagtggtcacatgtgtgccttgcttttcttggatgatcaaagctcgccatgtctgagccactgtcctggccagggacccagcacggtcaccgtggctgct

SEQ ID NO: 63375 - DNA, 1052 bp, Homo sapiens
cctccgcctcctggttcaagcgattctcctgcctcagtctcccgagtagctgggactacaggtgcgcaccatgatgcccagctaatttttgtatttttagtagagacgggtttcataatgttggccaggatggtttcaatctcttgacctcgtgatccacccacctcggcctcccaaagtgctgggattacaggcataagccaccgctcccagcccaagcttcccttagttgagcaagttctgttaattttgttttgccaggctgcactttgcccatacatacggcaagggatgtttaaacgtttatctttgagcatgtacgttttactatttttctttagattgggatgcttggaaggtgtgtctacgacttcgagataatggacttctggccaagccaacccatggcgacattatcaggtttgcgcctccgctggtgatcaaggaggatgagcttcgagagtccattgaaattattaacaagaccatcttgtctttctgagggtagccagctgttttcagtggtccctgggagccagctggagacaggtggtcctgtaaaagctttattcctaatgtgggcacattccactcccatgagtcttcaaaaactttttttttgaatatatttttttcagttgatacataatagaacaacgtttatgaacctgccgtttgctttgtaacgtaactaaataatgtaatggcatctatattcagttgaagtgttttgatgtgcatgtgtacttcctaaggtgaaatgcatctatatacagacagcctctaaatcaagtccttcagtataattgatatatgtttttataatttcctcactggtataagtgtttcatatttgaaaaagttatctctgggtattgcataaaaggcttcatcttataaagtgaaatcattgttattgaattttaggaaggattaatggttaagtgtatataaaatactaatattaagtaaacttcatattggccaacaccagggttgtattctatggatgtcattattttgaattaagaattagtgtttaacattcctaa

SEQ ID NO: 63376 - DNA, 1193 bp, Homo sapiens
tttaggaacaagatattctcaaaaagtaatttaaacttggcctagtagactggatttcctccgtgggcttcctgagttcacagtcacctggcgctttgagttcttcggccctggctggccctcatagaactctcaactgtgacccacctaccagacccgtctttttgcttagcaagcaagtcttctttcaagtgtggatttataatgttttcagactgattttttaagtgcctgctgaaggtatacaattattatgtaatctctgaggacagatctttgtgaggggggaagaaactattgcagtttaggaattacatttcgtccattgatgtattcaattaatgacagtatgtgagttgcattaaataaactttaatccttattttgccatgaatgattggcaatagatttgtgatgaaagcaagactctgagctagtgtatgtttaattagaaactaatacaggctttgaaaaatagcaatgaaagttaagttcctctggtattttatctagtcatgtttttcctgtgtttacagtccccgttgtcctccaaaaaacaaaaaaaggacagtcttaatatttgtataatttttctttaaacgtaggttttagaagaagaaaaccttgctgaaaatgcagacaaattgggcattatcttgagaaatgaactcatgaagctaccttctgatgttgtaactgccgtaagaggaaaaggattattaaacgctattgtcattaaagaaaccaaaggtatggagataaaacatttactcaagataattttttaaggaagacctaaaatacacttggtatttaatttaattaatttatttatttttcgagacggagtcttgctctgtctcctaggctgcagtgccgtggcgcaatcttggctcactgcactctgcctcctgggttcaagcaattctctgcctcagcctcctgagtagctgggattacaggcgcctgtcaccacgcccagctaatctttatatttttaatagagatggggtttcataatgttggccaggctgatctcaaactcctgacctcgtgatccacctgcgttggcctcccaaagtgttgggattataggcgtgagcccaccgcgcccggccacactttttttttttttttttttttaagatggagtcttgctctgttgccaggctggagtgcaatggcgccatttt

SEQ ID NO: 63377 - DNA, 1065 bp, Homo sapiens
ctgcaggccacccggaatatctgtaataaaaacatttaagggaccagtgtgtgacccacttacttattgcctgaagaattgagtgtgccttggaatttgctatgacattggatttgggtggaaacagtttacccccaaaggactcctgtagactcctgtccttttttccagtgttcagaaacatggcatattactaattgtttaaaaccatgactggtgaacaaagagactgagaaaaattaatgtttgttgtagttcatgtcttgggtttgcctttcagagccagtaattgttactacatcagaggtctctgaagtatagatgtttttgctgaatagacaaaacttttgctaaaaagaatgctcagctttgttttttaagcatttaaacaaagcatttcatctcgacgttggaagtgattgtgaaattatatcattgcagaaatagcttttctcttttagttgcaaaattatattgttttgtgccattgaagtgtacctaaagtatttgtaatgttttagggtatgactaagtcattaggttgttactggtagttaggttggcagatgtaaactctttcgttgaagtcattaagtatcagtttcttggccgggtgtggtggcttatgcctgcaatcccagcactttgggaggccgaggcaggcagatcacctgaggtcatgagttcgagaccagcctggccaacatggtgaaactatatctctactaaaactacaaaataaataaataaataaataacatgtgtggtgtggtggtgggcacctgtaatcctagctacttgggaggctgaggcaggagaattgcttgagtccaggaggcagagattgcagtgagctgagatcacgccactgcactcaagcctgggtgacagcgagactctggggaaaaggatgcttagtagaatgcttagtgctgagaaatgacatggtgaattgactgtctttcaggtgtctgcagtgctgtgtgatgatgacatcatgctgaccattaagccaggggagcatgggtccacatacggtggcaatccactaggctgccgagtggc

SEQ ID NO: 63378 - DNA, 1975 bp, Homo sapiens
aatttattcatactgagtaaagcataaagagtccaagaaagaaatcatacatgagtgttttagacttagcagtagtattttggggaagttacatatagtacagttagacatttttgctagcagctacctccagttggatgattcttacatcacttttgttttgattgttggtacccacccctttgagataaagtctgatgaaagttatggaccttcttcttggaaaaatatacgtctgcatgtaattctgcattttatttcaggagattttggactctctgcagactgtccctggatcttgggttaaaaatctgtattctagactgaaccgtgggaagaaaaaatagtcagtgagtctttggcaaaccggagtactggattttgtttagcaattgcaaattcctgaacatactggatttactgggtagtgccaagtttaaagggaagtaagccaaactccaagtattatgttttgctaatttggcagctcgaatcaagagtggctgtgagattatacatggtttgacttgtcattggtagacttctgttgaaacatgaattaactagtcttttagaaagtaagtatagatggaataagtatgcctagtttttggcaactttctcctaatcatgaatttatctttaagctttttttttttttttccttccagaggtgattcctatgcacatgctctaatttccttttaattattagtttctttcatagcttagtttttacttcatggcttatcaggatgcttaatggtaaattgggtacaaagaggtgtgtgaagccttgtggaggggctagttttagggctgggggtgactggggagagtagctatggctctgacttatgtgatggggcggcagggtaaacaccagcctgctcagtgatgtttagactttaacactcatacaagtaacggattgtagtttgtagtttgactctctctagtttctcagttaccttttgctaacaatagctttttcgtttgtttgtttgttttttgagacggagtttcactcttgttgctcaggctggagtgcaatgcgcagtcttggctcactgcagcctcgtcctcccaagttcaagcgattctcctgccttagcctcctgagtcgctgggattacaggcatgcaccaccacgcctggctaattttgtattttcagtagagacggggtttctccatgttggtcaggctggtctcgaactcccgattcaggtgatcgcctgcctctgccacccaaagtgctgggattataggcatgagtcaccgcacctggtcaacaatatcttttatgctacaatttttcaggataagttttgtagaaacaaccatcctagcagaatagattgttttgtttgggaatctcatatatgtgtgtgtgtgtgtgtgtgtgtgtgtgtgtgtgtgtgtgtgtatgtatttatgtatgtatgtatatgttggtctaattcaacttgctgtgaacactttaaagctattataagttaacatttttttcctagtctttttgcctttcacctttgtttatgataaatttgacctacagaagttttagatatttgtggctaaataaaagattttaggctgggcacagtggctcacacctttaattcgaaaactttgggaggccgtggtgggcggactgcttgagcccagagggatggacagttcctctgtctcctgccccatgcctagtctctggcagtcttctctgatttggtctccctgcctctggtctctgccctacagttgtagctgtctcatagcattgtgcctgatggtatcggactgtggtaggtgcttaacaaatacttagtgtttagcaggtactcagtcaacacacagtgcattagctctggaaagagtcttactcttattgattggttggttgattgattgcctgattgacagggtatcactctgttgcccaggctggcctcaaactcttgggctcaagtgat

SEQ ID NO: 63379 - DNA, 1073 bp, Homo sapiens
aacctgggaggcagaggttgtggtaagttgagattgtgccactgcactccagcctgggcaacggagtgagactctgtctcaaaacaaaaacatttcatgccagtggcattgctgagggcctggggctggtgctgcacctgcatctcttttcactacaacccccggggaagggggtggtcaatgtcctttcccctctctgaggaaactgaggcattgagcttgtatttctctgcactggttcccatttcagtagtaatagggaccctccagcacaccaggtgatgtctgcaatgtggccccagaggcaggagcaggctgggagttaggaggctgaagcctgatgtgggggagcgctgccccccaaccccactccctgggaaccaaccctccacccctttgccctgctgcctccacacccctttcctctggctgtgaatttctccattaccaagtgggcccgtcagatctggaacttgggtcagttaggtgcttctcccagtaaagcacctactgtgctgggtactgggtactgtgcccggtagattttgggcaggattctagagagcatctggcaaagttgctgcaggaaagggccagtcactgcctgccagtctcggcccctgtgaatgcacgagttgacatttctcaaattccagcctcactttgtgggccaggcagcccttctgacctatgagctgccaaactgagccttttgatgacactgcccccgaggattccctgcagccctatgtcctcctgagcacctggtggcccctctgtggcctccgagaccctggcctgggtgctcactgcccctcatccctacacaggagatgctggggtgactcctctgttggtaaaccaaggctctggttgctgaggatggggctggtcctgcgccagggtgcccccaggtgctgatcttggctccactgtggttgggcaccaggcatggcagaggtgctgagcagacaaaaccctgccctcccaagccccgggcttgcagaggaggcaggaggagggaggtggtgatgtcaggaccagagcagcaccaagggctgtgtgggcgcagc

SEQ ID NO: 63380 - DNA, 1048 bp, Homo sapiens
caggcgcctgtaatcccagctgctctggaggctgaggcaggagaatcgcttgaatctgggaggcggaggttgcagtgagctgagatcatgccactgcactccagcctgggcgacaagagcgagactccatctcaaaaataaagaaataaaaaaaataaagaagtggcacaggtagagaggcggggggacagagttgcattccaggcaaggggagaggcaatgaaaaggggggtcaggtggggaacctcggggagcctcaggtgtatgaagtccagtgaggatggaaaagagttgtcggggcgtggtatgggggtcctctgagaagggatctgcttcagctcagaaatcccagcctgaacacatcctggatcagccaggaccccctcaggggctcgcagtggcctagtctgctctgggctttgctggatgcccttcgagaatcaccgcgcaacctccttcagaggcccaacactccacgtgctgacttcccgggcctgtgtctcccctgccgcagactgaagcgttcccggctgaaggtgaggttctgcaccaacgagtcgcagaagtcccgggcagagctggtggggcagcttcagaggctgggatttgacatctctgagcaggaggtgaccgccccggcaccagctgcctgccagatcctgaaggagcaaggcctgcgaccatacctgctcatccatgacggtaggcctgtcggacaccaggacctcacgggggtgaaagctcccctttcccagggtgggggctgtgcagagagcctctttcactgggccaaaccactgactgagctaggccaccaacactcatgggttgggggtaaaaacctcatgggacttcctgctgggggctgggggcaggttaggacccagctctgtccattccttggcctcacaccagagggtccttagagcaggttctggatggctcctgggaggaaaatcctaggctctctttcctgatctaggatggaccaagcggccagggaattgtcaaggtggcggagttctagctcctgttgagaaagagacag

SEQ ID NO: 63381 - DNA, 1031 bp, Homo sapiens
ccttcagtttccaaggccatctgtggccaggcctccgggtggggctcccctgggtccactctggcccaggtcccattagctgccccaggtcagcctcacatcccgtcccatcctcacagctgcagcccctcctgcctgcctgccgtcaggtgggagggagaggcagacgagcagatggagccctgtgatgagctgcgagtgggcaggggagaagagggggagaagggatgagaggacggaattgcaggcgagtgagcagagcactgctctgctggcccttgggagccctgtagttttgccagctcttggatgccttctgctgtgggtaggcctttgagtggatggcagggtgcctggtgctaggggacctgagtgacccgggcagccctttctggagttgtgaggctcctgcctgtgagatgagttctcaggcccacagcatcctgcttcttcaaggcccttgactcttgggggcacatttgggacagtgtttccgtggctgggcatacacctgttccttgatcccaaacttatgccatgtccctctctcttttcccagtatgcctgtggcatcaaagccgaggtggtggggaagccttctcctgagtttttcaagtctgccctgcaagcgataggagtggaagcccaccaggtaggttggcgccttgtgaagtgggtcaggggaggcagccccgtcagggaggccctggagcttggaatggattacaggactcaggcagcctgtggggttggccaggcagccaagcgtgggctccctgtgaaagctgacctggctgggaaggagggggaagacagcaaacgaaatccactgaatagtttcaaccgtgaagttactttcagtatgaaagcaagaagcagaaatgcctgcggcttttcctgagtttttgctgcttctctgaaaggataagaattgacaagtcctatcagtgtgttaatatatctcactggcaagacagtgtaacagcaagattacaacaatatggaggaaataataaagtcactcattttgc

SEQ ID NO: 63382 - DNA, 1032 bp, Homo sapiens
acacacacacatgcgcacatgcacccacgcactctctttgcctgtgggagggcaggatcccagctgccccagcggggaaggggtgtggggaatcagccctgcagatgcggtgtgaggggcagacatggcatgctggtctttggcagtgtggtcccaagtgggggcggctggagaggtgccttgccacagggcccaggccacccgcatgcatcccatgaggccgtccaagcccgtctgccctgcatcagagaggacaccccaatgcggggagggaggaacctggtgaagccaggagcggtgggcaggggccagcaaggatccccaggcccccagggcagtgtgcatccggccttcttgcatgcccacctggcatcctgcctgccgcctcctgcctcccgccccacccctcctgcgtcccagcctggtggacctctcagggttcactctcatttcctcctccccacgccacctgctcgggccacaagagggcgccttgctgccagggatgggacaggccgggcctgctggagccagggccgatgcacgcacagctacatacactcacccgggcccacgtgtgctcacgaggggcccccatacccacacgatcccgcatccacatgtgcgcacgccaggccccacaggttctcaggcccaggccacacatccacaggtgcccactctcatgctggcctcatagtgcatgcacacacacacacacacacacatatacatacactcacgcccagacccccccacgccccaggccacacatgtgggcctgctcacaccccactcattccctcccagatgccgcaccacccccatgccctgtgtgccctctgcctctcggggccctggggccccagctccaagaaccacgggcttgctttagccaggcttccacaagcctgcccattcctcaggacactgaccctctcctctgccacccttcacgggtgcagacgatgagcatggagaacaccacagcgcacagggccgagggccaccatcagagtctcctgcagccct

SEQ ID NO: 63383 - DNA, 1102 bp, Homo sapiens
gggtccaggtggcctgaggagaggggtgcaggccagctgagggggctcccagaactccacgagctcagagacgggctcttgcccttgcagccccatccttgggatgccccagcccttcatccagacctctgctgtgattgtgtcaggacctgtccctgcagtggactggaagctccaggtgggcaggccttgccgtggtcacctgtgtccacaggcctgggcagagcaaactgatgagtgtctactaaatcagagagaagacacaaccagggagcgagtgcacgcccgggccgaccagggctgcgggcatcatatcccgctcagccgctgcctgccctccacgcgcccctggctgcctctctcagcctcggccccctccactcatgagtgggaataaataagagagtagaaaacgtaagtgaggttcttgtctggccgcccggctcatagcaatgtttaatagatagtaactggtgttatgactgaagacgtcctttgtgggctattggagttcttaatatccccgagtaaccacagggcaacgctctggcttgacaaggggcggcactgctggtcagcagcccagccagccgcagcggccacttgtgttcccagctgtggcttgtgatctatggtcgactgagctgttactctcctcggttagacacgcatatgcacacacatgcacactcatgtacttacacatgtgcacgcgcatgcaacgcacaaacacatggacacacatgcgcatgcatgcacacactgtacccacgtgcacacacgagtgcacagacacgagggctcactgtgatctgctctaatgcatggtcttaatagctatataatattccacggttcttttttctttctttcctttttaagatggagtctcgctctgtcgccaggctggagtgcagtggcgcgatctcggctcactgcaacctccgcctcccgggttcaagcgattctcctgcctcagcctccttagtagggggggactacaggcgcgtgccaccacgcccggctaattttttgtatttttcagtagagacggggtttcaccgtgttggctaggatggtctccatctctcgacctcgtgat

SEQ ID NO: 63384 - DNA, 1084 bp, Homo sapiens
gccgggaggagcaggactgttgacacgagagcaggggtcaggctcagtgcacaggtcccagtgtgcagagctcacccggccccagctttcatcacccatctgagatcggcctccttcactcctgttctctgggacttccttgtgtgttagagactcgagcaagaccctttcttgtctatccccggacggacccgcctttcccgcatctctgggggtgaggtcggctctcgttcaggcctgcagggtccctggtgccgcagcccctctggttggaaggccccctgcgtgcagccccgtcctccagccccgctcggctctgaatgagttcattatgtctcagcgcgccctggccgccaggctggcagttcttcgggctggcggggctcgggagctgtcagcctgccaaatccagttgtttgacttcatgtttcaaggccaaatcctttcaggaaagttctctccatcccaccactccaccgccccccgcccttagaaaaataaatgcgtgattgactggctttgcaggttttttatccatcgttctttccaaagaatagtgtgaacagctcattcgattcgttcatgtgacgtcctccctctcccaatccctgtctctctctctccttccacagccacatgaaattgaagtgggagaacatggtgtgtgagcattattgggggtggggtgcggagcaggcactggctttggttgaggtctgcaaaggaaagcacccccactgccaggctgctcaggagtggctcccaccctcgactgcggggaagtgctggaaccctccgcacgagggcaacctttcttgggctctgaaggcgcctctcatcctctgagccaagaagacttctgacccagaattctgagttgagttccgacgcaggcgtgggcgatggtgagcaactccaggctaccccgagaaagccgctgtgtgaccccattaggggacttggctctcctgccaagcccccacccagcacctgtcccttgtgtcatgactggacttgttacttctagcccaggagctccaggtgaaggggactgtgttggtcctgtctgcccaggactctcccc

SEQ ID NO: 63385 - DNA, 1166 bp, Homo sapiens
tggttccggtgagtgtagggatggcacgataccagggcagcctcttgaaaacggcctcgggagacgggagctgcgagcaggtgggcagatgagggccctatgcgcactcaggggtgaagggcgtccgctggccactctgcaggggcccctgcaggattccaggcacctcccgtttgtccttgaggactgctggctgtaaccagggcacatcacccacctcaagacaagcccacgcccttgtcagcttagggggagcccagtcctgagggctgcatctctgttgtaggcccagccaccggcacaaagctggattcatgctccctgcccctaccccaccctggctcctcaccctggggcatccgaggagcctagccccctgagggtttgctctcctctcaaggtttgtagctcctctccggctgccttgcagacaccaccacatgggctctgctctatgggaatctggcttttagcgaatgtggcgtcttctgcaaacaatagcaattgggctggcttaggagcaagtggctcattttcccataaggctaaaaataactggtgcgctcccttgtgttggctgacacgcgcgttcaaagcacttttgtagtcactttgcttttgctcgtcttcatggacgagtgaacgcctcgcttctgcaggttgagtccagatgcttctcaccttctttctcctcaagaaagatgctttttgggaaacgttgtttaaatcttatttttttactacatcaaaaggatggtggttcaagttcccaatatgtgggtggcacttcttaaaaatcagctttaaggagctggcagaaagcccccagccccacagccctgagagatggtgttgctagctcaggtggctgacacatggggtatgccgggcactgggcaggtcccagagccggggaaccagctcacctctggttgctgtagctcctgccggaggcatgtctacttgtgatcccggacagccgaacccaagagctggtggctctgagcagacagagacatcttggcctgtccctgcctgggggtcatggagaccatgtcttcttagagcaaatgtggaggcggccagggcagttgttgggtgaatgtggagagcacatggccatgtcttgcccccggagtaccactgggcgtggggggtcctggcac

SEQ ID NO: 63386 - DNA, 1038 bp, Homo sapiens
ggaggaacccgggacttgattggtcttgccacagcctggtggtctagttgctttgtggggtgtgcagtcctggggctgcgggaggggagtaacccttagtaacctgtgtgtctgcccctccacagaactgtcagaccttcagcagcctcagctgcctgagcgcagggacagaggactgcggtccccagagccccttcgcccgccacgtcagcaacaccagggcctggaccgccctgctctcagcctccggcccagggggcaggacccccgctgggaccccggtccctgagcctcttcccccttccttcgacgaccacctcgcctgccaggaggacctgtcctgtgaggagtcagacagctgcgccctggacgaggattgtggcaggagagcggagccggctgcagcctggcgggaccgcggggcccctgggaacagcctctgctccctggacggcgagttggacattgagcagatagagaagaactgagggggtgtgggcccaggcagggctggggtgtgctggcatcgacagcccccactctgggcactaggtgggcccttgaaggggagcccaactcgtgggcctgatgaaagcttcctgagtggtgtcgggtcccagagagggagcccacctgctgcctgggggagagcctggcctggccgcgtcatacagcgggtgtgtcagcctctcaccggctccccgagcgtggcagccaccaggtccacagaactactgcagcccagaggacagctttgaagtttgcgtcttttctgcctctttccctgtgggatgttgggcagtctctgttgtccccggcagagctgggcaccgctctgtatccccctggtggtgggggctgtcagggagggcctggggtgggggccaggggccatctgctatgtcagggcccttcttggcctcactcaggttcacttctggggagtcggccccgcagcttctttcactcagttttactccgtgccttctctcccaggtctccctgcttcaggcttgggaaggttcgggagatgcttcc

SEQ ID NO: 63387 - DNA, 1065 bp, Homo sapiens
ccaggcagcaggtgggctccctctctgggacccgacaccactcaggaagctttcatcaggcccacgagttgggctccccttcaagggcccacctagtgcccagagtgggggctgtcgatgccagcacaccccagccctgcctgggcccacaccccctcagttcttctctatctgctcaatgtccaactcgccgtccagggagcagaggctgttcccaggggccccgcggtcccgccaggctgcagccggctccgctctcctgccacaatcctcgtccagggcgcagctgtctgactcctcacaggacaggtcctcctggcaggcgaggtggtcgtcgaaggaagggggaagaggctcagggaccggggtcccagcgggggtcctgccccctgggccggaggctgagagcagggcggtccaggccctggtgttgctgacgtggcgggcgaaggggctctggggaccgcagtcctctgtccctgcgctcaggcagctgaggctgctgaaggtctgacagttctgtggaggggcagacacacaggttactaagggttactcccctcccgcagccccaggactgcacaccccacaaagcaactagaccaccaggctgtggcaagaccaatcaagtcccgggttcctcctatccaggcaaggacgggcccatgagcaacgtactcatgaagatgcacctccggccaatgagcgctctgtgctcataaagacacgcgcaattccactattcacctactaactcggcaaagcacacaaatttgatgcagacccagttctggggggctgcggtgaaacaggaatgctcctaacacttcgtccacagcctttctgaagcgcaacctggggaaaatatatccaattccttgatcaggtaatttcactacttggatttttatcttaagaaaacattctaagatgtgtgtaaaaatttggcaacataccgttaaatggaaaagaagagagtaacccaaacaccctacaatggtggtgaaatcaatgtttttcaagcagggacctctatgcaaacataactgacgcgccgcgatactt

SEQ ID NO: 63388 - DNA, 1067 bp, Homo sapiens
cacagagagggatgctcccagcaagaaccttcagggaggcgagggaagcccatgaactgcagaggcccaggaaagaggtgggctcagctgaagtcgcttctcagcctggtgctttgggagctgcgaagtgtgactagcacgtgggacttgatcccgcccaagaggagggacagctcctgtccctgcacctgttggtcattggctgggggtgaccccaaagggaaagggtaacctccttcctatcctagatctcccagcccagagtagttccggaaggggcagccatgaactgtcagagccaacactcacagcagtggagagtgggcactgctgtgggtttgggactccaggtgggacaccagcagcctggctttcctcttaggatccttgcagtggccctgtgaagcagcctggccagagacagcagttctgcttcccaggggaggaaacgggaagtgaggccacttggccagtggaggatctcagtgcctccagctgcagagtctagtttcccactctcctctccggaaccctccaggttcagtggagagccagggcccagggggtgagaataccgcagcctccttcggaggaggcaaccgggacaaaggggagtggtcactatctgctcccagacatatcacctgaccagccagctttgtctttgtcaccggatgcccactcctgcatgtggggccgtagctcatgagttctagggacagcagtccctagacaaatgctggggctgtttccccctccactccccaggccttgcccttcggagcccagagtgggttctgggtcactactgataaaacatgtggtttagttcagctcaggagatgtttctagcgtctctattacgtgttcaccctgctggcccaggaacagcagcacctgggagagggaatgagcttgttgggctgaggctggacggagtgagtagcagtctgcctggcagcagtacagagctgatatgttgagttgatgagtttcctgaggcaggtctgtatttcagcttgtacctagaaggcaaggaccaggccacctttgtctgtatccccgtg

SEQ ID NO: 63389 - DNA, 1032 bp, Homo sapiens
atccaggctggtttccttactcccaggttagaggttgaagaggtaggtgcagaaggttctagctggagcctatacgtttcagaactggaagggacctgtcattatgtacctggtgaaacaggcctagagagttgcagtcctttgccctgggtcacttagaaagttagctgatgatggggcagtgaccagacctggccttccactgctgctgttgcctgcctttggcagtctgcccagcaggcctgcagctgcttctgcaagtcagtaggatacagctctcatcccccaccagtttcatcctgtctcccgcaagtggctcgcttgttgtggcaagcactttccaccaccagtctctccagtgacgctgcacattcgttaagggctgggacggtgctttctcttctcagggcggcttcccacaattgctaatcccggccagaccccttagcagcaaaaggagccccgaacaggcgggacaggtggactagctctgagttctgtttcatctgtaggaccttgggcaagttacttaacctttctgagcctgtttgctcatctgcaaagcaaaaaagagcacctttaggggcttgttggtgcacgcaccatgcctggcccattgtgagggcatggtggagggctctgctgttgcatttctagtgggttctccctcgtgaagccccatggcaattattcttgaggtctcatggcattcctatgaggcaggcaggacgaggtcattattgccattttacagatgggggaggctcccaaggagcggggagatgtgtgatgatgttatggcaggtggtggagagccaggccaggacacagcaggccgcagcccatcctaccccagcttcccagaccttcccctccatggagactgcaggctcgtgggcaccaggcacactgggctggaggcacccactgcccatctgtccctctccatcctggaggtttcctgcccaaggcttggccctctgccgtgcccaggcctgtggtcttgagcgtggggttttccaacagacgctc

SEQ ID NO: 63390 - DNA, 1051 bp, Homo sapiens
tgtgcacatactgctcttggcactgaggactgtgtggagcaggatggccatgggcccttctctctggcagcttccatctagtgtagacagatagacaatattaagagcaaagcagattgtgttggacaaagtaagtgctgcaaagacaaggagcatgggtagtgggacagaggcgacgagcagagaagtagaaggatcttctgcgtggaatgagagacctccaaggctggcgtgtgtgggaggagctggctgtggctggggcagagggaccccagcagagaacaggctgctggatattcatctgtgcctgctgaacccctgctgcagtcaggagccccagctctgccattaagcagtccctggatgacagtgggcgttacctggagtggccacgctcaccccaaggagaggctgtctccagagccccagtgctgggcagctcttcctcattcctcggcatcccgtgtttcctgctggtatcgtcctgagaagcttcgtgggatgagatgtcttggtggggaaagccaaggaggtagcaagttcaaggagcccctagtcttcctgttgacacccaggagggtgtggctttcaggcccctccccaggccagcaggtcctgacacctgaattcatgtggaaatgctgagcctctgaatggcctcctgctgtgtgagactgggtggtgtccaggaggtagtcccagggtgtgggtggggagatgggagatgagaatgtcctgaagctagccttgtcacctgaatgtgacaggacactgtggtcagtccaccctctccagccaagagtgtccaatgtggagtgaagttatgaatgggcccctaagctgggcctgaggaggcagccccgggccctggagctcaaatctgtgttgccatcatctaaaacgggattgtccagaagcccatcacctgtgtgcccctggggctcctgtaacctgggcacgctttgggacctgtggctcactgcagtcttggctgttggcaaagcaatcattgtgcatttcctgcctgtcttgctttcaaaaggagcccgag

SEQ ID NO: 63391 - DNA, 1045 bp, Homo sapiens
ctagccccagaacgggatccatccagcagcaggcaatggggcattgcttctgtttttcctgctctacagtaccagcacggtacccagcacacagtaggtcccagaaagacacattgaacaggtggcaaagagaaacctgaacatgggtcctttatgagtacaaaggaaatgaggaggaggcctggattctgcccactggaacagggcaaggcccaagatctgggaggcggacatacaaccaagaggcgtctaggtttgctcacttacagcaggcactcccactgtggaggcgcagtctggaggcaccccaggccccacgataagcatgctctgaatgatcaagagagccaaaggctccagggagccctgctgtagtgggagcgcaggtgttccccgacgccatggccctaatggagggctggtttgggtacaatgccacagtgaacacagaccccctgaactcacatatagactatttgttaagaacaaaaccaaactaatagtagggcactgctccatcagcaccgttgctccagtgtccatggcacagaccaatattggaaacgactgttgttcacggacaggctggaaacagttggtcaaattgtgcttggtgcggccaggccagcccagcccctaaggccagacaacacgaccctcccgaagggacaacagggttgatgagatcataggtgatgtgctgccctcccactgatggagtgtgttctgtggtgttaaagaggaaatagcattattacaaactaaggatacaagagcatcaacattcacagtctttgaaactgaacagcctaaaataattcaattctatgttgcacaagccaggagtttttttaaaaactgtgacaacacttggacacaggaaggggaacatcacacaccggggcctgttgtggggtggggggagaggggagggatagcattaggagatatacctaatgtaaatgacgagttaatgggtacagcacaccaacatggcacatgtatacatacgtaacaaacctgcacgttgtgcacatgtacccta

SEQ ID NO: 63392 - DNA, 1086 bp, Homo sapiens
gggagaattgcttgaactcgggaggcagaggttgcagtgagctgagattgtgccatggcactccagcctgggtgacaagagcgagactccgtctcaaaaaacaaaacaaaagcaaagttgactctggcctgggacccagaaaactctgtcagccagatatcttctggccccttaggtggacagccagctcagaagttgctagaggagatgagcttgtggtaatggagcttggcccggcaaggtggttttgcagccactctgtgaaaataagggtggggatggttggctcagatttaaaagcctcagctggctgtggttttatcctgtgccccacctcaaagttaggcagtggaggctgtcccagggcagatgctgccattgtctgagaaacctgcagcagccagcctggagccaggaggctgttgcgtgggctggagcatctttggggacccagaaatgtgttagaaagttcttactgtaaccaagaccacttccaccactgctattagctctggccctagcactggcctgttttgaaactgacaatgaaaagatgaggggcaaggaggaaaagctgctgatcagttgtatctctccctttaaataaagctgctccttgtggctcctcttagtccttccttggtgagcagctctgctcagactttaggcctatcatggctgaaagcaggaaggctagaggtggagggagtcacgattctccaaagggtagtttagcttcaaaggctgtatgtgtcctgcaagtcctgtcagtgtacactgagctcccatgatgtgcaagatgctggcagaaggggtgggtgcacgtcagccaccaaacctgcccatccccaccatcgccatcccagtatctgggacacagctactgttattgtcatgccaggttaccaccacagacacagaagcacagacctaattaaataactcacctagggccatggtgccggttctaggcaggtaagggatttgaacttgggtggtgtggctagcagtctgtgtgctgagcccgtgcagcgcagcctcagtgggggcacagggagcagggtttgaggaccagcaggctggaga

SEQ ID NO: 63393 - DNA, 1020 bp, Homo sapiens
tttactggggacagtgtggcaggcactgtgctaagcgtttgtgtagctgtggattatctttattacagccctggaaagtgggtattgttgtgcttgttttacggaagaggctgaggttcagagtagcggccacggtcacaggaccagctgtggccatgaggcccatgcttgttccactccccaggagggggtctgggcagggctctgggtgccaggcccctcccatctcaggtgttgtccacaaaggggtctggtccagtgagggctagagtcatggaggtgaggggttggctaggccttcctgccttgccgtggtggacacatgaggatccctggtgtgaggcagccaagcagccgggctcaccgatcggagcccagacctgggatggcagcagggatctcacatgacgtcatctagggagcttgctctggcccctgctaggccagccgtcagagccatgtaagacagtctaagatgacagttgtcactgttgtggatgaagcaggctaagattggatcattactgaaatctgaaacttgaatttaagtggggacaacgagcagtgtccaaacgggggcagtaatggtggccttggtagagcccaggaacctgttgaaggaaccccctcgtgcttttgacagggcaccagaggtgttggggtggtggtggcagaggacagtaaaaggtcccttccctcctccccactgccctggccttgaggcctagagagacctcgcagtgcgggacagtggctgtaagattgtctcagagcccaccagctgggagaaggaaaagcacaggacaggcgcagcttttattccaggtgtcagatcctgtttgggccctttcaggaggcctggcttacaaggagagctagactctgcctttttcctctgcagttgaggtgggttagagggcagccatgggcccttctgctcctgggcctctctcaaccttctggggaccattctcatcacagcatgacctggggaacactcacagaggacagaggtcccag

SEQ ID NO: 63394 - DNA, 2136 bp, Homo sapiens
tactgcttttttgagacctggtttgaccacccagcattggttggctcccagcaagacttgagccatacgcggccatttagacatggatcacgtgtgtgtgagcaaagatttcagaaaaaagcaacaattaaaaagttcacccattgaatgcagtccccctaggtgtcatagtccctgctgtatttttaactccaagctggtcagcttgaaagagcaacaaattgtacttctcaacagtgcttcaaacagaagcaagatgtttgtggggaggggtcgggatgtcgaaacagaggtttgattgattgcggctgcccacacactgagtccccgaacctccctgagcaggcctcagaacaggcagcaactgttgtgttagcagatgtttgagggaccgtgaaagctggccaggggcagtttggggtagaaaagaagcatgagagaaaccagcatgccagcacgtctttgggaagcctctgagagccgtattcctgggggtgagtccaggagagctgggtgggcggggccgcagggactgggcaggatgaggggttgctgcaggaagttgggagagcttgtgcgtatgctcatcagtgactcgcagctctttgctggacaggtcctccccaggtgaagcccccccagccagcttccactttccatcttttgtgctggtggggccgcctttgagggacagtggcccttgttggtcgccatggggttggctacatgacttcttgcgctggcacccccagcagctgcaggccagctgtgcctttccttggccaagttcctgtgcggcaggcccagcttgcctgcacctttgtgacttttcctgtccatcctgccagtggctgttcaccttcagctgcttagggttcccaccgccctgcaccctcagcacccttcctctcagggtgggaagctgtgctgacggcaagtagaggaattcagaggtggagcaccccttataacacagactgcagacagtgtgaagatctagtgagagaggtaggcatggaaagccctagaaagcccattgcaatgaaagaaatgctaaatacaagtaaaggcaaaaacttttgtgggcaggcacacgagagtagttgcttctgacttagagatagttaggataggcttgaacaaaggaagagagcctgtaagacctgggctgtcagagtttagggatgtcaagggggcagctttggatgctgaactagcactcctccttccgtgctcttgacagacattgctaatcaatcacggcagccttttcaggtgaacttagtggaggtcttagaatcctcctcttggcagtcttggcagccattgctaattgatgggtaattgaacgtcatccaccatctctgttctaatcccctcacttgaggatgaagcctctagagtacaggaagagttggggccttgcccaaagtcacatggtgaggcacctcggaaggtgggaaccctgacctcttgaccccaggctcagtgctcccactgctgtgcttggtcctgggtgaggaccaatcagctggcccttccagaggactgatgcacatggggcatagagagtgtggcagtgagaagtgggagcttcggagtcagataactgggggtgtgtccccattctgccacttttgagctgtgtgccccaggcctcatgtctgtgtctgtaaaatgggaatggcagtgcctgttgctcatgagtgtgggaggaatcatgtcgcatggatctggcacacggttggcactcagcaaatgccagctttgatgaacaaagaaagcccgggcctgctgcagcctttcttctgttgctcccatggtagctcgccccacaccctctgctgctctgggcagtgtcctgggctctccactcttggtgggccgggatcctgccagctgtggcgcatgctggcatcaggcttccaggagactagtttcagctctagtcctcatcttccctgcttcccttccttcctttccctccctttctttcctttcttttgacggagtgttgctctgtcacccaggctggagtgcagtggtgagatctcgactcactgcagcctccgcctggatccctcctttctgtctctagtcacagccctcaggttgcacaagcaatctgcttaaggt

SEQ ID NO: 63395 - DNA, 1031 bp, Homo sapiens
aagatggtttcagaggggttggttggaggggatggccttggtcactcagcattatggccagatccacggcaggcaggcttatcacgctcgctgcgtttcaggtgggcatagctgacttccttccaagcccagtgttgttctctcagttgggtcttctttccttttacaaagaacatgcagtttctcttcatggggttttgctcttctctcctttagttcctactcccaacatagaggtctacccagaaaagaagaggtgcaggtgtcttaagtctaaagcatacctggccccagagtccaaactttctggccacctttgttcaagagcctgggcactggctggggcattatgggagggcaagatggtggtatgcttgtgcctcccctgtgtcagtgggatccgcttgggggagagcctgaaggggtgtggggcagagctcttgcctcttctcagctagtttccatttcttccattgtggctctaggcgtgtgccaatctttttgctgtgtagtggaacgtttttgactttactagctggacagggattgaacacatttattggacaccaagaggaatttcccttctccagaaaaatttaaataggttaaaagtctggaaaggtgacagatttgggtgacttctgaggaaaaccaagagccccgagttctgggtatgataatggcttcagctaaatttttaatactgagcatattttattacctaatcagctagataggtaacaaaaacaacatgcatgttattatattttactagccacagttggaataacaccactggcatcattggagacatttcttgacctcgtttggttagaaactatttaaaaatacattgctcagtggggctgcgcccagttgtatagatggcttcatcagccccaggcaggcctcccagatctgggaaggtgtgcggagcctgaggaggctgctctggttcagcctgtctgtccttggccgcctgcttggcagtgggtctcgggcacagggaaagtagagaggggcctctggaa

SEQ ID NO: 63396 - DNA, 1041 bp, Homo sapiens
cccgcagccgctcccagccgtgtgtccttaacgacaagaaggtcggtgttaaaaggcggcgccctgaagaagtgcaagagcagaggccttctctagaccttgccaagatggcacaggtaagagccccagcagcctggagtcaccttggtgctcactggagcctctgctggttctgggccgtcctagacaagcatagattgccagtttcagaaatacccaggagtgggttaatttccttgtttttttaaatcctattcaaagaaagattatttccagttggtttttaaaaagcgtttatttctatttacaagcaaatattccctttcactgtgagctcagtgctaggggtacaagggcaggtggatggtgagaggcggggtgttggtgggcagactcactggaccaaacactggtaatcccctccggcccttcactggagccgtctctcccaggaagccacccctgcagctgctgcaagagatatacacacacactggggttcagtgtcccttggattatgctgatcctgagatcagggttgtgggtaatggtttccaagagctagcgattggggggacttattcctttgattatactgttgaaacatgaggccatcaggatgttgtgatcaatatcctctgagctgcctctgcaatcatccttgcccttcactgtagaagaagtatctggccacacgcccctgtcacttggactttatcctctttgtcttggagctctgccttgtgctaacactgatcttggatattgatttgaatgagatgaacttggagttaatactctgtcatcaggagcgtctctgagcccgagagttggctgcatctggttctggctggggatgaggaagtggtgctggcccttgtgacctctgactcaaggatgggcggatgtgatgggacacaacactgttggttctgtgttcatccaggaggccatcggttgcttaatgccacggtctgaccatcatcttttctggacttatttatataaacattggtctcgctgggtttcaaggggtaaaga

SEQ ID NO: 63397 - DNA, 1037 bp, Homo sapiens
gatgtatgatgaagaaattggatgtttagcgacagtcttgctttgttgcagctggcttgcctgggcttttggaaggtttctctcctgcatcttcagcttctgaggccctctatgaatacagcctctggacagttctaccagtgtcccctgtcagggtccccagcccctcagtttgtatctcatgaccttggcaggatgcccaagaggaaggagtaccaccgttagctctgctgaccttggcaggatgcccaagaggaaggagaaccaccattagctctgcctcggctttttctctgggctcctggccctccctttggtctgcacaggtcattcccgttgagtcaatcaagtagctgctgcttgtgacgctcagctggggtatgtctcttggtgccctttgaggagtggccactggtagtggagataggtttgtagtccttgctgcctcgagcactcatgggttaaatctcagttttctgcacctgagcccatcttgcctgacccataaactccttagggccagggccagagtcaggctcacccacagtccacctcagcgctgcagtgtagtgaaaagggcctgcgctctggggcctgactaagctgggtttacatcctgtctggtgttagctgtgtggccttgggctagttgcttagtgtcccccaagccttggtctcctgatctggtccaggatggtacatgcactcagggggctgtgtggattacacagcccagctgaatgctcagtgagtgatctgcattgctgagagacccggcgtgcatttaaatacctaccaaatatcatttcaggtttcacttctattcttctcttgactgactcaagccattcacatgtgcatgatttataaatatatataggctcgagaaaatagtactaacaggttgttccctgatatcatggcatattttgtaactttgcttttatactgtaaacttgaatacaagaactatgtcaaatttatctttgcatctcctaaaattcccagcacggtgcctgattccatagtagaaaaac

SEQ ID NO: 63398 - DNA, 1010 bp, Homo sapiens
aaaatatgaaggtttatagtcccccaagaatctggagccctgggaattttccttcaaatttaagggtaggaatggaaataagaacatttgaggtcaaatgccattcgtattcctctgagtgtttttcttgcttcaagctctaggatctgtgcacacagcagtcttctgcccttcttagtcaaacggtggcaggaccagagccttgtgagtgcgaatttgggaatttgagtccttgtctctgcatatgtaggcaactcattctcctgttctttgtggcatagtcaaaagtcagaaactgcaagctcagtcatcaaacctcagctttggaagagaccttgcttacctagtctgtccaagactgtgagagaactgggcccagggatgcttgtgtgttcaccctcccatctgcaggcaaaggctcttgtgtgtttacgctacacacaaatgcacacgctctcgtgtgtatcatttcagacttgtgaagataatgctcagtggggacgtggagaagctttacatgccctaaaggctaaagcaacaggcgcagcatagaactgaatgggctggtgccatgctctcaggctgtgggccatcgcgctctgctcaggtctgccaggggcttggtgtcaggctgcagatggatggggggcccttctgcgtatctttaggacacagctgatgggcccttgcgtgttctcagggagaaagtgggaggcttcacactcatcttgttcataggagtgagttagcttctaaggcctttgctagtggctgtccatcaagagcatgttgtgtagcttgagaaggaagccctgagggtccccatcctgtcctgtgaaacctctgatgggtgaagtgatccttctccatacttcttcctggaattagcccaaaccaaaacataaacaccaactttcagtgttgttatgaattcaaatttgtagagaccagaattgtcaaccctcctgaagcttctgggcagtggtgctggatggtctggatgggccgcc

SEQ ID NO: 63399 - DNA, 1187 bp, Homo sapiens
tgaatgtgatctttgggccaggtcctccagtaagagactgctcattaaccagtgtaggctagaatgagatttgttttcattgaaaaaaaattacatccatatgtaagtatgtatatatatatgactttttagggtttgctttattatttttatttttattatggtcatatgtgtgatttttaaaaatctctaaaatagtttgtccataaagggtatgtaaattcttccttgtaccattcattggtttcaggcagtttttcaggaataataaagcacagaatggaagtagatgtaaaatgtggttggcacatggtaactgttgccagtgacgagtgaagacagagcttcccagggctgccttcttacccaggttgggctcacctgatggggaggggaccacaatagtgccagaggacagggaatggccactgccagcctgtctgggtgccatgccttccacatgaagaaatggtcaagttaggcagcctggcccaactgcaagagcatgaccttgggtctacagactaggttgacgtctgggctctgtcatttgctggatgtgtgtccatgggggagatgtgacatcgttctgaagcccagtttcccccatcagtcagatggagattgctgtgacaacccatgagatgagtcacgtgcttgggatgcacattcatgctctttctcagcttcagcaaggaccctattggagtgttagctgattaacagtaaatatgcatttattgacagtttcgtgaaaagctctgcctgtcgccagttccctcgtcggtttaatggcgccccgctttgctgtgtacatcagttaagagatgcatcaccagcagctgcccgtttcacttgctctgtgcacacccacaatcaggatggaaatccagaggagatggaccaaactgaccttgttgtcccttcagagttcttgttgccagtgcaaatactagctgttccctgtacatttatgaacgcctgtgggagctgaggggtagaataggaagtcctggtcagacccaaaagggctgtcacaagaccctagtctacccagccttgtgcagatggtgagattgaggcccctcttcccagtgccccatctggtgtggtttttaactgtgaggatctcactgggcatctttttgtaagagcaaagacttcccagaagcagtggcagctgccat

SEQ ID NO: 63400 - DNA, 1023 bp, Homo sapiens
tttttttttttttgagatggagtatcgctctgtctcctaggctggagtgcagtggcgcattcttgtctcagggcaacctccgcctcctgggttcaagcgattcttctgcctcagcctcccgagtagctggaattataggtgtctgccaccatgcccggctaatttttgtatttttagtagagatggggtttcaccatgttggtcaggctggtctcgaactcttgacctcaggtgatccacccgcctcagcctcccaaagtgctgggattacaggcatgagccaccgcgcctggcctatgctttttatttatttatttatttattttaattaaaagcacttcacgccctgtgattgcaagctggataccgggcccctccccactcttgtcccctaccccagtttaggaacttgatacagataagtggttttgttcttctcagtgtggaagagagaacaaagccagcgtgaagcgtgggtgggagaagcagatagggtagagctgagtgctgcccagccagccctgcaccagggctcagtgccccttattagggtgccagctcagccgccaccacagggctcctgccagcggaggctgttttgactcttggcttcctttctcatcttccagagcatccccagtccaccttctttgctgaaatggaatttcctctacaaagcttctctgggaaagagccatttatatgactggttcttgtgctctcgacacaggaaacatgggtcaggtggcagctccgtggtgcggcccaccccctggtcagccggctgggtgagggagccagcccttgctcctggctctcatttctagtgggtacaaagaggggcctgggctgtggctgagagtcatcctgtgtggggagaagcggggccacgcgtggactctcagtcaaggctccctccacatcttctcccacttgcagtgggggacccagggtcacacgtgtactagtttgatcttttttggtgaaacagggcaagtggagtgagcgcagtctccattcacc

SEQ ID NO: 63401 - DNA, 1049 bp, Homo sapiens
acactcaggccaagggcctgttcttttgtttccagagtgaccacctcccttggccaggcccgctcttctttctgcagcccatcctcccttaaggctgaagaccaaagggagctggtggctggctgctcctgggcagagggcagcatggagctccaggctgcctgactttccacgtaacaaccaatacttgtcctttggaggggctgatctggtagctagaacaagcacttccttctgtacttgtcagattaggatgccaaggctaaatgacttttcttacctgaggagttagtggccatgtcaggccttgcacccagttgcctgggcactggggttcttcatacttcgggccatgctaagttggcactttgagctcaacagccccagccaggatctctggcaggccccaggctggcctgaagttagaatgtgggagtgcacagggtccagggcagcctgatgcctttcaccctgggcaggcagagataccaaggggcctgcccatgctttggctaatcccagagcctcaggagtcagggccagcgtatctctatccgcatctttgagagtcttcacacaaaggtgctgttccctcctcagcttctctttcttgtctcaggcctggatctcctttttgctttcgactgccacggtctcgcggggttgcatttcggaagtgtgggtgctccactcgttcccccgcagggcatgagcgcgagcctccccctgttgctctgtggctccctgtaacaccgtgtcaggagatggaaaaggtgatttgatttctttagtggataatgtgcagagcaaagttaccaagaaccgtggttgtggcctggcattttctgcagggccagttcctcatttggagccttaattgtgtctttatttaagccagggctgctttctttagtcagacagatggccctgaagcctccatttgatttccagcttttgcctttcctacgaggatctaattccaaaaaccttctctcgtgatctgaggagtctcacagagacgaggccctgccccggcgtgggctcgggaa

SEQ ID NO: 63402 - DNA, 1111 bp, Homo sapiens
agttgctgtatatggctgtaaaatggggataattcaatctggcttgtggctaatgtgtgtaaagcgcctggtacctagtaggtgctcagtagatagaagtgattcttgatataggttaagagaaaacccactagaccatggcagggtgtgtgccccagaggtggcctgtgggagggctttgcgaggcttccacctcgcgccctgtgggatcacccagttattgtctttttcttggccatgcccccggcttctctttgagaagaccctgaccctgtttgcagactgggctcgaagtctccggcctggtcctggcattccccagtgaagttggccgggccagggcccacgggtcataggaatcccaggaaattccagatcgtgctgggctctgctggtctggattcgcctcacaaattctgagaacgtgcccagatcatttcacatgttgctgtaatttagctggattctggaaatgtgtattgagctgctagggtatgtgagggatcgtggtaggtgttgcaaagggttcagaaaaaattgctctcccaacagatcaaagcagccagctccagcttctaacctcctttgggagcccccacagctgcagtgataaggtctccattgagtatggcattcagagccctgggtctggtttgagtctctctctagctcccatcctgctgctgtgccctctgcgtgccctgtgtgccagccaccagcacgctcaccgttcccatactccaagtccgacccggcggccacgccttgcttacacccttccctctgcctgggtgccctgcccttcctgatgaaatcttgcctgttttttaagaactaaaagtaccatgggcaggcgtgggatggaatattcaaacctcacatagggttggacgtggttcctctccggaactgtcattcccttctccaggcaaccactgtgtgggaccatgctggactccttctatttttttttttttttctttttttgaggcagagactcactctgtcactcaggctagtggactcgctcttcttgcctttgtcactttataggatttcttggagattgtttcatatctgtacagtttgaactggctcattaaaatatttt

SEQ ID NO: 63403 - DNA, 1081 bp, Homo sapiens
aacattgaaaagtccaggagaacagagttccgatttggttcagcagctcagtttactgttttgtcttgttttgtttttcccccttccattaaggagacacataggcgagcctgggccactttgttcagccaggggcccaggtcaagtctctttcaagctgtgtagtgtgactcccagtccttccccaagtgtggccttcggtggcctttgattacctgaaggactagatcagggaatatgttttagccccagttactgaagaaagcacctctgaggacacaccttcctgtggagggagggatgaggaaggggtgagtatgccctctctgtctaaggacagcaggtgcttcatgcgtacagccagccactctcacttgccctgctgaatgtccaccagcccagttgcaggagcaaggtgcttggaggactcaaaaacatattcttggcccctagaagctaatgctgtagctgtgaagacgagatgcttttatccaatttatgagcatttaataagggcctatgccctgctaggaattgtgcctacctagggatttcagtgtttctagggatatttttgtagtgcccccacctacagggcgttacctccttaacttatagctgaggcgggcagcacaagggtaacgtcttacatgttacaaaggcagaaagctgagcaaagttgcagagcttagccagggccctgcagctcctctgggactgagctgggctgagcgtggactcaagttcagtgctcttgctgtgatactgacttagcagatagacatcagtcaggttgctgccgtgggcaggctctgtgctgaggccacaggatgactgagggagggcaacacctaggctgcacacgtggagggggggctccccacaaacaacctggaaatgaactttgagagaaggacagggtggcagtgggggaggcataggcaggaggcacaggacctgaggagatagggacagatggatacaggttccagctggggttgcaagaagccattgtgactccctgcaggcccaggagcaccctgagcttcctggaagacacttcaccctctgcaggttaccc

SEQ ID NO: 63404 - DNA, 1030 bp, Homo sapiens
taccccagtgttccccccagcaaggatgtgggttggcctgtgtgggtcttggctgcctggcatatgaggctcgtctttcctttcattttcccactgcatcttattttctgggaaacttgagactagattcccggagatgttttgttttccgttcagccatcttcatggaagctgtcctcacactctcaccgtgatagttggagacacatttatttcctacctttaggtaattctatcactaacacacaccatccactgtccatctcggtttccaccctccacctggaacccagatactaacggaggcagccttggcgattttgagttttgagcttttggtttcccagataggttgattttacccgttctcaccaaagacaggccgcatttgggtcgagctgacagagctgtcatggacacagcaggttaccctgtactcgggaatgcttcatgaagcttcccactcactgccgtcagtccaaggctgggcgccctttgtttcaggtgccctgaaatcagtgtctccgtgcagtggtgggaaatagagtgcttaaccatgtccagaatcaactgctgtaccctttctttcccttccctgatgacacctgagcccagccggggctgctggaggtgagagaccctgggacccatctggggaagcaggtgcagagccaggaaatggtgcgttgaagtccatacagtcagccatgctcacatctaagtgcttagtggtggtttcctctcatttgggggttttagttgtccagagtgaacctgaaatcactgctgggtcttgtgtctttagctccagatgtagtcactgggaggtgacgggcaggctttggctttgcctggccttgaagttttcctcacagttttgttttgtcaaggagtgttcccccttctactctcgctcctcagaaacaaggggacactaactcagtcatggctttgaatggagcgtttctgtgtggttttctccttgtcccagtactctgccttctgcagctcccagcccccagcagctggg

SEQ ID NO: 63405 - DNA, 1003 bp, Homo sapiens
ttttatgtattcatacctgttctgttctgggccatttgggcctgatgggttataccattgttcctaccatgctggaatgggaaatacatggtctgatgaaatgaccatgttttccatgggcatcagataaagaactacttcattcattcaaaatgatggctactgtgtggcatgaggaaggaaggtgagttccaggtacctcagctagctagtatcacgtgacttactccttaaaatgctgtccactgccaacactgatgccgtgtgttgagtagcttggaattgggctgaactgtagctcttgtcttgcttggtccataaatgctctgaataggaatctctttggaagctaactaggggcagagtcattctgaggggtgaaggcaaatatggagggcgtagatctccagttcatcagacccaggcataaatgcatcagtgctggacccatctcccccacatttgtgcatgctgatagactctgagtgtggagaagagctgtgtggctggttgtagtccacgctgtctacattggagtctctgaaatgcattgtacagtcaggagtccagtccattgctcctgttaggaatggctggcttttccatgtttggtttacatggttacagtctgcacaaatcttcacaccttaaacaatgcccactccctctgtaatcaggatggaaacctttataaaatgcaagaatgacataccaggaggacttttcaggaccttgggcaagagtgaaaaaagaagaaaaccagataagtaagcctgatgaacttagctctagaatagttgcatgaaggaagtgcctggtaaggaggaagttgtgtttaagaggtcgtacgtggaaaattttttccccacatgctttaaaagggaaaagaatagccttgaaaggccagccttgattacgtgtccccctcccatcccactgccacctttgacactgtgcttgcctctagccagccactcctggaatggtgtcctgtgtcttcctt

SEQ ID NO: 63406 - DNA, 1082 bp, Homo sapiens
ccactgcccctggccaaaaaacaatttttaaaagcatgtgtgaggttcaggtgagtccttatatgttacacatgatttcaggaagtcattgttctgagacatggcgtggtggcgtgctcctctgccatggaggagcgtggccagggtggtgtccgtctgctcacctgaggagctccctgggtctgccagcttcctgcctggccaagcccttcccctgcacttgtaagacgacgactgagcgtggctgatcctgcccggtttctgggtggatagtggaacctgggggaaccagggtagaatcccttatgggaggcagccattggcctggccaggctttgggcgctgttggagacagggctgaatttttagccctgagtgtaggcacaggcgagagctggagcccaggcacttgttccctgtgtggctggctgctcatctctgatttagctttggctcaatttttgtcctaccccctgattgctactggagccagcatggtggtcacagccactggtgtcttagggccctggaagagaagacagcaatcccaggttgccctctcctctgctcagggctgatcctggcagacatggaggaggagataggcaggaggagatagggagaagacttgggagggagctgggtcttcatgccaaatgcaggaagaaacaagccatcgttcagttcatgtttgagctgcgtcagcccatgtgaaggcccccacacctctgggaagaactgcagggagcatctctctggtccccgtctccaaggtcggggaagcattttacagttttggaggtgatgcggggaagggccacagccaaaacttcatgtggcagtctagcatgccacacctcactggaatcccgcacgctagaagggagccgccttgtgagaggtgttccagtgaagtggaaccccaccagtaggtggtgggatgggctccagaacagtgtctggaacaggaactagtagagctcaacgtcttagattccttaaaaaaaaaaaaaaggttgattttgtgtgtcttaataatttcctttataaatggagcctcttatagtacaaggcagtacaga

SEQ ID NO: 63407 - DNA, 1402 bp, Homo sapiens
cggaagtttgcacccgccacccccggggtgcgggagcgaggcggcgggctccgctgctgctggactgtccggggcggtcaggatgggggtgagggggcattctgtcccgggcgggggaagcccgcggggaggccaccgctggggcttgcggagtgggggcgtccgcgccggcgtggcttttgcacatggcgagaagggccgtccggcacaggcacactggtcgagtcacatttttgctagtcttggattttgcaagcccgtgggagtcaggttccccgctcagggtttctcttggggcagagacgaaagaaacgaggacacccagaatccggggagggtttgcggtttgtgttgtcccaagtgtgttctcgctccccccgcccccccaccttgtcccccagcccccagctctccacccccattttcggacttggggaacaatgcttgtagtacgggccggggcgccgcagcagcgacgaaccgcgcggacaggtttgcccgggtccctcgcgttcggacgccccctgaagccgagctccttccatctgaccgcccgggctcattaacacgtactgtacttaggacgatggtgaacaaagaaaagctctttgcagcgtttgatgaatgggattctgcctcctataggccacactccgagtcttccatacggtacaatctccggactcggtggtgttaggaaagtggcccccggaatggcttgcattccgggtctgggatcctggggtgggcatttgtgccgtcgccttcgccgccgcgctcgccttgcaggagcgggtgcagatggagccaggctgacggttgttcaacaggaacaaatgtttgttcaattgttggatggtggagaaaagggactgtttcctattgactgctgcaggagttggaatggcattgtttattggcctgggaagccaggcaagcgtcttgtgctgcttacaacatattagcagacttccaaatgacatgctagcatatgtgttcccagcagtccccaccggctggcagggagattcctccttgctccagatcctggactcgtttaaaagatgccacctggtttgaggacttgggaaggaatggagtcagccgaccaggtgaaactcactgttccttattaggccaggtttttgtttcattttaatttatctatttaagagtaacttgtgtcagttacagttttgatattgaattgcaggtctacagggtcccctcccccgcctctagctgtggactacagaaacagctacttgtcccagttgatagtcccattcagtgggagaaggtttggctcaggattggtagcccttgactctgtgtctgcacttggctgtcacccatcatgcgacctgggagtctgccgatccagcttccaggcgctttttca

SEQ ID NO: 63408 - DNA, 1082 bp, Homo sapiens
gactaagaatacccctcggatttagatcgttacctgttttaagtggtaattttttttttttttttttttggagacagggtctcactatgtcacccaggttggagtagggtggtgcaatcatggctcattgcaacctcaacctcctgggctcaagtgatcctccaacctcagcctccatagtaggtgggaccacaggcacgtgccaccacacccagctattttttgtaatttttgtagagacaaggtttcgccatgttacccaggctggactcgaactcctggcctcaagcagtcctcccgccttggcctcccaaagtgctgggattataggtgtgagccaccgcatccggccccagtaattattcactaagaaatgtgggtatggtgggggaaaatgtaaatgtgggtgcatttgaattgaaaccaaatggacaaggatatggtataccttccttcattaggtctgagtgccaaggcattattccaagtgatatcagacaaaggaaccaagagcatatccctgtaggatcatgcatcaggaagctggtagaactggatttaatgaaagtgttgaattggatttgggtcttggccatttaggaagcagtggcctgagattttataattgatttttactttgcatcatccagatttgatatccttgatcagtgattcaggtttatttcctttgctgtaagttaacagtgccattcacggtgacattttcgtttgatgttgagtaatactttagtttatctgatttgtccttagtttatactagaattgacagtgtagtgtgtaaaaagtatggtgaatcagttatttatgctactctagaaaacatttggtttggcccggctcggtggctcacacctgtaatcgtagcactttgggaggctgaggcgggcagattacttgagctcaggagttcaagatcagccttggcaacatggtgaaaccccatctctactaaaatacaaaaaattagccgggagtggcggcatgcacctgtagtcccagctactcaagaggccaaggcaggaggattgcttgaagccggaaggcggaggttgcagtgagct

SEQ ID NO: 63409 - DNA, 1085 bp, Homo sapiens
tacacatgttccagcaattagcatatcgtgtatatttctgagtagcttaggaaaaaatatgaaaacactctggttgaataaggggactgtgaactgtatttctcatttttcattaatatattacagatcaggcagcttatcattgatgatagcagaatcgaaatggcattgggatggctgtagttccccagctttgcctgccttactgctgcaaagaggagagaactgttgggaggaagaggctaaatgtagaagagtgtgggtgctgtcagttcacattttcctcctaacccttctgctaataggaaaatgtcaggcctttgttcccatctaattttagtacatcctggctaaaaaaatgttaggatgaaaaaatgttaggatgatttccaaccatggaactttgaggggtggggtaggggaaggaagaatggaggaaagcgcagtttatactccatatccgtctgcctttctgcaacagcagctagcccctactctgttgatttgggtaatgaaataaatttagatgcattgaagcagtgataattaggttttccttctatcttctcagtaagaagcctagttggtttctgaatggggaaagtcataatatggtatttaatgaaacatacctggcaaaattaaagagctgtacgcaagctttggaagaaaggcctgaaattgtgagtgcaaactacatgtggtgctatgtataaatagaacctttgagatgcatttgtatttcagggaagctgcttttatactgttattttgaatgagagtaatattttgatttttaagaatcagtcataagcaaggcacacaaggctgagctgtttatcccctctgtaaacccaacaggcctagagggaaagcccagattcagtgagagagccagttggatcaaacaattgataatatagtttgttcaagagataggacagaattattggctttgtagttgaaactaccaactgttgtggttgttatttaattaaaaagtaattaactgaattaaactaaaagggcaattctgaatactggagctcactacgaaataagctgtcttcccccagtattcagtt

SEQ ID NO: 63410 - DNA, 1580 bp, Homo sapiens
tactgtaatgtggtactgtatgttgacctcaattcacatttatccagagtataatagaaacctcaatttttaaggaacttatattagtagttaagtttcttatggccttgaaataattttcttcaaattggtatacaaagaaatagtgtatccctgctatgttaatgactttcgtctatgttcttttaagtaattttattttacgaattgtgtgtgtgtatgtgtgtgtgtctctgtctggtagcctacaatgaaaatctgtacaaatgtgaacagtttgtctccaggggagagccctggggtttgatttcctgtttttggctctgtaagctaacgtgtatgtgctcctggacagccctctgctttgagagtatgagaccaagtgtcttgtgttccacagtagtaacctctttagctaatgtcgtgtgtgtgtgtgtgtgtgtgtgtgtgtgtgtgtgggagggagtgttgatgggctctgaaagaagtcttgtctcgtacatttcactgaatgaaggctgcccatgacctagagcttgattgtgggaggtgaagagcatatatggctgaaagacaattgcatagtggggaaaaaaattaggaaatccttacatttctcttggttaggcaggaaacagagatgtccatagaagaagagggagctcatcagcatgttttattaacagttaatggaagaaaattaatgctaatttattcttcatatacaccatgcaatttgttagaaaagtaaaagaatagtttgaaattctttggtcaattgatggattcctatgttcagggcatagaaatgaaactcaacatcaagcagacaaatacccaagcccacaggctacataaatgctgaataaaaccagctctacaatggaactctgaaaagcgacgggtaagaagcctaatgaatgattgaatatgaccttagcaaaatccctggagtgttgttgaacgatcattcatttccagcttagatgtcaagatgggctccagtaaccaggaaaaaagagagcttgagtcagtacttactgagttttaaaaatcttttgcaacacagtgtattagactgatcattaaaaggacttctctagctgaattttgagctgtcactatagtttaggcccagggaaataaacttaaaaagataggaataattcctaagacatgaatgtatcaatatcctatcctgcttttctggagtaggacttcaaaaactgaaatgtataggctggcagaatgtacttttgtcatgctgataccactgtaaaagagacttaaactaggagatcagttgagccctaaagtatttgcaaattacttgcctagcttgttagaagaagaaataaaaagccaaaatctacatttttgttttcaaaagaaatgatttctttgtttcctgaagagatgagaaaagataaattcttccatgttatatttttacgtacgtatttttattactgtactgtatcaacaaatgataagtattttaatgagtgatctttattgttcatagtagctggaagcatcttaagaaaagcaaatctaatacatctgttttcccaaatatg

SEQ ID NO: 63411 - DNA, 1006 bp, Homo sapiens
tgtaagggtagtagaaggaaagagaactaaggaatgttattatttgctagcgctatgttaagttgtcttattaagtaattgagtcctttcaatgtcttcttgaggtatgtattgcttgttcttgtttctacgtataaggaaaatgaagctgagagaagtgaagtcacttttatgaggttcaacagtacaggatggagccaggatttttatctgggtctgtctgactttaaaacacatactcttctcctagcatattctgcctcacaggtgcttagtctttgcctttgtagcatttacagtacagctggagacccatgatgattacatataaagttcagttagaaaagatgggtagttactttattagtgttcatctgtggagtatcagaatagcagtcagccaactctgtctcatatcatccttcattacttttccccatctccctactcaaagacttgcctctattaagaattttgtcattcttctgtgaaagggtagtgtaagttatataagccctcagcgatacatgcacaaagatgttctagttaggggctaatttggcaagagaaacagtttattaatgtttttgaaaagataagtcatattcatacttaataccattttgtatttgtggtaatattttaatattggagctaaatacaaatttttgcataattttttgatgattttcagctttgtgggcctattgggttacataagtgactttttgtttggcaaatgttactcctgtattgagtaagtctaacattacgtcccttttctttttggggaggggtagccagaggagtgagtttttcatttagatcaacattgatcaaccattaagacaagatagttgaagacatgtatgtggactgtcaacaaaaataacattttttgaaaagcttttattttcaacatgtaaaaagtgagaaattacttcaaaatatatgcaatttaaattttttagaagattgtgttgattttaccaagacaggagatctt

SEQ ID NO: 63412 - DNA, 1031 bp, Homo sapiens
agccaggtgtcgtggtgtgtccttgtaattccagttactcaggaggctgaggtgggagaatcgcttgagcctggggaggttgaggctgcagtgagctgtgatcacgctgttgcattccagtctgggtgacagaaggaaaccctgtttccataaaaaaaagaaaaagattgctgaccctggattgagagatttttattagatttttttttttggcaagtaaacttattaggtgttggtgtatatttgcatatgtggcgtagaatatttggtgtagaacattcatctttttgttatattaacagccattgaagaccatttcttatacgtactactttttcattgatcagctacatttttgatggttacttttcctacatttttgatggatgtttttgctatatcattttaggttactatttttcttttactatcttctggcttccattctttatcacttattgttagctataagccttatcatcatccttttaaaggtaatctgtcgccttgtatcccacatccctactccctggatgtttttgagatttttctgtttttctttttttttttttttggtacggagtctcacgccgtcacccaggctggagtgccatgtgccatctctgctcactgcaacctctgcttccggggttcaagtgattctcttgcctcagtctcccgagtagctgggattacaggcatgtgccaccacacctggctaatttttgtatttttagtagagacggggtttcaccatattggccaggctggtctcgaactcctgaccttaggtgatccgcctgccttggcctcccaaagtgctggtattacaggcataagccaccatgctgagctgatttttctgtttttgtttttcatcagatacactatgatgtgtctaggtggagtttgctttcatctgccttgaatttatactgtttcttgaatctgaggcttgggtcctttgtcactattggagtattcttagccatatgccattttttcttctgccctattctcatttcctttcc

SEQ ID NO: 63413 - DNA, 1795 bp, Homo sapiens
tctaggcttctgttctttcctaagggttgtgactaggtgattgctattggtttcttgtagctcaaaactctagaaatgcatatatatatatatatataaagatgaccttttgcaattccagtaggacatacgtatcttatcttataggtaagcatatggtttgaaaagtgcattttgtccatggaactgtgtttcggtaaacattccactgctagctaaaccatcactgttgtatgcctgcagtgtgctcttgctatgctgtgtgctgtggaggaattataagacttaggcttcatcctagataattttacagtcttaattagtacagaaataaacataagagtgaaatttgttaagtaaccaccacatgccaagcctcatgtttggcattggcaacaggaaaatttagactttgtgcttgaattgtttacattacaatagagtatggactgacatatggacagttgtgccatcacttgatgcatgcagtaatacactgaatatagaaaagagggtgattaattttggagtggaggggtagggaagcatcttggaggagtaaatatccaagttgggtggaaatttcagggacagtttggtgacctagtggcgtgtaaagagggagaagatttcaactaatggaaatattatctaaaggcctgaaggctgaagcagtattttatgttctgggcctgtaaataatttgataaattgaaatacaaagtatacgtggggatggacagacatgaggattaagttaaagataggaaccatattatgctttgccatgcttaagaccttcgattttgcatttaggctatggggaattgttaaaatgtttttagtagtggaatatgattagaagaacttgaaataacccttcttgaaacattgagatatagtgtgtgtacattaaagtgcacaaatcagaagtatacagctaagtgaattatcagaaagtgaatacatccacataacaatcacctggtcaagatgtaaaatattatagaactctagaaattccccttgaactctctaccaattattactcctttcttcctttttttttttttcaggctttgtcacccaggtaggagtgcactggtgagatcatggcacattgtagcctcaacctctcaggctcaagcgatcctgtcgcctcatattttgattttttttgtagagacaaggtttcactatgttgcccaggctggccctccttcctttttaaaagtaaccactatctaccaatcatgaacaaaagatgagttttaacatcagattaatttgcctgtttttgaaggtataaatgaaactctttagggtgtgctattcctggtgtctttcaggcttttttttttttttttttttttttgagacagagtcttggctctgacacccaggctggagtgcagtctcacgatcttggctcactgcaaccttcaccacctgggttcaagtggttctcgtgcctcagcctcatgagtagctgggattacaggcgcacgccattatgcctcgctatgtagttcatttttattgccatataagattcctttgtggctgggcgctgtggctcatgcctgtaatcccagcgctttgggaggccaaggcaggtggatcacaaggtcaggagatcgagaccatgccttggctaacacggtgaaaccccgtctctactaaaaatacaaaaagttagccgggagtggtggtgggcgccatatagtcccaggtactcgggaggctgaggcaggagaatggtgtgaacccgggaggtggagtttgcagtgagcgg

SEQ ID NO: 63414 - DNA, 1039 bp, Homo sapiens
gacatcaagtcacaagaggccagaacgcggttttcaagtcagaatcttagccagaaacgaagttggcctcttgccaaggagccaaataactggatggacgctcgcacccgcttcgcagacaggcgcacgcagtggagaggtgaagtgatttctgcgtttgggtagagcggcgtcggctttaggtgtccacggtgcggaagccagccgttttccaaaatgcaatacctctaatggtccctcacgaacagcagtccccaaatacagccgctcttggacctcgacgaaggggatgccactaacgctgtggggagagcgcacggtccccgccggcgcagggagccgggggtagagcagagggcgtcgcgtccccatcccagccccagcgcgggggctggagcagtcgagagggcggcctcccgccgcctagaggcgccggtccgctcgtccgctctgcctgtgccccgtctctatggcggccccaacggccgtccaggacgtggagcgaaatgagctcgggcgctgacggcggcggtggcgctgcggtggcggcgcggtcggacaagggcagtcccggggaggacggtttcgtcccgtcggcgctggggacccgcgagcagtgagtgtgacgctgggcaggggaggatgagccgtgccgccctgcctgggccccgagaaggggacggcggggtggagacccggggctcagggacagggagaccctcgggggcgtgacgggagcagggccacctggcggggggcttacggggatttcaaagagtggaatccctaggggtcgccctacgcggttaaccgacgtttcaagggattggagcccaaggggcttgtgggtgcgggacaggctttggctcctgggaggccttttgggagtctcgaacctgagggccaggcttgggggaaagggggagagggcgaggctggcgaatagggctggtcggcgagagtgagagaccgagggagaagtgctgggcctgggagccgaaaaggctgagtaggaggggagggatgtgggagctggaag

SEQ ID NO: 63415 - DNA, 1064 bp, Homo sapiens
ctttaaaaatgtaagaaaaaggagcataaaacgttctttttgtgtttgttgaagtgaatacagtagtccctgcttatccttgggcaatatgtggcaagactccagaaatcgtggctagtactgaaccctatctatatgtactatggtttttcctgtatgtacatacctatcatgaagtttcacttatgaatgaggcacagtaagagatgattgaagttatgtgaatgtgtccactcactctcaaacatatttgagagattgaccaagggtaactgaaactggaaagtgaaaccgcagacaagagggggactactgtatacaccaatgccatattatgaccaactaaaggacagaacgaaaaagaaataaagggagaaacgttcggaaaggagaaagcatacaacagagagacacctggagggaaaagagtgaggaaaagaaagtccagggtctcttactcactggacttccccccaaaccaccaccaggcctatgccttctttctcagccccaaacccttccacctaatggctgggatcacgatttcaactctgtgtttcataaaactccccgagacccaacttcttaccctttccaaaagccaggccaatgctttccttctagcactgcccacacgaatacaatcagcgttcttgatcagcagttccttccgtaacgccagccagccctttctgcttgccgcttcctgctgttccctgcagttttcaccctgaccactctcccactgtcagctggcccaaacacctggcccccttgcacccaaaaatccctggggacttgtgtcatattcaccctcgaacatccacccgcacctattgattgcttcagagaattgtcaccatgcaagatggctacctataaatgaagccatcagttgctgagaacctcgcctcttttagatttacacataagcaaaacaggaatggggaagcaagacgagcagccagcagttcgtttgaggggaatctcagagcaagtgaaattgtttaggctctggttcacacattgcttctgtctggtctacgaaggtgtctgatttggtc

SEQ ID NO: 63416 - DNA, 1051 bp, Homo sapiens
aaactgggaataaaacttgtggaattgttgggtcaaactaatacctcccagcactgaggcaagaatggaatgaaacaacctgagaaagtaggcagcccaatgtcttcttccacatcccacaaatgtttacttcccttcttcatttctcagaaaatgagctgctacgttatctttttttcataagtaattgatacctagaaacaaagaaaaatgtcacagccatttgaaaccccacattttataattacttgctatcagcacctcccacatgtggaagtaatatcttttgaatgtagcaatctcttgagtattcgtcaatgcaaaaggggcctcatttcagaaaaacatttggactgatttctctttattcacctgtgtaaacctgtgtaaggtgagaagttaggtcttcattagggttaccacaggcatatgcagccaagcacgtctatgtcacaatactatgtggtgttagtacaagatttttttctcttaaacagtttttatgactacgcaagcaaagtgaatgaggagagtttggacaggattcttaaagatcggagaaaggtatgttctgtttgttgcccagtatgattctgaaatcgttccttatcaccgaaaagataaaaccagacaggaatgtaaaatggaacaataagatttcatgttaatatgtaaaagttttgttaacctacatagattttttgatgtattaatagaaaaaaatttagatatttatagcatgataccattattattacatgcctgtaataccagctactaaggaggctgaggaatgagacttgctagaaccctggcggcagaggttgcagtgagccaagattgcaccactgcactccagcctgggagacagagcgaggctccatctcaacttaaaaaaaaaagaaaaaaaaaaaaagttgaacacaggtgtttttccaaaaggtcatgtatttattatttctatcaacatttgcatatgatgttctagttatgtgtagactaggtaagcaagtctgaatacaactgaaaataaaccaaagttttattgttg

SEQ ID NO: 63417 - DNA, 1037 bp, Homo sapiens
ggcaacagagcaagaatccatctcaaaaaaaaaaaaaaaggatgttggtacaagtcactgagattcgtgacttcaaaaatgtgcattatagtgcatttttttttttttttgagacagagtccagctctgtcactcaggttggagtgcagtggtgcaatctcggctcactgcaacctctgcttcccaggttcaagcgattctcttgcctcagcctctcgagtagctgggattacaggcacacaccaccatgctggctaatttttttgtatttttagtagagacggggttttgcccattttggccaggctggttttgaactcctgacctcaggtgatccacctgcctcggcctcccaaaactttatgcatctttaaataaaaacttgtattattccctttagctctttttgtggttacggaaggtatttttcttgtcagttatttacataaaattgtttttggatcaagaagcattaacaagacatgtttattatgcataaattcttataaggaataaatagctggaaatcatcatttgcttctccataatccactatgtggaaatgtagttttattgctgtggaagtctgattataattttgaaacataaatttcaaatacaaaattgtgaaattgaaccacctgctggttaacgagggttttgcatcgtgaacttgttaaaccaaaaaaaaaaaaaaaccacccctatgattatatgatcatgttgtctgtttgtaaacagcaaaatggtttccctctggaagtttatttgttgtagaataaattaaattgacatcagtgaaaataattgttaattgttaaaaaggtttttataagatttcattatgtaatctgtgggtatctcttgagcacttacaggctcagcattgtgtcagtcactgtgagtatacaaaagatgtgtaaggcatgacctgtgctctcaaggagttgataagcaaggttttactttacagaagggaaaacatcactaattcatgtatccttgggttgtctgtagaaggaggtgctccgtgagac

SEQ ID NO: 63418 - DNA, 1050 bp, Homo sapiens
agactctcttgggatgcacttatatttttatttaatgactacttgttttctagttttgcccacaacgtctgaaaccactaagacattcaggagcatgttgagcttctggtttggaaacagcaagacccaccatttatgacaaggacagccatgaggttaatacttggagtttaactgccttccctttgaactagttaaaatctgtaagaataaggaagttgttgaaggcttaaaatctgggttctgaaaaagtagtttcagtttataggatacacatttactcactgagctccagttccaatactaaattagacagtatcatatagacggaaaatgaaatgctagaactgccgttctttggatcgccactctatgggggtctgtcttttaactactctcctggttatgttggccttacaccactgccatttgatttaaaacgctgcagaccactttatctgcaaatgtgttccagttgttatcagctacctactacgcagcttcagcgccagtgtgaatttatttttttttaagtgccattaccgtctcctctgttcagattttgacattcaggaaaatatttttattttgatgccatactgaaatctacaatgtatatctgacaaagcagttaaatgtgacaataaaaaacttatttaatcatggtaccattgttttaatgtctgtctcagcaccggacaaggccttgcctcagtgtactcattctggcaattcatcatggactgaaaagagctttttaaagggcattaaaactcatcttcatacaaagtttttgtcaggctggtttcaggagacatccaggaacacaacttgctaaaatgtttctgtgattttcaggagtttctgtttccaaaatatttctgttgatttcatgttacctacagaactaagtatcaattgtgtataaaattgaatcttggagaggtccccaaaaggcatcttccacagaggaactgatcttgtttaaagtgactcctcagcctggattccctaacagtagagatactgtagaacttgctgcctgagagc

SEQ ID NO: 63419 - DNA, 1693 bp, Homo sapiens
ccgccggccgcccgtggctggacgcggtgccggtcccaccgccgctcttccgccagatttccccacaacttcttttcctgccggagacggatcggcgagtggggtttcgctcccactccgcaataggccgtaaacacttgggtccatcgccacaagttggttctggtgtctccaaacttgtatttcagtccctcggccgcttgctttccacctcctgcggtggcctccagttgccatttgtaggaaaataaaggtgggggacgacgaggcgggtggggaggaggagctggagctagtggaaagattcgtctacccctcctgctcgcagtaacgagtgttcagtgcaaggatctgttttttctctgctatggtttggtgcgggtcatttcacagacaaaagaactgtagtgaatgctggcattaagcgcaagggacaggcagtttaggttaagcctggaagtttgaaccggcccattatctttgagatacactggtgttttgaaactctcttgctgaggatattgtatttcagtcagttgattacccttttctgtaactccgtagactatcgatttaagcgccgccccatcttaccagtattttggtttcaccgtgtttatgatgatgttaataaatctaatgtgcaaaaataccgttttaggaacacaattggagataatttttttttgtatttgagacggagtttcccccttgttacccaggctggagtgcagtggcgctatctcggctcaccgcaacctccgcctcccaggttcaagcgattctcctgcttctgcctcccgagtagttgggactacaggcatgcgccaccacgcccggctaattttgtatttttagtagagatggggtttctccatgttggtcaggctggtctcgcacctctgacctcaggtgatctgcccgcctcggccttccaaagtcctggattataggcatgtgccaccgcgcttggcctgagagaaatctttaactctgggacctattatataatgagttatttctttacctgtgtgttttagttaacttcttttatcacttgtgcagcatccagcagtacccctgttttggtcaaacatggatgactcagtgtacaaaccataagccaggggaaaccataaggaattttgatcttggcttgtgccaaggctcttgggaaagtcatctgaactatgggagaaataaagctggatcttgtctccttgttattattttgaattaaatgagggaattctaaaaaaatttagaatcctattgacttttggctctaaagataggcagtctctttatactaaaatttcataacattgtttttattgggctgttgggggtttacgagatagtaggacagtaatgacattttgctcttttgaggaggatgttatctgagtgtcatgagggattttatttctgttgctgtttcgataccttttattaatgcctcagagcattgggacacccatttatttactcttgaaatgtgcttgggtgtgatgaactcattcatggtaatatattttaagctcatggccttgatccatgtctgtacactgataggggttatggatgtcacatttaaagtctgaggattaacatagttttggaactcatgatctagttgtacaatatatgaggcaaattgcttcatatgtgtaattgatacagtgagagcttg

SEQ ID NO: 63420 - DNA, 1008 bp, Homo sapiens
aaacgtgagtaatgaatgtattgtgccatgacattatggtggctttgacgtcacaaggcaaatttttcagctttgttatataatcttatggggactactgtcacatatacagtctgtcttcgattgacacatggttatgcaggctatcactgtaattctctttttttctttttttgagatggagtctcgctgtcgcccaggctggagtgcagtggcgcgatctcggctcactgcaggctccgccccctggggttcacgccatcctcttgcctcagcctcctgagtagctgggactacaggcgcccgccacctcgcccggctaattttttgtatttttagtggagatggggtttcaccgtgttagccagaatggtctcgatctcctgatctcgtgatccgcccgcctcggcctcccaaagtgctgggattacaggcgtgagccaccgcgcccggccctgtaattctcaactgtaagttgatttattgcaaggcaggattccctggatatatgaagaaattatccctattctgcagcagaaggaaaggatctctcttagtgttgcacagtaaaagttgaaacaatacacttgtgagtggaattctgaagacatcacttctgtgatttttaaaccacttctaaatcctttcctcttttgtttgtggtgggtaattaacttcactttttggtatttaatggagctaaagtttatttttaaacgggaactagttcagttttccgaactaactaaactttttgtggaatactatcttttgataccagcagaatattaagtttctttttattaactaaatgattaataagcaatgtttacatggagatactgtttagggacataatgagtttttcacagttcagtgttagaaacaaatcataattcagtaaactaagaactattttagaagtttgttttgaagtggtaaagaagggattaaaggcctggcgcggtgggtcattcctgtaatcccagcactttgggaggctgaggc

SEQ ID NO: 63421 - DNA, 1645 bp, Homo sapiens
ttgttccatttccatacatgtttaagaaaactgtggtctttcatccagttagattgcaggttctctgagcacagggacagtgttttgtctagttatatctctccatatttctgagtgcatggtaaacctttggtaaatgttgtcataggttgttacattagttttgtttgggattgtgatttaaggtacgtgattgacctgggatgtctcaaactgtgtaaaggaactatgctctaagataggttctgctgaagctcaagacatacctgtattacacccgctcactttcttgttacgattgaggaactgaagtgttcagatagagtaagtatgtaaagagctagaaatcctcctgagatgacaagatgaacagaaagagcattaatattgtttcatgctagatttgacacaatgtaagttaactttttgtctttaagatcttctttcattctagtcagtggattgctaattgtctagtggtttaaaagaaaacaagaccattagagttgtaacttttattacagttttttctaatgtatccttgacagattaaaatgtaacatttaaattcgttacattttgaagatttaggtttggttggaatgaagttagttgtagttgtagagggtaatcacctcagttaattaaggcatagtgctgataaggccaaggtcaccctggcaggtgttatttaattttaccttgtccaacttatccacaaattcctgggaagagtacagtgtgtttagttcagatctactcatttgatacagatgccatagataatagtgacctctttttataggaatgccagctcatttttgagatctaattattgattatttacatacaatttcacactaatttaggacttttagaagatacttaatgattgcaaaagttttgtacttgtgtcattgtcatagcaagatttgaatagttaaccagcttatgggttgccacagtgctctggatggtagactttcagagcagtgacgaaaggaacaaacatttattgaacaattttgcggcttttagtagtctaatccctttaatttgtagatgggaaaactgaggctcagaaataggaaattctgattacgaattgagttttggacatgttaagtgtgagaaacttgttaaaccttcaaattgagatgtcaggtgggcaactggttttacaaatcttgagttaggggagagatccaacttggagatacaaatttttaaattatcatgaagtagatgatatttaaagcccagggattgtctaagatccccaaagtagttagaggttagagagaagaggaccaaagcttggggcacttggctctttaattcagaaagataaggaagccaacaaagaagtttgaggaagaaaagctactgagattggaggaaaaccaggagaatgtcttggaagccatgtgagaacagtatgtttaattgtggattatagaaccagagagcttcagactaagccatttaacaaataatttagtgattgttgtattttgcctaagagttctttttatttcaaatgccgaagttgcagaggcaaaagtgtttaataatttcgtggattcaattacatgttacaaattttttaatggggctagaatgtgaaggtgctgaagtcatggct

SEQ ID NO: 63422 - DNA, 1359 bp, Homo sapiens
acataacaagtgtatcaaacatgaatcttagtccaaaaactcagatagaaagaaggtaccacatttgctttctttaaattaacttgatttgacttctacttctttggcaagaaattcaacctcagtcatccttggggtcccctctcctcatgttattggaaggcctggtgtcatatggttcagattttgcctgcattggttatgatactgtcttccattgccttccacaaggttccatcaggttctgtggctctgccaccaactgtgggccctagtgcctgtggcttgacacctagtttatatctagcagacactttttactgaggtcttgctgcctgttcagttgctgccatggagttgattccatcctctctagaatttcttctgagattgctcacaaggtctactcctttctttcatcaagtcattcaacatggcctcttcttgggttttactaaacacaaggtgctggtctaccttccgtgccactggaatctctgaacaaaggtttttgaaagcctggctgtttgactggaaatcgaagggagggatggaaatagaaggatgtgagtgacataggaaaaacatatatgaattagcgttccaaaaactagccccaagaggaaatataaagtgccaaatgtcaataaaagtatggttgcttggagtgtacttggagtgagttgaaaacttcatgaagatgagacttgaactgagccttaaaggatgggtagagttcattataaatgagggtgtctattgtgcttctgtatctaaggcagtaccttcatgtgtatgttgggtggtggtgacacatgcatgagtcgggcgtgtgtggcatgtttgggagtgagtggtgtgtgtgtttgtgacaggaaggagttgagagtttatactgttgcagaagagcctcagaaagagaattgtggaacagtcagctggatggatttagaaagggaagatgcttagaaggcttttatggtagttctgacctgaactggaaaaggattgatggcagtgggaatgagaagacagtaattagatagaaaccactagaaagaatctgtggggagaaggcagaatttaaggtgattctgagttctctgctgggtgcagaggtattaatagtgtcattaatggaaactggagaagtcaagataggagtttgttgtgagaagaaaataaggggtttaatggaggatttgataacctggtgaagccctgaaatgaggttagatttgtagataaagggttttaccatatcatcgatcttcacgatcctggtctagaccggttgtttttcctgttgactattgcgaagaagacagtgatgaaagaatatactgatgagaaaagaga

SEQ ID NO: 63423 - DNA, 2773 bp, Homo sapiens
caagcagttctctgcctcagcctcctgagtagctgggattacaggcacctaccaccatgcacggctaatttttgtatttttatagagacggggctttaccatcttggccaggctggtcttgaactcctgaccttgtgatctacccgcctcagcctcccaaaatgctgggattataggcttgagctactgcccccggccatgaattagattttgagtatattttaaatattcaaaatttaaaatattttaattatgaacattcacaattatattggaatgattatgctactggttatttcagtgaccttccacagatttaattttccccagtacagtcttcttttttttactccagatagaactagattttgaggctacagattatcaaggaactacctatttcataatgttactttgttaattgtagccattacttctcaacatgtttctttactacctgtgctaattaagaacagtggataattagcattttaagttgcttttctcccttagcgagaatgataaaatagacgttgcttgatcttctgaattcatgaatcataatctgtgttcataatttgagaatggttatgtgtttaagctattttttagtttgtgttgtttcctctacctttgtctctttaaactattggttacttttctaaattgatgtgatggcctccctgaaattaaacatttctattagtggcttcccgttaatctcatccttcttagatcaaacctcgttatatctcctgcctatctcttttgcattccaaagttcagttttattaaatcccagggtctaagattttttctttgagaatttatctccagtgtttctatggaaattaaaaaagaaaattaggataattcaatgtcgaaatgttgcatgcatcttttgagaaatttatattttgtaggttgaaggacttgctttttgggcagcgtatttttggaggtggaatgtagttattttaataaccatgtcctaattatttatagcttcctgcctgacacagctcacttcaagaagtgcacaatgtcagaacgtggaattaagtgggcttgtgaatattgtacgtatgaaaactggccatctgcaatcaagtgtactatgtgtcgtgcccaaagacctagtggaacaattattacagaagatccatttaaaagtggttcaagtgatgttggtagagattgggatccttccagcaccgaaggaggaagtagtcctttgatatgtccagactctagtgcaagaccaagggtgaaatcttcgtatagcatggaaaatgcaaataagtggtcatgccacatgtgtacatatttgaactggccaagagcaatcagatgtacccagtgcttatcccaacgtaggaccaggagtcctacagaatctcctcagtcctcaggatctggctcaagaccagttgctttttctgttgatccttgtgaggaatacaatgatagaaataaactgaacactaggacacagcactggacttgctctgtttgcacatatgaaaactgggccaaggctaaaagatgtgttgtttgtgatcatcccagacctaataacattgaagcaatagaattggcagagactgaagaggcttcttcaataataaatgagcaagacagagctcgatggaggggaagttgcagtagtggtaatagccaaaggagatcacctcctgctacgaagcgggactctgaagtgaaaatggattttcagaggattgaattggctggtgctgtgggaagcaaggaggaacttgaagtagactttaaaaaactaaagcaaattaaaaacaggatgaaaaagactgattggctcttcctcaatgcttgtgtgggtaagtttctgtattctgcattttttgcgtgggatgggaaaaggtagtaaaaatgatatgaaaagagctgggtgcgctgacacacgtttgtggtcttagccacttgcttgaaaccaggagtttgaggctgtagtatgccatgatcggtctgtgaatagcacttgcactccagcttgggtaacatagtgagactgtgtctccacgcacatgcaaaaatgtgagtgtgtgtgtgtgtgtgtatatatatatgcgcaaagtcactagcatttgattcattcagcacgatagctgtactttcaagtatgcatacataaaaatttgtgtatttgtgatcttgtcgtaactttgtactaaattgcccacaattaattgtgttcatgtctctccattactgggggcagtggaaacgtttaagttaaagcaaagtttttacacatcagcagtaaaatatatacctggactttaaaactgctactctgtttattgtaacaagatgtaactgaggaacaccagctgctgtttccaagtatttgtaaacagtgtgagcatcttgtgatgatagaagctttagtcagatgttaaaaataccacaaaaatgtgtgactccaagaagttgaacaaacatattgaccttgaaaatactggtgttaatttaacatgaatgtcatgtagtaaatgtttgcaaactttatggaactgattacatgtagccagctgattccatacttcaagttatggttcatatgtattgtgacattttcctcaggaaatgctgttaaaggacagagacataggagagcagagtttttcttcagttcttgaccttgtgagttaattgtgatgtaattcacaaaagcagtgacttgagtcttcagtattttttttttgagtagattagatgtttgatttttattaaa

SEQ ID NO: 63424 - DNA, 1131 bp, Homo sapiens
agagaacctgtagggaatattgggactatttaacctggttaaataggttaattccttaacctggttaaggaatttagctgttaacctgagggcagtggtaaactttttttttttttccccctgagatgagatctcactttgtcacccaggctgggtggagtgcagtgacatgatcacggctcactgcagcctcaaccttcttgggctcaagggatcctctcacctcagtctcccaagtagctgggactacaggtgcatgccagcacgcctggcttattctttaaattttttgtggagattgggtttctcccaggctggtcttgaactgctgagctcaagcagtctgccctccttgggcttccaaagtgctcagattacaggtgtgagccactgcgcccagcctagtggtcaacttttgaaaagggaatgccgtaattaaatttgtagtttaagaagaccacactcaccctagtgtagagggagcaacacttgagatggcagaccagtagagtaaatgatagcaacttaggtatagccaggtatagctggggtagagtcagtggagatggggaaagggagatttatttgaaaaagactgaagtagaattggcaaaacttggaagaattgatactgggctgagatgaggaggagtttagaaagccagatttttggtttggacatctgggttggctaacagtatcatttttcctggacataggagagggaaagtttaggttttttaagaggttttgtggtgaggatgcctgatggattattggatacatggggtctgaaacttttggggatggatgcttgtggggctgtgagtgtctacagaagccatgaactttctttttcagtggcaaattataggagctttcttgtttagtgtttctaattggagaccttagtaagattgactgggttacttttgaacatttcttccaatttgatgattttctgtcttaattctgtctacttttgtctagaagaattaaatgtatataatatgaacagtataaagttataataaattatgaaagtttttccttttatcctttcttccttgcccctgcttcgttttttaaacagagacagggtctcactctgttacccaggttggagtgcaa

SEQ ID NO: 63425 - DNA, 1028 bp, Homo sapiens
taatacgaaaaaatttgtaagtagataatatttttagattagaactaaagactataaaaggtgccttgatgctatgtatacctgagaatagtcaagggctttgataggtctgaagggaaaggtcgttgccttcatacagaaatgctatgaagtgaaaggagatggtgtgggcatggtcagtcctaaataaaataaaactgcattgaattatcttaaaagttatgggccctaccagactatacttaattgttcattaaataatttaagcagaagtttcagagttctttctgtatttgaacataataattggaaacagaaaactcttcgatcatagagttgtttttagttcaagtagcactttctggtctatttgaaaggcttgcccctttgggaagatttatagcctttatctcatgccatccttgattaagctttagctttgacttctctagggtacactgttcctcagaaggatgtgtaaggtgggtggaggtggggcatttgtagctgaacttgtatatgcatggtgaggaatttatcaagctacattgctgtgaaaataagaattcctgtaagaaggcattcttaatataatgggttttcaacctgaagaatgtatatgtctgtgttcggggcagggggtcatttttttgaggagaggatcgaaatttgcagaaaggactgttttgaatattggagtcatgttttcactgtctttgtacttctcatattgcctggcaaggcgttcctgtatatgatgaggattcagtaaatgtgggaattattttgaagccttgttatctttactaatggtagaaaattgttgcattttatcaatctgttatattctaaggaatatgtctgatctaattcctagttcaagatggcaattaaaatactcttttaaaagtacactaagaatatttttttacctagtattagtgttctgtccagcaaacacatttgtcttgatgtaatttaggaaacacttaaaagtatttggtcccataaataattttttaaaaatt

SEQ ID NO: 63426 - DNA, 1013 bp, Homo sapiens
taggcacatgccaccatgcctggctaattttgtatttttagaaaggtggggtttcaccatgttggctaggctggtcttgaactcctgacctcaagtgatctgcccgcctcggccccccaaagtgctgggattataggcatgagccaccgtgtctggccaaggtaacattttttaatggtaagagaaatagagtaaaagtgcagagagtcatattaattgtggattcaaattttgtcagtatacatctttcatatatacttttgcatatttgtttattcaaatttgccaatatttgggaaccactgcagggcactgtatggggattaaaaaatttgaaggttagatggaaacatgattgtagtagctaacccctgtgtccagtttggtaagattccagtgaagccggggtggggggcttgagagactgaaggccatgatgaaaacaaaagggcaggcttattgagtataagggagaagggaacttttcagatagagggatccaggttttggaacatgagatagaagaattggagtttttctagtgtcgaaggcctggctgcatttgtgttgtggtgcctagttgtgttgtctattgtatattggaagggctgtcaatgtggagttgtagttgctggtggtgacaggagccaggataaagaaggtggttgtgaactagggtgaaagtcttaaggggctcccctaaaggtaggtagaagattattacaaggttttagaggggccattgtgagtcattgagctcctgagacagtctgaggagtaacagtgggatgatgatcgaacatcagtatatttattgcagtatcacagattgtctggaaacttagcagctaagacaacaaatgtatgttatctcacagagtttgtgagggttagaatccaggagctgcttagctgaatagttttggctcatgatgtcatgaggttgcagtcaagtggtccagggctgtagttgtcaaaagactcaactggggctagagtatctgttcctaagc

SEQ ID NO: 63427 - DNA, 1032 bp, Homo sapiens
tggagtaaatactccaaaggacagaattaaaggggccagtagggagactggaagtgggggagtctggactaagtctagactaagggggtgtgttgcagagaatgctcagccaagttcttttggaatgagaacaggagaacattagagttggggatatgtatgtggggcaggaattttcatcggtttctgtgtcatggaccatgttggtagtttcatgaaacttatggactccttcccagaatactgtttttaaatacaaaaaataagaagtaaatgagattacaaaggaaatcagttgtattgaagtaatagctaccaaaatactaaactaaatttgtgatatataagaaaatacattttaatataggtaaaaagttggggataattgatttaacttgaattaaaaccaaattcccattaaagtacatggaccattcccaagatcatggaccctaagttaagaactcccagcctacggagatggttgagaaccataaggttgaaggaggtgagaaggtgagtggcaggcttcaggggcacatcctgcttaaggatggtggtggaaggggttgtttgggggctaagtttcttttagaatgtttgtggtagtcagggtccagtccaggtggtttttggaaaggtctttccaggtttttggaaagggcctgagagctagctgatgggaataagctatttttgaatttactttgggggagccattttaactatgttacttgagaaatagtcaattatattctgaaaatatttaatatttggttttccatgtttgagtgttgactaatggttgggctcatggagttaagatatagtgagaattttcatggttaatggtaatcttggccaataaagtctagttgaactgaatttccacgtaggagtttttaaattttttatttttttcttttcttttgagacagactttctctctgttgcccaggggagtgatcatggctcactgcagccttgacctccctggctcaagtgatcctctcacctttcagcctccccagt

SEQ ID NO: 63428 - DNA, 1047 bp, Homo sapiens
aaagggcttgaggtcagtgggaactaaccctttaaataccgtgctttttttaagtccaagttagggtacttgaaacttgtggtgtgggagaagagtatttgcagtttccctttatcagctgtgattctctgcttctaaagaatgtttttattgtgtgcacgatggttagtctactgaggttttctgtcctctctcctcttcctgtgatgtgtctatgaacaacacccttttccatacatttttatgtgcatctttgagtatttccttgtgataaattcttaaagagaattactgaatcagaggataaaacatttttgtgactgttactgaaaacttattctggtatatactttcattggtaaggaaataataccagtgtattttaagattaaagaaaaccttgagttattgggaaattttgctgatttcttttaaatactgttgttttctgcttccacttatgatacatgagatgagaggaaggtttcttttgtatttaaggtgtctcaacaagcagcaaagtgtattccagcaatggtgtgtcctgaactgacagaacaaatccggagagagatagctgcctctcttcatcagagaaagggggattttgcttgctattttctgactgaccttgtaacatttacattgccagcaggtaactccaaaatctaacgtaaaaagacttttttattttattatagttacatttgtgtatgtaggtgaaaaatgtttctgttagaaagcacataacatagctactgtatgtgcatcttaaattacttgactgtcttatatatgctggaagtgagcatacagaggattacttgttaggaaatgcgtctgctatctgagaggaagacagcagttgatagtaacggatttctttgtggacctcagattattttttaaaaatctgttgtactcttttatttttctctttggttttattttagaatatcctttaaaaaaatctcctttgaaaaattttcccttttcatgcttgtgtgttatttgaaattagatagctatattggttacctggtatta

SEQ ID NO: 63429 - DNA, 1688 bp, Homo sapiens
atttattttttatttttattttttgagacagggtcttactctatcgcctaggctggagtgcggtggcaggatcacggctcattgcagccttggcctccccaggctcaaacagttctctcaccgtagcctcctgagtagctgggacacaggtgtctgctgccttgtctgattaatttttgtatattttttgtatagagacagggttttgccgtgttgcccaggctgggctcagaatcctgagttcaagcagtatgctggcctcagcctcccaaagtgctggaattataggcgtgagccattgcacccggcccagaaaagaaatattttatatcacacatgttacactggtatattaagaaaaagctatctgataaccttcaatggaaagggagttattttagagaaagttactagtaggtaattaataagtgtaattaagtataagttaagtgtaagttatgaaacaaaagatcttttaagtttgcattttctttgtagatattgaagatttgcccccaacagtccaagaaaaattatttgatgaggtgcttgatagagacgttcaaaaaggtaagcatggaattaatgagtataatttacctttcatctgatcaagtaagttttgtttagtaaggcatggtgtagtttggtgtgtagtcaacttgctttatttttattttaaattaaagacgtaaagtcctgaagttcagtgttatattgtatggttcactgttacagagtgaacaaataaagatacaaaaattttaaaaccttggttctccgcttcctgttccagaatgtatatatttctatatgaaacactttttagaaaataaaactgtaaagaatttaaaagtttattaaattattctagagacagaagatgtttcaagtactcaaaagtttatatttcaattggtcaattttatttaggtgtttattggtaaattacatataaaccattttatagctagaaaataggttcttctccccatgagtattctctaatgacataggtatggaaatgaacatgtatttaaatccatcgtacagaattagaagaagaatctccaattattaactggtccttggaattggctacacgtttggacagtcgactgtatgcactttggaaccggactgcaggagactgcctacttgattcagttctacaagctacctggggcatctatgacaaggactcagtgcttcggaaagccctgcatgacagcctgcatgactgttcacattggtgagctggcattctgccctgtttcaacccaggagtgcatttgctggattatttccttgtagtggtgggatactttttatgtcagttatattttctatggaaactggaggaaaaacagttcattttggacattaaaatactttgaacacgtccatggtttctgtttttgtttttcccccaagaaatgagataaaagcaagaatcaatggtttttatacatttttttgctaaattttaaaatagaaacatttgaagctttaaaatgcaagcatttattgtttctataagacacaggcagtatatttgaacatttcaaatgcagcatttcaagttatatatagtagccttaaatattgataaggccgttgctcatctttttagggattgattgactgattgattgattgatccatcgatggaagcagggtctggctca

SEQ ID NO: 63430 - DNA, 1035 bp, Homo sapiens
taaaatataatgttccagaggtttaactcagtttaaaacatttttcatactccacgtaactgaggatgtttaatcataattccaaatgttttaaaattaaaatatgtatattcttttataatcgctaagataaatgtgtcttgaaaattttggcaacagtgatgaaatacattgttttgaaaagttcaaggagaaatatcagagaaattgtcaatactgaaagttatatgcagttagaaatttcttggtgcctaaaataactttataaataagacagctaagccagccagaaattcaatggtgattgcactcaaaactcttcaaagaccactgaagaagggaggttcaatgaaatatactttaaaactaaacatgttaaaatgttcatcctcaccaccccaagacctaaactctgatactaccagagtctccataagaacagacaagcaaaccaaatccagcaatatatgaccaaatggtacaggaataccagtttggtttaacattcaaaactcaattccatgttcatggattggaaggctcaatattgtcaagctggcaataccaccatcaccccaattaaatctacagattcaatgcaatcccaatcataatcccagctgtcttttttacaaaaatcgataaagctgtatcctaaaatgtatatggaaatccaaaggactcaaaatagtcaaaacaatgttgaaaaagaaatacaaagtcaaatgacttacagtccagatttcaaaatgtattacaaagatatgatcatccagacagtctggtaatgacataacgatagcccagtggaaaaataaatcaatagaaaaatattaagagtccagaaacaaacccttacttttatggtcaactaattttcgacaaaattgccaaggcaatagaatgtagaaagggtttttttcaattaaaggtaccgaaacaactgggtatccacatgcaaaaaggtgaatttaggacatctcacactttaaacaaaaatgacctcaaaatgtaaaacaaaaatgacctaaatgt

SEQ ID NO: 63431 - DNA, 1046 bp, Homo sapiens
atttcccacctgttgtttatacaagtgatcaagtaggtggtgtactatacattgatagagaaatgtagtgtctttgtatacaacatttcagatgactttttttttttttttttgtaaactaattgtggacagtggaaaataaccagtctcatcattagcgtttgaagtttgaaaatttggttgtcggtaaatcaaattctgactaaagatgttaaaggatgttacaaggtatctgctagtggaagagggaggcatttttcattagaaaaatacattaccaaccagacaaaataaaattattaattgtttcacagactgcttaaagactgcattaaataaaaatgatcagaactttaaatgttttatttatagaagactatttatttatttttttactatcctgcttttttaggttttacacacgctggaaagattgggaatcatggtattctcagagctttggtttacatttttccttgagagaagaacagtggcaagaagactgggcatttatactctctcttgctagtcaggtgaggatgcttcaagtcttgttgcttctatgagaaaagtaagcatgtagtctaaactggtttatttgagcaaaccatgttgggggcaatgtggtcaaagaaaagaatgcttgacgtggtatcatcagtcaacttgggttctagtgatgactgctgtgtatcaaataaatagcatcgcaagtatagatgagcatcgcaagtatagattagcatcgcaagtcctcactgcagagcaggaagagtaacgtgtttttatatcgaatgattaaaaacatcaaaaagtgaaagctgtgctatgacggttacatacagtagatagtcttgggattgctctccgttcctgcagcataggcttgatgcctatggtacctatccaggtgagctctgttctgtctctggggacacttaagattactggtgtaggtacttgcattgctgttgctgatctgtcaggccctgaggaaccagttgtcaatcttcataatgctccctgtggtgaggcaatacctgtgt

SEQ ID NO: 63432 - DNA, 1052 bp, Homo sapiens
ttcattaataaaaagacgttagcaaacttgcaaaacttcattcccacattaatcagaaatcattcctattgatggtaattagttcagagtaagctaaactacccttttcctttgcctacatgacacaggtattgcctcaccacagggagcattatgaagattgacaactggttcctcagggcctgacagatcagcaacagcaatgcaagtacctacaccagtaatcttaagtgtccccagagacagaacagagctcacctggataggtaccataggcatcaagcctatgctgcaggaacggagagcaatcccaagactatctactgtatgtaaccgtcatagcacagctttcactttttgatgtttttaatcattcgatataaaaacacgttactcttcctgctctgcagtgaggacttgcgatgctaatctatacttgcgatgctcatctatacttgcgatgctatttatttgatacacagcagtcatcactagaacccaagttgactgatgataccacgtcaagcattcttttctttgaccacattgcccccaacatggtttgctcaaataaaccagtttagactacatgcttacttttctcatagaagcaacaagacttgaagcatcctcacctgactagcaagagagagtataaatgcccagtcttcttgccactgttcttctctcaaggaaaaatgtaaaccaaagctctgagaataccatgattcccaatctttccagcgtgtgtaaaacctaaaaaagcaggatagtaaaaaaataaataaatagtcttctataaataaaacatttaaagttctgatcatttttatttaatgcagtctttaagcagtctgtgaaacaattaataattttattttgtctggttggtaatgtatttttctaatgaaaaatgcctccctcttccactagcagataccttgtaacatcctttaacatctttagtcagaatttgatttaccgacaaccaaattttcaaacttcaaacgctaatgatgagactggttattttccactgtccacaattagtt

SEQ ID NO: 63433 - DNA, 1094 bp, Homo sapiens
tttgacaatcttttctttcttaaaaaccaactgcgatagtatactgaaggggaggtagtattgttttttacacatcagttttccaggagtggtaataaatgttttaagtttttgttttgtttcgtacagcctggagcaagcttggagcagacgcacatttttgtactggcacatattcttagacgaccaattatagtttatggagtaaaatattacaagagtttccggggagaaactttaggatatactcggtttcaaggtaagccattattcaggaacgttttacaagtttctttgaacggaatggctcagatgtcaggaaggagcagtggacaggggaatgtgaacaagggcagtgagggagtggctctttcttcctgtgactgttgggattttcttccctctctttccaggtgtttatctgcctttgttgtgggaacagagtttttgttggaaaagtccgattgctctgggttatacgaggggccacttctctgctttggttgccatggaaaatgatggctatggcaaccgaggtgctggtgctaatctcaataccgatgatgatgtcaccatcacatttttgcctctggttgacagtgaaaggaagctactccatgtgcacttcctttctgctcaggaggtaagcagtttctcctatgaactatttctagtagtgaccttgtaccagaaacagcctgaagtgcctttcaggtgtggttttatctgcactatcacttaatttctgaatgtgatggtagtaattgctgaaggtactagctatactttgaaatttaccttttcaaaactgctgtatggggacacatcaaggaacttaaggtggtgatgggttttaagaagaaaaagtaaagatgaggtttgtgatttaaatatggcattttagggaatgagaagtgagtttttatctgaaagcagagttccaagaattgcaaggccagtgtggtttaagaggggaagcaacagggaaagagagagggtaggcggcagggggagggaggaagggagaagaggtcagagaggatagggatgggggggagttcattgaaggctttttaaagctttgggttttactc

SEQ ID NO: 63434 - DNA, 5833 bp, Homo sapiens
gggcatcacttgagctcaagagtttgagaccagcctgggcagtctggcaaaaccgcatctctacaaaaaaatacaaaaactagctaggcgtggtggctcatgcctgtggtcgccactacttgggtgtctgaggtgggatcacttgagcccagaaggtcggtcaaggtgagccatgttcatgtcactgggctcctgtctcttatgaaaaggccagaagtagaagagccaagagcttggcaactctgccctgaacttacaaggccctatttctgtgtgttccttagatatccgccaggcatcgtgggtgtggctccaggaggacttcctgcagccatggaagggatcatccctggaggcatcccagtgactcacaacctcccgacagtggcacatccttcccaagcgccctctcccaaccagcccacaaaacacggggacaatcgagagcaccccaacgagcaatagcagagaatgccagaaggtaatcactcagatacacttgggaccaagagacagtgaaaaatagatgaactaagagaaaaagaatcggatggtctttgtaactgattctggacatatgcatcattgatgttgcagtgttgaaactacaagagctagaaaactgaagatgtcgtctgcttacggaagcgctgaaagactaggatgtgatttattaacgaccaacttctgttattgtgtgttaagtttttcatctgtgcatcaaatcacaaaaagaataaatagagctttttcctttatcagtcccttgggcacagcaggtcctgaacaccctgctctacaatgttgcatcaagagttcaaacaacaaaataaaaaatattaagaggaaatccccatcctgtgacttgagtcccttaagtctacaggggctggtgacctctttttgctaataggaaaatcacattactacaaaatggggagaaaactgtttgcctgtggtagacacctgcacgcataggattgaagacagtacaggctgctgtacagagaagcgcctctcacatctgaactgcatactgagcgggcaagtcggttgtaagttcagtaaaaccctctgatgatgcaaaaaaaaaaaaaaaagtattaagtttcacaagctgtttgtactcaaatatattttctcagtttcagatcctctgctattttattgagtggaaagtcttgagctaaaagggttcaagaagaataatgttgcatttccttatgtctcaggaaacactttttatggtaacttgtcagattgtctatgaacaaacccacttttttagacattgataaagtcttcttttcttcacgtgatattttatacaagaacacttcagatgtattagatgtgactgattttaacaaatcctattagatttgtatcaactagttacatgttctattcatagtcttttgtgaatcattgcctttttgtttaaaaagatggcctattttgagcctttgtataggtacattcctgtttttgtgacaaaagaaaaactttaaaattgtcccaaacagaaaaataatggctatcagaagtatgttttgttttagtgtgagttaccgttactgtatttgtttattgtaaaggtggacatttagcgttcagtgcagttttcaataaaaagtaattaaaatttgttaagttctgaaattcaagtacatctcactaatgtaaatgttctctacttgagatgtttaaggcaattgcattgtcaattagccaatttccagctcttgttactacagggttccataaccagactcaagaccgctgacaattaattacctgtgataacaaaaagtttaattgaaaaatcaaaacctcacacaagtccatcattatcacgtcatgccatccttaagatgcaatggtgggttagtgctaaatcaattcaaaaaaaaacaaagttgctcaacttttagagttctgactttaatctaccccaaagcaaaatgacctggacctggttcaagggagggaagtgaaccttgaaactgttttgccaataacctaacaaacaaaatgatatttacaaagaagtgttgcaaatagtcccatgagttaagagcttgatttaatggatcttctttttaaatagaattaaacctttatactaaaagtatttgcaagtgtcaattaagtccaacaattccaggtatgaaactccctctgagctcttccttatacttcccttcccaattaaaacaaaacaagaaaatcatggtgtcttaaagcctttggcttgcctggccttgtctgctcactcattttaaggtggtggccccatcccaactctaccataaaagtgtctattaacacaagctcacatggagagagacggcgctcatagttactgacctattaccccagggaacaaaaaggtagtttaacgtcttcgtaaccactcatcaaagaggcaatgaaatatgcgtgaaaaggaggccaagcgcacacagaatatcttaccttcacgaatatgtgaagaagtctgggacacgatgaacctaagagtcaaaaacataaaaaggcaggtctgaatccatggtccacctgggttttaattattagatcttggtcgcccaaacaaaaatttatatatatatatataaatttgaccccaaggaagaacaagtcaaaacaaaatgccacgctctgtttgctctagaaaaagaaccatcaagtccacagagtgcaggtatgacttactctccagagtcagtcattaatgtctgtcacctagccacgtataatcatctttgaaaaaggactatattctatcttgggacaataattatggctgttttaatagttcaagagcataatatagcattgatttaccaaaatttttggcctttaacagccagtctatgaaaaccatttagagccccattcctgtctgtagcctaggaaatggaaccatctttaattctttcccacagggaagaatgctgcacctatcacactatgtggtcagggtcactgattgataataaataaataaataatagagcgctcaggggaaacaacactcaccagaccacaacacacagtagaagctaagtgctgagcgtgtactctggacaacgctggctgcaatgcagactgcaatggctacatgcttttccctctaacaattctctttggctttttcaattgggagggcagattttgcttaacaggcaactagaacaggatctctgcccactaaaaaattatccctatacatagagaaattactacagatgctaagtagtcagaatgctaacattttctacaaacttgattacttattggccaaaatgaaagcaaacagccaatttttaacaacacattcaccacttgaaacaaacagcagcatttacattatatcaaagattcatttctacagaatcgtactaaaaaatcatttttcctgcaagatttagcatgcagcaaaaaatgatcttttcatcctgggaacacctttttactgagttttcggggggaaagaactaaagacatgacagttttgtgggtatttttctatttttagtattctggcagcaaatttgaggttgtacacatttcattatcaactaaacaaaacaagaagcaagcaaatactttaaggttttcacagcctttttcatcacagggaaggaaaaaactgtgtgtgtgtgtgtgtgtgtgtgtgtgtgtgcgcgcgcgcgcgtgcgtgtgtcgtctttccaaattcctggccacatcaatagtctagaaagtgcttatcaggacaccaaatatttctgtgttcctgagataggtctgaaatttttacccagtattgaatgtatacctgaagtggtcaaataatacttcttataaaaaagtttttctacctaagattatagttttaactttaaattaaagaatggccacaattaaccaacatgcaaaaattctcagactaaacactgagaaattcttcatacaatgcatttgccaccttattgcatttttaaaatctttattctgtagtgaattggtattcccaatctgcctaagcaaaggcatgcccttctaacaagatttgcttagagcagaggtgatagaaggaagaatccgaagaccctctggcatggcaatctgggagcagcacattgttgatggagtccaagtgagcacatttcacacaattcatttagtgacaagtgggcttgctcccttttcatccaggaaaaaaactactcacagaccactgcccagaatctggaataagaaccctcattttaaggtattcttcccaacaaataaatatctaaatattgaaagggggcatatcagaaaacttaaagacacaataaccaaaaccaaaaccctcttcaaaacaagtaagcaatgtctgtatttagttcactctaaaacattcttagcttttcttgcagtttgttcctaaaagatttgattgggcacaagaggaacgaaattattaataaaataaaagcttatttttgttttgctgtggataatcggtacaaaacgtttccagatctgagacttagatggatcttttaaggtgaaagtagaatgccaggttctactgaaataatatctgaaaggaacaaagagccatttgccatgtgctttttctaagtgcccatgctggaaaaaattttctcaataatatgaagatgctggtacaacttttcctattaaacaatgtcttacacaaccacatgcgttacatttatagacagatttacaatttggaaggaaaaaaagttctgtcttaataaaattagttttttttacaaactgtagtccaactaaagttctctgtctcctcacgcagcagaggcattatctccataaggtgtgtgtggtccaggaaaacacttccccgagcagatcctgccagatttggttcattccatgatgtcgactctgcttggagcaccacactaactttagggtcattacagatctgatgccttggtcttctgctgtttgattttttttttcattcatcttcatcatcctcatcttcctctccatcagacagggatgtacacggccggatctgtcggtagcggtcaagccatttttctaccatctgagtgaccagggggtgatttcgccgccgagaactcttctgcatggcaaccagaactcccccctccgtcacacagcagtccagccactccctgagcagtttttcttgctgttcctcattacctagcttttggaggaatatgaagacaaagggaaaatcatacaacagatcagagacttggtaggaatgtgacatggaaacctacagctggtatgctaactcatgaaaaggccaaagcaatcaacttttcacatggttttgacctcttggaagttttgtgattaaagtccagtttgctctggttaaatttaaaaagacataaatgggaaatttctcagaaaaaaactaaagaggagcacactagagggtaatttgttagataaaataaaaaacaaatgtcctaataaactgatcctggcaagccacagcttcaaacacatgacaaggtaagtttacttagtcaattatgtacaagctgaaattatacaagttacggtctatgaactttttttcttcatgttgtgattataaacgttttataattactagtatattaaataaaagaccaatacttttataagaatactggctttctgaaagagcgttgtttttgtaccttctcaccacctcccctgtctggtctacagcaccctttcactccccttcatctacaatacctggtgttcctgctcctgccatgcaccagaccccaaatgttcctcttctgggtaaactggccattggtttacc

SEQ ID NO: 63435 - DNA, 2131 bp, Homo sapiens
ttttaaatttaaccagagcaaactggactttaatcacaaaacttccaagaggtcaaaaccatgtgaaaagttgattgctttggccttttcatgagttagcataccagctgtaggtttccatgtcacattcctaccaagtctctgatctgttgtatgattttccctttgtcttcatattcctccaaaagctaggtaatgaggaacagcaagaaaaactgctcagggagtggctggactgctgtgtgacggaggggggagttctggttgccatgcagaagagttctcggcggcgaaatcaccccctggtcactcagatggtagaaaaatggcttgaccgctaccgacagatccggccgtgtacatccctgtctgatggagaggaagatgaggatgatgaagatgaatgaaaaaaaaaatcaaacagcagaagaccaaggcatcagatctgtaatgaccctaaagttagtgtggtgctccaagcagagtcgacatcatggaatgaaccaaatctggcaggatctgctcggggaagtgttttcctggaccacacacaccttatggagataatgcctctgctgcgtgaggagacagagaactttagttggactacagtttgtaaaaaaaactaattttattaagacagaactttttttccttccaaattgtaaatctgtctataaatgtaacgcatgtggttgtgtaagacattgtttaataggaaaagttgtaccagcatcttcatattattgagaaaattttttccagcatgggcacttagaaaaagcacatggcaaatggctctttgttcctttcagatattatttcagtagaacctggcattctactttcaccttaaaagatccatctaagtctcagatctggaaacgttttgtaccgattatccacagcaaaacaaaaataagcttttattttattaataatttcgttcctcttgtgcccaatcaaatcttttaggaacaaactgcaagaaaagctaagaatgttttagagtgaactaaatacagacattgcttacttgttttgaagagggttttggttttggttattgtgtctttaagttttctgatatgccccctttcaatatttagatatttatttgttgggaagaataccttaaaatgagggttcttattccagattctgggcagtggtctgtgagtagtttttttcctggatgaaaagggagcaagcccacttgtcactaaatgaattgtgtgaaatgtgctcacttggactccatcaacaatgtgctgctcccagattgccatgccagagggtcttcggattcttccttctatcacctctgctctaagcaaatcttgttagaagggcatgcctttgcttaggcagattgggaataccaattcactacagaataaagattttaaaaatgcaataaggtggcaaatgcattgtatgaagaatttctcagtgtttagtctgagaatttttgcatgttggttaattgtggccattctttaatttaaagttaaaactataatcttaggtagaaaaacttttttataagaagtattatttgaccacttcaggtatacattcaatactgggtaaaaatttcagacctatctcaggaacacagaaatatttggtgtcctgataagcactttctagactattgatgtggccaggaatttggaaagacgacacacgcacgcgcgcgcgcgcacacacacacacacacacacacacacacacagttttttccttccctgtgatgaaaaaggctgtgaaaaccttaaagtatttgcttgcttcttgttttgtttagttgataatgaaatgtgtacaacctcaaatttgctgccagaatactaaaaatagaaaaatacccacaaaactgtcatgtctttagttctttccccccgaaaactcagtaaaaaggtgttcccaggatgaaaagatcattttttgctgcatgctaaatcttgcaggaaaaatgattttttagtacgattctgtagaaatgaatctttgatataatgtaaatgctgctgtttgtttcaagtggtgaatgtgttgttaaaaattggctgtttgctttcattttggccaataagtaatcaagtttgtagaaaatgttagcattctg

SEQ ID NO: 63436 - DNA, 1051 bp, Homo sapiens
caaatacttttagtataaaggtttaattctatttaaaaagaagatccattaaatcaagctcttaactcatgggactatttgcaacacttctttgtaaatatcattttgtttgttaggttattggcaaaacagtttcaaggttcacttccctcccttgaaccaggtccaggtcattttgctttggggtagattaaagtcagaactctaaaagttgagcaactttgtttttttttgaattgatttagcactaacccaccattgcatcttaaggatggcatgacgtgataatgatggacttgtgtgaggttttgatttttcaattaaactttttgttatcacaggtaattaattgtcagcggtcttgagtctggttatggaaccctgtagtaacaagagctggaaattggctaattgacaatgcaattgccttaaacatctcaagtagagaacatttacattagtgagatgtacttgaatttcagaacttaacaaattttaattactttttattgaaaactgcactgaacgctaaatgtccacctttacaataaacaaatacagtaacggtaactcacactaaaacaaaacatacttctgatagccattatttttctgtttgggacaattttaaagtttttcttttgtcacaaaaacaggaatgtacctatacaaaggctcaaaataggccatctttttaaacaaaaaggcaatgattcacaaaagactatgaatagaacatgtaactagttgatacaaatctaataggatttgttaaaatcagtcacatctaatacatctgaagtgttcttgtataaaatatcacgtgaagaaaagaagactttatcaatgtctaaaaaagtgggtttgttcatagacaatctgacaagttaccataaaaagtgtttcctgagacataaggaaatgcaacattattcttcttgaacccttttagctcaagactttccactcaataaaatagcagaggatctgaaactgagaaaatatatttgagtacaaacagcttgtgaaacttaatacttttttttttttt

SEQ ID NO: 63437 - DNA, 3461 bp, Homo sapiens
cgggggagcaggtctcttctgtagggactgggttttgattaagtcagtagcaggattaagtcattgggtcatcagaaaatctcatggataaagttcaaggggtttgtgaactttaaaaaaaaaaaaaaaaaaaacaaagaaatagccgtcggcacggttcaaatctgggcttggtgctctgggctgcttttccacaggccctccaggccctggatctgcagagtgtgagccccactgattgaagcatgttcgtgcacagacgccatgagggggatggaggctgcaggaacgggggaaggcaggcgggggtcctgtgaagtgtgagctcccagcagttgcatgctggggtcctcagtttcatgttgccagtgcgtcagagagccatctctcactccgtccctgccaccgtccagtcctgcctgctgtaaagggtgacactgaggaggagaggcgtgatggttcgtgccttgctatactagttgtcctgcagctgtccctgatcagactggccttattcaacctttgttctaaactacggcagttgtcctagccaggccatcggttagatggagctgctgcaggaggagccatccagcattgaggtacccctggaacacaggctgcctgctcggaaatgcgcatctttgtccttctcctgcctgcaccttggagccatggctttaaagattccttctgtgatctccaagagaaccagtcgagcatcaacactaaccattttgttttcaaaatgctgaaaactgctctgggaagctggaggtgctatcgagggggaccccatgggtttatgaaatgacagccgttggggagtgggagacacctcctcatcctgtgacatagctggcgggaggcccaggctgcataatgcagatgggcgcgaggccccaccagtgggacaggtccaggtctgatggtcatgtgccctgcctcccgcccagaacacagtagcatgtggccagtctgcactcgggccagcctgcagggagccattgtgctcatgtcaccctttgcaggagcgagcccagcaatgaggaggcaggacattactccctgtgacattgagagcaagtttttcaaacacaaagctcatgttaagaagcctgcagtgcacacaagaagtggggagaggggtgggaacggaggacacgggtggtgatgggaggggcatgtgggcttgtcagaacactctgtgtttgaaaatgtcaataacaaggaagggttttgttttgtttttaacaaaaatcctgctgtacccaatataagcagcaagcactgcggtcctcacctgtcctacaccggccatggtggcccctcgcgggcagtgctcgcctcaggcctcactaagctttgggcacacggtttctctggcagcagctaccagcggggatgccaagcccggactcagctcagaagcaatggaggtggcagcgctggggcgcgggctgtggactcactcacctggacgctctgtttctgtacaggtcgcacggggcaggcggttgcagttcgagccaaggcctttggattcagcgtcatattttatgacccctacttgcaggatgggatcgagcggtccctgggcgtgcagagggtctacaccctgcaggatttgctgtatcagagcgactgcgtctccttgcactgcaatctcaacgaacataaccaccacctcatcaatgactttaccataaagcaggtaatttgaaaatagatgccatggaagcttctgtcgaaaggtggtagcacttgcttgtgggcacaagagggacacggagggcaacggaggtggtttctggatacactgttgagcagggaagaggccctgcaacaaaccagtgacaagccacgtgaagccccttcctcgggctgagccaggctaagcagagaaggacaggcgctagccaggacccagcttcagaagcttcccagaacctttaaagaggccagcagctcggcacagtccagcctttccaccgtgttgcttcctctcaggatcagcagcaacggccctggcttccagccgtcaccaacacttcccactcccttccctcaaactgcagcacacacattaaaccaccagaccaacaaaactagcttgcagctttcttctttaaaccttggtacaagagtcttccaccatgccagtgtgcctgtaaccggcttttctttccttccacagatgaggcagggagcattccttgtgaacgcagcccgtggcggcctggtggacgagaaagccttagcacaagccctcaaggagggcaggatacgaggggcagccctcgacgtgcatgagtcagagcccttcaggtgcgtgttgccccagccgcctaccaggagcccacagggcccagctccacacctgacccccacactttgaactcgaggcccttttcccaaacaggtccctgggcaggaaactccagagatgacatttacagtctctgttcttctaaggattgtgctgtattctaattgtaaaagggctggaagtttcccagaggtcatcagggaaaggagaggcagaaaattggtgggggtgtggcagtggttctggtcttcagacagacaggcatcatctctgccctggattacagcaggacaagccttcaatagaattgggctttttgatctaccaattatacggttcttacacaactttgataattacattcaaaaattcccagccttcataaaatatcatcacagatgttcctgtatccatgctatctatgtagctacttttctacatggccaagagctcccttgtgctgaggagggcagggagcgtatgcgacatttcccgcttactctgttttttctacatttttctagctttgctcagggtccgttgaaagatgccccgaatctcatctgcactcctcacactgcctggtacagtgagcaggcgtcactggagatgagggaggcagctgccaccgagatccgccgagccatcacaggtgagcccctccgtgcctctggcctgccaagggcagcctcagctccacagtgcagccggctcctgtcctgctggctacaggcagctctcgacaggtagaattcacttttagcatcaaatttatatgagttgggccctgtttatttacgtaagccctgaactaaacttcacagagggaaccattccctttagtcccagacattataaactcgggggtcggggggcacacagaggctgaaggtcagtgttgaagagctcaagcacttgggcctttggatgttctacatttttacaaatgcttatttccccacataagcagctacaggtgtaatgttgaacttactgtgatttgtaaaaataatatgattaattttaatcatcttaccctaggtcgcatcccagaaagcttaagaaattgtgtgaacaaggaattctttgtcacatcagcgccttggtcagtaatagaccagcaagcaattca

SEQ ID NO: 63438 - DNA, 1030 bp, Homo sapiens
catgagattttctgatgacccaatgacttaatcctgctactgacttaatcaaaacccagtccctacagaagagacctgctcccccgtcacagcgccccccccggccccccatgccgcttattttaaaagcgcagctcccacaggctgcctttccttcagtttctgtccatgcccccagccccaggctgccctctcttggcggcaccgtcccaccccgcctgctgcactgagcccgctgggcctgggggactcttgctcagtagaacccgaggccagcaaaagctcttagcccaggatggctgcagcagcgacagtcctgaaggctacagagacacctggaaagggaacaaggagagcacgacagtccctgtgctgaggatccagggtggtggcggcaggggttagtgtacagtctcgagaaaacagggcggcggcagggggctgcactgacctctatacaccgagagggtttttaaagttgaatgacaagggcacagctacaggaacgaccccaggaagaagtcccgtgacggctggagtcagaagcccctgaaacaagcacctccccagtgaggccccaccgtgtacccagggtgctcatgaccacccccaggctctgcagcctggccagagaccaccgaggccccaggaggggcttcagagatggagatgaagctgcatctccgagccatgaggcccagtggggcccggacagagggagcctggtgttcacacaccacatctgttttccaacaaagtcaaaacacggtgggtcctttcagaagatccccagcacccgacacttcaactcagactccaggcgtcgggcgaggccagacccaggagatcacagcctgtagcggggacagaaaggtgtgcactcctggaagcgtccagcaacttctctcttgttcaagtggcaccccaggtccagagcggggcttgtggggagaggagcacgggggcttcgtcctcggaggcgcggagctccaagcaagggctgagcagcagctgggagtctcccggaggc

SEQ ID NO: 63439 - DNA, 1021 bp, Homo sapiens
agtagatatttggtgggatacgtggtatctgccttttgggactccaagaaggcgcatgtgcacacggggccagtaatgttctggcctccgggagactcccagctgctgctcagcccttgcttggagctccgcgcctccgaggacgaagcccccgtgctcctctccccacaagccccgctctggacctggggtgccacttgaacaagagagaagttgctggacgcttccaggagtgcacacctttctgtccccgctacaggctgtgatctcctgggtctggcctcgcccgacgcctggagtctgagttgaagtgtcgggtgctggggatcttctgaaaggacccaccgtgttttgactttgttggaaaacagatgtggtgtgtgaacaccaggctccctctgtccgggccccactgggcctcatggctcggagatgcagcttcatctccatctctgaagcccctcctggggcctcggtggtctctggccaggctgcagagcctgggggtggtcatgagcaccctgggtacacggtggggcctcactggggaggtgcttgtttcaggggcttctgactccagccgtcacgggacttcttcctggggtcgttcctgtagctgtgcccttgtcattcaactttaaaaaccctctcggtgtatagaggtcagtgcagccccctgccgccgccctgttttctcgagactgtacactaacccctgccgccaccaccctggatcctcagcacagggactgtcgtgctctccttgttccctttccaggtgtctctgtagccttcaggactgtcgctgctgcagccatcctgggctaagagcttttgctggcctcgggttctactgagcaagagtcccccaggcccagcgggctcagtgcagcaggcggggtgggacggtgccgccaagagagggcagcctggggctgggggcatggacagaaactgaaggaaaggcagcctgtgggagctgcgcttttaaaataagcggcatggggggccggggggggcg

SEQ ID NO: 63440 - DNA, 1050 bp, Homo sapiens
acccacccactgtgctcaccccttccctcctggcaggtatccgcccccagatcatgaacggccccctgcacccccgccccctggtggcgctgctggacggccgcgactgcactgtggagatgcccatcctgaaggacctggccactgtggccttctgtgacgcgcagtcgacgcaggaaatccacgagaaggtgggcccaccctgcccggccggggcctgcactgaccttgggcagtttcctccccagcatccccccattagatcgccccaagtcaccggcaggccccagaacccctgttccctgctttcctgctgaactcctctgcctcaggttcaagggtgatagggccagggggccaggccaagtggtgccggtgggctgcacggggtggggctccgaccctgtgctctgttcccacgcaggttctaaacgaagccgtgggcgccatgatgtaccacaccatcaccctcaccagggaggacctggagaagttcaaggccctgagagtgatcgtgcggataggcagtggctatgacaacgtggacatcaaggctgccggcgagctcggtgagtgcgaggcagcgctggctgcctggagttgtccggagctctgtgggccctgctcgggtgggcttggagaagcagctggaactgggaccacggagcagccgcttctggctgtagcaaggtggctgcctccaggccgggctgtggagcaccttgcggccctgccttcacatgacacaggtaggatagtccctgctggcccttgtgtggggtctgcggggctgtgaggcatctctgccctcagagcaacacccagctggcacaggctcaatttggagacacccagtgccgcctccagaggggagaatgcgactggccacatgtcctctaaaccacccctgctgggtgcgtcccctaaatgacccctgccgtgtgtgtcccctaaactgcccctgccgtgtgcacagctctaggcccctgtccacatgggaacctgggcctcccgttctgggagggcagccttagcagcatgtggtccagg

SEQ ID NO: 63441 - DNA, 1012 bp, Homo sapiens
caagtcccactggccgagcacggccttccatgcagggctggtgcaggtgctctgggccgtccctccccagcaccgtgtatagtcttaacaggatgcagtcacggccccagtggagggggatttccttcctcgtctccgagcgtgtggctaacggaatatgagccttggtggtccagcaggagcccccccgtggctggggtcccagtcatcgtccccaccaagtggccagcttggggactactaagagcccttgaggaggttagggatggaaggcgaggccacacagatgaagttggcctttgtggaaggctcctgcttttgcctgtgggaccctgagcctgctgccttgtgctcaaaggccagtgatcccgggaatgtcacaccttcctggttgggttacccatggtgggtcaccaggctgggctcagcctggagcaatggcctggaccgtccagcctcagagggagggaggggatggggatgtaaggccgccgtcagggttgatctggatatctgaaaagttgatgagccccaaagttttaatctgaggctaaagagttctaatttgacaagagacattgccccttcctggcatctcggcggattgcacctctggaactcaggtagttgttctcttgtgtccagggtgtgggtcttgaagatgtgaggtttgggcagatggtcaggaggacctacgaaatccaaggatggatttgaagggggcagtttttgttggagaaaatgctgcttctctgtctctgaggtcttcggagcctgctgggtttgctgcacagaataaagagagaaaagaggccctgaggctctcgctgcatcctgggcgggccccgcagggtgtctgccctgtatgtgcacggggcgcaagcatgcgcgtctgtagtgtggcaggtaaggccttccaccaccctgctgaacgtctagatgcagccgcgctggtccagatgaagttgctagagaatttgtacttggacttgtgggaaggaccactggggcc

SEQ ID NO: 63442 - DNA, 2705 bp, Homo sapiens
tattgcctgtaatcccagcattttgggagaccgaggcaggtggatcacctgaggtcaggggttcgaagccagcctggccaacatcgcgaaaccctgtctctgctaaaaatacaaaattagccaggcatggtggcacatgcctgtagtctcagctatttgggaggctaaggcaggagaatcacttgaacctgggaggtggaggttgcagtgagcggagatcgtgccactgcattccagcctgggcaacaaaagtgaaactctgtctccaaaaaaaaaaaagccagagccagcctttgcctcctatgtcagaaatgatcatttgcagctgctttgctttggggtagaagcctcaaatcctgaaaccctttaccctggggcaggttgtcttgtgctgtaagcaacagaaacccatttagatcatttttaaataatgagaatttctgttggaaggatgtcggcttagctcacacagtgtctaggaagactggaaaatgggtctcagaaacactgcaggcagctttgtgtggcaggatcaatccagttccttcttggtgactgctcaggggaacatcccatttgccttgcatggtactgagccagaaggtcaactccaggcctgtctgcctgtatccgagaaagcagcagctccccacaatgaaatgtagcgttttccagctccggatccttccgccatcctccctgagatctacctgccttaggatctgtgagatccacgcactttgcttttcctgggtgtctggttactgttcacaaaagtccagcagtttggcctggtgttgtctttgtttttgactgagcatctctcatttcacaagtatttattgcagctgcagctctaagcaataccaggcccagggatgggcgtcagcactgccttgagctggtgcacagcacatcccggacggaggggcagggccgtcctggtgcacacgcaagcctgaaaccagatagtaattgataccaggggagccggcagggctttctgctctacacagttaatgtgggcaagctgtcaacagtaaggcactgatgtcatttccgtgatgtgtccagttgcagctggaattgtcctgaaatggacaaggcaggtttactggcgggagacggtagaaaggaaaaatagcgcatagagggcaccagggccctgtgaccctcgtccgcaagtgtctcctcatacctcgtggttgcgcaccgtggtacggggccaccctgagcgctgactcccgggctgtgaagtgggaagaacagcagcactgcaggactcttgtcagccttgtggtctgtacgcatggaaaaggccgtcagctgtgcatagcaactggaagccatggctttttagcataaagcccagttcttcggaagccctcattacgtactgcgccttgggctttctcctcgcaaattcccaatcctgccccactgggcctggggaccccacgtccctgaaagggtcgtgttccatcttaatgtatatgaatcttactctgtgtgtcagttacatcctaataggttaaaaacttgctcaaatggtcagaagcctgaaagaggcgtcaggaatcctgtgtgaggtaagatgggggatctgtttgcaccttcatctctccatatgagatcttccatatgagctcttccagaaacctctgccccaggctccagcaagcctgtagggcagcggctgctaggcaagggcttgaatttcagtccagattctctggtgtgtgggtggacagtttccttctgggactgaaggagcacttggaagatggtgctttcccttctagagcaaaccttggcattgtcccagctaagctctcatgcccagggcttgggggtctcctgtggcctccatatccctgcacctcatgcagggcacgcaagcatcccacccactcccaaccccccacctccagccgtcgtgcccggcatcttttcccagcatgagaacccgttggcttttctcttttcccgccttgccatgaaggacctgctgccaggattcgagcctcagaccttggacaggtctcgggccagcctcagccacgttctgcgtgcccggccatcagggagggtagagggtgggtttcaccaaggagaaaggcaacccgtgtcggggagggagccgatcgctaggcaacctggagtttgttaccctggtaacggatccatgcactgatgatgctgcggatggacatcttgtgacaatggcctctcaggctccccagacgcatcagcggctctggattcccaccttgcgcccagcgtggttttcctgtgtggctaccatttaacgaacagcttggatttcttataatcaggcactctctccgataaccatcctgccagcacccctgaaagtgaagttggggtgttcctcactgtgtgtgggcgaccgcctggggcatgagaccaggacttccaggccccacagggttgtgcgctcagacctcaagtaggggccagaagagtgtactgaaacagaaggaatcttgtggaatttggcagttgtaccattttcttagcagaaaacaggagcccaggtgggagccatgtgtgtcgggttcctcgtcaggtgacggtgctgttgcggatctcgcggatgagctgagggggtatccagctttgtgctgcacgcttcctgtccactcatacaggtcgtgggctggtgaggacacgggggtgttggc

SEQ ID NO: 63443 - DNA, 1053 bp, Homo sapiens
gacaacagcgtgagactccatctcaaaacaacaacaacaacaatttttagtctttggcgatgccctgaggctcatctcttccacagaggcttggaggatcggccacacgagtggggtatgcagaggcacaggcaggtgggggagtgagaaccccagggcgcatctgaccttggcgtgccggcaggaagagaacaagcagtcctcctggaagattccaccagaactgtttattggacaggggactcagacgatgtgtgtccccagccacagtggtggctgagagtgtccctatcctgtgcatgagatcctgaccacccgtccctgcagggaccgtccccgtgttgggaagcaggagggtatgtcgcagagcctcacccagtgggagccacaatccttattccttgctcctcaggcttggatgttgctccggcttctatcccccacatcctgtcctccctcccggagcccagggaccacccatgtgaggctgggccactggggaaatctcgcacacgtagcgcgtctcaccagaaatagaagcagagcctcacgtccttggctgcttcgctgtgggaatgccttctaaggcgccgtttttggtgatgtcccttcacggatctttcaggcccagtgagtcagcagtgtctgcattcacacaggctgggtggggttgttggatctgccccgggtggatggcacctgctccctcagggcaaaaattcaccccagaacatgagctgcacccggggttaggtgaaggtgacggagcctgaacactcaacaccagaggcagccaacaggacggtgtctgggcttccaaaaagccaccagtgcctaaaaacactttcaagcacctaacatcactcttggttttgtttttattttaaactccattacaaaccgggaaatagctgtcactttcctgtgttctgggcccgctgtgctcctccgttccgcatagcgcggacactgcagggtgcgggctgcagcttccccaggggctctgaggaacccgttgaagtgactgcacgtgcttgtctttctagggttgca

SEQ ID NO: 63444 - DNA, 1172 bp, Homo sapiens
cctcttagaggccagtgttaagggccaagttgacatagatccatttcttggatcaggtgtttgttttttcagttaattttttagagccaagtctcactctgtcacccaggctgaagtgcagtggcacactcatagctcactgcagccttgaactcctgggctcaagggatccacctgcctcagcctcctaagtagctgggactacaggcacgtggcaccacgcccagtaaattttgtagagatgggatttcactgtgtcgtccaggttaggacaaggtttcttatcaccggggccatgaatgcctgctgggccaataggacaccgtgaggaggaccgtgtgtccctgcatccagcttggggagtggggccagcacacacgtgttactatcctgtggcgtctcggtcttgcttggatgtgcccttctgttctccgccgttctgataacagttaccatgatgacgtctcttttaggctgcaagatctagagagacacccgggtgggaagagcgcatgcctcacgtgagaagcctcaggcccttggttcttgattttgtgtgcctggttgatagatcgaacaatcacattcctgcagtaaaagagagagaactttaagacctacctcagcctgccgaggcaagatcacctgtctgtttcctagggccaggcctgatgatgtctgtctttccagtgtccagagcttgttgagttgaaccaatccagcaggtggtttgcactgcggtggaccctggggttgcatgcttggtctctggtgtcagagagacctgagtttgagtcctgactccatcacttacttgctgtgtgaccccgggcaagttccccccgcctccgttacctgctggggaaacagcagcgcctacggcacagggttgtgtggagggtgcaagagaagtggccgtgaccatccttctaaatgggacaggctgtattccatggtcatgatgctcagcatatggtataaggagctaactgtttaccatccctttgttaccagaaacttgactccctgtgtgtttgggttcttggtgcataggtgattttattgctgcaataaagtattgaaaaccaattaagtaaaagaggctgacggcagcggtgcccgcacgagactattttacaacttcgggcgtttccagtctcaggtatttcccc

SEQ ID NO: 63445 - DNA, 1240 bp, Homo sapiens
ggaactgaatgttggcaccaactgcccagcgcaggccagtccattccccttccatccacagtgcttagagctgacctctggcctctcaacccaacacgtttccccactggggatttgcctattagatgctttttatatgaaggaataaatatgcctttgtgatgggttctagtgttttcctgtaaactgggctctgagcctgggatgctgtagaagttactagattttaagaaaaagttagagaagaaagaagagtggaggcggcatccagccagctgttgtgctgagaatgttcacttcctggctgtgagctgggcctgggcgcagcgctcttggcccttggcctgccggacagcagtcctcgcggatcactttcctcttgggttttaggaccactcgaaaaacgagagtgtgctgcaagcatgaggcttctccctctcccatctcagccttggctgccatagctaaggaggagggtgttattttgcttttgtggacattcaccctgggaaataaggtgagaaaattaagactgggtctgccaggctacaggctactcagggtccttttgcgggaggacgtgttgttcatttctctggaacactggtggaattggtccatctgattccaagggacaagccagcagccagggcggccatccagagggctcctggtcccggcactcatgggcagccatcccctcgggcagtgactcagtggtggcccctggaacttggcagtggcactcggctcgctgcaggttcatggaacatccagggcgtttgccctcctggttgctgctacttcctgtaccttggaggaaaagtcccttggggcactgggaagggtgggcggggcctcatggccttcctcagcctgatcgggacccaccaaagggtcccagaccccagtctcactgcaccctgaccatccccttccccgtcaccccgggtggtgccagagcctttttgtgaggtgcagggatccgggtacccagcgcacagtaggcgttctcaaactttcacacagtgagaagtcagactgagccatccatctctgggttgcctgtggcctttttagattcctgcagaatctcacccagccccgtgtgtgtccacactggacacgctgccagcccagcacccagcctcttgtgcggccggcgagtgagtgtgcagcagctggccgctctgccagattcctctggcaacaattcgtacttttctcttctctattttcc

SEQ ID NO: 63446 - DNA, 2953 bp, Homo sapiens
agatttgtgtgtcaggccagatctgctggggcagcagtgccctcctgttctttagttgaggtcgggttgatgtgtagatttcccattacggtggtaaaactcaactgtgtttcttggagaaagtcgcaagtcactcagaacagactgcagccttgagctcacgaggggtggccctttctgtagttcacactagggaactttggagaaggcaggaacgtttcatcaaatgctggctgtaaagtgtgcatcctccatttagaagggcgtgatcgtgtggaaacgtacctctcacgggtccgcacgccgtatcagaggcagtgattacccaccgtggagatgaaaatgtgtgtgtttgcatacttgtgggttaaacaaagcaagatgttgaaatccctcagaactcagtttcaaaaacagatttagtctctcatatcagaaaatacagttgggaattccgcgtgcttgaagggaaggatatatttccaagtccaggaaagggagagtgatggtaggtggttttcttcacaacatgtgccaggtgtgatttatggcgtgtgtttccttggacattgtggatgaagtcctaggtgggcgtcctcagagcaccatttacaatttttattttaactctagagtcttgaccacaaatttaaaatgtaaatcagttttcttcctttcaaacataattctttcctccccgccagcctcccctacgtcattcagaaaacagaatccttttcaaatgatttttttttttcctgaatagcttgtgaaaatcaggatgaaacaataagatctacctttttgaaaatagccctgaagcagctgtaggcggggaccgaggcgctggacctcacaaccctgcagagaccaccttaagtttctctgccatcgctgtgtggcccgtgtgtgctattaatattacctcctagagatgacctccaggcattttgcattttgtttccaagtggagactgagcaactggcctgattttctgctttgtcgtatagattctgattttgtctcatggatttttttgaagtctgatcacatcattatttgactttctcaaatacatgtgcggcaggagggacgtcagataatttttccgagggcctgtgcctgctctctcagtcaaacattctttctttgcaaccaactgatttgcatggcgatgacatttgttgctccagtaatttcatctgataatggccgggcttgcaaagcggatctgaaaacatattccttaattatgtgttgctaagtgacaggagggtttggtcataatcacagaaagattatctcctcacccaagtcgtggaaaggttttgccgaaggaggaacctgtaagattgccttttcttttcttttctttttcctgtttattttagacttgccttttaacaaaaacattcgccattatttgggtatggagtgaggggtattatataagttgtttgcagtgtgattgctaacacgatgttttacagaccggaggatattgatttttacttaatttgcgtggcagcgagccagtgccagggaagtctgcaggcagaagccagccagcaaatcaaatgtctctgttaaatgatccaccccatagctgcagtttccctcctcattccttatcgtatgctgattgtggcattatcccccacaccctgtcgggaagggggcaggggctggcgtccctggtagcgcttcagctgtgtacatggctgtacgttttgtacagtaggttccacagaatccgcagtcacatttggatctgtcggagccagcagggaaagtagacggtgtgtgtgtggaggataatgttgacatttcaggaaagcacaggctgggcagtcccgccggcctctggtccaggacgcggccatctggaaatccagtgttgcttgtttgggacgccgccagcctgaacgcatcttcgttctggtgccgcctaactcaagtgcttccctcccatcggagggacaaggaacgcccttctggaagttgactctcttctccccttcgggatgggcggtgttgcactgcttatagtggggtggtttggggtttggggattgttttcagtatctattttattttcggatgctttggctatttttaatgtatgtttgctttttctcagtccacgaactacctgccttatcttggtgggttttgtgcatacacacaataggctcctatttctagtccagtttgctggccaagcagtccagagtgacaacgtgaggaaggcgtatgctgcggggaccccagtgcggcccaccagccccggtgacacagacaaatgggggctccaggcccgcgtgagtggcagcacctggcaggtggtggggtcggctgtcgctctcaggctgacctggccggctatggcacaagtcgcggagccctccggcggtggctgcgagccagcaatctccccgtgtcacgtgctgtcacccgagccctgcctgcaccagatgcagcagggatcatcagaaacaacgaacgaatggggctgcggccattttcatatctttgtcttcacaaaatacagccaagcctgcagcctgcacagggctcagctcaggacacaccctgggggcaaagtttcagatgtgagaaacgcagtcccagcccaaagagccacaaaaagatctttctgagctttttccattttcttccagccgtttttcttgatgcaactggattaatgggggcacatgtgacccctgtctagttgcttagggtcactgcctgaggactccaggatggagggaggagcgcgtggtctgtgtggaggggctgttgaggaggctgatggttgtgacagttacctgtcaccagagctggtcactctcatggcttcttttcgtgtggcctcggtttccagcaactggaggtgtgaacgctgatctcctaggtagaaagcacctccatcaataattttagccctat

SEQ ID NO: 63447 - DNA, 1067 bp, Homo sapiens
ttgcagcttgggagggctggatagagcaagccaccggcttcatcagtctaacgagatgtcacatggaacaaagctttagggttttatttagctcctaatccgcatgctgagagagccctggtccatgtgagcacaccagccaggaagggggacctggcaggctggggacagcctcctctccgggactgagctgtaaggaacagacctctctggctatcgttggggagtgaggcaaagttaccgtgagtcttatgttttgtctgctaaggtttcggaggattaataattcaggccatgctttgaaacagaaaacccccagttggttgtccctgccgtctcggaagggttagcacacagccaggtctgtttttgatgtatgtaattgaagatttataaagaaaagcttctcctctgcctcatccgcagtcattttttttccaatgccagttcccagcaggcatataaatattggtcgttctcagagctgggatgctgctgggtggtacgagggcccctgggagaacgccgagtccctgcggcctctggggaggagaagctccctgacgtatggcacagcagaggggacttggtttgagccaaaccaccgaccacaggacgctgccctgcccgtggccgccgagccctacctgtaccgggaggccgtttataactcagtggctgcaagaaaggggtctactcctgacttcaccttctacgacagcagacaggcagtgatgtctggtcgcagccccctgctgccacgggagtactacagtgatccgtctggagctgctagggtacccaaagagcctcccctctatcgggacccaggagtcagccggccggtccccagctacggagtgcttggcagcagaacgtcatgggatccaatgcaaggccggtcacctgccctgcaggacgccggtcacctgtaccgggatcctggaggtaaaatgatccctcaggggcggcagacacagagcagggctgcatctcccgggcggtatggacgggagcagcccgacaccaggtatggggcggaggtgcctgcctaccccctcagccag

SEQ ID NO: 63448 - DNA, 1789 bp, Homo sapiens
ccacaacacttaacttgacagaagcagacaaaaatccagcacaggctgtccacatttaaaagcaggaaatgggtatgccataggccgatttttctgccctgtgtctgccagaaaaccgtgttacccgctaacttctgcagcctccctagggaagcgctcgctgtgggagacgtagagggcactgtggtggctccgtcctgggatgcagcaggcgctgaagagcctcctgagatgttatttccgctatcaccttcagagctgccctggccctttgtgttggtggaggcaggatcagggaatggaagcccaggcaggtgcaggacccccctggggaagctgttccttaagttccttcagttgggaacttaagttgcctcctgagaatgagctattccctgagaaggccttgagacaaacctggcagcccaccaagtgggcgggtgacaacacagttaagagggacacaccattgagccaaatggccctcatgttactgcaaccttcagactcactgatcccacctgttcttctttttctataaaagtgagaattagaccccagagtcatgttttctctctcatttcaagcagtttcctgcatgattattccaatgggaacatgaaatgcttgttggcagtttgtccaaagactgctccgtcggagggtacccactgatcatccccatcctggcctctcttcccagctcttctggaactgtctggatccatctctggaattgtctggatctctgtaggtctctgttgttaattgacaccttgtgtcgcacagggacttcagaattggctttgggtggacatcgcctctctccccgacacagctatgttacacaatcatcttatttttacttgacataatttctatagtgagggttttggcagaattaaaaaattaagcccgtgagatgtattactctaatgggtcccatctcacttttagtcaacatgagaatttttaagaaaagcagtcctttctaaaagactggagtgtggtgtgtgtgtgtgtgtgtgtgtggtgtttgtgtaaccagagtgtttggaaaagtgagtccagttacaggtgtttttacctagcgcaggaaaacatctgtcataatatttgtcaaatctcagagccaaggctgtgcgagtttgggtggtttccaagcagaacaggttgaaagttgatagaaatggaagctgggcctcctggttcaatgggaggctgatgctgccccaaagcgcatctgcccacatctgccctgctcctgcgatcaccccttggacaccagctcagtaacctctctgaagaatcattactggtttcttaggcgctaccgggtaaacattcttctatagagccctgtttacatttgagaacttgctgagctgaaaaccagatagcaaagaagctggtgagtcaacagagctacctcaccctgctacaaaaaagacttggcatgggggattttcccggaatgctccaagtttatccacccatctttgaggggtgtgcatgcaccatgagtggggtagcatagtactaacaccacataaggtcatgttgttcattacaacaaggggaggaaagaaattggcaaggtggcttaatcctgaggcgctggccaggcgcagtggctcatgcctgtaatcccagcaccttgggaggctgaggtgggtggatcacctgaggtcaggagtttgagaccagtctggccaacatggtgaagtagatagagtagagacatggtaggctctactaaaaatataaaaattagctgggtgtggtggtg

SEQ ID NO: 63449 - DNA, 1328 bp, Homo sapiens
ggagacaagctggtttctgtgaaacacatagatagttagaaagtctgggaatctcattctgcatcacctttgtcgcaggaggatgagaagtctgagaagatgctgccggggatgaggtggaagggagtttccccagtgggtctcttctgtgtcgcgggctcttctgctcttctcagtgggttgaacttgccatggtggaagcacatgtcagtgggatgtacccccaagaaaggtcatccatacgtataaggaacaaagacaggcgcctccagggtcagcaaggttacccaagtggtctagaagtccctctggctctttccttcttccagcagcctccttgcctggcaaacacccatcagagcctccaggatgagagagtgactttctctttccccgaggaaagaacataatccacagagtgttgacaaatggttttgtttggtatttaagatttatttgtttttgttctgagtagctgttttcttttcacctatctttgtacagatgcattataaaatcaggacttgttttgtttttgtttgtttttttaaagcactttgagcgcttcgtaaagaaacagagttgaagcctgcctataggtagtccacaaacagttctaataaataactttaaatagccccaaaatgtggattttaaaaatgggattcataatgttgctatacattataattatatgttgggatcaggcaattatgcacatttccagcaattatgtgattagctgtaattacattagctatgtaaatatacaatagtcaactagacatgccttaaaaccccaaagcacaaatgaacatacccaaacaatcttatgcaaaggtaaaggttcaggaaacagccaaggcaaagcttcacagacaaaagtgcggttctttgcaaggggtaaagtttcatgttttgccttatctgtccccggctttaagagaaactcagagtgggggacccctccccagggaacccctcaccccacctgttcctccaccgactctggggatggggttcatagactgccctcccgttctgcagctgtgaatcaggttcggtgttttatttctctgttgttactcatttctcaagcacaaacataagcgtctctttgcaccggtcagtttggtgatgggcggatgtcttcatactcaccacttttttctaatagcaacatgttaaggccactttgcttttatttggggggccagggatgtgtagtgcaactggagtctgtggctggggtttgggggttcatcaccgtcttctagtttggttctgcagctgcggttttcagctcctgcccctaccacagtgaatcg

SEQ ID NO: 63450 - DNA, 1036 bp, Homo sapiens
cacccatctcacaggtgctgccagagaggcgttgagcagtaggcagtttgcacccaggaacccgggcagtctgtttttttctgtttggccttctctcataccagcttgttggattcagctctttcttccacctgaaggccttgaacatctaacacacacaaacacacacacacacacacacacacacacacacacacacacacacacaccccctctagctttgaattctcaccatgtttctattctatcaactacttgtagaatgttctgtattgatatgcagagagcctgtcaaactgtttttttctccctccccactgcctacacctgacacagggacttctgcgtcccttaggtttgttttttttttctttctaaatgattaaaagcatgaagctgccatgttctgctgtgcttacccggtctgctcccaggcttgtaggaactttgtcttcctgctcttggtgtctggatacaccagctccttaaaattcgtcccctcccgcctgctacacaatgccaacatcaagccctggtcgtgggtccctaggctggaatcaggcaggcctctccagggtcccactccaggtactccgctggaatctgagcatcacccctgcacagatacttgtacaacctttccctgttttctaaggcctgtccagccccttcctctttgaaacttttcaaagcaagaaaaagtggcatggagcttgatccttctgtgtgcccagaatctgccgtggggattcactccgccaggctgtgtctctactcggagagcaggacacagacagtctttgggactccagccaaatgagctggaataatggtctttctagccaatgtaaaagccacattttaatttttttaatgtaactctttgagtttgctatttataattgttccttttttttctgatgcctgctatcaagcaatcctataataccatgtaagaattattacgaaggagccctctcgtaacacaggctgatcagaacaagattgtggtctcctcattctcaagtataatgga

SEQ ID NO: 63451 - DNA, 2613 bp, Homo sapiens
ctgacccctgcgcggctgttttggaaagcattgttgtaactcacctggcagcaggccttcgcagagcccctcgagtcgccacggtgtgcgtctgcatctcagtgtgagtgcgtttggggcaggtccaactggctgtcacttggtctctgccactggaatataatttattacacttcaaattggtcagtaaattggaatttatagccctaaagttaaaagcaagagatctgttggaatttgctgcttccagaaataactgacgattgtcttgtgtgcattcacttgctttctattatgagataagaagcaggaggcggctgagatgcacttggtgcagcctccattcccagtgctttgggaaaagagcaagtcccatgtgtccgcatggcaggttcccttatagaaagtagcagttaagtccccagtgagctgttgtcctgtgcccagagggtctccagagagtaaggattcttttctccttgtttcagggttcatagtggcgtcatgcacgcagactcctgcaagttcccctaagttcttagaggactgctttgccttttgatctgagagttgcaaagttccataaagaatggcccttgtggataagcacaaagtcaagagacagcgattggacagaatttgtgaaggtaagagcgtgtttggcggtttttaccaaacatacgtagtccctcactcaaatcttcgctggctgctcccttgagttggctgtgccactccccaagccagagtccctcctccgattccaacactgcataccattggcaccctctgctgggtgtccttggccgtgggcctggccttggcttaggacaaggcctggcttctggggcggggttggggactaggaggacagtttcagggctggtgggccctgaggtctatgtcttccatgtacctaaggttattttgcatataaaagatggtgttgattaggaccatcttttttcacttcctgaaatctcaggactttacctgttttggattaagatatttacaatgctgaattccctgatactatgagattcctgaagagcccagcattgcccctcgtggtgtgttcatgtccctggtatctttggaaatgtctggaagtgttctgttcatgaaaggaaaaataaacataattaaaatctaatggaaacctggggacaaaactctgaagtgttgattaagcactgcgctcttccagctagcgggtggtaagaaaccagcgtgtgggttcgggtttaggggtgagtgcacctgccagatggggtcagtgctacagggctgctctttgctcagggtgattgctggtactgccctacagggtggctctcggagggaagcgaagatggctccgcagccccctctgcacccttcacgcacacgctgaagtttagtagctgacccaccagtttgtggacaggaatatgcaacccacagggcttcccctgcagctgcccatatggaattgtctgtcctataagtagatgtggctcatgccacacggggtggggacatcatagacattctgctgagtgactccatggcctcacagaactctgcgctgcaagaacacaaaagcactgacattcctggggttcagtataaggagtttggcgttaaagggtttttttaaagtaaacattcacaaattataaaaacctacagagaggttggtaggatggtacagtgaacaccaatattccattcagttttccagattcttttgaggggagataaagatagagatatacatataaatagacactgtgtgagtagatgatggattttcttccagaaccatctgaaaaaattcaggggcagcactttactctggactacctatggcatggcaccttttatccaatttcgtactgctcccagtaccggaatgaaccccaggaatctaacctcagggacagtattgtctagtataggctgcatattcgcatttcctccacgtctctttgcctgtgcaatagataagggtcacgcattgtgtttagttgttacatctctctagtctccttagtctaaaattatcccctgggcttttttgactttcagagacattggacttactgaagagcccaggccccattgatttgtagactattccacagtataggttcaccagattgtatggggagttgtaaaatttactcttgacttccactgtaaaggtgcttgattgaggttactgagtacttgcttctggaacacgctcgtgactcagctttccaaggttactagcaggaatgcctctggggctgactccaccccctgcacccaggattctccagggatgttgcatcagaaactagaatgggattgaagagctagcagcgtttcctctgtgtgtttccatggctgtataaacctgacttgggcaaaaccattgtctgcttgcagaccctctgtcccatccagacaggtgctgaaggatggttcaccaaccttcccacccccttcatgtgtaataggaaattttcagccaattttttataacagaagtttgcattaccttgtctatgcatggtgttccagatacatttgcagttatatattttaaatttctcaataactatcaacgcagacaggccaaaa

SEQ ID NO: 63452 - DNA, 2430 bp, Homo sapiens
cacccacgattccgcccctggcatgatttgaggaacaatttcagcagaagtggaatagtgaaacacgttccctctgcttttgttccttccttatttgtgcccgtattgtttggtgtttaggggggaaaaattgatttatgagtggagcctggttttcatagcaggcatcaccaagagagctgtgatgtcagggagcccagagccagcgtggatcgggggtgctggcttgctcagcatggagaccagctggaggccgctgtgtgcagctcagctctaaggagggcctgtggctgtcattggaagatggttatgttaattaagtcctcgtaaatagcttgctccttgggagggctaaggaggaaaatgtcacatttcatacattctttttgcacaagagatatcgggggagaggattgaggctacacaagtcaatggtcactgcccagaccagacccagaggctggtggccttgggagccaagatggccagccctaaacatgggtcggtgccactggcctggggtgtgcagaaaggaacccacagaaggtccagaacagagtgacccccctcccccacccccacccccaaaaaagccagacatgggagtcagcctctttttttttttttaatagtggaatattggcgtttgtggaagctgatggctgatctttcctttgattgcatgattgagattctacttatcaatttttcaggaagccatctaattatacaaattaaaattcaaaggaaagcaaaaggaatgattacgcctcactcgggggttgggggaggagggtgtgaaaccccccttgcctcagattataatgctgtcatttttcatctccgaggtcttcacaaaaattaactgattaattctcttccccccttggatgacgcagctgatgtggaaatctgtttttacaacagagtcaaggaggggccagactgcagtttgaccatcagagcttgcgcctgagcaaatgacaattgctggcccgagcctccctggtcagcctcacctagagtcacttgtgggtggggggggggggggtggggatggacaaaagctcagatcaataggtttggccccccgcccccactccaataactcttaagttggctatagttagggactctttttttgtgtggttacctttcagaaagcccagcactggctaggcgcagtggctcacacctgtaatcccagcactttgggaggctgaggtgggtggatcacttgagttcaggagttcgagaccagtctgggcaacatggtgtgaaaccccatctcttcaaaaaatacaaaaattagccaggcatgttggcacatgcctgtagtaccacctattaaggaggtgaggtgggaggattgcttgagcctgggaggttgaggctgcagtgagccatgagcttgcccctgcattccagcctgagtgaagaacagaccctgtctcaccaaaaataaaaaagccaacactagcaaaaccaatttttaaaatacgtccacatggatctgctcaagggtaaccccacacattctatgacaacctccatctcctgactgatccgatatggtcagtccccgttttgggggaacttcccaatcgttgaaagggtttggtatctcagggatgttacattaattatttatgtgattggaaattgtgctttttcgtagctcttttatggagaatcacgtaattatcgccataaatctttcggatgccttttcagcttcgttgctgggaaattagccgttaacttacagaaacctggtagacctgcagtctgaccttttgataaagtaactcttaatgttttgcataactgatgaccgtacatcattatcctcatttctaccccttgggcctcatttttatctttatctctcctctttctttctgctagatcactgagaaccactttttctgtgtgtgtgtgtgtgtgtgtgtgtgtatgtggttgtggtggtggtcttaaaataagactgatttaattgtattccttgggaaaaaaaaaatacagaagacaatagagtgggccttaaatgttgtttcccagttgagattcaagccacctttttttttttttttttttttttaaagacagagtcttgctctgtcaccaggttggagtgcagtggtacaacctcagctcactgcaacctccacctcccagattcacgtgattcttttgcctcagcctcccaagtagctgggattacaggtgcctgccagcatacccggctaatttttgtatttttagtagagacgggattttaccatgttggccaggctggtctcgaactcctgacctcaggtgatctgcccgcctcggcctcccaaacttctgggcttacaggcatgagccaccgtgcctggccaagattcattaagcctcctttaatcaatgtaaagaatgcagttccag

SEQ ID NO: 63453 - DNA, 1027 bp, Homo sapiens
cagaagattctacccagctctcttcctaagaaagacatctgttgcacaagtttggcttctgaagcctatggaatgtgctcttttgaggtggcctgagcacatgtggctgttaactccggatgaaaagtcagagtgttttctgggcagaagtcattggtgggctggcgttctcaaggccctgttaactggcaccgtatctgcagatgtgccgccagcaccacaccagcaggatcctcggctatgtgtgcaagagctgggtgtcaccaccgcctggactgttgctgtctcctcatcttggcacagtggtcgcacaggctcctggatgagcctgtgggtgcactgagaggccctgtaggctgcggtgaaggaagctttccaggagtgagtcctgtcgtttgggatcccaggctcagaagggtggtggaccttgtgcattgatgcggccatctgggttgcagggaatcttttcttcctgcattggatcgcctcaacctctcaaacagaaagtctgcgccccactcatgcttaacagtgagatctgagttctccggggacacactcagagaactttggcaggacttgcttaactacgatgatattaatttgtgagcatattgtgaaactcggtctgcctttattaacagaatgtttaaatagatttccttgaaagaattgaaagccatcatcatgtttaactggatttgagagaaatttcattttgaagaaaggcactgtcaaaggcatgcacttactctataaatcccttcagctgcctattcttgatgaaggctaggaagtggagtcaagaaatcgagagggtcggccgggcacggttgcttacacctataatcccagcactttgggaggctgaggcagacagatcacgaggtcaggagatcgagaccatcctggctaacacggtgaaacccagtctctactaaaagtacaaaaagtagccgggcgtggtggcggcacttgtagtcccagctactcgggaggctgtgagggaggagaatggcgtgaacct

SEQ ID NO: 63454 - DNA, 1362 bp, Homo sapiens
ggaaaaggtcagcccacgtgggggtttccattggttttgagagcaagcagagactgcagagagcatgtccttatacaagcattctggaccctacggtgtcaagagatgagtgggctgggatctcagaaggccagttgggttcccctaaggacagtagaggccccataaaatcagtcgaggattccaggcctctctgaggcaaaattcaaaggcaaacatcttaaaaatctaacctgaagattttttttacaaattcatatctcatcattgcaatttgtttgataagtagctaattcctataattgcctttatttgatatttaaatacaagggcaattcatgtgttaagtgtaagctaaataattaaaagttaggaggattaaatcttcccccatttcatatattaagacagcaatgtttaacattatctcattaataatttattatatactatatgatacatataacacagtgttctataatatggttacaattgacagttgaatacatagtctaataaattgtattaagttttgcataggtttagcatataacctccagatatttctctccaagaagtgtagcttggtggctcttgcctttgcaagtcctcaagttcaaaacccttagtggccatcagtcccctgtgcttttacaccatgctggacacagcagatgtattgtgtgtgcccaattgtattgtgtgtgcccagtttctctgcatgacgttcagatataaacattctggaatcatttcttgcacactgtatgtaacaaaagatgagttttctggtggaaccacttctgtctgcctaaaatttgagatcactaattttttttatctgttcaaccagtcttctcggctacagatcaaaattttcatgccagagtaggaaagagaaaactagaaaaggaaaaattgatctgcattcctgattcctcaagtctaaacagacaggaataagaggtgtcatttagtttgtttgcttatttgcttttatccctttttttttgcttaacctttattattaaataacactattaaaactaatatacagtttatttttaaggcatatttggaagacaagttcttttaaactgtgtgaaaatcctaaacacaagaatggctcattttctttagcaacaaagaccaacacttaatttccattatgacacaaatcaaacaaccaattaggaaaatcacaaattctttctgctcaagtcttctgttcttgattatagcttttagcaagtgaaaatatttagaattttggagtcttgcatttaacacgaggaaatgtattttcgtgtgctaacaacccttaaccaaaacgggaggatttactcagctttgttggccaag

SEQ ID NO: 63455 - DNA, 4538 bp, Homo sapiens
tttagtagagttggggttttgccatgttggccaggctggtctcaaactcctgacctcaggtgatctgcccgcctcagcctcccaaagtgctgggattacaggtgtaagccaccgcgcccggccgtggcttcacatttcaacaggggaatagttgcgacacacgcccatgcctcgctgtgtgaacaccgtcctccagatccttggcggttagcttggaaaaggcaaaactcagggggagaggaatggatggttagatcaggtgagagcacctttatgggacggtgcccaggaggcatcttgtgaggacgcagcactgtgtgtgcaatcgtatcacgtgaagaacttttaacatctttctggagttttctggtgcctgtattctttatagtgggtgactttggggagggcgcagctgcatattccaggctggctgggtgcaactgggacctccactttgcctactgcacagtggtcaagttcaggtgacagtccaagagtttctccccgtcagggctcctgtaaaactctgtaacagttcataaagaacaagcagaatactaactccgagaggcctccaagttagaaatgctttagaggagaaggctgaaaaagcacctcccgccacccagctcgttgatggcatgaaagcaccaggcctcattcctgccacggccctgagcctggcttcccgtgagaccctcttgggggcctgtggacaggaagtgggacggccaggacccagacctgtgacctgcgtcagagtgtaacgaagtccaggccagtctgttgcccgaagcactgggatgctttttactgaaggagtgtttaaaaggtaagctggatctcagacaaagctcctccaagaggcttccagaggctggagttttgtcaacaaatgaaacaggccctattttaagccacgctgtgtaccaggacttcctgtttttccagagaaacttcttgttttggtttttgtgatgatggatttattgaaacatttgctattcaagtgaccctctttgtgttccaaggaaaaagtcaagctggagattctgtggcctggaaaagggatacgcactcacagcaaaaacgtcatccccaaaagactcagtcggggggagtctgggcctcagtggccgatcagtgaatggacaaagagctaattgccagtcaggggcccagacggatttcatagctcggggtttggcctgttgtttagagggaggcgggggctggtcacaggacaattgaaaggggtttttgttgttcctctcaggctaagttaagccatgtgtgtgtctctctttcgaggagtgctggtctggccaatcccagccacgtaaatcccactcacttcctgctgaccttttgacaccaacagatgttttttcttacaagtgtcattagggcctctctactcgctgacctcatcagattgtgttgaagtcgttttcatcggttttgtctctaacaatccgtttaacccttcctgggtgcctctctgggaataagattgcactgccttctggccttgctgtctccctcctgcccccaggacctggcatggggaacggagcccaacccagagggcagagaggcatgcttccccggctgggggctgccctgtgtaccccggggacagagggacccttgtgtcttcctcgggaaggtgtgatggagaaagcaatgaggggctcaacaggtccctcggagagaaccttccagagctctgcctgtggatacatgctctgatcacacagctcatcaagcactggggccacagacacggactgggaggtgggtccccatggcacttgtgtgacctgtccgcattgctgcccgtgatggggttgggagcgatggagttggaggtcctaaggccacggaagtttctgtagccaacatccctcgactaagagtgcagactgtcatctgacctgactctgtggccgttctagaggcaggaggatggcgttggtcatttaacctttccatgaagctgaggcacaaagagcagctgtggggctggcgggtgactagagggagtgagttttcagcagatgaccctgactcctgggccgctgtgttgtgatgttatcttacaggctctgggcctcctgggctccttagagccaatggcacactcttctgaaggcatctggggtggagggggagtgtgtgtatcctgcctgcacctgaggtttcggggactcacctgaagcctcatccagagctgacagacatctgtgctgggcgtgtcctcctccatggcgtgcacgccttcactgtgcaaaccagcccagcagaatggaattgctggctgcttatgcattgtgtcagttactactcacagccgcttagaatagttctcatcgcacatggagcattctagaagtggtagctgcttttgtttattagttattattattattattactattattattattattattatttttatttttgagacacaatctcgctgtattgcccaggctggagtgcagtggcgtgatctcggcacactgtaacctctgcctgtcaggctgaagcaattctcctgccttagcctcctgagtagctgggactacaggcacgtgccaccacacctggctagtttttgtatttttagtacacacggggtttcaccatgttggccaggctggtctcgaactcctggactcatgatctgcccacctcggcctcccaaagtgctgggattgcaggtgtgagctgccacgcctggccagttagctgcttttaaagtcatgcatgcagctaaaaagcgttccagcctcttggagcctcctccttcccacagtcccactcctcagagggactcccctgccaacagttgggtatgtgtctacctgcctctttgatttttttcttttcatgattttacatgctagtctggctttttgcttctgcagatgttctgtgtctgctctggagagctctcccttggagtgtggttcggggattgtggggtgtggctttgtgagacgtagccgtgttttgcatctggctggtgtggctcagtctgactccacaagcctctgcagtgctgcttctgggggagcgggagatgtacatcggggtcctaaggacataggactaggagtgacctggccatgttgagtctcaggttctctgaagtttggatttggtgacctctacaatctcagaaggctccagaaatgccgtgatcctaggaaatcatccagggccacccaagcatctgggcacatgagggcatggcacctgcgtggtttttgcagccttcccatttctgccccttgtgttgcagttgaggccagctcctgcctcggctcatggtgttccctgtctcagaagcggctgtgtttgtgccctgaacctctgtgcagactgccttcaatatttacctacatgctctttttctctgagagctcagacttaatcgtagctgcagttcaaggaccacttttaagaaaaagcaagaaggtctgtttacccagtgaattaccattcagaggggggtctaggaggctgcattcttaatgtggggcccaggctctgatagatctttttaatgttccccagatttatgggtgtgcgtgagtcagagtggagaccccagggtgcctgagttaactctgtgcatgttgagcgtagccctggaatttattttaagcatctggggtaagtgaacataacagcagactttccgttccttcagcttgtacgcattgctgttgtgaggagaatagcgtttaccccaagagtttacagaagtggatatatcacagacctcatgtcagtctgggcagcggaggatttagagggtttcgcttgttttttgttagtgttctctgtcctgtaggtagtataaactagacgccatgcattacaaatgtattactgtttttatcttttctgttgaactgtactgtgtcagtgaccatagtcagtgtgatagtttgtgtaaagggttgtattagttatctattgctgtgtgacaaattacctcaaaatgtaaaggcttaaaacaacaaaactttattgtcttgcactgtctatgggacaggaacctgcacagcttagcttggtgcctcctgctagggccctgacaatgttgcattcaggatgtcagtggggttgtggtctcatctgaaggcccggctcggggagggttcagcttctcatggactgttgggactgagggccttggtttcctgttccgtgggtctctccttagggcagctggcatggcagctggcctctgggagggagggaagttggcagggaagatgggaggatgcccacactggtagccacagtctcttttaacctaatctcagaagtgacatcccctcacctgtgtatactgtttactgtttgtttagaagcagagcttgtacaaggacatgaattccaaaaggttgggggtccccgggggccatgggattgattctttttctggcatccacagtgtagatgggatctgccttattcagggagagggtcatgttcagcttggaaagctctcagtgggc

SEQ ID NO: 63456 - DNA, 1025 bp, Homo sapiens
gcacactgagctgcccactgatgcagtgtcagtggccttggagcatggcttctggggtcgacgtcaaaaaacagtgtgaaaatcttagcgtggacattaggctaatgggtccaggtcaggtgtggatcaggatgggttggtggtgacaagccttgggtctggagtaaattccatctaaatcatgtcacttttggctggagtgcagtgatgcaatctctgctcactgcaacctccacctcccaggttcaagccattctaatgcttcagcctcccgagtagctgggattacaggcgtgcaccaccacacccggctaattttttgtattttaagtagagacggggttttgctatgttggccaggttggtgttgaactcctgacctcaagtgacctgcccgcctcagcctcccaaagtgctgggattccaagcgtgaaacaccatgcccggcctcaattcacatttctgaagtgaaattgcgtatgtcttacccctcacgtaccttcatatcgctgattttctcctctataagccaacaaaacccagcaggatcctgaaacaactagcattgcttgtgtctcctttttacttaaacacgcctcccacccccaccgcccacactttgtttagcaccagcaaaggagacaaaagtgacagtgccgtctccagaaggttcacgcagtgagcctccggtatccatgcagaagcctccccctgcccatcctagtggtaaggaaatctcctgaaggtcctcgtcacctgcctgaccgtggggatgtgcttttggtggtggtggaatctccgtgtgaagaatttggtagacttgattctctgatctctctgtgcctttttattttgagacagagtctcaccctgtcgcccaggctggagtgcagtggcataatcttggttcactgcagccaccgcctcccgggttcaaatgattcttctgcctcagcgtcctgagttgtggagattacaggtgtgtgccaccacacctggctaatttttgtatttttagtagagac

SEQ ID NO: 63457 - DNA, 1379 bp, Homo sapiens
atttttacagcgcttggctgtccttgcagacgaaaataagatgtttgctttagcaatttgcttagccctgaaaacattcctagacaatgccagggccttagttgaaaatagtatgctcagcttgctgggatggtcccaggaaggatgttttgagtgaaaataaaatggtacataccagggctgtttgccaccgcaggaatcctgggagagttcagcattgagggttgccgggagccgggatctagcaggggctggctatgggctgccctagcgtgcacccctggggccgaccggaagattccagaacagggagaactgtctgcaggtgtcaccctgcatgttgctctttcctccctttgcaccttagcacaccagcccccgcgggtcaagaggggtctccagctgcggtccacagtcctggcctcggcttcgtgtcctctaggttggggcaccggcctctctggggaagcctgcccgtgtgcttcttattcctcgactgtgagaaacttctttatccatctgcaatctctcctcttggcttcccctctctcctggtcatggttctgcccacgcagaatacacccaatccctcttccgcatgactgccctgcacataatcacaggcagagatggaaactcgggaacgttccctgctggggatgagcattgccattctcttccacaacacatttgcaagtttttcacttgctcagaaccagtgttgcaggtaagccgcaacagacacacacatgtacacacacacacacacacacacacacacacacacacacgtggggggaatggaatatcatgaccagtagttaaggaaaaatgcatttctgtttaaaagccatgttttaagaaaaagtacttgaactcaaataatgacgagtgacttatttcatgacatttgtctctgagacaaggtggcaaatagtatgctatgatcatttgtcgtgtgaagagtgaagtcagagtaacccgctcagctccagagctttgttttcctctgcggattcccttggcagcatttctgtggaggataaaaatagcacacggtgccttaaaataaatggctgtggggaatgcttgtgtacatcagctgcgtggccacatatgttcacattctccatattgttcactcttcaaaagagtgactgggatagacggttcgaatctgcccgccatatgataactaaagtgacatggaagagcctttggcccccgggaaggatgactccagggatgggcagtggggcaggctcaggtgtgtcagactcgtggctaacccgcgaggtcctgcaggtgagccttttctgtcctttaccccatttcatcctaagtgtctccccacaaaagatcagcaaagccagacccaa

SEQ ID NO: 63458 - DNA, 1179 bp, Homo sapiens
ccttagctctcagctcagagacccacaaaaacaaatcctggggagctgactgcgcaggatgtggacttggtatttccctgatactggcatttgttagccggatcctgcctcttcccttcgccacctcgccttccccaaagcccctgcgggctttgctcttccttccctttattttgctgaagttgacagtcaggtatgagctgcattaaaatgttgactcatccttgggttgttttcaattttttaaaaagtgcacattgagaaaagcacagattcatgtgtgcagcacaggaaatcatcacaaagagaacaaggctcttgttgggggcatttgagttcaagcagagtgccccagttgcaagacttccatttggatctgatgatggctggacctccctggaaagactggaacctgaagagcccagtcaaagaacagtctgtcaagcagcccctccgcaaccacagtttttgtgcagagtggtttggggagcccatggaatggggacagtacgatgtattttctagtggcaaacatttcatcatcaagtgagagtttctttgctgggcatttcctgttctgtgtgaaacagttgtggttacctgtgggtgtgtttcagataatcattagagcatattctctgctcgttaagcagtaaaaccagtgaggtggggaagcttgtgaaactgaaatcccaaatatgcaaaacttggcaagaaagtagagaagagccagaccagctctgagctaagtcaccaaaccagaaaggtttcattctttgtcttttcttcctctgtctttaaccacaagccttgggctgaatccccacatctcactacacagtcagggaagcagggtcaaggctgactggggacactggcgtggcgggaatgggtgaagtctcctgggtggatagtcacctctctgccttttttgaaactaaacttctctgatttttatttcaagttgtcctgaagaacatgattctaaaacagattcagagcacgcactctgactataaatagaacataaggcaaacttggacaatggattgtggcacttttttttcatgtacctgaaattcttagagttggggctctcttcccttgagaagtagaactgctattcttcggagaccgatgggtgacctcagcattgtcctcaccaagaacgctgtttcc

SEQ ID NO: 63459 - DNA, 1391 bp, Homo sapiens
ccccagcagggcaaagcaaccctgacctccaagttgcaagggaataggtgactcagggagtacctcctgcagccctgctggtctcaagactcccaccttccagggcctggtcctgtgctcagaaacccctctgcatagggtgctgatgagtcctctgcagctccctcacccaagggaccacactgggaaacccagtagttgtctcggccatggcactaagacctttgcaccctggccatcttgttccgggacagccagcatctgtggtgtggtatagagacaaagctgccacctccaggacacttgctccttcctggccttcctgctgccctgaaacctgtggcctgtgtgttagtggaaacattctcagtttcattgctcagtaaaccttaggttatccaaactgcaaataaaatgttctctactttctagatttttataacttgctattttgagagaaaggggatggggttatgtgtgcaaattaacattttcttttggtttatataactccctgtctacgtagtttgaattctttaatgtagatgaagtttcacactcctgaatttgggaatggtcattgtatggtgttcaccctgtgcctagcagaggctcagtgaacatctgtggtcagaatggacgtgtccttcgcagatcaggatggtcgtggggcagaactctggtgcagctgtgaagcttcccaaaatcctctggagtctgtgggcctgggccgcatggtgaaattggctgtcatcttcctcgctttgctttctggctgcttgttggggctgagttgaggcccatctgactgtctggaggtagtgggtattcatccgttgttgcttggcaccagagggcaggtagatcctgtggcaagtggacaggtgagaggcccaccaaggagaggtgaaattgggggtgcctcctagggtatacatcggacccgccctgggtctgcagcccggtggcttcttgggcagacactgcacttggcggcttcagaggtgagggcacagaatgacgcgggtcagggagtcccaccatgggccctgcccatgggacttgatgcttgggtcagtgtacaggtcagggccttccttgaactaaaggctacgtgcacagactgacagctgacacttgctataacttactgctttgagagaaagagaatgagggttatgcgtgccattaatattttcctttgatttctctcatattttggtttacattatatcctttgcctgggttttgagatggtaagataagaagtttgataaatggcatatataaaagcagttttttcccttctaaatggatatttttaagaacagtttgatttacagaaacgtctagaaggttacatggagagttccgtatctcctcacctagtt

SEQ ID NO: 63460 - DNA, 1024 bp, Homo sapiens
atctcggctcactgcaacatctgcctccccagttcaagggattctcctgcctcagcctcccaagtatctgggcctgcaggcacgtgccaccacacctggctaattttttgtatttttagtagagaccgggtttcaccttgttagccagggtggtgtagatctcctgactttgtgatccgcctgcctcggcctcccaaagtgctgggactacaggcctgagccacccgtgcccagccggtatgatgcatttgttacaattaatgacccatatatatatataaaactgctgagctcaagtgattggcccagctaggcctcccaaagtaattgatccattgttatccaaagtctgtagttacttagggtaactttttatctttctatattcacttcttttggggtttgtgtgggggggggaggggggcagggtatggaaaaggaagtaattttacatctttactttctgtcaacttcctgatggtggtggagttggggagtagggaaacaacaaaatactctgtgagaacctccattaaaggggagactctcagcagaaatctccatgtcctgattagatggcacaacaaacagaaatgaccgtgtcctggcttggggatttaatattggaaaacaagcttgtcttaatggaaactttcagccagtaattttgttttcttgtttgtttgagatgaagtctcactctgtcgcccaggctggtgtgcaatggcacgatctcaggctcactacaacctctgcctcctgggttcgtggcagttctcctgcctcagcctcctgagtagctgggattacaggtgtgcaccacaacgcccagctaatttttgtattttcagtagagatggggtttcaccatgttggccaggctggtcttgaactcccaacctcagttgatccacgcacctcggcctcccaaagtgctgggataacgggtgtgagccaccgcacttggccataggcagtatttttgtgtgtttgaaactcatcattgtgggcgtttacaagttgg

SEQ ID NO: 63461 - DNA, 1693 bp, Homo sapiens
tggagtgcagtggcgccatcttggctcactgcaaccacagcctcccgagtagctggaactacaggcgcacgccaccatgcctggctaatttttgtatttttagtagagatggggtttcaccatattggccaggctggtctcgaactcctgacctcgtgagccaccgtgcccggccatgtatgtggattatgttctggccagaaaagcccatgtccaggtctcagggtttgtccatggtgtggatgtctagggcccagactggccaccctcagcccagaggaagtgcctgtcttgacctcttgtcttccaccaagtaccctgcgggcagctgactgttccggcccattcccctcaacaacagttgccagattccgtttcctgcttgcatcctctgtttcttaatctgcagcatttgcaaaggtgcagggtctgctttgggaatgtttgggggtggtggtacgcatttcacggtatctgggaatttggttttgtgatggaaggaagaaccattggaccattaactatggttttagagagttactgtctttcttctaagcgttttattcttcactggctctagtcagccttgctttctaaaaaagctcttcaaaacctggcggactggtccattctcctgttccttggccagctgtcatcaccattagctctgttttaatttgcatcttgtaagtttttactgccatctttcaggtcttacttcacttttggggtgggaccccttcgccttgttccagcagttggaactcaggtcttcagcatgttggattaatttcctgtcccacttgggctcaggctcactgtaccaatgaccaatttgttagccggctttgctgcttcctccatcaggagcacacagcaagtgttctgcattttattaatatttcctggtttttccatcatccctgaatccctggctggccccctagtccagtgccaagggccgtccagtggccttcaaccaggctctcatgttcttgggccttcccgcaaatgctccttcccttcccagagcagggagcctgcccctcgctgcctctgtttcccctctcagcaggcggtggttgcatgggtgagtggggcacagatacgaggtcgtggcagccctggcacacggctcgggagcatctggatgtgcctggaatatgcttccatgcaacagagagcagcatctgctcagaattggggagggaagcaatcaccgcatacggggcattttgtctttgcaggaatgcagtgtgagggaagtgggtgattttctttttttctttggttaaaaagtttttattttagaaaaattttaggccaagcatggtggctcgcacccgtaatcctggcactttgggagactgagagcagcctggccaacgtgaaatcctgcctctactaaaaatacaaaattagccgggcgtggcggcagatgcctgtaatcccagcaacttgggaggctgaggcaggagaatcacttgaactccagaagcggaggctgcagtgagctgagatcacaccactgcactccagcctgggcaacagaacgagactccctctcaaaaaatagaaaaaattttagatttacataaaaattgtgatgataatacagatttcatatacctcacacccagttttccgtattaaaattggtaatcattattattattattatcattatcatttt

SEQ ID NO: 63462 - DNA, 1168 bp, Homo sapiens
ttaaaaaataaatcccatttgaaagaggtgcagaaaccagccatgcatgatggctcacgcctgtaatcccagcactttggggggccaaggcgggcggatcacttgaggtcaagagttgaccagcctggccaacatggtgaagccctgtctctactaaaaatacaaaatatagctgggtgtggtggtgcacgcttgtaattccagttactcaggagcctgaggcaggagaatcgcttgaacctggtcaattgaactcgggaggctgcggtgagccaagatggcgtcactgcactccagcctggcgacagagggagactccatctcaaaaaaaagagagatgcagaagccattgaagaaatctcatcgtgtttttgagcttctaagtggacatcatcaacattgagattaagaaagaaagatgatgtaaaatgtaagagagtggcccttgccattgcagacactgatttattgggcagggccacatctgaagacttgggcgagccggcgtggaactgctgtggctgttagctttctctgacactgtgttcttgggctctggaggtgggatctcagctgtttgccattctgtcatctctatttattgcatccaaccgttagtaatgacttaaatgatgattgccaaaactgtagtcaacagttttgttagtgatttggggccttgtaaaataattagtcctgagacatgtatcaaggggaacatactgaatatctgagactagcttttacttgatttgagcctgcaggtcctgctacaagatcctgtgtgtgctccagggacctgcaggcagttacttggggaatcagccatgccagtggtaggtggtagttcctccccagctaccatgagggccccaagcaattggcatctgtttctttgttttggccttcttgtcagtttcctttttttttttttttttttttttcttttcttttttgagacagagtctcactctgcactctgttgtccaggctggagtgcagtggtgcaatcctggctcactgcagcctccgcttcccaggttagagcaattctcttgcctcagtctcccgaggacctgggattacaggcgcctgccatcacacctgactaattgtttttgtttttagtagagatgaggtttcaccatgttggcaaggctggtgtcaa

SEQ ID NO: 63463 - DNA, 4530 bp, Homo sapiens
cacagcttgagacctaagtctggcccttccagatgggccatggctaaggttccctcattcaataaataattgatgacttcagctgctgtatgcatggatttcttgcgtgactatttttccccctttttaaatttcttatgtgcgtctggagaccctttggcagtggggcctggagctccttttagaaaagatccacaggagattgtgtttccaatgatgacagccaagatggcacaggtggcagccctcccatgctaggggtgttgtcaggtcgacagcgctcaatccccattgttccagaacggccagaggacagtgaccaggggcagaggagagtgcactctcatggcccagcccctcacttagcccacctgccctgggctgggtgcactggtggctaccactgcttggtaagaggtacgggtgacagatgtcttggttgacggtgtgggtgtgtgttttttttttacccctaatccaaggaaactgggtgtatttctctttgtgagttttgactgctgttcccctaagtcaagttatatggaagcatgatttatcttctccaaaaaatatgggcccctcagtgaagttaaacagagtataaaatgccttcatggtagttaaatttatactctgttaaaatgatttgtgcactttgcagtaagctgtgatattaagtgcataaatatacagcggagttaacttggaggaacgttttatttgacaggatcacttaaatgctcaggtacagtatcgaaaccatttagcatggttaccaggaatggagggtgagccgactctgtttaaaatctgcagaaaacattcagaatccaaaggaaagcttgtaagtaagtacttctccatggagtgcttaatcgtggaagtggttttcatcacaggagagaggattgcaatttctaaatcagtctccctgcatcatgtgagaaaatgccttgtaaataaactctccattggaatagtcacttgtcctaagcgtggaactgattctattcaaattagcaaccattatagatattttggtcttctattgtcaatgacaatacattttcctgtgggaataggttatttagtccatattgggacattacaggagaattaataattaatgacatgctagtgctcggcccacccttctgtttttgtagccaaggcttgattggattttctgtatgtataatgggctgtttcaaaatggtcttgcctcattgtttcttcatatcttattgaaaccaacccactgttgatctcaatctgtgtaaggagaatgcggagtatggcattcgcaggactgaatccctagattttaagtttggaaggagatccaaccgggcagatgaattgaccggtggtgaatattctgtagcattttcctccctggagaggaatgccgccaccgctgggaaccgtggactggcatgtgagccagtggctgtgaaaggcgctgtgccctgtgtcctccgtgtactttagagcaggagcgtcacacatggtggagccgggtgatatcccgggcaggctcccgaaagctcctggtggcccatcaggggctggtttttccaccttttttttttttttttttttttcctcgagacaaggtctcactctgtcacccaggcaggagtgcagtggcatgatcttgactcactgcaacctttgcctcctgggttcaagcaattctcgttccttagcctcccgagtagctggcattacaggcactcgtcaccatgcccggctcgtttttttttttttgtatttttagtagagacagggtttcaccatgttggccaggctggtcttgaactcctgaccccaaaatgatctgcccgcctcagcctcccagaatgctgggattacaagcacgagccaccgtgccaggcctggttattccaaattttttgattggtctaaaatttgtaatgaatggtaggaaaacacagcaggaaaaagaaagaacattattattggtaagggtcagattaagccctgggtgagagtcatgagtccctagaggtatctgaagaagtcctcctggctttggccatctctacaggatccggtgattgctccgcctccagagctgtccccaaccatcgcagcttggcttgtctgtgacctcgtgtcaactcaaaacagcactttccccccgacactttgaagtcaaccctggtagaatttgtgaggaaatggccagtgtgtgttgggtttaaaaaaaaaaaaaggctgtggaagtagaacaatcttggggttgccacagaacaggcagtttgaggtgacgaagtggctttgtaatcaataataattgataagaccttgtttctagcaggctgtagacaaaaataatcttcttggacctatcttcgcctaggaaatatgtcctagaacctccctcctctgttgatctcaacgcccaagcccatcctcccatgagaaaggtttttttttttttttttttttgagacggagtctcgctctgtcgcccaggctggagtgcagaggcgcgatctcggctcactacaagctccgcctgccaggttcatgccattctcctgcctcagcctccagagtaactgggactacaggcgcctgccaccatgcctggctaattttttgtatttttagtagagacggggtttcaccgtgttagccaggatggtgtcgatctcctgacctcgtgatctgcccgtcttggcctcccaaagtgctgggattacaggcgtgagccaccgcgcccggcctgagaaaggttcttatgggaattgtgatgaaggggtcagagcagcccccacctccccccatcagcaccacccagggctgaatctgaagtcagacttggctgcttaagccacaacctaagataactttgaataccaggtgctgaaatcacagaacagactccaaatggtggccccgtttggactaaatgagaggtgagctgaggttgaacacgggaggcagagggccaggggtcccgtgggcatcagctggggtgggcatcaccacggtgcccccagctttttcatgggtgatttcttcagctgacctgggttttcagggttcttttaggcaggctcccagttgtttgtgtcagagagccctttttgttggtaatcccaagcccagaactttccagaatgtgctgttggatgtggctttattctttgatcccttcaaaaaatgaaccacaccgattactattggctgccaggcctggtgagggggtgagtgagccctttctgcgagcccggggagtttggagccagatgggggttcttccttccccgtctccagtcctgttgctctaagaacacagataagggagtcactccatccccaacaggtgccgccttatccctgctgatgtcagaaaccaactctgcagaaaccaactcttccccagctcacacatgctggaaacgctgaatgtgtcttataccctgcatctcattacatgtgtcttgaaaatgtggcttttctttatgtatataaacctacattcacagctctgcacaatcagtggcttgttttccgcttacaatagcgacattttggtggtagcggtgcctgacacgcatttcatttttatttaacttataaaaccttggggtgagtgcttctggacacacaaaagctttcatggagtgcaagagtggtgaattttttctcttttcaaaatggaggcgtggcgcatctggacacacacatcagttggcctgacctgtgcgttcgctacaggaagtaaaagtttggatgacatcactgcagggttatttcttgttattgtaattaatggaccagcaggaagtagcgagacagatgattcttggcagaaatgaccatttaaagggggaaggatgaagagggtctgggaaggaagaaacctttctggacatttaaactctccagggatgaaatagggaaatacgtagacagtgcacaaggaacgagccatctcttgccagagtggatataaaattgttaacccctgctacaactcagtttctgtttttctctctgccttctcagaacaacgccgacctgactggcactgggttttgtctggtccttttgtgccaagtgtgtcttccacgtcaggtcggtggcaggagaactcggaaagtgaagtctgtgctgcgtggagaggcgcgctgcctctcaagtcccaggtgctcttttgtgtgagtggaaggagctggaaggagtgtggggctgtgatgaaagaagggaggtggccgagttcctggggaaagagctgagtggtgacagtgttcctggacagaactgaacctagaggagatcttctggacccagaggagatcttgaccctccttgaagttgagcctcccatggtgtgtaggggccagagctgactgggcgatggccgtgctcccaaagtggttgagctggggctagaacccagctgctgcctggaccagccttccagggccagtgtcacaccccagcccacctgagtggagttgacagggttggagccttaagccacgtttgctc

SEQ ID NO: 63464 - DNA, 3858 bp, Homo sapiens
tagtagcagagctgtgcattgagattacccacaccccagctgcgagagtccctgttaatgcaaggtggccagtttaaagctgacaggactagatttccccatggagtgatttgctgaaggctttgggctggaagttccagcgcccgcagaaaacttactgttggaggttcttcgccctcgtttctgaaggaaagctcccagctctgcctggagcctgggatggaaattgtctctggttaataggatctttaagacagctaaatcctgcactaaagacttgatgcaactgctgttgcacacggaggtggctcccctgccatatgcccgcagagctttctttcattgtcattacagagagtcaggcgtgtgtacaggaaggagacgggatcctgccgtaatgactttgtcttcaccatcttttctcagctgcttaaattgctgtcagggcagcgtaggaatcttaaaggagggagttttctctcatataattatgctgttggtaaaaatgttggcggcttttctctacttttccccttagccaccaaaataaaactctttatcttggaactcggcagctgtttgcaatccgcctcatttctcctgctgatgtattggtgtcgcagcttgggtgatgggtggtgacgtgagggttgaaggtaatttctgtcgcagtcccatggtcatgagccaagacctggagtgctggaggtgcgccaggtcgggtcatctttgggttttgcccagtgagctgttgctaaggagagggctttgtttgcctagagctgggggaaatgttcaagggcaggcacacattggcagagatctgctgacgtggcgacggcggaactcatggctgtgtgtcaagcctgggcagtaacaggtggcgaaggccaaacctttgggggcagacttggggcagcagtggagacgtgttttggggatctcaaggcgtcttggtgggaaagagtgccggtgggtcaggaaggcgggggtgctgggacactgctgctgcttgggtggggtcaggacctgctacacagataccagacccaccctctgccaggggacacagaacgggcaaggagaagggctgtgcttctgagtgcttcactggtctggaaacccatgttttaactggggccacccccggacccctgagactgaggtggtgtgaacctcagggctggggaggtggcttccaggggaccacctcctcacgccctcccttcccagagaggatggggaaggtttgggcgggagcctccggactggtagggactccacctagaggccagcccctcctggggtaggcacagaggcctccagagcgcctccctctgagtcacattccttctcatttagtcacctttccttccacggggctgctgttggctcgaaatagaaggatgactggaccgttctccgtgcagcttcttccctgagatgttccccaagcccctcaaggcatcctttgtgatgcacttctaaacagcagccggctgggctcacagtggctcacacctgtaatcccacgactttgggaggccaaggcaggaggattgcttgagctcagaagttcaagaccagcatgggcaacatacataacatctctacaaaaaataaaataacatagtgggctctcttctctacaaaaaatcaaaaaacgtagctggggccaggcgccgtggctcacacctgtaatcctagcactttgggaggccaaggcgggcagatcatttgagattaggagttctagaccagcctggccaacatagtgaaaccccatatctactaaagaatacaaaaatcagctgggcgtggtggcgcatgcctctaatcccagctactcgggaagctgaggcaggaaaaatgcttaaaccagggaacggaggttgcagtgagcccagatcgcaccactgcactccagctggatgacagagcaagactccgtctcaaaaaaacaaaacaaaaaaaactttagctgggtgtgatggtgcgtgcctacagtcacagctacttgagaagctgacgtggcaggacggctggagtccaggaggtcaagactgcactccagcctgggaggcagagtgagatcctgccttaaaacaaacaaacaaacaacagcgagtgtatcctgggtgcttgttcggactaaggtgcaaacagagggctttgcgttatggtctttgatcctggtggcattttcattagactagatggtcacggtaatgtggtatcttttccttttttgtagacaggcgactgagtctcagagggcggtatcctcgcccaggtcgggggtctgcacatggctgtcagtgttgtgtcctcggacagccctgtcctgggaactcagaggctcagcagtggtgcctgtggaatgggcctctgttttcaccgagtagttgaccccatctggcacgacagggagactcttttttatccagaagccaaatcaagagaggcttttctgagtgacttggctgtgcttttttccagctttggaaagtatgttgagaatgcgtgctggccctggtggtcttacgttgttggtgtcagatgtaaacttgcgacgtgaaggcagaatttaagtctagctttatttagtccaacacgtgttctgcagcagccgctggctgcagagccaaggggataaccatcccctcccagtacttgcagtctggtggggaccaaccccccagagagatggaccctgtgctggctcagagagagagggcacttaaatcttgcttggtgtgctctgggaaaccctctcctggagcattggcttctgagctgaattttctggagtagaaggtaatgccgaggcctgctggacatatgtcctgtgaaaattctcagaaaggctgggtgcaggggctcacgcctataatcccagcacttcaggaggccgaggcgagcggatcatttgaggtctggcattcgagaccaccctggccaacatggtgaaaccccgtctctaccaaaaatacaaaaagttagccaggtgtggtggcgtgcacctgtggtcgcagctactcaggaggctaaggcacgaaaatcacttgatcccacgaggcggaggttgcagtgagctgagatcatgccacttcactctagcctgggcgacagagcaagactgtttcaaaaaaaaaaaaaaaaaagaggaaagctggcagaatgatcatggatacagtgtgcaaacgtgacttgtgcagccaccatactctcctcatgggggagtaaaaattagctggaaatgatacctgaggcaagaggcctattaaatcttattaataattgattttagtgggaagtacaagttcagtacataaagcaggagctttttggggaagttactgagttttttgtcttctccagagagaggccagaagggcagcatctccaaggtgaatctgcccattggctgtaaggagcatggacgaggacttaagaggcagcccatctggccacatctccaaggcgaggctgtccactggctgtaaggagcatggatggggattttgaagacagtgtgtcccggagccggcctgcagagacaggctgcctggggggaggagggcagcccccagctccggcgtggccagccctgaccttgggccatcagggagggcacgccaagctttgtgactttcaggtctgttcccttgcccacgggctggttctggctggtttctggactgtactgtggccgtgtggaattctctggcacacagcagcaggtacagagcctgcccctgggcagcgctgaccatgctggcctggggtttggatacttgagcctgggtagagacagggtgggttctcggtggccacttcctctgcagcagccaacag

SEQ ID NO: 63465 - DNA, 5250 bp, Homo sapiens
aaaaatgagctgggtgtgatggcacgtgactgcagtcccagctactagggaggctgaggcaggagaatctcttgaccccagaaggcagaggttgcagtgagcagagatcatagagatcatgccactgtactccagcctgggcaacaaagggaaacttcatctcaaaaaaaaaaaaaaaaaaaaaaagaatcttcagacaaggaaaccatgctctttgacctagtaatctcccttccccacccaatgccaagaaagctctaatgcaccaagattttagttatggtgttacttgacagcaaaaagacagatgactcaagcatccaacagtgggaaaacagctaattctttttcaaatgatgccttcacagtttgaaataagtagaatgcttgtcttaaaatgaaaagcttcaatatcaaatgttgaacatttatgaatagaaccataaaaataatcatgggggaaagctgatgaggagcagttcatagtgattatctttagttggtagaattttgggtgatttttttttccatacccactcctcctccccaaatgttctgtaatgaatatatgtttgggtttttttgtttttttccaagacagggtctcactctgtcacccaggctgtagtgcagtggcacagtcacagctcacagcagtcttgacctccgggctcaagcagtcctgcctcagctccccacatagctgggaccacaggcatgcatcacgatgcccagctaattttttgtttgtttgtagagatggggtctccctgtgttgcccagactggtctcaaactcccgggctcatgtgatcctcctgccttggcctcccaaagtgctgggattacaggtgtgagccactgcacctggcctatgttactttttaaatagggaataaaatagctggtcaccctgatgcttccaaaggaatcatgcatttgttgaagaggggaacagtgcaatgcaagatttacgaagacagagctgattaccttccctccccagtcctcagatactgtctttctccttgcctttaccaggacgtacaagtgcatctgagcatacggagggtgtctgtgttggcttaccgaaaggagtcctgttactcctgcattcccattcgatatggcagattgtgcatagatacctctgcagaccagtaggcctctccaatacttttctttccctcttactgcctttgggcatgtgtgcacacccaggattttacctaagtggaatctgtacttactatggttttggtttgtgttaagtcatatcctttgttttttcaattgtctcttttggcagaaccatgtatgctagcatccagctgcctgggctcaattcctgcctctgcctttggtagctgtgtggcattgggaaaatggctgatcttttctttgcgccaatttcctccttaaatataagtaataatagtacctgttttataagcttgtaaaggataaatgacttagtacctgcaaattacatggaccagtgcttggagacgtaagcactttgccaacttgctgtcagtgtggttggttattttcccccatctccccagttttgttttgttttgttttgttatttatttatttttttttttgagacaagatcttgctctgtcgtccagggtgagtgccagcacagcttactacagcctcgacgtcctgggctcaagcagtcctcccacctcagcctcccaaatagctgagactgcaggcatatgccaccatgcccagctaatctttaaacttttggtagaggtcgggtctcactatgttgcccaagctggtgtcaaactcctggcctcaagtgatccttccaccttggcctcccaaagtgctgggattacaggtgtgagccaccacgctggccctcctcagcttttttttttttttttaaataaccattattattccatattttttctatgaaatcatttataaacataaaatatcttaagtctgtaattcagtttatgatacatattcagttatgatacattctttgcatttcactgtttcatgtttcagccaaatcccatccccccaacctttttttttttttttttgagccagggactctctgtcgcccagactgtagtacagtggcatgatctcggctcaccgcagcctcttcctattaaagtactgggattataggtgtgagccaccgtgtctggcccctatccctctattaagtgcctttcagcaattctgtttttagaggaaaattcctttttgcttctgcttgctccttttaccacccctgcccatgaaagggggagttacctgtccagagcaagtatagctttggccgtgatcttcaaggactattgcattggtgctgactgctggggccccttggcccccaggttcccaccagtggagcaaacacgaagggtgcagcctagtcggaagtgttcccaaggacaacatcagtgtgcagacttccaggggaggggcatatgaaactgagccaacagaggccaagatgagaaccctcctgtgacatggtcccacccattaggccattcccttggtcagctggatggcaaatactagtagtgtatgctatggagcagacatttattaagtccctgctgtgtgtcaaggattgagctaggactctgcaggaaatgcatgtgtagttcagtcctggaagctgcccagcttccgcctcctggaagcatccttttctccccagctgctctcgcctgcacatcttacattctctggctggtccttctgggtgtgttcagccactttgagctgtgcctgcctgatctgcacactttgcaaatgtgtagactcagaaagagaaacagcccaaacagtggccagaaactgttcttggaggctctaggttgacaaaagggtcctttaatagctccaggttgacccctcccctagacacctgtgctccccctgagccacaccgtgacttcggaagttcaactgtcatccagtttggtcggctctttcacaaaataatttcactgattctgtcaggcattttcattactttgatttaaagtttttgtgtcaacctctggtactttagaatctccagatgttgaaaaacaaaatcccattggtaatgtttgttttcctttacacttatgaaaaaagcaacttttattctcgcctaaaatttattgtcgagagcacgtcttttaaagtaaaaaaatgtttgcagcatgtcatacggctctgaaatactatgtaggtcgcagcttgttttgaggcataagtgacaaatatacttgtgagagatgttattcttaccctattaaagaaattagaacatggcttttgtgtctctgatactgattttatatcttcgcaaccgaatttgtgaatcccagctagagtaaaagacacacgtgatgcatgaagaaagtgaaatggttctgtttggtatttatctcatcttgatctttggcttggaagaactgataatgaaactctctttgggaggacagagagctctggggcattcatctcccaactaggtctccgaatttggtgcagttcttgaaggcaggtgggtttacacagtggtgagaagtgggaagtatgaagggtgtgatcttcgccctctttttgtatgcccgttaacaaaactcaattgttaggcgttgagtagggctattgatttctagccaacggaaacacttactgtgtaatttccaggagagagacattttcaggtgatgtggactcattccctgcagttcagaaggtaatgagcaatagtgatcaatcctgaggttatccggggtgatttcagcttgtccattgcattgattgataaatggcatgctctgaggctgattgagtgatgaccagcagcatcaaagaaaaccctcagtttgcatggcgggtattagaagtggctgccttgatgcctcctgtcatcgtttgagtggtaaagagacattctttgtatgtttataactcttgatttggggtcatggttatcatctgtactaactgcacaggtcatcccgctcccatccctttttcattctttagaatcccccacagcggtccacgccccttgccaacttccttccactatcctggttctgttgttactcctgccgactgcagtgctgttccgtgagcttcttgaatgacatcgtacagtatctccgacgcacagtacgtaccagttacagttgtcttgacaggatctcctgtgatcttttgtcccttttcagtttagctcttggtggctccataggctctcaagcatcctggacagttctctgtgggctggcgtcctgggtcagattccagggccggatgtgagctgtgccttgaccatttgaagagctcaccgaaggaggtgggaatggacggtgcaggaaagtaactcaggcacccgaggctgctgagcccagagaagaagcacctgtccttggagtattgttccaggaaatggggaggcaaccggttccagagggcagaactgggttgggagacaaggaagcacagttcttgtaaatcaagaaaatttgtaaagccacataagctgtccaccagtgagagagagcatgtacatgctgtgagctgcagtcaggccgcctggccacaaggcatgttgtggcatgctgtgggagtcggcgttgaagcatcccagagacctcttgtgcttaaacaaagctgagttattcagcacactcctagatgtggggtctgattgttggtcaaactgaaggactcgagaaaatgaggactaagtggggggatgagagacatgtgagtgggtgttgggccagtagaatgacaaaaggagcaggcccaggctctttggaagacagacctttgcccttcagggggactgggggagtgtttcctggcaggtgtggacattcgtcctcatggatgtcttctttataataacctgtggaggacggcccagcgcatcatgccactgaccttcactgatgcttctgtacttaagaagtaatgtcccttggctgggcgcggtggctcatgcttgtaatcccagcactttgggagctggaggtgggcgaatcacctgaggtcaggagttcaagaccagcctgggcaacatggcgaaaccccgtctctactaaaaatacaaaaattaaccgggcatggtggcaggctataatcccaggtactcgggaggctgaggcgggagactcgcttgaacccaggagttggaagttgcagggagctgagatcacaccactgcactctagcctgggtg

SEQ ID NO: 63466 - DNA, 2150 bp, Homo sapiens
gcttgagagcccctggtgaaggggtagaagttgattccatggcccttgtcacactgtacttgagccataccgtgcttggcacggaaaccaccctgtagccgttgtcagaggtggagcgtcctccctgaggtgcgtaacccccacatcatcgttgcttccttgggctgtgttctagcgattgcgtccgtccctttttctccttgattgcagatggaagggccctgctctgagccgtcgccacatgcctggtgcttggctccatgatgctcacatgggtgttcatgacagtgcatttgacagacagatttatttgtcaccttgtcagggtgacatgttgggatggctccaccacttgtgtgccattgacacttggctgtctgaaatcaggacaaagcatccctgagactgatccgaatgaggcttatcagcaccaggcgtaacttaccgcctgctttcctctgtttctttaacttttaattgaaaccatttagttaccacccctgctgctaggaatctggggacaattaggaaagtcccatctgtcctttgaaccacattatattgcgtttctcctcgcaatctcaagaagacggcacattctagcagcagtgtctttgccttgccgtctcgcctcccactggatggtttttatctcacttgaatgagttatagcaactctttaattcaattattttctccagtgcaggctttgagatgatttagttgaatcaaacacccgggttttccaatgcagagcagtgactcccagcgaggccgtgggagggtttttacattttcacttccagccacggttgcgcgcgttctgtgctgccccctgagcgtcctggcacaagcccctacttaccattccgaggagtagattggaaatggcagatgccgtgggctttgccagtctttccccaaggcaaggaattatctgtccagtgatattaggtcactgcattcccacccagctgtgtcgaaagaagggagggggtggggcagcctgggtgatgggcaggaaggccatttataaattcaagtgtggtaaacagtcgactctcctgctttggtatttgagtttgaattaaacaaagtgtcgtgggtgggaggtgtatcatacgatcattttaaccattgtgccttttaatgtggaaaatctgcccaaaataggacctgctgcagtggttttcacatatacaaagaagtggctagaatgttctctcagaacagcacacaggattagaaaggacatttggccgctggaattcttcagtgagaattcagtgattaagcctgccttctgttttccttgtgggccgcagggttcctgtggatgtccccaccctcagattgctggagtagaaaacttaactttccaaaacactgagttgttttcagcccagcattagaggttaaagatgctcatgtagaaagcacgcaggatggatctgacgaaggaaacagcttctgatacttgagcaggctttggacagtgcagatgaagggggctgagatactgaggcagtaaagagaacggtcagcttggggtctggagtcgctgggcactgagtgcgcgttctgagtgccattcaagcaccacgtaacggttggggctggtgttgggtcctgagatgggccatgggccaccgttaaactcaggaagcacgtgctgcccccccccactctagaaggcgggctgttttcctggcgctgtgtgtgccatgctttgtgtgaacatctcactgggtgtcgctctcatgtggtaactgggcatgttgtagaagtcgttgctcctaaacgtaagccagtgcccacattgggtacgttctggaagaaacagtgtggcccaacatgggcttatccagagacaggacacctgctgcctggtgacgtcaccacctcccgatggcaccactctgttctactccactgcccccggggcctgacttgctactatggaactaaccctgtaggatgaggccgccatgcccgtgtgtgtgtctgtccagatctgtccccacatacttgctggtggcgggtgggaagaaggttagataagttactgtcatagattgtgactatgaagtaatccattagaatcttcagacaaggaatgctgggagtggtggctcatgcctgtaatccca

SEQ ID NO: 63467 - DNA, 1906 bp, Homo sapiens
gtgcagtggtgcgatctcggttcactgcgatctccgcctcctgggttcaagcagttctcctgcctcagcctccctagtagctgggactacaggcgcccgccgccacacccagctacttttagtagagatggggtttcaccatgttggccaggctgatctcaaactcctgacctcaagtgatccacctgcatgatccacctgccttggcctcccaaggtgctgtgctgggattacaggcgtgagccactgctcccagcctcgtcggccttttttgccttctgcttgtacctcaaccctttggcaaaaagtaggaactacagagggcctgtcattgagacttcaagttgccaatgcccctcacctattcatctgaactcaggcacatgtacatgctcacacgtgtgcatgctcacacgtgtgcacacatacatctgacatggacacactgatatgcacacgtgtacaaattgtgaatggtatggaccccacgtgaggcatgcacctaaggcgcgcctgtagcagcgggacagagaacaggcttccttgtaccctgtactcatcacgggggttgcgctggcttccttgggttggctttgaggagtgcggcttgtgacttctccacggtagagaactgaggccttagacaaatagtcatccattgtaactgttccctgcagtgttgatagaaatggtgttgggataattagactgtgctgctgctttctccttttctcccaggttgatgagtaggagcagtttaatttgagactagtaaattttgtaattggatttaaaagactgaaatgagcggacctggtttccatattacctttataccccagcgaggggaaatgcttgagtcaggtgtggatcagattattttattgtgccaacattaatattgggagcacacacataatctggagtcagcaggttcatccactactatctcattaaattttcaggcaaaagctgcaaaaattaattggaggcatgtaatagtttagaatgtgtgccagcttatggtaatataaattatgtgaagagaagacagttttatatactgagagagggaaaactggtttactttaatgagaagagatagaaatgtagagctattttttcattacagatacactctaaaatgtttggacttagttgatgaatagagttaattcgctgctacagttccaataattcatgttgcacagtttaatgacttctagataaaaacaggattgaaatgttaatttctcggaagaaattggggcactcttgtatatcagacatctcccccccacccccccattaaaccactagttaattccaccaaacaagtctctttgagctatttcatgccgtgtagacttttgtatttcttacctgggctggctggcttttttttaaaccttaatgtatatgataatcttaggtgacagaatgtgttagagctgtgtctaggcaacctgactcagcagagagtttcataccttttagttttgtaaatgaccacgtgctataacctgcattctcctgtccagtaactgtttcggcagggagggggtttactgggttgtggttagccatctgtttagtcgagtagcgatgttgtcccacttctgagctgggaaataggaagtattgatcagtcagctttagattcatgaggcgatagtctcaaatcatgcagagattttatcactatgttattttgcatctttgttttctttttcacttttcataacttggagacattttttccccatggggtaggttcagcaaagttcactgtcttctttctctttaacctactctcagaaaaaaagacgaaaaggaaatacgaagtatagtaatgaagtgttaactaatagtggggctacataattgagtactcggattttgttgc

SEQ ID NO: 63468 - DNA, 3277 bp, Homo sapiens
aacctttcttggtcgtgaaggtctgctgtgttcctgaaggttctgtcttccacctggcacttgggatgtgggttgctcactccttgcccatcgacctggtaataatgttttcctatcaagcagtgaaaggtttggggtttccatgaagcctttcccaaatgtcacgcattggggttttagttgtgagggtgtgctgatcccagccgcagccaaggcgaggtgctggcaccatgctgctgcacccgctcctatgcccacctggacatctgtttcgtaatggacatccttccctgggaacatgtctctactcctttaaatggcttgaggtctctgcaatttgcctgaacattaagtgtgaccaaagagcctgaggccagccatggagaggacgaagacatgaggctttctctcgagagccacactgggagaggccgggaacacggccacttcacatgaaaggcggttagattcaggtcactgggtctggactcctgcattttatggcaaagtctaaaaatgccgatttgtaacaaccaatgttaatgaattcagactgtttgaatttcacactgaataatggctggaattatcagagcccacagcttataagatccctggatcgtgtaatcttttctcaagatttaattgatagaatgatgtaatatcacattacttttattaaaagttctggccataaaagagaaacacctattaggatagaagaatttagtaaaaatagtagtaataacaagacagtttggaatatgtcatatattcagtaaatttcaaaagtcttcatctcatttaaaatacagtattgtgcccatagatcctgaatgcaatacctttgtaccctagggcttcctctttcctacactaaaaacattctatttaaatgcagattttgatttgcaatctaggaagaggattctggaagaatgggaagaaggacaactctgcatctattaattttagttttatgttattcgcgtttttcctctcatccttatctcctccagcccttccttcctgtaaaaggatcctttctaaacatacaaataaagacatgcttagaatttcagcacataagaatgttgttacgccttcttttatttttgtttaaaaattaaattaaaaaattttttttccaaaaatgtttgttcctttgatttgtgtacgtgtgtgcacgtgtatttgcccctgggttgtagccttgtcttgcttttccacacatgctcccagtatcttacctaggaaatgagcggaacagtggaattaccaagtgcagatggtagaacttcccttaccagagcccaagtgacttgtgtgatattgagctttggttactaaataaatggatttctggcttttgacattgtactctgagaattgggtggccaatcatcaaataccatttttttcactgttgtctgcatttaatacagcatcttctgccatacgcacttgtcaattcaaacatgagcgttacattttggtctttatgatctgtcaagggaaaatggaagtaaattctttataatatgctaattgatgtatttgggaatttttagatgtagacaacatctgtgcatgccgttaacacagttaatagctcccgttcttcaatatgagaaggttttcagagtctatgtgtgatctagatgagaccttctgtgtccgcccccccaggacttggcagtgtcaaatttaaggctgttttttctggtgccttaggactgaatctgagcctgcgcaaagtcctgttttgaggatgcttctggccacagtgtgctgggattgtgttggttctgggaagagcctggctggccagacctggtcttatctatcacccccatccctactccgtcctagcctggaccagactggctggagtgatgggtccagagaaagagaccgtggacctgaacagtccttgggacccttctgccactcttggaggtgccacctcccctggtagcttggcaccatttgggttctcctttagccatgggtttttgacaactcaagagcttattttccatacaaacttgttgatggttttctaaggcaggaagcattgctttattgagagtgaggaattgtaccctttgaaagctgccccctgaaaagggagtggagagagatggctccagttggagttcaggatgggggtatctttcagtgaacttggggggagggctgagtggtggagcttggggctcatgtcccaggccttctctggtcaggaaagcagagttgaaaagggcccttttaatctggagggcccagaatggtccagccagttgccccggaaaggaagcctcatgtggcatgcgtgccagacgctgcacagcttgagttggtcctatgtgtgtggcacagccttacaaggttgaggtatttacctttattcctataaattgatggataaggggggttaattgatttctcttggcacttggcaagaacagacgtcagatttgaacctaggtctaggtttcagttgcacacccagcatgttctgctccacagccttttcctaaaatagtttagatgttggtataaacctgtgcgtactgaacgtgcctgaccgtgtgctagtatgatggcttttctacagtgtctccctagactccatgcttgcagaccgacagcgcgtggaaaggaggctttctggcttggtaaatgctcagtcaggtgagcttgctgagtttattgtaagctttgcagttccattccccacacacccagtggtggggatggagggggcgcagggaggaggtggccccagagcagattgagccccttggtctttgctgtagccaggactccaggctaaagtagcacagggtgggcagctccgaggcctgggtgtctctctgtctctctctctgtctctctctctctctctctctctctctctgtctctctctctctctctctctctctgtctctctctctctctgtctctctctctctctctctctctctctctctctctctctctctctctctccccctcccccatttctctctctgttcacccgcagcagccccaggctgcgtcattggcactgtgaaggtgcagggcacaggtacaaataggggggtcttctggccatctttggacataaacccccatcctcggaagcatggcccgctcatccccaggtcctggccttcctaagggctgttaaacacacatcaaccaagtgatgccttacggaccacgcatataccagacgcagctgggtaccgtgtattctcttgatattac

SEQ ID NO: 63469 - DNA, 1103 bp, Homo sapiens
caaattcaaggacccagcatggtggctgctgctttgctcaccttcagaggcctggaagctggtgtttcctgcatgtgtaactgacggccccagtcccacatttgttaaaaaaaaccttcactttgatgagagtacagtactcctggctttttgtaattcaattgaaactcactgccactccctcattacagcagaagatgacctctaaaccatgacacagggcgacagcttcctctgggaaggaggactcaacattgatttgtgctctgatccccacccccctgcaaaccctgggcttaagtggcagcactgcagaggcctgctgaaggccggaaagccctctctgcctgtgtgtttaaacagagcagattgatgcagagtttgatgtggccaggaagaattctttagcatggaattgcatcataacagtcactccctccaggagccccagcggctctggcacttcctcctgatgtttgcaaggggaaggtaatgattctaattgcacaggacttggtcctggccttggtgatggcaggagggcagagtcctcatggtatggccaaaaaatgtttacaacttgaccttgtcctcctctgatggtgttgaccttggacaaactatgcccctctgagcctagtgcctcagtttccccctcttgcaaatgcagcaggtagtagtgcttaatctcagagttgtggggattcaatgaaacagtactgaacggggcttaacagatacctggtacatgttaagagcttagtcaagaatgactgctgagtctggaatgacattatggggactgacgagggaggctgatgagaggtggcttggtgggtacaatgtgcattgtttcagcgatcgaggcactgaaggccctgacttcaccacaatgcaatgtatggatgtagaaaattgcacttgtaccccatgaatatatgtacacacacaaagatgattgctgcagtagcagcagtaaatgcacacagccaaaggcttagcatgtgggagatgccctgctcgcctggctgggctggaggggaaggtagtacaggttgcatctctccaagccggtacctgtggtctatgttgcaatgaacatt

SEQ ID NO: 63470 - DNA, 4762 bp, Homo sapiens
atttatacatcgtttttgccctcttagtattttctttagcatgtcctaattttaaaagcatcccattcctgttgtgctagacttaatattttggtttatggccgtcttttttagtaacttgacgtcaaacacttcagccttctcctgacaagaggctcgttctctcagtaatgaatagtgacgtgctaaatttagatcggatgcatgttctgcttttactatctgttctgtatgttgctatttgtcagaatgaaagctcaatgtgccagatggctttgctggcttctcctggaaaaagacttcgttctccatcacttcagttgggtcatggttttttagtactattttgttgttaagcattaatatttgcagcagtacccaattatctttttttaacaaaagtgtcacagaaaaagtgtttttggttaaatgctcataaatgagggggaatgcaaatcaaatcccttaacttttattatattacgtaaaatggtggtagaatagttgcagctgtggttttgcaaagataggactgtttccggctgccatgcatgctgtattatgtattttgacagatctccaggatgatgtagaagcttggcctgccgaccagggcctctgggaaagacagtctgaggtgacacagtgctggaaactcagtgtgcttggtggtggaagaggggtttgccttgatctgctgtgggaactaggctggatttccatctgagttgtggctgtagcaggccacctagttgaggtcatcttcctgatcattggtcctctagcctgcttctggcaggacagatatcttttttccatgaaaaacagaaggaaagtattgaattactctggaaacacatacctaaaccttggggtccgattgtcaatggttgtgaagtggtggaggtgttggcgccatggccactgtgccactctggtcccagtgtgtggcccccagagtccttcgggcccttggcctcctgagctcctggcctgcatgcatccgtggggcctttgctagggccgtgtgatcctgctccagtgtttgggccagaagcaagactgccaacatccgaaaccacaaaccagaggaagatccacagggcctttcatctctggggttctctaggtgagaaacagtcaggaggctgagatggggcagtggggaagatgccagcgaagctttagccagccttcggagtaggggaggaggggcccccgctgaagctcttggttcttgcttggattttattcctgtgccttctggatgtgagttatgcttcggaatcccagcctccctccaccccccaaggataaatgggaggcattgattcagtgtttgttcttctctcctgagcatctcagcaacctagtgtggcctcccaagtagggatggagagatcaccccgtccattccccttctttttgctttagcatctacatgggtccagggtcacacaggggtcacgccctccattctcctggtgagtctggctttctgctgttactgttgttttccgcttcctgcgccaccctggctgctggttctcatcagagtggatttgcaaagtagggaggaagagaccaggcagaaggcctgaattttcccactgtgacccatgtgtcaacactgtgtggccggcctgggtgggttcctgctgagttgctccttcgctggaggggtacctccgagcagggcatctgcaggatggtgggcacacttgcctctcactcttggcggggccaggagtctctgttgccactgagtgacgttatgctgggaaatggaggcgtggtgtccgcttctctttccgtgatcctcatacccttcccaagacccccattttgttagtgaagaacttgacgcccagatccacctgccagcatgtgtggccttaggtatatctggcattcaggagccgatgaagcaaccccaaactcaggtcgccccgcgtcccttgctggtggaagcctttccggaaacactgtggtagtgagcctggcttcccatacactgcagggtccctttacagtgaagatggcttcccgggggctttgatattcctggaagctttctcaggtttgtcatggtaccgtccccacacccagggttgtgggaggaagagcacttggtccatgtgaagtggggccgcacatggggtgcatctttccgctgagagtgtggcagtgtgcagagaatgggcctctgctacccctcatcagccaaccctggtggagacccccttgtgccctagacaggcctggccactgaactgagggatggcagccctgttgtgtgggacagccagagacacgggtcagcggctgatttctctgaggcttggagcgtgtgtttgttaaaggcaagaagagtgggaaggagtggatggagtgagcggcagggccagagcctcacttgttgaagggagtggtggtgcattgtgtttactgtcaagtttcaggctggggcgtagatgccgatgtgcaaatgagtaggcagggaagtgagctttctcttattaaaatgttggcttactaatcaagtgttgctgggtgtgattagtggcagaggaaaaggttatttctttctgtaaatatttttgcttaacatttatgcgttaccattgctgattgtattaatactcttagaatgcattagaccaataacttgtttttttttaaaaaaatgtcttggttttaagcagtttcagttggtctttatggaaggacacacagcatttcactgaagcttgagggatctgccaggttcaagtgtaaaggggcattagtttcaacttagagcagctcccccagctacaaatgctgataaaatagctcagaagtgcaagagcctggttactttcagtaattttaggatttagtatctggatctgaattttgaccattgttgaaggagcagataattggatgcattttctaaagtaatgatttaggccaaggagggcagatcctttgagcccaggagtttgagaccagcctgggcaacatagcaagaccccatctctataaaaaaatttttttaaaaaatcagccaggtggtggtgtgtatctgtggtcctcaggttccagagtagctgggtgggaggattgtgtgagcctgggaggtcaaggctgcagtaagccatgattgcaccactgcactcagccttgggtgacagagggagaccccatctccagaaaatgtttttaaaactcggccaggtggcggcgcctgcctatgcctgggtggccagattgtgtgagcctgggagctcacgtctgcagtgcactgtgatcacacccctctacttagcctgagtgacagaggcagaccctgtctcaaataaattaataaataaataaaagtaacgatttaggaaatggctgagaattcccatgaccctcgtgtcctcgggcctggtgttttcacaggggtgggggcgggagaaggggagaaagaaggacgtgctgtctgtggcttccttcttcccaggcattcatttaacaccagctgaacacatttgctttattgattggttgattcatttatttttggcaaacttggcaacttccacctggccccatgctgttaaaaataaagtcttcttggtcgactgaatgcttttgcaattcattctttccatgtagcaattaagatgattcccctagccttgtaccagttaaggataaataggaggttttcaaagaaaatgctgcgtaattcatcggcatttgtgtgtgagcacacgggtaatacatgcgagtagcctccgtgagtggactcctgtgtaaggaggtaaaatggaacgtttttctgcacttatcctgagaagcagcccgaacagtgacatttatacatatttcataatgtggtttcttcaggcacgcggagcaaacaaatcaatttctcagcagtatactgtttaaaagaaacagcaacaacctgtggggaagttgcagaagctgttaaaattaattatatatggcaaaaagatagaacattagggggaaatgttaatgtgggaggatgaaaaaacacagccgtggatgagcagcagtgcagagcatctgatgacagtgtttaatttccgtttctttataaatgtatactgatgaacaacaatggcgcccgcacagggtcctcctgttccgtcctttctccaggccgctgggatcgaatgtccccgtgagcatccagtcagctccacgtggtgtgagccttgatttctgggaacggtaccgtgctgtcttttaatagggatttgtggaaaacgagaattggtggtgaaggtatcgaattcctgagccttgtaatgcaacacctttcccgtggtcaccttccctcttccggttcagctatacgttgtttaactcaaaggaaacctttgttgtcgtgggtagggtgtaacctgcaactccttgaaaaattcagcttgggtgatcagtttcctcagggatgtagggggagaggctcttcagcaggggtgggagggtgcttacaggagggtcccagagctgtgggacaggcttgccccctttcctgggggaagctcgcctctttcccggacactgcaggtttgtaggatataccccttggttcagctggtcatggcaagtgagtcctccctatcacccacttccgcggtggtgggacgcctggggggcatggatggggcctgcgtcctaggagaccttggctccagctgctcgaggccactttgtctcttctgcatgtcgcagaagcgtctgtacctcctggggt

SEQ ID NO: 63471 - DNA, 3099 bp, Homo sapiens
tacgtctcaaaaaaaaaaaaaaaacgaaaaaggtagaatgatggctgggcgcggtggctcacgcctgtaatcccagcactttgggaggcccaggccagtggatcacttgaggtcagaagttcaagaccagcctgaccaacgtggtgaaaccccatctctactaaaaatacaaaaattagccaggtgtggtggcaggcgcctgtagtcccagctattcaggaggccgaggcaggagaattgcctgaactcaggaggcggagcttgcagtgagccgagatcgcgccattgcactccagcctgggtgacagagtgagactctttctcccaaaaaaaaaaaaaaaaaaaaagtcaaatgcagctgggaatgtggttcgtgcctttttgtatattaaccatttgaaacttggttgtaaggtggggttggcaatgtcaggcctggctgcagcagctcatgtctttagagtgtgcctcttccctctctcgtggggctcgagcaagactaccttcatacatgggctctccagttacatagcaactccagtgttaaattccatcttttcttcctggaaaagccgtagaaaggacacctggacatgcctgctgcacaggttgtctgccttccccatcagccgcagaaggaggaactttgctctcttctctcacagctgtgtgtgcataggaagtagttcggatgatgtgggtcccaccatgtattccttctctgttccatgtagagtaaaataaatgggagttctgtttaatgcatcacctcggttcatattgcatttgccaagaaagtgcaattttattgaacattaggattgaattcttaactgagtaatcaatttcagtagtaagttaaaatgccttctattaatggacaactgcaaccgttaatcagagttacagtagattaacagttgtcagcatttatgctaatagcacttataaaccgtgggctcatgatttgcactttataattccatatttctcaaaacagttggtaatactttttgcttgaaggtattgattcttttgtccctttgcttgctacttggagatgtagagaaagctaaatgacattttcacggtgatgacacaatatcaccttctgcttttgcacacttggctttgtgtcaaaatagatggaaagggttcatttgttctggtgctctactgtttaatttgatctggtgtgtgactaaagcaagacaaatagtatttttaatgaaaccatttaataacctctggtagcttagagtcgaaggcattggaaaaatgcaattaaaggatgcctagatgtaaacaaaaaaaaaaaatctctacttcatcttcactgactccattcattttgctttcagggtttcatcaccttaaatggttttgaaccaatgaaggtgtattcccttaaaaagacggacagcccatcgtgtgaactatagagtttgtggacagatttatattggtgagttattgtgaaatatctccaggtaaaagttcagttttctagaatcccctttgcaatgtgtgttcaattagttgatgagtatggattgcctgcagcctctggctgtttcattgggatgtctaatcgtgggatcatattgattgtctttcaattaattgcatctagtattttcatttatcaaaagcaaaatacatgtaattaactctgaagcaatatagttcagtgtaaagtgatttttgctgctgctgctgctatagagataagtcaacggaaattatgctacaaggaaactcaagtcagaatggaaatagtgttaggatttctcgatgtattaattaaaaagaataaaaatgaattagagaaaccatctcatgacaccccgagtcagtcataagtgatagatggatgtctttaggaagaaggcggcttgtggatactggcacctcttcagtcagcttaggcttttagtgttaccagcctctaggatgtcttgaacataccatgatttttctggcggagtagattgggaatgtgggtgcaggctgagatgagcattcaatccctaccacactcattgatggatggagttcaatcctgtgcccgtagcagggttttgggattctaagtttcatttcggcatgtctttagccatttttcacaaaacctggatctttcttaaagtctcaaagtggcaacttctctgatggaattgattttaatcttgctttttaaaaaaaaatgttttccccgtgaggtaacaacatcattcaaaagcaagggaaaccgctagccaattgtgtcctgtctctctcacctgtcacactcctagcagagccttgaggggactagctttggttcccagagaggtttaagtttgtgaccaggccctcaggcctggcttcctgagttgctggaggcagttagagacttggagcccaggggcacacatgggtgaccacctgagggggccaagctgaatctctgcctgaacctaagcagcacagtgggttgtaggatcaggaaaggatctctgtgtgtcccttccttttctccataaagtagatctagctggggaaactgaggtagctgacccagacctagacctccaaatattgcttaccagcttggtgactgagcaagtggtctctgctggcactcggaagccttatctgtgaatcgaacaggtggattgggctggtacccaggaccctccccaccctttaagcttgaatttgatgtagaaattcagaaccctttcctgggagtgctctgacagggctttgctgggccaaaggccatagcagagcgtgaagctcgagttgagttgtgtatgagaggggcccctcagtcatctttgaacacttaaggctcttagcattgaggaggatgaggaactggaagtctgatggaatgttctttggtggaaacctgagggaggtcaggaccgccactcgcaaccttattcagttcagcctttcaggacaaacgttgcttacttttctggctctcactctcagacctgtgtgctagaatctgcccgggtttctcaggcagagacaaagtcaccttgggcctggggttggcaaagatagttccagtgttgggtgctgggtccaaagatgttttcagtg

SEQ ID NO: 63472 - DNA, 2000 bp, Homo sapiens
agagtttctcagacgcccccatcaagacctttttagggctcattgaaggcttctaaaggttctagtctcatttagtttctaagaaaaggatttattcactacagacctaaaacgtaatttttgtatgcctgacttagtataagaacaaaacacccaagcagtggcggtggggtagggggtcctgtctaggtactgcagcctcagttgtgagtttcctatatgtggaaggtgcaggaactagctgaccacagtctggttgggactcccacccccaaatccatctctgggtgctgcggttctcttctgggatgtgtgagagtacacacccccctgtcatcagctgtaggcagatcacatttgccgcgggatgtttaataagttcacgcaggttgatggtacaggccagaaataggacccctgtctggcccgaagcagccacgtgaacttggagggggtgggcatgctgaccggcagttacacgctgaggccacttcagctcctgcggttgctggttcagaagtagtggtgattttaatcagctaagtcatttctgcgtctcgttgtatactcctggaagttcttagagaaatcctgccaagaaaatatcccctggtgaatcctcggggcactagtccacgccgcactgtcagcaagtatctgctgaaacaagtatttttgaatctttagcttttctgtagctccagtctttttaaagtacttcttttgaccttcaagtaacaacgagcacttgctttaaaattctgacagtcttccaagccttttaacattcttattccactaaataagctgtcgccgttcactgggacaggcagcacagttgcttgaacgcccggcttgaaattccacgaaatgtcacctcctctgtgaagccttctacaaggcagacttgtctatttcctacttaattttactatgaaatatctcaaattagaacctgtacccaccatcaagattaggtagatgttaacatgttgctacgtttgtcttcagacattgttcaaaaacaagtaatgttatagtcattgctaaggtgcacctccccagttccttttccatccctccttcctttccaaaagggactacttcctgaaaatagatacaatccctttatatttttggaaattctgtgtaaaccattggaaatggaaggagaaagcctgtgacatacgaagacaagcaacactaatcaggagtataaattctgttttgcagttaattaaatatttgattccctactatgtttcaaagataaataaaatgtgattaagtaaaaggcatttaacctttagagacttggagatgggcagggtatatagtagcctgccagctagagtagggaagatgttaaagaagataacctgtgagatgggttttgaagggtggataggagtttgccaggcaagctctgccacctcaaaaaaatagttccttggctgttagatgcttgtgtcactataggcttgggattactgaaaagctatgcttgtccctcccttcctaacacttctgaggctggaatgtctgtctcccatctacttccttaagaggtgtgggttacagtgtggtgtacagttgggagtgaattactacttgaccttgggtacatgataaccttgactgtagagtccatgcttttcctgagtagttcttcagagtccttcctgccagtgacttggttctaggtgtggagcaggagctggctgtcggaggactcattgaattcagtggaaacagcagggagcatggttttcttttgaatggaaaccatgagtgtagcagttcttctttatgacttgctacataatcatgcaggaaaatgcctgtcacgggattggatcctaggagattagccccattgctaattaaaagccccattaaaagaggggaagttcttttaggtatctacagcttcctaagatttgaatggtttacaaagcagaatgttggctgggcatggtggctcatgcctgtatcccagc

SEQ ID NO: 63473 - DNA, 2832 bp, Homo sapiens
ttttctgtatcgaacttgcatgagggtggagggacacttggcttttttcaaaacccacctttgtagtacagcagccacgcagggacttacatcctaaatggggccactttacaatgttggtgtggcccgaaaacctgcaaggcaaagcagcccaggcagcagctcactttctgcaccccagcttcagagccctcctgacaggagctcacagctcacatttttccatattataggaaatcatgctctttgcagaaaatagaaaaatacaggaaagtataagaaataagtaaatgatagttatgttacacattgtaaaaatcctttttaatcttagcatggagaataacactttggatctattctgtctcttatgcatatacgtatatactaaaaatgagattcactgaagaatgttttaaaatatgtgagatttgaatacatgtttcatagtttattttccatttgacctataagtatttttcctatgtctttgaagtattttgaaatacttttagtaaatacataattgttgagatggatagtgtctgacatatccctgtacagctctatcaggagaaaatttatcctactctggtttccagcatggtctggtacatcttgaccacttttctaaggattccctagggggagagtggagtggggcatggaatctcaagtttacagaaaagatgcccactccttccaccgcagtgggagtgggggtcacaccctcgctgactcctcagagcagccagcatcctgcttttggtcaggggatcttgcattaaaacctgccagctttagaggttccatctctcgctgtggtatgggtgtgtgctctgaatgtctgaagacccctctgctcaccttctggccctgtgtagggcctatagtaaatatatagtctggcccttgttagatcaggtgtccttgggataccctgtggaaaggagctcagaaaacccctcttggtcaccctatcagggagaaagcaagaccggagcctgacaccaggatgccccagctggttagtagtggccaccagttggagtgagccatctcctatgtccgctccttctggcaggttcctgaccatctcacaggggtgtgtgcacctccaccagcagccgccttgtccacttacagtgtggaaccatggaagactagagacggataccttcaagtgcttctgagttgggatgtgttttctacttgtctttcggagctgcgcgcctttgcggggacctcagggccaggcttccctctgagccaggctgattttaagcgttccccatccccccctcccaccccccagcgcctccactgcactggtctctttcaagttcaggtgatttcctggcttgtctgtaagtaggactgtcgtgccccactcaggtacaggtgtgtgggggtgcagccaggccccatgagcctcaggtccagttgctcacaccggctgcctctgcttccatggcccacgggcagctttgggtgtgggaatgcagcttgaattcacaaaatgacgtcgttgtgtgggctgcttgctcgtggatccacttttcttcccccctttcaaaacttggcccatggcagccccgatcagcagcacccgtttatcaatttgttccttgttcctttctccagttgttgccaggactcccatctggcattctcccatctcacgcccttgtttatttctccgtcctggagccacttcggatggggcacttctagaagcctagctaatgccgcaagggcttcaagttcctccttgtcacccagctcgtctcaagtccgttggccctgtcatctagaaaagctgaaagctgaaagagcaggggaatggtcacattaattgactacatctgagacaacactggaaacatatcctattttatttttctttaaaaagtggcaggattccaagacttcccttccagttttccactggttggccttctattggaagacgagttctaaaatcttggctgttgggcctttttacattcttaaaaccagctgaatatatttaatattgtaaaatttccataaacactctctgacaaagactgtgtatgtaaagtttctgcctagagggcatttttcttctcagagttgagactcttgggcatcagggggtcataatgaagtgttgatttcacctgaagtgcctctgtgccaacgtggctgtatagggacatggaaagaattagctttcggggttgttgttttttccttccctgaataaaggataattgtttccaagctaattaatatggtttatttattactaggcaatagttggtggaattgaatctcgggaaggaataatccagcaatgctaaagtgacaacctctcgggtacaccctgttcattcctgtccagtgtgtatctgacactcagccctttggtagacgttgtcattttattgtatttcttttccccatgtgccaaccaaacttggactccacactgcttcatgcccagtgagcttggcctttctcagggtgggtttgtccttaaaggctggccaggcgcgtaattaatatggtgggcttggggggtgccgtcccaggcaacgttgagctgtgctgtcatggtagcagcctgaagtccttgttagagggcatgggtcacacgtgtaccccactgtgtggtgctcggtggcagagttgagaagtgaggagaggtggcatctcccactgccgtttgctcagggatgcctgtctttacccccagcagcccccaggactgcacatgacctcttcctgcagagccagctggcggccatcccagtgccaccccccactgcccccgttacaatgcgttgt

SEQ ID NO: 63474 - DNA, 1135 bp, Homo sapiens
ttcttttggattctttgaaccagcggggagttaccgggagtgctagcgtcgagtatgccagcccttcctaaaagggaggcagcaggggaggcccaggaaaagacacagagtgccacaaagacctttcgggtgatacaaaaggctggtgtggcatttgagggcaccagcaaggtccccaggctcgagaagcaggggcgtagctctgggtctcccctgaccctggctatctgctagcacactccagctctagaactttctttgagcaagctgggtgttggaagccggccagcccagcgtacaactgtgtatgtcagctggggacagtcttggcctgttccagcctgctctgtagtttcgatttagccagactgggtcagggagtcctgaagttgttacccaccagagaggcacttgcccagcacagagctgccccgggggctggttttctctgctggtctgtcctccagggctgctctgtcagggaacgtgccctctgttgggtgtggccctgggaggcctgggcagctggcagcacctgggagagaacaatgagtcagtcatgcccgctcccaggaaagaattgacgtagcacgagcatctctgccagctccagtgagagaaggtcagggttcaggaattgtgagctctggcttctcgagagacaggatgcaccccggggcccctggggagccggaggacacagatcccagttgagtgcgtaagcagtgtcaacagggccagctcctcatggcccctccttgtaagcgctgatcccctaaagaaaggaattgccctacttagtgcccagcatgagctaaaccacataaaccaaaaaatgacaaatctgttattttaaaaattaaacttattttgaagtaattgcagattcacatacagaatgaattcacagggtaggagaaggtaatacaggaggtcccttaaaccctttccctggtgccctccagttgtaacattgtgcagagttctggtaacagcaacacagcggagaaattgacgtggatagaatccatggatactattcagaaatccctagtgtaacatgcactcatttggctgtgtatttagtctgtgcaattttagcacgggtaggtctctatttgtaccagcccaagaa

SEQ ID NO: 63475 - DNA, 1171 bp, Homo sapiens
ttggggatccggggaccgacttgtttacacttcttctgatttgagtgaaataccaagaggctggcagagggacagcccctgagctatggctccctttcttagcccagatctcaagagctttctgctgtttttgctgtcatctctgctggatgtcgtctctgctaccgaggtacagcagttaggaaacattcgcgtccccatcactctggtcactctgctgactggtttttggacactgagtgtcccattcactctatcactgttgactggttttgggacagtgagtatgtgacatgcatatgacccatgcttaactcactcggagccattatctgagcactatttgtcaggtgctaagaaggcaagcttcaattgacttaagttccagcggggatgtttgctttttatgaaaatgatgcttagtacctccttactaagacaatggcagaatagaccagactgttgtcttcagagattcccaaacaccggatattgacaaggtttgctttcctaaagttgagaagagggctgaaatataaggcttatatctgtctctctgagcattttagaagaaagatatatctaagctctgtgtttaaatatagcatggtgtttgctactcggatggcaaataagcaattgaatatgtaggtcattgacttatgagaatgagtttggaggtttttttgcatgtgattaacgctgtcttacgattgggctgttgatgctccgccaacattgggttacacagagttcagcaagccatctgggaagaaaactggaagaatcatgagaggatacctctgtccccttaaggtgttaggagtgtgacttggtgttgagccctgtggctacagccagtggcagtggcaccaaccgctcccaagttacactggggagaaacacatctgagtgccgtgcgtctgtacatatctatcaggagggagggggcagagggcgatacttcatcgagataaatgccagcggtgtattttaatacattcttgattcagaaggcactgtttggaattgcatatttaaaaggaaactgccatccccttttgaaggtatgtgacatttaaaagatctgtagcagaagattggtttgacagctttgaattataattgaaagagtttttgttttaaaaaagaaaatgattacttctatttt

SEQ ID NO: 63476 - DNA, 2447 bp, Homo sapiens
tggttgaagcagagggccaggaagcagagggacctgaattccccaccaggcggtccctacagagtcatggaccttcctttctccccgcttcctcctgccctgttgtctctgctgagcaaggcacggggcgggggggcttccgctgggtggacttgagttggcctagatttgaatctgctcttactgccgtggactctggcatgagactctaagcctcagtctctccacctctgagttgggaatgataacagaattacttgatgttggtcatgttggctgttggtgatgggcttgttaaatctggtcgttggggctgctcaatatttgcattttcagaacagcatgcagcgagtaactagcgctccaggacaggacttcggaatgtttccatttgttccttctgatcgtgtccttttcaaatctgatctgtagtttgtttcttgcctgatatcctacctgctaagttttacatgcctttatgtgcgtttctttttggacacattttatcacccatgcagaaagaagctgctccagtcttccagccgtggttaggaagtgcctgccattcagaagtcagttgtagttttccacatggtcggctgaataggaatgaggcacttccctgtccctaaagagctcacagtgtggaggagagatggtatacttctgctttaggctttgagactctttgtaaatacaactttgattaaatttgttcatggtggcttattatttccaaggcaaaaacagtcatttcaaaagactagactagcctctttaaagtgatttagagtttatagttgtgttcaaatgcgttctaattacaccctccaaacaacaagcctctgttttcagatggagaaaacaaaggattcagattgaaggactgctcagacaccctccgaagaggtggccctgcctgcgctcctcctggctgcagagtaccccaccagcgcgtgagcctgtttccctatcccctggttttgagtttctggcctgatcgttgcatgcttggcttcactgctactttgtgaaactctttgctgagattttaacctgggctctactttcagggcacgatgggattgagacacatcttgggggatgggtaggcaggtgagcaggtctgaggaggaggctgggtctgccttgacctgtcctctcccatctctacatacttaccagtaatcagtgcttgatgctgaaggtcatactgagatggaggctatgggcaagagtttgaatctgtgtggtcttctgtgggtgctcactgacctgctgtatgtggatttccatgcaccagacacatgctcttagaatgtgcctggcagcttgagcaggattgagggatctagagctttcttctggctgcttcccccacaatcaaggagatttagcaagcaggtgcagggccaagttcagggatgtgggccacaggcaggccctttaaatccagtcatccattttgattcttctctccttgtggtatctgtcacttgtcaaaaaagacttcatcttctggggctgtcattctaagcgtcattttgccatactgttaaaattttctgagtgtttgcttgatttgtgtttattgaaactaaattcattaggatgatgtgaaaatagcactctgctgtttaccaaatcggattcttgttgttgatatttcagtacatcatctgttctcacttgaatgtcgtggaatttgttggtaaagtgctgtgcagatgaaaacccatattttagtggagttttttttattcaaataagtttataagtattatatacccaaggtgcttgatttgccatttgatgcagtctgtacggatgtgcgaatactggtgcttggcttgggctttgagagtttgggggtgtgctgggagacagctgcagggattaggactctaccaggtgctgagtcagaggctggttggaaatcctcctcctccaactccgcccctcgccagctgtttgactgctgccaagtcccccaactgtgggaaccccaggccttcatctgtgaaatggccattcctgtgtttctgacaaggctgttggaagacttcattgaagacactgtattggtttttcagcactttaacatctctggactcaagttgtgtcataaaattgatcacaagccatagtttaattgacggcatttttttttttctcccttagtggtttataaaatgatgctggtctaaggtttgatgatgtcttagacttgaagaacatgaacctgtttttgcaaaagttttagagtttggcattttccaacaaaaaggcagttgctggacttttgaattggtcaacgaaattccacttgttaccagaagatttactagttgcatttctagagttgttggcctctcttttctgatttgattcagtggtcagatcatccagggttcttgtgttcagagacccagagtgctataatgctt

SEQ ID NO: 63477 - DNA, 1087 bp, Homo sapiens
agaacactgggcaggcgatcaagctgggtgagccagacagggggatgtgtctggggcctggggagccccacccatgcaccctgaggtcagggctggcctttcacaggaggtaggctgtgagctgtgagggtgaggggccagcctgggcctccctcccagctcaccctcccctaggaggccgccccctgcctgggtccctccagccccttcgttctcatccttatctggatctgagaatcacctggagagctttgaaaaaagatcccagcttaatcctacccccaggttctgagtgtgtggtccacagtggcatctgccttggtaataaaaagttcccaggtgactctaatgaacaaccaggtagggaaccactgcccagccagcactcctcagctgaggccacttgtcctgttctgctcgtgggccggaagggatgggctggagaatcaggtaagtcctaacttcgctgccccacagactgggagcagggtcagagggcagaaggctgccctgggaggccgacttcttaaatgcacacctgactgacaggtacgctcctgctgtggggccaggcaggagagcagcacaggggcacccagggccacacaccgagaagtgtcccgagtggtgagcccagtgtggcctggcttcccatcggcaggtgagggtcatctttcagggctgtttcacttcctcaaaagaatgcagtggaatgagctccatagggtgaggtgcctgtgtgcgtggggatggagaggagggctagctgctgggatgccagaaatgaagggaggctgggatcttcctgccttggtccatgtgtagctggaaggagaaagcagccgttgcctaggagacaaagctggagggcttgactcagactatggacctcttgaggcttcctgcctgggtgggggatcagcccaggaaccccacgaggcgatgggggatgggatggggacggtcatatatgcatttctatagaaaaagaatctggctttccagtgtctcaagggattccgggaccttacatttttttcggagccctcagatgggaatccttggcctacaaaggtgggaggctgtc

SEQ ID NO: 63478 - DNA, 1027 bp, Homo sapiens
aatagtaatggctaatgcaccactcacaggctagagacaaagtagactcagagaagctcagtgactttcccaggaacacacagctctttggcagctgctgtatggaaaccacagtgggactcatcagaagccggttcctttgcacagttagccgagtgaagagacggacgggcacaggtatgtttggagttcttaagttcgtcatcttgcacccaagaatcaaggtcgcagggtgaaactctgtagttctggagcctgaaaggcatttgacatcctggctggaaacatacatttttgttttacatttattcgggtagtggtttgctggtctgtttttttttttttttttaaccatttggcttggagaaattttccctttggttatggtaattaccctttcctgatatgtaaattgattacagcggctctttccaatcttacacatttgattatccacgagcctccttctctgcctcttagttaatcttatttttagcacagtccttgaaacctcagcgtgagactgtccatcttccgctgtttctgaactgccgaaggtcattttcaccagccccaccaaacgcggatgtgtttcaagtcaaacacagccatttgaaccagtttcaaacagttgcctttcaagtgtcagcgtggtggggacaggacctgccgcatgaggtccgtgttgcttgggatagtctcgaatcacccagcgtgactccgttggctcccttggttcagtcggctccaggatgagtgcacttgaccagaagctccggcgacactgagattataagggagccaggtgagcggaggctgcgttgtggacaccagccaagtctgggtgggaggaggcaccgggacctatcagcaacctgccctggactttgtttcctcatgtgtgtgtctagggctttgcggatgatttgctccagatggaattaatgctgcagttgttagaagagcatctctggctccgcttctgaagctaatcaccacctctgtttttgtaagttagtgagaggag

SEQ ID NO: 63479 - DNA, 1110 bp, Homo sapiens
ccctgagtaaaccatctgaagcggagctgcatctcaggcagcctctgcgagcatgtgcttcacagaatccttcctcctggtgtcttctgggtgttgctgatttcaaggaagcctggtggggtgtgtgctggctcagccacccctcagttgcaaagctcttgggggccgcagaggatttcacagttcactgcataaagcaagtcatttaattttatcatttgctttttgagaaggatcaagttttcaaaatcctatgtagaaataacttatatacagtaaaacaccctttagcatgcagttctgcaagtcttgacgatctaggcgtcgccaccgggtggttgcggaaccatcccatcaccgaggaaagttctctgtgctcctatggagttcctgcctccccgccctgactcccagcctccagccaccactaaggaaatcactcctttttgatagtagaagggccagcctaggaagtgcgaggagtttggtagatgctggtgtgagaggccagtaatttccaggacatttgtaatatccaaggattatgcatgagccccaggggtgctctggtcacagcagatggacttggcttggatgacacccctcctctccccagtgccatcctagggatgcctgagactccaggagcttggctcgtctggacaggtcggaccaaaagccagtcactgcagtcttgagtcgtgtctgaaaccagcagataaccacctcctccgcaaagtaggcaaaccgcccccgtcccctgcaaacccaagagtgggcagttctgggccacacctgcaggccctggtgcatctaaggccatgctccctgggctccccagggacactcacaacagctgcctctccacactgtgtcccaccagcccctcttggaaagtgcctgggaacaggtgcctcttcgtccgccatagccgctggctccaggtccagagggactgtgagtgactgccaggccagggccgctttctcctttctctgtgggggaagtggctttggagggagccgggcagtgtgctaaccgtgtgcatgtcgtgtgtttgccgcgtgctcactgtgtacttgctgtgtgcttgctgtgtatttactgtgt

SEQ ID NO: 63480 - DNA, 1346 bp, Homo sapiens
ttttagtaacaaccctgttgtgaggcagtgcgattatttcccacttgaggaattggcaagccgcataggctgggctcacagttaattaatgatcgagcgagatccgaactggttctcctccaccaataccaggccgtccagagaatggttgtgtattcacatgaccccattctagggatgagcgggtgggtgcaaattcgaaggccagaagggaagcaggagaatccagtttcaagagtctggagcctttggtgggagtcccccgggttgaaaggtgaacttgaaagagcatccacgggtgtccttagatgaagaaggatttaagggactctgtttgccccttgatatgaggtttgtaactggggtcttgagcagaaaggaattgctcttcttggtttgagtgactgctttctggggagcgtctgggtgctttttgagttgcatgcagagccatttatggtgagagaaattatgacctgactaattggcccagggctaggtgttttggggctctgcactgaggcctctgtgcaaggagcttgtctgcttgaatatggaaagtgatagtctttggggccctggcagtttcttttggggccgcttttggacttgagttagcaaagaaatgactttatgatttatggtgtttatgaagaatacctatctgttttcacatagacatcttaatagagattaaatacaaaataaagtggaatgcatgaacggagatattcccataagcaatattgtagttttaggcagtgtaattatgttttgtacacttcccgattaagcagttatgcattactggggaaactaccttttagagatttagaaaagctttagaatttagtaaatcaaataaaaataggtatacaatattttagacatagggtttcaacatgttacatggtgtgataatgcagtgccattgaggtgaattttttctttttttgaaatggaggctcactctgtagcccaggctggagtgcagtggcgagttctccgctcactgcaacctctgcctcccgggttcaagcagttctcctttctcagcctcctgagtaggtgggattacagcactcccagctaatttttgtattttttagtagagacaggttttcaccatgttggtcaggctggtcttgaactcctgacctcaggtggtcggcctgcctcagcctcccaaagtgctgggattacaggtgtgagccaacacacccggccggctgaggcgaatttgcttcttctgaacattgcctgtggaatgaaggtgcacccctactgtgtgcgggatgtcgtgggggggctgccgggctacagggaagaagagcaaggagggttta

SEQ ID NO: 63481 - DNA, 1835 bp, Homo sapiens
ccattgcactccagcctgggcaacagagcaagacgctgtctccaaaaaaaaaaaaaaatctcacttagggccgggcatggtggctcacacctataatcctagcactttgagaggccgaggcaggccagtcacctgaggtcaggagttcaagaccagcctggccaacatggcaaaaccctgtctcttctaattagttttggagaaattgattttgtagattatattttagtctcttctagaaatacaaaaattagccaggtatggtggttggcacctgtaattccagctaatcgggaggctgaggcaggagaatcacttgaacctgggaggcagaggttgcagtgagtcgagatcatcccattgcactccagcgtgggcaacaaaagcaaaactctgtctcaaattaaaaaaaaaaaaaaatctcacttggaaaagcaaaatggtccttgaaaatgcccttgggaaaccacccatgctggaatgcaagggcatctcagctggccagggaccaggggtctggggccagaatgtcatattcttcaattgcaaatcctggagagtgtgcacaatgaataagatgtgggaagtgctcccacgctagctgtttgttaccattattattattagggacggtggtgctggtggtggtggtggtgatagtagtaggattcatggcaatcccagtagttatggtggcgtgaatgtcattgagaaagacaaatcctcccgtcaactgtgccttcttcttcctagcagggagtggctgtttgtgccctgttttatcaggagggagcagataagtgctagcaaccttctctggccccctgccgtgccctgccctaccctgccccaagggacagcagatacctttaatactacgaagcttgggtgggcttggtggttttcacgagtgactcagtcagtccccagagaggccctggtacctggggttgggggtgctcaaaaggttggcttctggagcaggggcgtccccaaggcacccctggccaggagtctcctgagggccccacccttcgtcccgatggagaagccctaacatctgtatttttagccacctcctccagggggtgcctgatgcagccagcccgaaactgccaacagcagcacacagactggctttcttcaaaaacaaaccactcccccaacacacacccacacactcgagtctagttattgaacatttggcatgaaaaatggttgaaagaagattttatataactcaaataacccactaaattatttgaaacttggaatatggatttctgctgtactcatcctcattctttgaagagggattctccaccctccaacattaccaggcatttctaggaaggcagaggaaatttcctgggtgtctgataaaattggagctagttccgtattcagatgcacttgacatttcactcttgaccgggcagcagtgtgtattgagatgaggctgggcagtgtcagagcatacctgctagaaaagaaattggttttgcagattatattttagtaaaatctgaactgctcagtgaagcacactattactatctatgtacacaagtcaaagatggatgccacagagtcgatgtttttaacattggcccgtgtgagcaagaacatggatcagcaaaaggtgcatttacttcccactgcaggcaaatatgcttaaccttcaggagcgcccccgaggccctcacttgtgcctctagcctgtttcatcatgatgcaagcggatttgggagtgatacctgctgttttagaactgagagtgaactcgttttgtggcaaatcctttttatcttgatcggggaatttattaattagta

SEQ ID NO: 63482 - DNA, 1083 bp, Homo sapiens
ggtggggctggcttagtttgggagcagccgtcttctttctcattgattcctggggcccaaagcaatgaactgaaaactgttcacgaggttaattttagtctgtgggatgttactacgtattaggtcactccaagaaacgctcagtaaaatatttactttctatttaagacctactttctcttcctggagaaggaagaaaaaaactgccttgcctgatgggcagccagggtgggggcccagtgctgccccagccaccctgcccaggtgaagcctgttgagaagggtcgctcaggtttgaattctcctctactgaggcctcagtacataaaccacagtgaacgtgggcatgacaggccacattccgaggagcatatttgttgaggaaaaggaactgtgtctgcccttccctctgtgcacacgtcatcatcatagctcccttcaccctcccaggtccctgaggaatgggtgcgtttgccggtcagtgaccagggctgtcgacttgcttggtggcatcctgtttggtttcttgtgggtgctcagtcagcagcagctgtggtaactggaccaggtgcagctgggtggcagatctgctgtgatgtttgagcatgttcctgaccccaggccctggcaatggggtggtaattaatcatgtcctcctaggatattcattcacagatactgactgagcacccactaggggccaggcacagtacgcatgtgcgtacagcatcaccaaatgtcttctgattgaaatgttcaaatatcttttctccacccagccagtgttaactgctctgtgcttcctgtggggctccaggtgtgaatagtaggtcatgtgcgtgaaatggcaaggtggggtaaggaaggtgcctgtccggcagttagtttgtcaccttcagagtgggctggtcatttcatggaccagcagtttctttggattcaactcatgctattaaaaaatctcacttggaggccaggtggggtggctcatgcctataaccccagcactttgggaggctgaggcaggtggatcacctaagatcaggagtttgagaccagcctggccaacatggcaaaaaccct

SEQ ID NO: 63483 - DNA, 1023 bp, Homo sapiens
ctctggcattcaactggagccatgtgcacacctgaaataggatctggtttgtgggttccacgttggggagttgggggtcaagagacagggaagatgcttaggatttctcctaactgtgatagtctgtttgcaccactcctgtgaaaaccagggagaaactaggttttgccgggtgaacttcctttgggtcgctcccctgcatccgtgtggtgtgggccttagaaaggaatttgaattaatactcctgaacaaagggaacagccttcttttcaaagaggctatcagagaactgacagggaatggcacagagttgggtgtgtcttcaaatccagagaccagccccgctccaccggaagagtacccggagcaggtgatgcgggagctcccaggttgaccttggctttccatagagggtaaggtccccacaaggtgaaggttttcctgaaaaacaggcttttctttataagattaccttcctattctacaacccttctcttctttttgtgaacacgtgtgtacacttgtgagcacatgtgtattctggaaatccttggtttccgctggggctctggtggggccgggggtggtgtggatgttgggtgccccccgcctccatcttggcctttggattctgctctgtcttgtggatgactcaaggaagtgctgggaggagtctcttgacaaatcagtcatgtgagtcccggtgtcctggctcacctccagcttgggtatgaatagagtcagcccattttaagtgccccctgcagtttttaaacaggtctccttccacttcactccacctggaagagggtggtggggccaggatcatccctgggccagccctctcctttctgtggtgcctcactgggacactgagaagggggaagctgctttctcagaggctgttgcttggaaagtggcatctaagcatgagaatgactgcggcgtgcaggttcccatgaatggtcatttcctgtgagccgggccttgtgagtggtcttccagagcccatgtcgtgtctat

SEQ ID NO: 63484 - DNA, 1029 bp, Homo sapiens
agagacagacctgattcctttatctcggggctttcagattacggaatagaagtcacactaggagggcaatcaataaagagtatattttgctgtacagataccaatatgcacatataagtgcctacaagtaaaatctgggaatgtttttgatcttaaaaacatttcacagtcattaatcttcacgacgctcctgcgggctgggtaaatagagcaattcctattttatgccaggaagaaatattgaattgcctcccccaagtcataaagaggctgtttttcctccttgttcctgtgactcgcggtgtggggggcctggggcgcctggaacccctgcgatccgctcagactgactccaggacgacttccggtgtcctgcgcgaccttctgttgcggggagcgccagtccgccacacctggccgcgctctacctggagggggcggggtctcctgcatttcccggaccgcgggggtgccccaccctgctgcaaggacgggcctcctggcgtccgggcttctggggtcccggggtcccggggttcctggctcccgagccccaggtgaagccccctccatccctggggttcgcccctctcctcccggcgggtggacctggaggccccgcccccgcgggccagaacacctggcggcgcggccccgccccagctgtgccctcttccccccgcagggcacttggcggccccaccctggcccctccgcgggccgcggtatctgacacccccgggcccccccacctcgcgcctcgcctttacacttgtaaatggagccgcttcccgccgcggggaagtcgttgagaggtgtgagaatgggccctgccccctccccccgctccgtgcccacttcctccttcctcccgctggcctttgtgctgggcggggccgctcggacccggggcggcgggggtccagctagacgccgcctcaagccagcagggtcgccggcccctctccggtccgcgaggccccggcaaggtaggagcctcgagaccacgcgggacaccaggttggcccc

SEQ ID NO: 63485 - DNA, 4008 bp, Homo sapiens
ttgttaatctggtcgtgtacacaagatgaaacggtaaaacttgctatctgtataattattaactagtttgtcagttaccctttcagagaataatcaataacttcagtcttaacttttaaaactccagaaattttactttttaagtctggaaaatgtttcaaagagagattaaatgaaacaaacaaacagcaacaacaaacaacaaaaccagaaaatcaacctacaactttttagtttctgagtagccagctacaaggcaaagaaatgatgaatatatatagtatgtactgaacaagcagtgcactggattttaaaatgatatttttattgttaccattgctgttaaaatacaaacagctcacactatttgaaatccttgagattcacggattgaaaaaaaaccgaaaaggacacctctgagtgagggagtagccctgctgagatctagcaccagaatgccatttgccaacagttcactaacatcatgaatcatttttgaaagcaaagttataccctttgcacttaacgctttccctaaatggaaaaaatttaaagagtttacagcaatggtagaatggcagccccagttgtcatttttttaccactgtcatttccatagagaggggctgtcatcataatgtatgtgcatgcagcctgggtccctctgttaatctatcagggaaaagcagcagccctagtgtcctgtggccctgaatcaggccacaaatatatattcatacagcacatggttgggaagggaaatttatcagttgggcagggcacagctcaggtaatatttccactttgggatggtaggtctgttacacagggtggaacatatttttgtagtaactaaaaaatgggagggcagtgtgtctgtccctggaaaaagaagtatttgtacttaatggaagtgacccatgtggtgaaatctcggggtgtcttttccccagcaatctttctatgaattgctaggggaggaatgcttgtgtgaacttaccctgctgaaaacttttagtgggcacatgaaatgctggaatggatacacttttagagactgtgcggcctggcagatatcagttttctcccttacagctggtaagcatgtcttaatttacgctgctgcaagttaaagttacagcactcctggaaagaagggaaaatgcaaggcttctcctccccacctcatcttttgaagttaattttcattcaagtctgtgtttgatggaatatgtatcaaagacttatgaaagagtttttttttttttaatcctatcttggggtttggaaaattatatttaataattgctaaaaacttaagaaccattttaaaggtgttcagtggcccttttgatcatgatttaatggagagtatccaaaagccatcagtgtgactctaatgatattcacaaattaatgtttgggcataatctggagtttgcttttagctatcattattaatgtttaaagcctaaattatggctgcacttgggcattcagaacttcgcctgtgaaaagaagggctttgcacattgtgtaaaaaaaaaaaggggggattcacaaatgaatacagaatgtacaatagggagagagccaggccattgtttgtgtggaatgttgaccatgggagccaagggctagtttcgccttcattcttctgactgctggagaacacagaaacttcaggagctgtggacgggatgggaaccaggggcacattcatccgtctttgccgggcatggagatttggcctgccccctttccagagtttttcttagaaggtggtcttttctggactgctaaggaacgtcgtgtgctttctcttctcagtaatctgcttttttgaggaacgattttaacggcagatagtaagagttcctcaaggaaagtaaacagaccttttctaccccctcgaaatgtgattttaggaaatgatattcaacttcagaaaggaggcatcttaagtcacaggaggaagttgtgtttatttttactcctctcctgactttaaagtagtttttaatctgttggtagcattagggagaatgcagctaaaataagtttttgctggatgttcatgttttgcgtagctgctgccatttcggaaaaagctcctcccccattcacaaagcccttctccttccacgtgggagccgaggtcccaaagtggaaccaactctgtagcttaagggaggtgcattcctggcccctcactttctaaccctcaccttaagtggaatatgtagataatatgtagatcattaaccattgttggtgtctgaagcctgttcagtttttttagcaacgacactcggtgagaaccagttgtagtttgcatgtgtatatgcctagtccctccctcagtgaatgttttagaaagtgatctgctttagctgtttacctaactaaatttaacagatggttgcctagagttggcttaatattcacaaaaattgtgatgaaatggttgggatcttatgaatgggacaagtgatgattttgtttctatagagaattgtgacttttgtcctaggtaataatagagacttcgtttttcccaaagatcggttggtgtttaaaggatgggaaccctgaatagctgctgttgtctgcccctgatcctggtggtggccagccttgcctttggttttgttgccttctgtgagtccagaaaagccctggaggcaggggtgaggggggagagggagggctgggcttttcatccgtggggttctaaaaatccttctcatttataaaatacaaaaatacttaccttccattgtattgctgatttgtgcttcctccaaagctctcctctgatcagcagaaatgtgcttcttgcattaaaacaaatccttaattatgactaaaagaaactgtcagctgccttaaagattgtctggaaatagtggcaatatttctgtgtctcattccagcccacgttgtggcagaagcctggaagggccacgttaaaggatgtgtcacagagacagtgtgtgtaggtcttcctgcagcacaagcaagctcagggcttgtaaagtccagcttatcgtggctgtgctccagccatgcctgaaatctggcctccagcaatctgtcccgtcccaggacaaacaaaaactttattatggagtcatggaacctgaggaagtttctctggaaggaaccgaagacctagaccgtggagggagatcaactcctctggcctaatggggcttttctttttccaagatggaatttaaaaatctcatctataaaatgaggctagcaaagaatcattttatggtgtaagtggccagaatctaacctggaagtgatagtattgtacctgccgcaggtgtgtgtgtggcagcgggagggtggagaggggaaatgagaggagaagagtttggaggggaaaacagagcattcgaggtttctctgctggagggggtgaaaggccaggagtttgtgcacctttccttttaaatgagctctagctgtgagtttattattttgctgatggatggtctttcgtgcagtctagaagtgcaaacacagtcggcttatccgctgcttgttcaggtccagggagaccaagggaacgggtgggggcagtgcttgcaaatccatctggatcctggacaccccacttggtgttgctgcagccagctcccaggcctgcccacctggagtacagccagcgccagcagcgggcagggcccgagagagctcttaaagccatgtcccaggaacggttgagggaactgagaatgttcagcctggagtggagacacccctgggaagcccaacattgtcctctgtgcggtcatgtggccttactctgctcggaacagggaggccttgctgttggagctgccgggccagatgggctgcgtgggctcctggcacaggcagaacttggctgaccattggctcccagtgccagccaaggctctgcaaacacccgagaccctgatggagactcaggctttgggagcacctcctaatgagctggggaggatactg

SEQ ID NO: 63486 - DNA, 1118 bp, Homo sapiens
aattctgttggatattctagagactggtatatttttatctgacatggataattttgaggggacgttatattttggggaagtttacaaagtgattctttctgcctttctaacttgggcgaaatatatcgactcataccaccctttcaaaaaagatagctttctctactaggtgtttgggttcgaagacagtttaaaaattacctcgtgttcagtacctaagattgctgttttgcctcgagggttttccaagtagaagtgggtagttttcatgtactttgagaattctgaggtttttaacccccccctttttttttaaatataaatcttttctattttgaagtaatgagactttaaaggatcttgtttttgtaatcacttgatttcaaaggatacttcttacagcaattataaagtaatagtcaaaatgctaattagacattttcagtcatagctgctttaatgttgaaacagaatttttttctttagcagagactgtatcgtagagttgaaacgctaaatattcttttgtctggcatcagatctctgaactgctctgacattctcctgaaaaacccctagtgccctttttattgcccccaaaagaaaagttaatgagatggtagatttcaagcaaaaaaacaggccctctttcttgcaaaatatgcttacagttgccattgaagttggatgttagccgtgaatgcacttgcctttaatgaaaccagtttaatcgttcacacttgatcaagtataacatgagcaaacaaaggaaataagccagcatatttctgtagagtgtaagtgttgatgttgggtcaccccctccccctaccctgcccccctgtaaaagggagagagggttgaaggcaaagggaatttatggcgctgattggttttttgtgccccaggggtaggggaccccagttacatccctgtggaaagcagttattagagggaattaaaagatcttgggtttggagcttgttttgaacctgactaggtggtttgggtttaattctttttcctgttcagaaagataaggtaaagaataccgactcccccccgctctttttttttttttaacccccacctgacaaccccctctctaattgtacctt

SEQ ID NO: 63487 - DNA, 1035 bp, Homo sapiens
cgacgcgccgcggggacaatacggccggatctccggggaacaggagtccgagcgcgccggggtgcggcgggccttgcgcctacgaggcgagggtggggggggcgcggagaagaggggttccgtggggaagtcggggcgtgagcggctctcggtccccaggggcgctgcccctgccggcgggggatcccgcgcggctccccgggagcgcaagtgaaagacgggaaaggaggcgaagtggaacccttttgttttgccggccccgcattgttggctcctccgggcagccgggccacatctgctgccgctgccgccgccgccactgccgcgcggggctcggcccgccaaagtcgcggcggggcggggggcctgggcgggccgggcggcgggcgcgggcgggggccgggcgggccgggcatttcctctgcccggccgcgctcccgcgggcaccacttcctcctcgcccgccgccgccgggagcccggcccgcccgcctcccccaccttccccgcccgggccgcacttttcgggtggggcgaatcaaaaagaaaaagtttagcaggaggggctggctagggcgcgccccgggcggcagggacccggtgcggcgcagggacagccgggccgccgcggttcctcctcctcccagccctccgcggcgccggacggccccgcgcggccgaggggaagcgcctttctttctctccctcgcgctgcccccagcgccccgggcgagttgggcagaggcgcgcgggagccggggcgtgcctgggcctttctcccgcgggaggcccagcggcgtggcgggtcgcctgcagcccacgccgcgccctggggctcggaggccgcgggcccaagagctcagctcggtcaccgcgggccgcgccgagacacacacgcgcgcacacactccctcccgtggctcgctttccgccggcgacgacggtcgcggacacggagtgagcgtgtgcgcgcgagtgtttgtggttgtcccccctccccccgcccggtactttttccggaggcggcccaagcggc

SEQ ID NO: 63488 - DNA, 1033 bp, Homo sapiens
aaataaggtttattatgctttaaaatgaatgaagctaaaatttaaaagattccaaatcacactaaaacagtctttctaaactattttttctcttaattttttaagaacataaaaaaactcctgaaaattccctacagcaagtcgcacgtgagcatggcagtacaccgcataggaaggactctcttactagatgagctagatattcaagaactctttatgagatcgtctcaggtaatgcttttgtgaaaaaatccaacaaaacattaacagcttaagagcactagaaatacgattttgtttcagagaatggccaaagtggaaatgtagttgagtacttcaacaatcgagaaattgaaagtttcactgaagatagaaaagcttgaatgaagaaaaaagaagagaatgagaatggtgaagaaaattattttattgattccaacagccagattcttttttacaagaaaaaagatgaagccaatgaagaaagttgtgaaaaaaactgtgaaatttaagggactagtttaatatttttaagaatcctttaacgtctcccttaaacagattctcaggaaacacagctactggaaaatgtgaaaaatattagaagctgttcctatgaataaatacagtcatgttcccataatgacgtttcagtcagcgatggactgcatataccggtggtcccataagattataatatactgtatttttactgtatttgcagtgttcagatacacaaatacttcagtcacatgtacagatttgtagcctgggagcaataggctataccgtatgacctaggtagggagtaggctgtaccatccaggtttctataagtaacactctgcgatgttcacaccaggacaaaatcacctaatgacgcgcttctcagaatatatccccattgttaaatgacacatggctgtagttattagaattaattgatgctctttagcctagattctcaaattgtatgttggtaaggactgtttttcccacatgttgagaatggatacttttgaaaaacataata

SEQ ID NO: 63489 - DNA, 1026 bp, Homo sapiens
atgacatttaaaataagtgcttttttcctttgaaaagaccaccgtttagttcatcatgtgagtatgagcctaggcacggggatgtgacagtgaacaaatcacaggccttgctcctcagcagttcattgtttggggttataaacacatacacagatcatttcaatatagtgtgcaaagtgggaactactgcagctgctaaggaacatgttatagagaagactcacctctcccagcctggcttaggaggaggaagacgggtttcctttaggaaacaaaaaacaaaagaaaggtggtatgaattgacccagaaagatatgtttttaatgagtatgtgtttatgaaactattcaaaaaataataggagccttttctgtaagctagtactaggtaacattgtttcgactatgtgtgttgtattaataatatgtatctcatgttatccagactggtgactggacatggttgaaagagttttatcaaagactcattgatcagaagtggcagaggaagaaaaagagcaaagagcactggtatcaaaaggcaattctttccaagtttttatattacaggtacttggctacttatttatctctaaagagaaaaagggaattctgatctaaaatttagtgtgaagcttaatgaagttataatttaagttttgcccctgtgatactgttaacatttgtttcatatttcttttttacaagatgtatgcttaattacagattgtagtttttataaacgggtagactgttgcatgaagttaactttagtaacagcaatccttttttatttctggtttggccagtatcaatggtgatggagccgctcagcctgtctcatccaccgcagaacagcaggaatcgtccagttcagatcagacaaatgattcggaaggggcttcatggcctgctcccttcgaaatgccttcttcagtttctgaagatcccagtgcttccagtcaggttagtacttaaatgctaattctagaaactcacataggaaaacaaagccttttttaacatc

SEQ ID NO: 63490 - DNA, 2020 bp, Homo sapiens
cccctgtcgacctcccacatagcttggactacaagcacatgccatcgtgcctggccagtttcttaggaatttttaaattcaatatagatagagtaggctgaaagagcagtggtaatcagatgcaccaaaaaagagaaaaatgaaaaacttagaaagtttagaataatctttaatctatctctcttgagtaagatctaaatgtgattcgcttcttatagtagctatgatcattagccaaagcaagccacccaatgaggcgtgttattatttgtattggcctaataattcacaatggtagatttgaagtgtgtgctttgaatatttaggtgatactctcaaaagtgggtcaattttaagaaatgttgacagcagaatcactccttatccttgcacttttcacagggaagtgagcctcttgaaccctcatacatagtggggcatgtggcctcagcccccaaagaacaaaacctgattactttattcaatgacggggagcacagtcaggtatgctttccatggtgtccaaggtgacagcaaatccccagtctactttgtcatttcaaaactagcctaagtcgaaattgatagggaaaaactccacttgatcctgaaactgctttctaagcatctttgtgatcttagctctggggcctgactttgtcttctttgtctcttcctttttctagtctttttatggatcatggggggaaattacagattgactgtttattataatcctccctattttaaatcacagggtcttaaaaatgattttgttcggaatattctatggacatttgaagatatccatatgttggtcggctccaacatgcccatatttggaggaggcagatacccagcagtcagcttacgtctcaggtgaactaacatcatacccctcctcaagcttatggtatttaaattcttcctttagaatcagtgttccatcagactgaggttgcagtgagccaagatcatgctaccgcactccagcctaggcgaaagagcaagactcgtctcaaaaaagaatcagtgttccatctatttgggcatcttcctctttctctaggttttttcccctccctccttcccctgccagttgaaatggccacattaaggaaggagctactgtcagcagatgctgaaaggcaggcctatagctgagtcttcattctagacctcattgaatagagccagaggtttgttggactggcctagtcttaggtctgaatctacaacttgtgagaatattcaagagagtttatttaattagttagattcctactaactacttgtgagcatttttcttaatgctccacgtgtatttgttgatattagccaatgtgaattccaacttaagcatggtcttgtatggtgttcagtctttcttcaagttgtgtgtgaggagcaggcagtaggctcaccgtcctttcctattatattgtcttctattcttactgaaaacttaccaatgtcagttagaaatacaagcaagcttttggaaagatgttaaatatagcacaaccactgagctgcatgtgcatatcttatcagaaaagaaagcatagatggcattttctatctagagaggacagcttaagatacttaaatggtgaaataactttcagatgattaattaaggaacatcttaattaaaccaaataacactagaaatgtatatttttagggataacaacaaaccaattaatgtgctaactggaattgactattggttggacaacttgatatgcaatgtgccagagcttgtgatgtgttttcatgtaaatggaattgtacaggtaagatacagtgtgatttttctgatctctcaaatgcaaattggtacagagagttcctcaccaaagtctttacggccctgaagtactaaggtgcatttttgccagggaagatagctgtgaataaactgaatttgagtgtacatttaagttggtgataacagaattgtagatgttatagaagtataattttacaggtaatttggaggaagttcataaatata

SEQ ID NO: 63491 - DNA, 2128 bp, Homo sapiens
aaaatgcacttgcttgggcccccagtgttctagtatcagtaggatgtgtacttctgtcttttctgaaagtctgctgtatgattctggtttgcagtcttgattgaaaaccactgttagaccatctccctaaatggcaacatttagtgagaggctggggtgggagtggggagcaagagaaaagagagaggcagataaagcgttagcaaggcggaggggaacaggagtcaaaggagattccagggtttagggactagaataatggtggtgccatttagtgagataaggatgttgaattggtttagacagggaaggtaatatgtttttgtcacatgttcagtttgaggaaagtataaaaatgtctagtgagcattttgaagttgcagccattagagaaataaattgaagcatcatctgcctagatactgtcagatttcatcaccagaggaatctattaaaatcagacattggagcctctcctcataggggtaaaaatagaagggcatttagagagagagaaggagaacaagaatagcacagattaaaatacaggaaaggagcattttaaggaaggaaataatcaacattggggacttcacatgaacaaagtggggtgaaaatcaacctcagacgattgtgtttggtcttacattccagttgatttgaagtttccagttttagagtacttcagaaaatgtggtaggagatggttaggagagtgtgcacagaagataaacaagaaaaatgcaaaggcacttttaaaatagtggtagtaatgtccatgaagcctttactcttattgccacctccattcccccctgctccatccctgtgaagtaataaagtccatagatgaagggaagagaggtgtctactggaaaatttcctaaatgattctctctccttgagtcactgactgtagtttctagcaaaaaaaaaggccagaaatacatgtgttttaaaatcttgctgggtaaagcctaccttcatttaccatcttcccagttgaaaaccattcaagtggaataaaagtagtcagtatgatttgttccatgttagaacagaaataagatcatgcctgaatctgaggttctaaatctggtagtgattctccattgaaattactccaatagtgaactgcccttgctgatggggtggatgagattcctttgggaggctggggcagaaaaaagattaaaaaccactggtttaaacactttcatgctacataggtctctgtttgcaggacttctgcatttggttgctttttaaaaagaaaggtgttgtttccttgggttttctcttaaactgctttccatctgtctgtattttacagaaatatgaaatgataaagacagaagaaattcccaatttggaaaattctaatttttctactaaagtcataaaagacattgcacagaatattttatcatttttgaaatctaattgtaccaaagaaggacatacctattggctctttaaaggtaagctattaatacttcttgagtgaacaataattgatttgggtaactgctgtgaaatgagtcttctttgtttttcttttcagcaagtggcagcgatatagtgaagctctatgacctcactactctttgtgaagaaactgaagacaaataccaaaatccattcacaatgccggtagccattctcttgtacaagtgagtgctttaagaatttaagatgaagaagtagcctattatataaagttttaaagcatacagtcacagtttccaaaccaaggcttttaaatgcttttaggttttcatagtagggggaaaaatacacgtacacattgtaccaaatattactcagctttcttatgccaccatagtataaacgttttgggggttgtgggtaaagtgtaaagtttagtattttgttgtttcttatagctctttgttggaaagaaacaagagcactcctagacttgagtcttgcagacaacgatgaaatgggcagtaaagttgatataaactctttttttagggttgcttgcaacatgatgatgaagaagaatcaaaataagaaacactatggaactattagaacattgcttcttaattgtctgaaattactggacaaaagtaggcatcctcaagtaagattaacattt

SEQ ID NO: 63492 - DNA, 2093 bp, Homo sapiens
aaatttttgttaatattttagttatgacactctgtactcaaaagcttttgtttgtctccagtgaaattcagttgacaccttttaagagggagggctcagggtggagtaatttcgggaaataggaaatgcatcagcctataaagattttgcagagcatacccagagtatcagtagctttgaactgggaacatttctgtgtgtgttacagtctatatggtggaaacagcctgtgtgcagacctcctcctaaaattcgttagtatggtagtaaaattcatgtattttttgatgacagtaatttacacatatttctctctttttcataagattattgcttccgccaattacatgctttcagaactttttcaattggatgaacctaaaaaggaagaaaattcagaatctcctttaaatgagaattctgatgaaagttatagtgaagaggaggaagagatgcccgacagtgatgaaaatggatcctatagcaccagctctgatccatcagatgatagcaaagcagtagctataatcaagtctgttggagaactatcagtaccagaaaaatacaaatctattcatcaaatcagagtaagcctttagaatttatattaaatttttatcaaggaaacataattgttaatcgaatatagttagcctttcaaaagataccattacttcaataaacctttcatggtctagcatctagtaatcattagttttctgaattcttaaagttggttttataattgttcgagggtaactgacccacattatgcaagcctatagtggacaggtgtgtaaaccaggtgtctgtctattcttatgtgaaggattttcctttccagtgaccagtgtgtagtcatagtcatgtctcattactagggcacttctatccggtgttggggttgctgggaaatgacatatatagattgcttggtgaacatagagtagagaagggggtggctcttggaactgtatatggtgagctctggtacattatccctgtgctatataggacagtacttttttcgtgactcttgtggtcatgtctgttgtattggacatgtctctgccctggagagggccagacagatttctccctgtgtggattgcactgactctaccatcagtgtatctccaggcagtatatacctttcaacataccgtctccctatgattagatccaggccagccttaagagttctggctgttccctgaactgaaatacagtcgtatttacagataatctcttaatttaagcactgagtgtaactttcagatggaaactctaagcaagtttttgaggggctatgtctgtcaccttaaaacattgaccatctttctgaccttcacttgctccattggtttgccgtggccatgctgggttttttttctctcaaaagcatcaagattatgctcattggagggtctttgtatttgctgttgcttctgcttggaatgtacctaccctaggtctgttcatggctgccttttttaaggcttaagtcttgactgaaatgttgcctcttcagggagatgttccctgaccactctggccaaagcatgctctacttttttgtccttcaaggagcctatctgttcctgaagttcttaatgtttgtcttgcttcactagaacgtaagctccctgcaggtacagaccctctatctcccatgtctagaacacattatgggtgctcagtaaatatttgactaaatgactgcaggaaaaagtcattaactgtccatctaaattttagttcactttcagcttgaacttccacagtggagtgaaaaaatgttctggttataatcattgattgcaaaagttacatgtatctggaaaactgcattgtaacactaggccatggacttacggggcaattaggtaataattaaagatgtaatgagttagtgtcactatttttcacagatagcactttctgttccgtatctgaagcactcaaaaaatgcagtcttagtattcatataaacatgtctttagttagcctttccttatcctcattgaatgactttgtggtatggacagtcagcatgagctccagggtcccagctccccactcactcaccgtgt

SEQ ID NO: 63493 - DNA, 1049 bp, Homo sapiens
gctgggtgattaagtgtggttttgtttttggtttcaatataatggccatgtatttgaggattggggtaacaaggtaggaggagatacttctttttacgtaaaatttggcaagtttttaatctaatttactagttatataaactgtaattttcatttagaaagaaaaaaaaaaacaaaggaaacaagtgcatcatcatgctcagcctgagtcagaaagcagcagcacggattggcttcttgtagccttgagatgggaacacagagtggtcttcagtctactcggaataactttcttcattgaaatattttcattgacttacttttttcatttcctcataatattgtctctttataaattatcccaaaattaaattaacatctgggtagttgtgaagtgtgttttattttaatgcagtattggtatatgtttaagctgagtcagaaatgtacactgttttctcctttgcaggctattgattactatttgaaagcgctaaggtcattgggaacacgagacatacacccagctgtttgggattcagtgaactgggaattgtccactacttactttactatggcaactctacagcaagattatgctccgttatctagaaaagctcaggagcaggtgataatatttgctggagtataaaataagttctcaatctaattcccttgtttaacaaatatttagcgtctgttgtcttttccctaataagcagtatttaaacgttttaaaaactcctacagtcagattagaagcttatttttttcttccccctcaaaacaagaacagattgagaaagaagtcagtgaggccatgatgaagtccctaaaatactgcgatgtggattcagtgtctgctcgacagcccctttgtcagtatcgagctgcaaccatccatcacaggctggcctccatgtaccacagctgtctgaggaatcaggtattgtcagtccaagttaagtacagtgccacatcagtttaaaagtgttctgggtgctttttgtttttttaacatggtcatatatgtcttccttgacgtccac

SEQ ID NO: 63494 - DNA, 1775 bp, Homo sapiens
ggcctcccaaagtgctggaagatactggaacaaatttgctaagatgataagtgtgtttaattctctcctttaaatgttttactactgtgagtactttagaaaataatgtaaatattttagagggttttgttagccaggtttgtgggttttgtaagccaagttaataaatgctctagtttgtgacaccttttattctatcttattttacccagtgtttttttttttgttttttttttctagtacatatgattcagacctcccttcctaatgtctatattgtctggtcgttgtcccaacaacactttcatacataagcaatagcttgtcttccagatgccaaatctatgctgaaatcacattgatccattgattttaaagagaataggttgtttagaaagtgtgggattatacttctaaaggaagaaggcaacagttattctctccccacccgcagagtcggggagtccccaagaccattgtcacttctcacactaactacgagtctgtcggcggtctccaagaccaccctcaggtttgagaatttgctaaaggactcacagaactcactgaaagctgttctgcttacagccacaatttcttaacaatgaaaggatgtacattaaaatcagccaagggaagaggctcgggaggcagagtcctggagagttctaagcgcggagctcccagttcctctgctgctggagttacagatagtgctaactcaccccggcagtgatgcatgacagtgctcaccaagtgtatcaatcaatacatgtacaactgcggaagctcacccaagccttggtgtccagagttttcattggaacttggtcagatagacatggttgactgccacgtggctgatctttgtctccagtgcctccagaggtcaagctgttaccctggggcccaaagtccccacagtaaatcccattgttaggctatccattgtgacccaaggacccccaggtaaacaaaggcgttcttaccgggcaggacatttcaaggacttagtggttaccttctgggagccaaggacaaagactaaacctctgtacaagatttaatcctctactgcacaccgcacacaattgagttctaggagaacaggagcaaaggtgtcctgtagtatctgatagctctagaaaaattgtagttagaaggctctagaataaaacaaaaccttgttcatctggtctgacttcctgcctttgaacagagatgtaataaactattttacagataggacaactgatactaagtgcttatgtgacttgaccacacaactggtaaaatgtgaggtgggcctcgagccccagactcttttctgctggtcccttttcctaaggctcctgttctgaaaaagtggcctgtcttgacaaaaccaaatggtggggcagggaaacaatgattatttattgctttgtccagacttagtatttttgtcaagggaatattattaaatagaagttggatttagaagatttaagattctcattagcttcctttatagcattttgaaagtctgaattttcattaatacattaacattagatgggtttctagatttatattaaagaaatgaacgttttgtatttaaaactttaggtcagaatagcaatgttggaaagttgaaaacactatctggggctcttgatataatggtgagaactgagcacgcattccagcttatccagaaggagcttatagaagaatttggccaggtacatggagaaaatgactgtctttggtttttgtgtgtcttaagctacatg

SEQ ID NO: 63495 - DNA, 1064 bp, Homo sapiens
ttgcctggtattcatctcctttctttaatttgcaagtattttaaaatatttttaagaatatatctcaacaagaccatagttaacaaattataaagtctcttaagtttttttgttgctgttggtgggaatttgttttgttttatgttttaaaagaaaaggcctgtgccctcttttctaatttccactagaatgcctgggagcagttgaatggtgaatgggcctaagcaggctcctcaggaaggaatttctcgttttctgggcattccggcattcattttaccttctgctgttgctaaaagcttcctgaagcccccatgttgcgcccacctattgctcttctagccctgcttggtcaaatcctgtgtggtaccgtacatttctgcgttgtgtctaatgttggaaagtcaggattaatttcttctacaaaagtgcctattggggctgagacattttaattatgtgttttagtctatcaaaatgatcataggtgtgctttttgtttgtttgtcttgtttagggttaaaaatgtattggatgaatgaaactgcagttccatcacttggtacgatatgaaactacagttgttggatagctcgagtaaaataactttttgttgtttttagcctaagagtggtgacgccgctgcagctgctgatgcttctcctagtctcaatcgagaagaagtgatgaaactcctcagtatatttgagtctcggttgtcatttcttctccttcagtccattaaactgctatcttcaactaaaaagaaaacaaggtaaattaagtggttatttgtaggaatttctttcctagcaccctacctataaaaattttctctactaacatcataaagaaaaactaggggccaggcacattggctcacacctgcaatcccagcactttgggaggccaaggcaggcagatcacttgagttcaggagttcgagaccagcccggccaacatggtgaaaccccatctctaccaaaaatacaaaaactaaccggtatggtggcgggcgcctgttaatcctagctacaggggaggctgaggcacgagacttgctt

SEQ ID NO: 63496 - DNA, 1404 bp, Homo sapiens
gcagtggcgcaatctcggctcactgcaagctccgcctcccaggttcacgccattctcctgcctcagcctcccgagtagctgggactacaggcatccgccaccacacccggctaattttttgtatttttagtagagacggggtttcaccgtgttagccaggatggtctcgatcttctgacctcatgatccacctgcctcagcctcccaaagtgccgggattacaagtgtgagccaccgcgcctggccttatttggttgttaatccacagtgtctgcaccatatcctggttgtggtacacagcagcgggtgttgatacactcactgtaatttagcagagacatccatctttttgaagagccctaaggcggagcagatactgcatatggtaacaaggcttggaaagaattcctgcctttttctaacagcagtgggtaaagtttttaaatttgtattggtttccacaagatggtaatataaatatatgatacatgagaaaaagtgattcattgatttttcacaagtcaatcatttgagtaattggtaataggtaatagtttcagttttatcttttataactgtaacagtcatatgtatgacctaagtaatttttattttaatggaaggttttctaagcttctgtttatttaggttattaatattctgctgaaaactattgtaatctaaagttttcatgcatgacacatacaatcttatttagctaatttatattgattttaaggtttattaaacttaaatgtgataatgtgttaataaaataaacactttgacaagtttcaaaacaaaaatattaattactaagtcagtgactatttcatttttcactgatgtgcaaatgaaaacatctataattttattgttaagaggaaaataccctctgccacaggcttagttgtttcacagtgaatacatgaacattctcttttgcaatatagagagaaatcagaatgagacctaaaagaaagaaaatgcaatcagccctctgtatccaaggattctgcatccacagattcaaccaaccacagactgaaaatattaaataaataaaaaataatacaaatttaaaaagcaatatagtataacaactatttatatggcattgacattgtattaggtattataagtcatctagagttgatttaaagtatataggaagatgtacacagcctaaatgcaaatgctgcaccattttatatcagggactccagcctcctcaaattttagtttcctggagggtcctggaaccaatcctccacagatactgagaggccatgttaaacaaatttttgttttattttttgactactgctttttccacttcatgccctctggcaaaaaaataaacaaggcttaataattaaaatcttaagtttattagattcctat

SEQ ID NO: 63497 - DNA, 1006 bp, Homo sapiens
cttctggaaagaatcaacgttatcgtccacctgctgggccagcttgccgccggcagtgcagcgagcagcaatgccgttcagtgactgcacagagccgtgtcccagacacgctgtcagtgccttcaacacggagccggtttgttcattcggtgctttgtttcattaaataatagggaaatatccatttaaaacaggtatatcagtggaaacacagagttattttaagtgacagacaaattacggttgagttctgtggcttcttcacttgaagtgctaacatcagaatcaaacttaaagcttccactatttatgtctttgagaagtatgtagtacctcggtattaacagacctgctgtgatgcagttacactttcacgtatttttgaagtatgtcaagctacacgggtctaagatatgattattttggataaaatgttactttggtcaagagaacttttatccagatgacattacaggttcaagtgggttaaggagacctcctgtacatctacagtgtttccttttaaattgtccagaaaaaaggtgtgttcttcataagcttcagtgcaggatttttcaaagacgagctgttgtgcaatttgctgtatttaatgcatgttctgaaaggattcacttttgactttatatgacagttgatcaagaacaggtactacccctttttttcatttcaaacttgaaactgtgaataaggtaagaaaactattttgaataaataaactatttatttaaaatgtctttgtatttttccaatttccattcttcacattgagttttgatttgaactcagtctaaaattaataaactttacaaagcaaagctcaaaacattaaaagtaaaattctgctgtccactaaattctccctagaatattttacttattgctgctgctacatggctcttgtccagttacacacaaacatcccctgttctttgtaatggctacagtgcacaaggctgttttcgttcataattcatattttcaattt

SEQ ID NO: 63498 - DNA, 1001 bp, Homo sapiens
tgttttcacatttggggaagattctggcatttgacaacttatcagcttttttggacagtattgttgcaaattggcattcaaatcctatgctgtcctcactattctgcaaagagttaagggctgaaaatgcccttaagtcttcccagagtggagatgctgggagcagaggttgtggtgaaaggagaggcaggccgttcttagcaggcttctctctctaaggcctgtgcattcgccttttggcacttggcctagtggctgttggtgtggctagaagaggagtgggcagtgagcttgtctttgttgggggtggctgcagagccactcctggctgccggttaccggctgcctcctgagcatgagccctggctcatctggagcctctttaaaggtagaaaatgtttgccccagtgccagtcagcaccaggcctgatcttcaccttcctgacttagttaaggtgcaaagtctgccttctaaatagtgactgcaggctagggagtcacttcaggatcagaaggagttaaaagaatgtggctaacttgtttgtgtggatgttcattttctgagcacctccacacacattacctcttatgatcttcatataacaacccttcaagttcggcaaggtagcaggtgctcttcctgtttacagatgctgaaactgagtcctagaagcagagccaggcctggagcccagggctgcttcccccttcccaaagctgcccctccccattcccctgtgcacaggcactggccctgagttttcacaaagcctggttatttattcacaggggagtcctcagcactgcctcttctatttccctgtggaaacctcaaaagagaaatcctgccaaaagcgctcaaggacaaaggcgagtagaatgctttgactgcatcccttaccactttgggatccaccaggagcctttgcagtgatagaagtgggtggccctgcagagagcacacaagggagagcagggctgggttggataagccaggccag

SEQ ID NO: 63499 - DNA, 1026 bp, Homo sapiens
ggcggggggccgggcccggtgtctcgcgcctgtaatcccagcacttagggaggtcaaagcgggtggatcaccagaggtcaggagttcgagaccagcctggccaacatggcaaaacctcatctctgctaaaagtacaaaaattagccgggcgtggtggcggacacctgtaatcccagcactttgggaggccgagatgggtggatcacttgaggtcaggagttcgagaccagcctgcccaacatggcgaaatcccatctctactaaaaatacaaaaactagccaggtgtggtggtgcgcgcctgtagtcccagctactcaggaggctaaggcaggagaatcgcatgcccccaggagacggaggttgcagtgagccgagatcgcgccaccgcactccacactccagcctgggcgacagaggtagaccctatctaaaaaaaaaaaaaaatgcttcggggccagtggggtagtctaggttaaagacccgagcctatttggagagaagagtggaggggactgcggccaactgcagagcgagcgccagcccctgtggcaggtggggatgcagcctggggcagccaggtcttcccattgcgagagaaacagggttcatcagctttctaggaataagatctgcggttctcaattgatttttctctgtaaaatgaggggggtgggttggatatgtttgattctaggaatggtgtgagctgcgctaataggctgcttctgtttaagcagggtaacatctgataaatcagtgatccttcatcagtacgagatggcgtgccctaaaggtccccaggagcccagattgcccataatcgtgttctgtgatttcggtctttcctgggagtctcttgtctacccagccatgtcatggatattaaagtaatacttacacatcagcgctccacatctgatggggcagcttgaaatggcctctttgggtcgcacaactgcaaaaacatgttcctgtaatggagaagagaggaagctgtcaaaaaagacccatcaaaaggctaagat

SEQ ID NO: 63500 - DNA, 1125 bp, Homo sapiens
ggtgtcgcgcagtcccagcgaaaaggctgcaggagcaatgacaacaggggcggaagccccctccccacgcagcccgaggggccgcggcggccacccgcgccgggccccaggaccccgcacctcagactggggtcgcgtgggtggctgcgcgcagctaggcgctcgcgcatgcgcaccgccatccaggccacggaatgaggccagaggttagatgggttgaaccactacgggaaggggaggggaagctttgggaggagtgatggagggtggaaagcggaagaaaaaagcaagatgggaccgcaagctggacgtgactgtaaggggtcatggctgcggaatccagcaggggcattggggttgacgtgcactcagcgccgagcttcttcgtagttcctcacccccttggctactatgggctggtccggaaggtcaggcaaggggaagctgcgcaggcgcagtgtgagcggcaacatggcgtccaggtctaagcggcgtgccgtggaaagtggggttccgcagccgccggatcccccagtccagcgcgacgaggaagaggaaaaagaagtcgaaaatgaggatgaagacgatgatgacagtgacaaggaaaaggatgaagaggacgaggtcattgacgaggtgagaaggacacgctcccctagttggtttatacctgagaaaaactttttggcaagcccaggctgtgtaaaaatagtgtagggtcttccctgaccctgagggtctgtgaggagaaactggagataagttctttctcaggtttctcctcggtctttaacacactgcagccatagtagttattttttaaaggtctagtccggtccagttaatctcccaacccgcgtcctccccgaaaaagcccgccacaacaggtgtgttcttctcgtcctctttagttctcaggctgaagcctcagatcctgaatcggccaccccgggctcgcagagggggccctctcccctcggggcagcagctgtcctcctcttcactctgcgggcggcactcacttgggccctcagtttcttgaaggctcttgccgcgttctaccgtagaagccttttcaaatgctcttctttatcctgcagttttcccttccttcttcagatctca

SEQ ID NO: 63501 - DNA, 1050 bp, Homo sapiens
tttatttctatgaatatttccttaatgcctatattccttcctaaatcgtaagctgcacgagagcaggatcatttgtgtctgccttactaaccttttcatcttgagtgcctggcacagtgcttggtacctggattgatacttaataaatatttgctaagcaaatgtagtgtaacctcaaatccatgggctaagtcaagctctaggcaattccagggacttttgaagtgattttgatttttgcccacccttgtaatcaggaaaataatttatcctttgtggctgccgtgtctggtttatttgaactggactttctcaacatttaaactaggttactctgagtgttttgttttctcaggcttttgtgtcacctgaagaaatagtgtgaaggtgctttgtattcttcacagatggcaatcttggcaatgtttgcctgttttaaagtctagatgtttgtagtttttctggtaacaactattttgtgtgttatttacaggaagtgaatattgaatttgaagcttattccctatcagataatgattatgacggaattaagaaattactgcagcaggtattgtcttttatttattatgcataaatttcctcttctaagaaaaatcaggggccgggtgcagtggttcatgcctataatctcagcattttggaaggccgaggtgagaggattgcttgagcccaggagtttgagaccagcctgggcaacataatgagaacctgtctctacaaaaaaattaaaaattagccaactgtggtagcacacaccgttagtcctaactcctcaggaggctgaggctggaggattacttgagtctaagagctcaaggctgcagctatgaatgtgccattgagctccagtctgggcaacagagtgagcctctgtctctaaaaaaaaagaaaattcaggtcattcaatacaggctctcccaagttcatctttttagaatttccatttctatcctctccaccttgcctggaaggaagaattatttcctttcatctgctaattagagttattttgtttttttttttaattca

SEQ ID NO: 63502 - DNA, 1034 bp, Homo sapiens
gtctctctgcagctgttatctttgctacttgtgtagtggggatattctcaggctttgctgcctcaatgttgagggcatttactgacattttattttgtttcgattcatctctttttattgattctctgatgagttgtaataaaaagtaaaccagctgcttacccacctcagaataagatgcaggctacacttagtctttaattttgaaataaactgtccagttacttccatctatctttatgagatggactagagttgccattccagtgtgtctgaatgttaattatgactctcttaccactcatcatgggatggtaaataaccagtgtatttacttttgagaaatgcttaagcagtcaacactgaagacatacaagacgttaaggctatggcaggaaactgcccttagctgtaagatgaaaagtgatagcttttactctcaggttttgtcctctatgtgatggcttgtaataggaaacaagctttctctttgctttctagggtacccagtgtgttgaacaaattcaagagttggttctacgcttctgtgagaagaactgtgaaaagagcatggttgaacagctggacaagtttttaaatgacaccaccaagcctgtgggccttctcctaagtgaaagattcattaatgtccctccacagatcgctctgcccatgtaccagcagcttcagtaagagattctgggaaaatatctttgaacagtaatttttttttcaaatagattcctaaatgtcatttaagtagaatatgtagatatagaaagagttctgtccttggtttaagtgggtttagtgtgaggggagtggaagaaacatcctgtgaagtacatacattattaacaactggctttttgaagagtttgtgacaataatcatgaaattttaacttaagatttaagtgatatataagtagataatttcatatagactttgcatccccatttgattgaagtttttcaccttcacagatagctttctgcaacatgaataaaataatgaacaattacaacaataac

SEQ ID NO: 63503 - DNA, 1138 bp, Homo sapiens
ctctatccctgttcctcatgtgggtttaaaatctacttggtttgtgttttataacttctgcctgaatgtcccatttgaactttttcaattctgagttttgcttttttttagctctcattcttatttaagcatatgccaaacgtaatattctttgccgtagatcaaatgggttttgtctttgggttgtcccgatttttaattcatggttacttatttggtttagaaggcaattctcaagttcaactactcagtgcaggaggagagcgacacttgtctgggaggcaaatggtcttttgatgacgtaccaatgacgcccttgcgaactgtgatgttaattccaggcgacaagatgaacgaaatcatggataaactgaaagaatatctatctgtctaacccatttccaatggacagtgatgggcttgtttttgtaaaattaccagaaaactcagtggagatttactgaaaaactcagactttattcagattaagttcctctacaaaaagtagggttctgtcccatgtgtctctgacacatttacaaaataccagttttttaaaattttggtcaaattatgagtggttgatttaaaaacttttccaagaagaagaaaagcatggagtagtaatttaaagaactcaataaaaacttctattttttattttaaaataatatacacagtgttattttcttcaagaccgtcctgtggatgtgaaatccgtcttcgcgtcatgtatctcccatatccagcagttcagccatccagctacctttgggaccctgctgcaccttgtgtttgctggggagtcactggagagtgcatctctgttcagtttcagggcacgtctcacacatttgctgttccttattcattgttgacacaggggataggtgatccactacttgctgtagaatgtccttactttcactaggaggcagattactgaaatagtattgtggtaccagctgcataaatctgtttatttaagacaaaaagatgagattatgagtggggaaggtggtgagagacaccaaacattatgtctgggcacttcccatccctggagaatctacctgtagaaccggtatttaatttgaactcagatagtatctcagtccgactttgtaaaataaatact

SEQ ID NO: 63504 - DNA, 1017 bp, Homo sapiens
atactagatttcttttgctgaaataatcagtgcagatgaagaaaatgtgtcactagaggtgtttttccccaaataatgttgtgtgcctgttttttatttcctattggcttcattcatcctggcttgtatgttttaatttattctaatactgggggaacagaccaaccattgtgctgtatcggaactggttccaatcctcttcttgtgtctggacctccaagcacctcaggttttccctgctcctgccggaatagaagcaggatattaaccatattcagttgaccttagaaaagcaaacacacacacacaaaaggagagggagaattaggatgactcactctaaatttctgggatttctaagtaaacaagaataacatatttattcagagtaccaagacaggagccatgccactaacagtcgtgacccctcccctctgcatgttaggctaagataaaatgtcttcattattgctaaccatgtgacctttttcattttgaagctccaaattgcttttcacatgtgccacatggagctgaagaggctgccttgacttgttggaagacatttttacatcccgaaggagatcactttaccctcatcagcatttacaaggcttaccaagacacaactctgaattctagcagtgagtgtaagtgaatgctcagaaactacctattaattccaccttcctttccctagataagtctgagtccttattagttattcatcaaacattcttcgccagccctactggccacttgaatgcaatggcacttgaggccctaaacgcacccacaggcatctgcagagtgggagatgctcagtccccctgctcccacggagctctggtgtgccaccatggcgggcctgtacttccagagctccaggactccactcagccagccttcagagcaagcttgcttggggcatggtgacgggggacacagactcgtacatgggtctttggaggaagacaagaacagccacctctacgtgcccactgtcagagttgtgct

SEQ ID NO: 63505 - DNA, 1039 bp, Homo sapiens
aggaaggtggaattaataggtagtttctgagcattcacttacactcactgctagaattcagagttgtgtcttggtaagccttgtaaatgctgatgagggtaaagtgatctccttcgggatgtaaaaatgtcttccaacaagtcaaggcagcctcttcagctccatgtggcacatgtgaaaagcaatttggagcttcaaaatgaaaaaggtcacatggttagcaataatgaagacattttatcttagcctaacatgcagaggggaggggtcacgactgttagtggcatggctcctgtcttggtactctgaataaatatgttattcttgtttacttagaaatcccagaaatttagagtgagtcatcctaattctccctctccttttgtgtgtgtgtgtttgcttttctaaggtcaactgaatatggttaatatcctgcttctattccggcaggagcagggaaaacctgaggtgcttggaggtccagacacaagaagaggattggaaccagttccgatacagcacaatggttggtctgttcccccagtattagaataaattaaaacatacaagccaggatgaatgaagccaataggaaataaaaaacaggcacacaacattatttggggaaaaacacctctagtgacacattttcttcatctgcactgattatttcagcaaaagaaatctagtatgttttcatacatctgatgtataaatttgctgaactttgagttagttttcttaagataatttttcatattaagaaaattttccttttctaacctattaaaatacctcactatcatttcaaaaggttaaatgagttgatcactatctctgctctgtgctcctcaaaatataatttcaaatggatccgatctaaatctatacctagtgcagatttgcaaaaaaagaaaaggaatagtcattaaggatacctgttaccatggctgcgattgttagcacttcatctacacagtcaaattcacaggacgctaagatagacttcgagagttgtggatcaagaggaaactctgac

SEQ ID NO: 63506 - DNA, 1432 bp, Homo sapiens
gcttaaaacacaatagctgataacagaagccatatttttgatgggccttctaatcaaaaagaaaataatctctaaatacattagtcttttcagaaacacagttgaggttgaaagtattttttttttcatttttgtccttgatttttttttttttttttttgagacggagtcttgctctgtcgcccaggctggcgtgcagtggcacaatctctgctcactgcaagctccgcctcccgggttcacgccattctcctgcctcagcctcccaagtagctgagactacaggcgcccgccaccacgcctagctaattttttgtattttaagtagagacggggtttcaccatgttagccaggatggtctcgatctcctgacttcgtgatccgcccacctcggcctcccaaagtgctgggattacaggcgtgagccaccacacccggcctgtccttgatttttatctgcctttttttgtctggcagtcaaactttcacagtccctgttaactcctgtttcttcttaactttatttcctagcagtaactctgtgcataatccatattgttcagagtttcactaagtaagatgtaatacagcccactgctgatttactgatgaaagaaaatcacttataagatgaaccctgctgtaagacagagatgtctcttgttttgttttcagcagaagctgatcctgtctcattttttcctgctacaggttcctcagtggtgtgctgaatattgtctttccatccactaccagcacgggggcgtgatatgcacacaggtccacaagcagactgtggtccagctcgccctgcgggtggcggatgaaatggatgttaacattggtcatgaggttggctacgtgatccctttcgagaactgctgtaccaacgaaacaatcctgaggttggtttgtggggttcagtccgctccctgctgatgattcttggcttaggttctacaattctgaaggagcattattctggcattctacctgttaagcatctatgctgtgcagtagcaactggtctctgtcatcagccagccagcaacagttgctttcccacactggcatcatctgggattccttgtctaaatgtatcccatgactcccattatcccctggaaaaagttaacaacttgcttggcccctcagaaccttcaagcgtgtgcttctggagctatgcctcatgcagggtccacatcattgcctgtgtgcaagccacatggacacctggagcacactgtgtgccctgtgctttccacaccctgtgcctgtacacctgcccctccctgtgctcagcatgtccgggcccggctagttcctcctagtcactcagtatgcagtgtagcagccacctactccaggaaggcttccctgcccctccagtaatacacattagaaaaccctctgtggggcttctggaaaact

SEQ ID NO: 63507 - DNA, 1113 bp, Homo sapiens
tgccggtgtagaaaccattttttttttctccaggagtccttgttccgtttagtggtgaactgtgttttgaaaccaagatctggacactaagtacctattaccattggtttatcattgcaattttttttttgagacagtgtttcattctgtcacccaggctggagtgcagtggcatgatcacggctcactgcaacctcaacatcctgggctcaagtgatcctcccacctcagcctttagagtagctgggactacaagtgtgtgccactacactcaactaatttttgtattttttatagagacggggttttgtcatgttgcccaggttggtctcggactcctgggctcaagcaacctacctgccttggcctcccaaagtgctgggattataggcccacttcacccggcctatcattgcttttaggccatctcagtggacacaacaaggaaataaatgtatgtgagtgcaatatacacacgtctcattctatccatctatttgtggctctgtttctctctgtctttctctatttttatgtatttctattttcttacctctcatattttttatctctctttctatatcttaaaaaccatgagtttgtactgatgcctctgattccagtttagcactacagggtttattctagccttcccagttttcatatccataacttctctatgagaaacagggcttcgtgttattcacactatctttacctgttctcagattgaacaagtaaagatactcaaaagaacaattcatattgtagtttcagaattgctaatccacactgcagtttaaaaaatttttttaatctacttcttgagttttagaatttatcatcttcaagagcaagaattgttatatgttatatgttatattaatacctagcaatggtttctcttgtcatttttaatttctcaattatttcaatgaattaggcttattttctgttaattgggacgacatgtatcttcaaagtgagaaaaatcaaaatggtactcaaataagaaaatggatctatcctaaactaatttagatagtgggagcattggttggtttcttttggaaacaacttggtttttgttgttgttgttttaagagtttgcga

SEQ ID NO: 63508 - DNA, 1267 bp, Homo sapiens
tccattcacagttgatcaagacgcagagcctgagatagaggtcaggcagagagcacgaggcccagtgcagaatcattttctgaaccagccaggaaataccggaacccaccaaactttaaacaccagcctaaattattcctgttcttttaagcaggcagcagaaatgacagaaacccgttaacagaaaaaaaaaaaataatgcttttcatttgaactcctgtgcattttctttttaacttatatgtgttcctaattttccttactctttttgtttgtttgtttcttagtgtggtttattgacaatcatttacaatgccgaagagtgctgtagtgagccagcacagtgggtaacacagcaacggagaacagatgcaggtttgaggaatttaacttgctaaaaccttgaactgaagtcttagagattggaacatacgggtttgtataaataggcttttaagccctgtttgcaatgggttactgataggagaaacttgcttgtggaatgtcagctgcgtgagctcactgtcagacaagatggaagaagaagggctggagtgtccaaactcttcctctgaaaaacgctattttcctgaatccctggattccagcgatggggatgaggaagaggttttggcctgtgaggatttggaacttaacccctttgatggattgccatattcatcacgttattataaacttctgaaagaaagagaagatcttcctatatggaaagaaaaatactcctttatggagaacctgcttcaaaatcaaatcgtgattgtttcaggagatgctaaatgtggtaagagcgctcaggtgagtaaccactacaaaaaataatttgctgtatgtgttgattttttaattgttatttaatgacatgtcacagcctagtgttctaataatagtgtctaaaacaaaaaacaaaacattattcagataaaataattaaatcacgtacctaattttattaattttactaatactagctgaaaagttaataatatctatgtagaaattaattgtgtttagggtaccactgaattgtctatagagcagtattaaaattactcaaatgatcctagtattaaatttactcaaatgatccattgtgtatatgatattttaaaagatgtgatgcgtgttatttcctcagcatgggtatggggattaactgctctgtttcagtgcccagtggtctgagaatccagatatgtggatgtgcttgctggtgaagctggctgagctactgaaatcaaaagcacaa

SEQ ID NO: 63509 - DNA, 1050 bp, Homo sapiens
aattatttttttggaaacggagtcttactctgatgcccaggttggagtgcagtggcgcacttcagctcactgcaacctccgcctcccagattcaagcaattctcccacctcaacctcctgagtagctgagattacaggcatccgccaccatgcccagctaatttttgtatttttagtagagacggggtttcactatgttggccaggcagatcttgaactcctgacctcaagtgatccacccgccttggcctcccaaagttctggggttacaggcatgaatcaccacgcctggccaggacagaattaataccttttactttttcagcattatgctatcacaataaagttcagagtttgctttattaagatagtgtttgaatattctaggagattcagaaacctgcagtactagggaaatctgagttttagatataataacaaaattataaattttaaagatttgtattgtagaagattatccttaagtgttttttaaattactaatttactatttcacccttcatgcaaatatatgaattataaatgattgattgttccatagaatatgaagagacattaaataaatcttaaaatatttataaagttttggttaaaatgagcacaatttcttctcaaaaaaattcactgccagcctgggcaacatagggagacactgtctctacaaaaataaaaaaataaaaattagccaggcatggtggtgtgttcctatagtcccactactcgagagactgaggcaggatgatcaattgagcccagaagttggaggctgcagtgagctatgatcatgccactgcactccagcctgggcgacggagtaagaccctgtctttaaaaaaaaaaaaaaaaaatgcattgctcaaacagataatgttgaaacaaattctggggtaatataaacataataatttttaaaaggcaaggcgtgtatattttacatataaatatgtatattatatagtacagggtttacaaactatgagtcagatcatgagacagatttatttttgcagactaatttactgttgagtg

SEQ ID NO: 63510 - DNA, 1018 bp, Homo sapiens
agggcggcctccgcgcctcctgctccgggagccgcgcctcagcgggaggacggagccctgcgggcagccctcgcaccaggggctccctccgagcccgggcatgggccgggcctggggcggtccctcgagcccccctgacgggaagcgtggagcaatgcgagccgccgccgtcgtcgctgtcgtccccagtgagcctggcgcgtctcctgaatcgcgagagccaggagcacggttttgcccggctttgccccgtcatccccgtgtcccatttcaggcagggggcccgggttggatctttctcgctggcttcgttttttgtgtgttgatttgtttcagtccttcgcgtttccggttgagttacggaatctgcccacacgttttgtggccaaactttgtagggctgtgaaacaatgtaacattatcccacacaatagtctttcatactggttttaaaacacagtgattcagggtttgctttaaggaagctttgaggatcacaagagattattatctggtaggttgtaaaaattcaaacaaccaggagagtatcataggttccggaacaccagaaggaggaaagaaaaatggagacgagagaaaaaggataagcaagaaagtgcaggggcattaagggtgtggggggctgcaggattgatttggtattcaggtctggagattatggcccctctattaattccaaccgctgctccagacagtacttgagggaaatggaaggaagagccgttttgggggtcatggaagtgattactaatcttgccagtagaaagatttccactccatggatgacaaggacactaaggagaattactttcctcttagggaatcattgagaggttaattgaacttgagaagcatatattctgtgatggaaactgacatttattatattcttccaaattaggttttccccctctcagactatatggggactttttcagattaattgtcaaaacaagaaggtttatgtgtggatattgacaagcagcgtgatatatac

SEQ ID NO: 63511 - DNA, 1007 bp, Homo sapiens
ttcttaacacatggagttgttttcaggattaagccacagcacagaaaccaccgtggcatcatgcctgtgatgcagtaatgctcactaaacattagctgtggtggtggttattaggaagaatcaaaaggaacccgtcagcagccctggaaagaacttttagagcaggcagcaaaggcatcatgtatgatgacttgatgtgagtttagcataaatgacagtcaaacaatggcactaattttggagaggggaggttgtctgttatattactactaagtatgaaatctgttctaaggatgtggtttgagaagcctagtaggtggagatgcaaaacccatcattatcatgaaaagctccttgatgaggaagcagcaaacctagcactaaggaatgatgacaattagtcctttgctgaccttcattactggctccatgcaacactcctgggaggcaaacctagtgtctccttcccagatgccaaccctgagcccacgcaaggtgtctgaccccaaggacatctcttagcaagctggtgtgagcatcagcattggatcgcctccgtttctgctttctgatcactgttacctttgtatataatagagctgaaaatgtaatctctcagtggacagcagccaaacatgtgcattcagagttccagagccggccaggaacttactttcgccccggaagcctgggctgggagtttgcaagtagatagcgtgggccatgcaattcttgattgaaaacaaactgttgggctgtgttgtagtcatgtaatcgtctcgttaactcattaatgtaatgtctgtaattgtgatctgtttgaaaccaagttggaccaatgcaatcagcatatattctgtgatgcactttgtatcctggtcatattctcctgctaacccaatgctcaccagatgactgtggggaccagcaagggaaaagatgagctcaccttatgtgggttagaatctagggtcagatgttcaactttgagcagtttcttctacttt

SEQ ID NO: 63512 - DNA, 1049 bp, Homo sapiens
aaaatggcggcctagacgcggagtttcctgcccgacccgcggcggctccggcggcgccatgacgcgctgggtgcccaccaagcgcgaggagaagtacggcgtgggtgagcagcgccgccgccgccgcgcctctcgccccaagcccaggctccggcggggcgggtgtgccgggcgcctgttgccgccgccccgagcggccgccgggccggggagaggcgcttccgcccgcgcccgcgccgccgccccgctcgcaatgcccggcgaccccggccgccccgcgcccccggcggcgtcagctccagccccggggatgcgggtcgggaacacgagggggtggggtgggaatgggggcgggcgcgtccctccctagggtgtcccctccgacgcccgctcctctggacctctgccgtggagccccccgggctacccccaactccccggccccggccgctgctatctgcgcggctgggcccgtcagggaagcccaggggtcactgtctcgcggcggcttctgcttcttggatgaacttgcgtcccgcgtccgggctctgggtgggcgggctcaggtcggcgcggtcccagcggataattccgccctttcccggcggggaggagggggcgcgacctgggtggccagcgccccttgcccctcggcggtctcgctggggaccgtgtgggaccttggagagaaggcgagcggccgagcgccccagtggccccaggcctggagacccttccgggagagcgggggcctgtttttgctccgcggctctttgtcgcttccgaggggggatggaaggagtcgggttgcaagtttacatttcggacccgagtgcgcattcctgagagggaggctttcccttgcggctgaatagacgggcccgtccgcgtgggacccgcatccttgcgccccggggacccgcagccggtcgccgaggcctgcggacgcccacctcttcgtgatctgcgcgcctggtgtcgggactgggccgtggctactctcctgctctcccgggtccgggatcttcccagttggttttcgggcttgc

SEQ ID NO: 63513 - DNA, 1049 bp, Homo sapiens
aggtccacgccctaatccccagactctgtgaattcaatatgttacatggcaaaagggacttggcagatgtgattcaggttacttggaattcgtagatgggagattattcaggaccatccacgtgggcacagagaactttggctgtcaaagttgtgaaacaggcagtcagaagatcctatgtttggaagcacagttgctggccctgagatgtaggggctcacttgcaaggaccagagagaggcctcagggagctacgggaggcccctagctaatgatcggcagttacaaagaattggatcctgccaacaccctgaatgagcttggaaacagatttcctccccagggcctcctgctaagagcccagccagccaacaccttgattttgagaccctgagctgctgggcgtgtggcctgtggaactgagataatacatttgtgtggttttaagctggctgggttgtgggaatttgttacggcagcagtggaaaactaatacagatgatgggagagaagcttgcagggtgaggctctcttgcacccttgagatctgttactaagttcattgaaggtagtgaacccaagtgtgctcttcactttggccacttccaagtgcagctctcaaatgggatggggcattggcactgctcttactcataatgggacccttgagcaaattactcatactttcttagccttggttttctcatctgtgaagtggaaccaagcctgcttgctgccgagtcgtgaggactcgctgagatgatgttggcagagaatttagccctgcgtttaagatatgccaagtactcaacgaagcgttgcttttgttaactttttatttaataaagcataaagtttagaaacatagtgacaagtgacttctgtgtgcggttaacgggttgctggaaaaatgcctttcttcaaaagttggtttcttgatagtgtgttttgcttcctaattggggtagaagtcacatttgctcagtgtgaggagcctgacttgcgtgccttcacattagctctaagcaatgataattgctaggaatagt

SEQ ID NO: 63514 - DNA, 1023 bp, Homo sapiens
atttttagtagtgacggggtttctccttgttggtcaggctggtcttgaactcccaacctcaggtgatttgcccgcctcggcctcccaaagtgctaggattacaggcatgagccaccgtgcccgtcctgaagcaattgttataattatccaataaataaactattggtgacagtggttttccaatgtccttggcttttcagacaatttgtttttatattttgtgtttgcaaataatttgagcatgccatatttcattttatgctgtggttattgttgcacagaagggaagaaatgatgggcttgattttttaaagactgttcagatctggaggttttggtgagattgtgttttcttattgttgtcggcttaatttcctgcttgaaagggtggttcccatatagcatatgaataaaaaggataatttcagtagaaaaactgctttttcacagaggttttttagcaaaacccttccacatgggaggttgggggtgagaggggaaattgaagacatcccgtagtaatcagcaaattgaacttccaacttgaaatccactttacaaggaatgaagtatgcccagcttcctgctcgaggcaaactgtgaccagctcctggtagactcctctgagaaacacagacctactaacagatccatgttcatggcccttatttccccatctgatgcatgctgtaccttccctaaaaaagtcctgtctgaaaaaaaaaatcgactttagtggcctctgcgtggaagccagtgcagctctgcaaaaaccagccccagtccttaagcggatgagtagttgtgatggggtcttctgcttgttttccgtgtttacagctgacagctgtgttcccttatctcctctcagtatatactgcatgtgtctgagaggagacagagagaaattaagtagaggttaaggatcaaaccgctcatctcagacacttttctgatttgaagggaaatgctcttgtatcttgttttacttttgctgccggtcagttgaagttgaaatcctgg

SEQ ID NO: 63515 - DNA, 1066 bp, Homo sapiens
ggtaatcgttccgttctgttctcttactctccggtgcaaaacctctgccgggacatcctctctccttcatgccgaactctgtcatgcagcagggtttgtggtgtgacccctacttgtcttagggcacttccagtttctgagctcatggaggacagagattgggtctaatctctttctgtatttgtggcacccagtgtggtctctggtacatggtgtgcgggctcactttgttgaagaaatagtgcatgccaaaaatcgtggggaggaaaaccatggttttcattttgcttaggaaggccattagaagaggaatcgactgcctatgaacattaaataaagacacaaaactccttgcctttcatgcctactgcttggcccttcctcctcctgcctcccatagaaaacctttctactgtgtgtgaagtggcctctcgtttgcctgtgttctcgtgctgtttggtgtgcatctgtttttaacagatgtaagtgtgtcattatagtcttgttctgttttttattttccctcgtgctccatttaaaatgcactgtgttctctgtgtccctttagtccatggctctaactgcatcgtgtgcacatttcatgttttactaactgcctgcctccccgggtatgagcacttaggttgtccccgcttcccaccacccaagatcaagctgccctgagcatcccatgtccatctcactctgcagggcacacagatgtctttgggctgcgttcccaggagggggttgctgggtcttgggtgtggagatgtagactttggataagcagggcctgcttctcccaggctggttgccgcagtggacactgccacccacggtgaccaggggcttcctgcatcctgcagtgttctgccttctaccactcttaactgtgtacttttcatttctctgactattattaaactgaagcatctcttcatacatgttgaggtcttatgggtttcttctatacatagtttataaactttgctcattttctttcttttcttttttttttttttgagatggagtcttgctctattgcccaggctggagtgcagtg

SEQ ID NO: 63516 - DNA, 1213 bp, Homo sapiens
gtaagaagtgtgagttttgcatcttatttgcattttcctcttgtcacaaagcaccaagagcttgtagattgagatttggcctcttgcagaagtgtctcttgtgggttgtacacaccacagtgtgcagcagcccgcccagggtggaatgcttcttcttccctatagctgagctgagagcgaggccgaggagttcaggttctcagtgtgctgagaagggtccagggtgcagggtgttctgaagaccgtatgtaggttgtaggattcagatctttaggctcagactaattccggaggagctttagacttgcccatctctgatccagatgcaggaagctcacgagcaggtgttgacgctcaaggtctagcccctgttgggatcacctttttgcttcagtgggacacaggatgttggatgaagtcttggggattatgcattactttttgttcctttaatcttttaatgtcgcatggaaaccaaattccgtataatatgttttagtttatgctgaaagcaccttttaattcaacattaactaaatctcatgatctagtgcttatacctcatgcgtatttgaagagatagccattctctaccatctccacaatgctgttttataacaaaatctttctgattgggtttttccccgtatagcaagataacagggagatgtttcgaagtgtgcggcacatgatctatgaccttattgaatggcgatcacaaattctttctggaactctgcctcaggatgaactcaaagaactgaagaagaaggtcacagccaaaattgattatggaaacaggtttgtttatttgaaagatgattttacgcttaaattatccaatgtaataacatcactataagtcttcaggagaccaagatcatattttatcataaaacaaaatttctaccatcaaagtaatggcatgtttttcattttgaaaaggatgaggtattttccactggattctgaactggggaattttgtgagccattcttgaaaccttgtcattcttcaagggatagagtcaagaagccagggagcctgtcattttcaccgttctggagggaaccccatcattactcccctagcaaggaacttttactttctgaccatagtttttgactttgagtccagatctggggggccttgcatagtgacaagcaacaggtttctttctgtggaatcccaggttctgagcattggagtggac

SEQ ID NO: 63517 - DNA, 1049 bp, Homo sapiens
ccagtcacctcccaccagtatatatatatacacacacacacagtagatactcagaaattgactaattgaatcatctgttaattcaacaagtacttactgagcatctactgtgtaccaaatgttgaagacataatgatacatgagacagatgtccttggagggtttagtctaatgagggaacaaaaaattaaataactacacatatataatcattattttgatttattggatggacacctgaaagttttgtatctctgaaaatactcagcacagcagttgcacaggatacaattttttgtctgttgtgtgaatgcatgatttaagaatgtgcaggggagataagaaagtgactgcaccaaggcctttgctgggttatgccaatgagttattacaattttctattctgtagggaataaagaaagcaagtgtcagtgatgagtgttgctggggttgactttctgtttccttccatacacagtctcaaaagcagaacatagatattaacagacaagccaagtttgctgcaaccccttctctggccttgtttgtgaacctcaaaaatgtggtttgtaaaataggagaagatgctgaagtcctcatgtctctatatgaccctgtggagtccaaattcatcaggtgggtgacatttcttggctgccgtctttcctctttggttagtgttaggaacttgggatcagaaccactgaagcgtcccattcatgctgagaggccttggatgaatggctgctggacacgagcaagcagccgagtcaagagctgtcttagacagtgtgatggcagccaggttgggctctgggtcagggtgaaccttcttgcgtgtagattgctatttgctcgtagagttatagcagttgcaggtacactctggccgtatcttaagagtgtagctgaagattgaagtaatactttgtttcctaagttgtcttcgtaagattttatatatcctggtccctcaaatatcactatttccatttttcaaaatttggtttctatgaatgccatttctgtgagttttgtcttgttttttc

SEQ ID NO: 63518 - DNA, 1050 bp, Homo sapiens
gatcttcacagtcactttcaaaagaatcactgttgaatgttgattggacaatgcacagctgtgatttataagcttttctgctggagagaaaaaatatatttattagttattttcattgtggcttcaagttgacctgctaggctcaggatgctctagtcctcaagtttcagatataaatcatatatttggttttaaagtggatcccatctttccctgggagtgatcctgacccatattctcagtctgtagggaagccagtcagtggaggttttcaggtcttggtgatggacataagaatggatatgtgcaggacggtcaaagcaacgaagaagaggaagaaaggcaaactgtgaagagaacgcggttagcttcatgttggtgctcttcatccgccatgttggtgctgtttctccgccatgttggtgttcttcctccgccatgttggtgttcttcctccgccatgttggtgcttttcctctgccatgttggtgctctttctccgccatgttggtgctcttcctccgccatgttggtgctctttatctgccatgttggtgctcttcctccaccgtgctggtgctcttcctccaccctgctgttgctctgttatttttggtgacagcacgaggaatgtgaaagaccaattatctctgttgaggaaagataaaggcatacccaggaagttctgattatttgccctagttcactgtgactctcatttttcatagttttgggaagtggttttctctcttttatggttgcagtacaatttcattacctagcactgtgatatttattttaatttttgtgatttttgggattcatatggatatttatgagggaaaagttcctgattcttgacacatagctggatttttttgtatgaacagctatggaagacattctttcccttggctaccaggaaactctgaacttagtccatcccccctgccttttaaataaacattatttttagaagagttttaggttcaagcaaaattgaacagaaaatacagacagttcctatatatttctccttccttccccctg

SEQ ID NO: 63519 - DNA, 1035 bp, Homo sapiens
atttaattttgaggctttctttagaatgacttctgcgtgtctgtgttaacagagttcagttccttaaaatgagaaagtgtccatggacctttaagtctacagttcttagtcttcggttgaaaagaatgtgtcacatttctgtcttttaacctttttataatgtaaccttttctatctttttctaaaagatagaaaattgtaaaaataatggaaattttatggaaaagtgtagttaaataaattatccatagttttacatagccagggtagtacctcatgtttattctgatatgtttgtttccaaattattttttctgtgtgtggcatatgatttttaaatacaatatcccgtcctaccatgtatttgtttatttaactgattgattttttaatgtctttttagtcccttttttgccatcttaaccatttttaggcgtgcagttcagtagtaagtatgtttgcattgcacatacttttatctttctaacaaacctagcattatcttatgaacatgtccttttattaagcattattcaaaaattcggcttctcaatggctgcagcctgtagtcctgtgattccagcagtcctttgctttgggctctgaggttatctcagccttgcggtgtagtagctacgcagtgagcatcctggggcttgaagcatcccacctgtgcctgtttgcaggccagcccctgcagcggagttgctgactcgcagggtgtgggggtccatctgccgtgagcaagtcatcctgatgcagccccaccagtgggactgagccatcagcccctctccctgcgagacgtttctcacctcctgccttctgctctcctgcctgtgctggccctgggcctctgtcactcttgtcccaacgccactgcctccttccttctcctgccctctgtcttccagcatcacgcggtgccgtctgtctacccggcctctccctcacacagctgtactgacttcagctggactctgtcttttcaccatcctcttccctgaatgtagagaccctgggctggctggctgg

SEQ ID NO: 63520 - DNA, 1414 bp, Homo sapiens
ggaagccacctgccatagtgctctgcagtttcacttttccctcatttttattcttaatcgacttcagacttgaaacacatttcagattttagaaattttacggttttcagctgttggctgaagggtttaggaggcgggtagtaattgggtggctgaaggagccctgtccttgggggcccggagatgtgaggttgacttccctctgccccacgcatccttggtgatggaccaccgcgctcaaccccacccgactcctctgggtcttgagtgccactggctaagacaggaagagtatggctttctttgcaggcgggcgatgtggtcacatagcaccctaaagctttttgtacagctcagtaggagattttgctatcttcttgacgtaagaataacagcaaaccctgcgttattgagctgggagtcagggttaagttatatgtatctcagcatgcacaactagaggcaaaggtctctttgtggcttaaatgctttaggtttactctcctgtccaatatggtaaccattagctccatgtggctatttaaaatacttaaaatgagctgggcgcagtggctcatgcctgtaatcccagcactttgggaggccgaggcaggaggatcacctgaggtcaggagttcgagaccagcctggccaacatggtgaaaccccataactactaaaaatacaaaaattagccgggtgtggcggcaggtgcctgtaatcccagctacttgggaggctgaggcaggagaatcgcttgaacccgggaggcagaggttgcaatgagccaagatcacgccactgcactccagcctgggcgacagagggagattctgtctcaatgataatagtaattagaatgaagtagcattaaacatttagttcttcagtcacattggtcctgtttcaagtgttcagcagcaggggaggtcagtggccccgtcctgggcagcacatacatagcacatctccagcactgcagaaagctctgctggattatgttgttttgtagtcccatccagtgaggagagtttataaagggaacacagtgctgcagaatctggaagtttccttagcaaacaaggggaacagtatcatggaacatgggcagatattgaggtcataaataaaatacacctttgtaaaattataatattaaattgcctcattctctcatgagaaataatgcagccccctgctgttttgaatgctgtattatatattagacctcagaggttcttgatgcccagatgtaacactaagttgaaattacctgttgcctgctagtgtcctctgtgaaaagtcaaaaacaaaaacaaaaacaaaaacaaacccaacctgagggattgtttgaaaggttagggaggttattagttttagattcactgattttcacagaacatgttatgagttg

SEQ ID NO: 63521 - DNA, 1029 bp, Homo sapiens
cccagactgctgggattacaggcatgagccaccatgcccggcccaaaaacagcaacgtttaaaagtagaatcttggccggatgtggtggctcacacttgtaatcccagcactttgggaggctgaggtgggcagatcatctgaggtcaggagtttgaggccagcctaacatggaaaaaccttctctactaaatacacaaaattagctgggtgtggtggcgcatgcctgtaatcccagctactcgagaggctgaggcaggagaatcgcttgaacgcaggaggcggaggttgtggtgagccaagatcgagccattgcaccactctagcctgggcaacaagagcgaaactctgtatcaaaaaaaaaaaaagaaagaaaaaagaatcttaacagtaatggtcagagcattcagaaaaaaaaattcagctgtgtcacggagtcagttggcttggcagctgttacaatatgatacaaaattttgcagaggcattttgtctttggaaaaatcatataggggactaggtgtacagtattttcaccactgcagttagaaatgtttacagttgtacctgatagctccagttgaataaagctgttacgctggatgatattgataacagtgcttaaacttctttttcaattcttgaaggtggccattcccatcgaggacgttaaccgcagtcaccttcggtttaccttccgccacaggtcatcacaggactgtgagtagtcaagcactttcttcccccaagtatttttaagggagaactgggggaaagcgcgagaggccactctcagttgttctggaactcgctatcataacacaataaggctcatttcccaccggaacctattccttggaaacattcttctctcttttccttgagcagatctcaggaggagatcttaatttccttctccagttcctcctacccagtgttgctggtccccttctttcttttgctttccagtcttccgtgttgacttgccatccatccatgccatccatcagaaaagttactgagctgtaaca

SEQ ID NO: 63522 - DNA, 1067 bp, Homo sapiens
ttccttggtggaatggtctgccccttcccagcctctgtcgtttactgtggcctcttgtttccaggccctgttgatttccgctggtctgggcgtcttaggttgaaagcacacagtctttctcattgtcattttacagttactctcgctttctagtgttgcgggctttcctctgccttcttcaagaccatgctgctcttcttggccctttatcctggaatccgttttcacgttccaggaaaaatctcttctatgagattttgattagaatggctttgaatttatagattaatttgagaacaactgatccctttatgctaggagtcttcttacttgtaaacgtggtccatttttccatatatttattagattagctttaatacctgtttgtataattttgtaattgttttcataaaggtagcctttgtagcttcttataatgttattttgtcatgataattgaaagcaatcatcaatttttttgttttttgttttacagctaaggataaatctgagaaaatatttgcactagcatttgtcaagctgatgagatacgatggtaccaccctgcgagacggagagcacgatcttatcgtctataaggtatctggttgcattggtgcaatattgctgctatagacagtttcagtcttttctgggctccctgacctggaccaacctttcccatcattgtgaggaagctgctatctagctacatttaattatgcaaatgaacatttccaatgaccagcccttttgttgttcctaacgggaaaagatgatatacaatataacaataggtgccatctaaaaatgccgtgaacatgaattatgctgcagtaataagggaaattattaaaatgtgtatttaatatgatacaaagcaattacgatggttacaaggattagggataacaaagggtggcaaaaatggtgtgttgctgtttgtgaattgcctttgacatacggcatgactaaatccacaggccgaagcaaagaagctggaagatgctgccacgtacttgagtctgccctccacgaaggcagagttggaagaaaagggccactcg

SEQ ID NO: 63523 - DNA, 1044 bp, Homo sapiens
tcaaagcaatgctctgagctgcggttaggtgatgaggcccatccacagaatccttcttaacccttatgaccctggagaaaggggactgtggaccaggacatccccccggggggtggggtcagtggcaatccctcctttcaccctcaagctccttaagtctcaccagctgcagagtaatcccctccccagactgagggagagggcaccctgctctcagcagcagctgttgccaggcaacaaggaaattccgatgtgatgccactcaccaggactgatgggaagtctgcctttcatttctcaccagccacggttccccttcttgggattgtggcatgtcaggtgtgtacaagatggagctgccccaaatggcgtctaagcatcaactcccacattctcatttgagggaatcatttttctgaaaccatgatttgttcctgcgaagttccattacttagggaaacgcagtggctgaattattcattgaggttggtattaaacttctctgtcctcagcattatgctagatgctgtgggggatatgaaagaagtacaagatgtgattcctcttctcaattaactgactatataattagaaaggagtcatgaatatgggctgtgagtcccggtaataagggcctggggtgggactcatctgccttgggcagcctcatgggggctggacaagccctgttttcttccagcactccctttgctccaaggtgttttactactcattagcccaattggactttgtctcaaacttacaatacagcgtgccaccaactttgaatgaaggggatccagattattactgtctattaaggaaatactggtaattcttgtgagatggaaatctcccttaaccctaggaccaagagtgtgtctgggcaggatggagccttttccattacttcactttcacttagaaatgaagacatgttgcccaggtgcagtggctcacatctgtaatcccagcactttgggaggctgaggcgtgaggttcacatgagcccaggaggttaagaccagcctgggcaacatggcg

SEQ ID NO: 63524 - DNA, 1455 bp, Homo sapiens
cttgggccaggcatggtggctcacacttgtaatcccagcactttgggaggctgaggcaggtggatcacctgcgatcaggagttcgagatcagcctggccaacatggtgaaatcctgtctccactaaaactacaaaaaaaattagctgggtgtggtggcgggcgcctgtaatcttagctacttcggaggctgaggcaggaaaatctcttgaacccaggaggcggaggttgcagtgagctgagattgcgccattgcactccagcctgggcagcaagagcgaaacgccatctcaaggaaaaaaaaaaaaaaaagaaaaagaatatcttgatgccttaaacaaaaacatttctggacactgtcttcttccacattgactctttaaaaaccagtatattcattccttgctttttctatataaaatgcaacaaacaaaaacacaaccataacaaccacaaacttctgtggaagcccagacatggtgagggccggaagctcactcagtgcaggcgtgaacctcagtgcaggcgtggtctcagttgtccagagctactgtagctgtggggactcttaaccttgcagtctcagtactttaatttgtgttagttattttatttatattatctataaaaaaatagcagcttgttcttgagcaggagaaacaaaccatttggtatccagtgcctgggcagcgctttctgggtgagcaggcctcttcaggccttgtggtgctctgaaactgccttcctgtagaatggaaagacaagttcttttttagtttcccaaatgcacttttaaagcttctacatggaaatcatttcatggtaaatgtcgttgggaataatgaattcaagtgtactaggtgttaagtatgttgctacaaaggaatggaatatttagcaggtgaatcttttaaaatagggttgatttctctgttcacaaaattttatagagaacctcacataatgcatgattaacagagacagaacagagtttcttgcttgtgaagatctgattgtcattttctgtttccagtggaccttctggggctcttgaaatggcgctccaacaccagcctgctgcagcagaacttgaggcagctgatgaaagtcgatggtggtgaagtagtgaaggtaacatggagcccaaagggactttttgggtctttttttttttttttttttaatgtatgttaacagaagtaggcagtgacttcaaaggtagtataggattgtggttatactccctttaaaaaatagtgacatagggattgggtgcggtggcttacgcctgtaatctcagcactttgggaggccgaggtgggtggatcacctgaggtcaggagttcaagaccaccctgaccaacatggagaaaccccgtctctactaaaaatacaaaattagccgggtgtggtggcgcatgcctgtaatcccagctactcgggaggctgaggcagga

SEQ ID NO: 63525 - DNA, 1054 bp, Homo sapiens
aaactccgtctcaaaaaaacaaaacaaaaaaatagtgacatacacctctaggtgcacagagtgcttcttggcttctggtttggggggactctctgggttagccgtgaaggggactggctttgcaatcaacctcatcgtgggttctgcgtcctcttcccataggtcctcactacaggactcacaacagttcagtgacctctttaagcctctctttcccctgccatgagaagtggggtaacagtagtgccttctgcagggtcgttgtggagcctcaggtctttttactgttgtcatgatccttgttactgccatcagcattcgtactagactccctgagatcccctttaagtgaccaggagaggtctgtggtgtggtagaaagatcacgacactgagaggcttgcctgggccgtcttcttcccacgggacgctctgcagcagtgtcgggtataattattcattcagacccttgtggcctcagcatctttatctgtgagagagggcagtcagattacatggccggaggtcctgggagcactcagcttctggaattctttactctgtaattgtttgtggttctgatgttttctgcagtattaggctcttctctgctctcagataccccacaatttgctggggcaacttttccttgtacgtgaggaagcgaatttccatttttagtcgattctgtttttggctatgggacgataagggggtcactggcatgtggcgttctataagcatagactctccagcaaggtctgtgtgttgccgcctcagttcctcactctctaggagaggtgattgcagaaagagacgaccttatctctgtaaaaactaattacttaaaatggccttaattaaccagcagtgtgcttcacttcagtatcaattaatttggtcgcaccagtttcctgaatcgtataactcttcagacatatactcactaatcttaaaattttaatcatcttctcagtcctggtgttctcccaatggcttggacaatgttaattgcattttaaacttccctgtgttctgtaaattccctaattcag

SEQ ID NO: 63526 - DNA, 1615 bp, Homo sapiens
cacgatcctcttccatgcctgggcaccctggttggtagaaggtccttccttccactcagctgggtcctgtccctgtgtggcttctgcccattcactagctgaagtcctgtacccagtgtgtagaatgagtgagatgcatcttcccagagttgccattcagcgctttgtcaccagccttatgaaaaccggaaagagggttggaaaggccccctgggggaagcagtaggccctctccttgctttgaccctctccatttaacactggtggcatttctttgttctgaattcgctcatccaaaatttttgtcttgtgtatctagtggctgaaaaggatcccgaatggctttataggtagtgctgggggcaaagtgggtatttggagtactgcagagatgatagttattccagtgtgtgggggaagtccggtgggttcacattgtcacccgaccttctgtgtctatgcagtttcttcaggacacgttggatgccctcttcaacatcatgatggagaactcagagagtgagacttttgacacgttagtctttgatgctctggtaagagagctttccttctcatatgcttggataacacagcgttcttccatgctgcagcgtctgaggctggagtcgggggcttcgtcacagtgaccttgaacgcattttcagttgtaaatccaatcagagatgaattggggtggcagattttttttctcttttttttaaatgtaaaactgtagttaggcaaatgtcatttctagggtaagaaaaggtaaactagccaccaacttctatctgaaaatgttatggttcatatcctaacacaggggtgcagatggttctgatgaagattataaaatggcttacattatgttgctaatgaaaatattattgattaatttgacaggtatttatcattggactgattgctgatagaaaatttcagcattttaatcctgttttggaaacttacattaagaaacactttagtgcaacgttagcctacacgtaagttcctactttgttttaaaaccaatacttctttttttggtatttgtgttatttagagtctttttcatgtacttttgtctatgactgtgtatttactcctgctcaaaactctgagtttactggaataatttttagtattgtttccctcttaacatacctaaaaaccttgttgaaagagatatgtgataaatcatcgtaatattctggaataaattcttgttctccctcacaccttccatttatctttgaaatcttcactttatgttcgatgaaactgagctttggatgcggagtgtctgacaccgcggcttcctcgcgagcctttgatgaatggataaatgcatgtgttcccgtgttaaggagattggttgtttagtgtgaattagatgcagttttgtactttgcaatgtatctccttgctctttaaagagcaccttcccttttctttgacaagcttcagctgtcactgtcttggattccttctatccacccctctgcccgtctgtgccccagaggtctaggaagacaccagaggctatgcatggtgcctgggccagcttagcagtgtgcctggtattgaagagcagagccctggagtctggagtcag

SEQ ID NO: 63527 - DNA, 1038 bp, Homo sapiens
cattagatttattatgatgacttaccggctctttcttggtggaatttattggcatttattcagactttttattgtgtgagttacagcaaaacataaagatttacataatttctttaagaacatcccgcttagaatcagtagaaaggattctttttagtgtgagtaaatttagttaaaactcccttctgtgtcttcaacatactttgcaaaatacctgtttttcctccctgtgtgcagtcatgaactcaggtcagaggactctggcctcctgaagccagctgttaatataccctggtcctgcacctggattctttcatatctgcctcgtgtgcgtgtttactgtaaggtggtgggtggagctccaggaaggctaagagctgtgaggtcctcaagcctgcggaacaagctgtgactagttctttgcacttgcttgctaataaacgtttgtttaaaacattttgttcgctgagtggagatgcccagtgtgtgggcatgtcgagtagttccttacagaccgtggggagggtgcattgcagggcacttttcctggctcttgtgaccaaaacaggagcttgtggggtttgcggaagtggcctgtggactgcagcaaacgtagcacggcctccacgtgtgctcattttcaaaattctgccttttgattgaaatgtggccaaagaactcttctcagattaggctccgtgcttgaatttcagaagatgagaggcatgaatcagcttaccacactgcagccacatctcttcattggcgccagcctttccatgctgtgctgttggggaaggagtgatgcagccattctcataggtggagaaagaaaaatgggagattttgatgagtttcctaatgagacaaacaaaaagtaccattttttctttatgctgtgatgggactgagataagaatagtatcctcatggccgggtggagtggctcacacctgtaatcccagcactttggaaggccgaggtgggtggatcccatgaggccaggagttggagaccagtctggccaacatggagaaa

SEQ ID NO: 63528 - DNA, 1033 bp, Homo sapiens
acatgatttactataaaaattggtgatttatacagaaagaaatgtaggtggtgcatacattaaaattttaggttatttgggcaacttgatattgcccaaagctgtcttattgtcccaaggttaaaattagcaatgtgtttggtacatttactactgaattcagtggcattttagaaaaacagacgtgtgtagtgtaagaatagataaaaattacaggaagttttgagcccagcagtaattttagattgctaaatatatccttacattattaaatttgattgggcttgatttgtgtctgcctccctcccttgaagtcagattacttagtgactagggaccgggaagaccatgcttcagtgggtgttttattataagacacaagtgaattgagtgacgtgtgtgcattgatgcaaaccttacatctgcaagacagacgcacggcgttttattaggcatgtcacctcccttctggtaattggtatcgtattatttcacaataggtgctttctcgatgacgttggaaatttaaagattcccatcgtgggagcctgacttttgtgttgttttaactctttcagttttgctgtgtctaaatggaaggaaataccttgtgaaccatcttccatagacaaagtatattttcagactgtgacatttaaaggttaaacattgtttccccaagtgtggccctcgttggtaccaaacggttggtaccttcccggttcaagtgattctcctgcctcatcctcccagtagttgggattacaggcacccgccagcatgcctggctaatttttttgaatttttagcagagaaaggctccatccccttcttggtaccaaacctgccactggcatcaactttgcggattagagtcagccacggggttttacgcctcattgaagagggagggcaggaggaacttcagaagtaatttattgcaggataagcatggtctccagctagaattttcaacaggactgttttcattgatttagtgacaaaatttttccaaggtcatttaagtgagaaa

SEQ ID NO: 63529 - DNA, 1032 bp, Homo sapiens
cattataatcaactcccagctgatgctaaggttgtgggtccctggccatatattgagtcagaagtggccacgcctcgccttgcacagacagctgctgtgtgagcagtagtgtttgtgggtagggcacctggtctcagttcttgcagccttcaaggctggcttcattcaggctgcctgccctcagctgtctgacgttctggactattttgatttgataagtttgccctacacacagatgatgacacacttgcaagtgtgtcatgttaagaaagactcagcagaagaaggaacgagggaagtgaagaaaatattttatggcttgctcttagaggacctgtgggtccaaatgctccccatttcactatactgcttgctggtctgtggccctgcagagggttgggtagtctggctgagatctgaactcaccaggtgctgcagcattccagtcttcttggttgcttcctaggattcttcctgcccgctctggagggaacaataccactcacataggcaagaattaatcaggagaggtctggataaatacacttgtttccttgagcacctctccacccacatttatactgtgcacagtactttgcaacagtagcagaaatgcagcagtagcactaccttgcagaaatgcaacagtagctgaaatgaaaatcatctctcttccaccgtttcttcagcaaaccaagtatttctattggttttcttccaattctagtgcatgcccatcaaaatgtttatgcttgcaacctgcgtagtttttggtttactgatttttttatcattttatcacaacacctttccattattaatgtgtagttgtaattgtaatggctgtatgccagttcagaacatgtgcctgaattgatgtgcaatcatttgcttaatcaaatgatttttcctcaaattaatttttctattgttgaatactaccgtgttgcttttagcattttaagcctgcaacaaattatttcattgataagtagtgtgtgtttatgttttctttaattttatgatccattt

SEQ ID NO: 63530 - DNA, 2619 bp, Homo sapiens
ctgaaagtgagcaggtctcagagttatgcttagtacctcattgttgagttatgtattcacctgtttaaaaaattccttcaatcatatgttcattctcctgtgtgccaggcactgtgctaggcactgaggagttacagcaccaatcacacagatacgctctgtattctcatggtggttccattggagtgagcaaggcaggcgtgaactcagtaaccatcccctatgtgtatagttgcatagttgcaatatgtgattttaagcaaatcacagacataaaattatcattgtggattgtagtcactcattttaagaaaaagtaaaggtcagggtgacaaggtatatcggggcattggaagtagtttaggggttcaaagaaggtgctgatacaaaggtagtcaccatgaggtgcttggatatgtaatacagcagaggaaaatgccaaacccagactctcgtatggtttggagagaactgtgctgccacttttgtccagaggggttgtggagcatgaagtaatcctaatcccttctgttcgtgcagtactctcaggcaccaaagactttgatgcgtgttatctcttaggatcctcccagcactgccatggtggttgttaaaaataatgagaaagctttctaaagggacgggcagagaacatcatcatgcaaagtctgtgcgtcttaatagctgactcattgatggaaacatttatatcccacatccactggctcttgtctggcttcttcaaatgcacctgtccctaggaccccttcctagagataccagcatttagaacagaccagtctaaacaaggtcttctcaagtgaactgaagatactaggcctgcaaacgctcatctgcacttcacttacgatgtggcatttataaatgcattcaccgtaggtgtttgtagattctttttatgttttaagttttaagtttgcagcattgaggcctattttgattgcaaattgcataaacctcaaataagatctaaatcaaaggaaaggtattgcatgcttataggtgactcaacattaagaattcagttcttcccaacttgatctacagattcactgcagtcccaatcaaaatcccagcaagtttttttgtggctattgaccaactgattccgaagttcatgtggaaaggcaaaagacccagaataatcaacacaatatttatggagaacaaagtcagaggactggcactactcgacttcaagtctgctggaaagctccagtagtctaattacagaaacccaactccaattcacattagaaagaaggaaattaattgattcatgtagtttgggagtccaagtgttaagcatgagtgagtttaggatttagaaggtatcctcctcttggcttagtatttatttctctccatttgagggaaaagtggctgccagtagccagaggcttgcaattttcttttttgtctaatagtcttcgaggacacagagtgaccgtctccctctttaaggcaatgttaatcttcagacagaaccatcgttaaccttcttttaagcaggaggctatccctgaaaggaaaagactgtgaagttgaaacagaagtagagcttcataatgcagaaaatggagaaagagggatgagaggactcacaggaaggctgaagggacatttgtaaatgcagctgaagccagtgcaaattggcgactttgtgaaatgggttttgcagctattctttggagctgtctgctgaggtgatggaaagggtagttaaaagcttcatttaggattggtgttctgccagcatgccaagtagcccaaaccaaggcctgggaggagagcagactttaaatatgtcccaggaaacgttttattgagaaacatgtcaactaccactatagcattatcaagagggaaaaaggaatatttcatatgtgagcttaaaaaatcattagctctgttatattgaatacttgcaaaatttcattaaaattgtttttgcagaattttatgatagaataaattacttttgtgtatgtattgatgaaatcatggagttatatgagtttggatttctcaagcacccaaatagtcaacatcaagaatcagggaattaggaggttagaaagtcacatctttagtttttttcaggaacttgcccaggaacagaggggtcctaggtgggatgaccagaccccagttctctgttcttcagcccagtgcttttttcatgacatcactcaagtcagattttaaatttgtgcattacactggctttatttagaatcctgtgccaggcaatatagttttgattagaagctgaacagtattattctccatgaactgtgaatgtgacacttttataattcaagtagaattatttttcccttgggaaatcctatacattcaatatggtacattgaattagcaaagaggtagaagaaaaaaggggctataaaaagtgtatcttattaaaacaaagtaggttttcttcttgcctgtgtcacctttagatagtaattcttagcatcactattttttaaatcacaaattgtcttctatctagtgaaatgattaagaaagaacagtagtcctcatttgattaggtgaaacgtgacacaagtctcgttgatttttgaaaaggac

SEQ ID NO: 63531 - DNA, 1035 bp, Homo sapiens
aggaatgcaaaaatataaacaggattaagtcattgatggcatgctcatacttcctaggagaattaagtcttttcaggtaccacagtatgtatgagtccttcttaactctcatttccaccagatctccaccaaggagtttagaactgatggactccaagtctccctctggatgagacattctgagttcttgccaatatcatgctaagctgggttgataatttcctttgaaaaatttcctttgaaaatgagtagcatttcatcttttggaaatttatcattcttcagacttttcactgacctgtcccctcccatagccgaccccctcctgtaccccagggtttgattgatatttgcttttgtattgtaattactatttaatatccagccctcctgaggtttgcttcactgcagtcacattgtattgcaagcagaaaatgtcacgtcgcctggagctgttggggtagtgtggttgtggtcctttgggtatttcctggcacacctggctcatgacatcgtgcagagctgaacaggctctaggaggaggaaggaaaccttgcctgggtacttaaaattatctatcacagtggatcctgagtctgcctctcagcctgtcttgaatgccaggctattataaatcagctttatttattttgtgtttgaattttgactttcctgttcaataatttaatattttaaaatgacacctttggtcttttatttgtcataagcgagggccgagttagccaccctgcaatttgcctctgtactctccgccccccagtgtgtagtcgttagctcataattgttttcttaacctcctcagagcctggtgtgatcttgctctcaaccttcttgaccttccaaggtagttaaatgaggttttgctttctctatgaattaattatgtcatctctatttgaaatgttcctgaacccatggtgctgtattttggcaaaataaatactattttcagagactgtaagacccatccattttatttccttttattagaagatagaacgattttcttagatg

SEQ ID NO: 63532 - DNA, 1031 bp, Homo sapiens
gcagaggccacttgtttctacaggtttgtcctggtggtctgtcctctgtgccattgaactcccagagtcctctgcagaggacatgtaataattcttgcctattaatttgtggaccctgtatgtggggctttttttttttttgcctgtttgagacttcctgcctttaggagtagacaatgacctttcatacgtttaatgcttctgttgttctcaagtttgagaatgtggtgtgtcccctgggtcccctccttacatgaaatccaacccaaagggtcagtgtgtttcttgtgtgtttctgtcttcactcctctgtccgctttcatctctttcctggtgagtctctgccctgtcataagcaaataaccttagttgtttcctccccagtaatggtggcttcaattgctgtggatttcctggcctgatttcaaggctaggggaaaatgcctgtgtcctggttcagaacaggcagtctctttatttcttctgtcttgccgtggacaaatagaatcgtggcccttacgagttctttctaaaaaaatcacctttattgaggtaaaatttatatgaacaaaaaaatagaaccatttgaagtatctgattttggatcattttgaaaatgtcccaaatgtcctctcgtcaccaccgtaatcaagagctggaacatttcgccaccccagtgatctccctttgctggcccctggcgatgctcatacatgtggtggttcttcacgcgaaagcagctgacctcaaagagggtgaacatgagccctgctttcctttcctctttgacttcctctctgatccatccctaaactacaggattttgtcatgttagttcctattttctattaccatgaatgactgttggcgcctcaggctggggaaggttaattgtagtaacaaagaagaggttttcctggcaggaaccatttccttactcaggaaacaaacgctttcctttctcacagtcatcttctccttcttatgtaagtagaaatattaagccatactcagtctgtccaggtcctgag

SEQ ID NO: 63533 - DNA, 1128 bp, Homo sapiens
ataaggatgagtcaggtgcaggcttcggttgctcatttgaacagtgattctgactactgttagagaagggatatgggagagaagtgcaggggatttacttagccaaggctgaaggcagagaaaacggtcattgctgcatggcacagctacctgtggccagagaggagccatggcccagctcttgctgggctgacccaaaggccgaggaattttgtgtgccaggcacccatctgtgacacaaccacgtgggccaggaagctgtgtgtgtgtgtgtgtgtgtgtgtgtgtgagcaattaatggacaggatccagagatgctgagagcagtcctgcacagtgaagacagtatcaatatccctctccctgagaaacccaggagacccgttcctcatcatcgatatgcttcaaggaaggcataacaaattgatttgtgtaggaacttgaactggattcactgaagaatctcaggaagtttgtacttttttcagtttgggctttgtgatacagaaacacgcagatacttgtgggaacaacgtccctcaggcgttaaattgacatttgggattgagtgaaccgaagcattggtggtagagatggggaatgctatctgaaaaaccagaatcagctttaaggaagctgattacaaagagaattgattacaaaaagtatttttggatttaaaatacataagatgtaggcagtcctaatttaataagatataagggattgaagcaattgttgccatcgtctttctttttgttctggactgctgtcacacacaccatagagatgcctccttgagtgtcttcaaagtgctgtggatttcctttcttcagccgcctccgaccatcacgtccagccatctgtcctgtttgatcaagtccgcagagtgggtcgaggggcaccaattggcagaactggtcttggtgcattttcccctatcaagtttatctgtttttccggaggctgtttggctcttccccaaatcttccaaagacagaacacttaagtctaaaaggaggatttgtggaccatatatattttagctcaaaacctccaagtggaatcattttaatgtgcgttttcttgagaaatatgtaaattaataattgcttcatacattattca

SEQ ID NO: 63534 - DNA, 1046 bp, Homo sapiens
gtcacttctgggtgggcttctgttcctgttgctggatgttgaatgcaagaagaacgatctgagaagagactgtgttggttgtgctgtatttagtcatgtgcacactgggcaccaggaaagcaagtccctgagtctctttagtacatgatttcttctagctcctggtagctgatttctgtaactgcatgatgtgttgtctacagtaactagcctgggacagtggaaagagccccaggtcagcatgcagtctcctaggttctgctttaggacctctgtcttttcttgggcataaactcctccctgggtgcacagtccttccgctaagatgaactgcaacacaatatagggttttgacatatgtattttattgtcagagcaaccaggaggggagtttgtgcaggaccacatgggccaagacctatgtttttttgctacctttattctcctggtttaaaaaatacccaccattccacagccctgtatattctctctcagttttctcatcctccatgtggtgagatcctgcctgcagactgacagccctgtaaattctttctgaacttaacacaagccacatccttgatgtacccccttccacctagaaaacagacttcctgcctgaccaattcttctcacacagtgttttctgcatttttcttgcatcttgccaattttttcatctactgataaatgggactcatttgcaatttttctccattggctcttctttaatttcttccctctgacaacttgttactaacagagtaatggaagtttaatccttagttttccagagtaaaagatacaaaatatctgctcccccactgccttcctttaaaggatggctcgcttttttacaaagccttgtgccgatgtccagaaaacatatatttgacaaacttctttttcctgttgttcaatagtccacgtgctactgtgccccctccttccaatttccaacacccttttacttgctctgtcaccttttcatttcaaattccatgatactgaatacctcaagagtgaagtgcagattaccgcatttc

SEQ ID NO: 63535 - DNA, 1254 bp, Homo sapiens
aatatagtggaaattatgtaactatgaatcagcttaaaaattctaagtaatcactgaaaatgagtttttaaaaattaaagtgattaaaaagaactctgaaattaatatactttacttaatgatttattccatgatgttgtcaacaacagtactagaaatgtggcctctttccatcggaataaggcattaactgggaatgtgattatgccctgacagcttccccctattaatgtaaggaatagaaaactggggaacttcacacttaattagataaattgggatatgcaatataaggcttttctttatctgtgggattttacaaaaactcgactttgcagtcagttgtatattgtttgctttagttgattatatttgaaatgggtgattggaatgcgtctcgtgcctaggataataatgtgctatgatccgaagtattacatccttaagaaaaaaccaaaacaactctatttggcagttgcagaattgtagaccatgtgaatacctagcacatgcccagagacagaagcgttgcaataaccttgccacagaacaaaaaggtcattttatctttactctgatgtagtctgatgctgtagaagcatggagtgaaatacttatttttatattaagtcagacttcaggatttatttcagccttcctttttgagaagctttctaagccctcagcattaagcagcatttttcctcatcacacacggatctgagcaggtgaccgcggctgggataggtgctgttgtgttgtgtgcaggtgggctggccagccattgggtgtgtgtttttcctagagtaagaagcactccaggctgagatgagagctgttgaaatgagtaacatttccgtctcctgtgatacgcgctgctgttgcttctttcaaatgatcagatttacattcttttaatgggtcctttaaaaatgtaatcgagtgagaaggacttctaaacatttttctttggcctggatacacacgaggggattggaaattactaattcatgaaaatgaaaatgtgggcttcttttaaggaaaaattccctttgaacattgacagaagtgggcatagggaaggggaagattttgcctggattctccacttaactcttgtcaccactggagcatcctgactccctagacacaagtgatggaagttattttgtttccactctaaacactgtctcagggggacattgatgggatggtggagggtgtgtttcattgtgacaacagcatctttggtgg

SEQ ID NO: 63536 - DNA, 1046 bp, Homo sapiens
tgggtttactgcagaagaagtaaaaaccacattgttgaatgggcacaatatgctctgcaatccttacatattcataccaaacagcaaagatatttgcaaaaccagactgccttaagttaatttttgcgcaacttaaaatgaccttgtcattgaccaaaatgtataggatccactgtagcatgatgactttatgccagttcatgaaatggatgttctttctgatctttgtaccacagagttgtttactttcagtaaataaagtggctgcacatgcagtgcctgcaaatatgctagtgatagagtttctgtaggtcaaagaagacgtgctggtgtgggaagcagctgctgtgatctttaggtgacactgctgcagccaaactgccctgattcataatgaaatcaactttcacttgctgataaaaatgctaaggaatgagtccaccagtgacaggttttctaaacaggccatggtgttactaacaccatgacatagaaaagttcatgcctctttcttgtttccttttcttgctgtcttctaggaaaggccagtatttgatggtctgtcttcacagttttaattaagagttgtgtatcttggttctgatatgcccatgtggtttccaaggaaaacagtgttgcaggccatcctccttgtgactgtttataggttggagttggtctgcctgaggctgggccatgactgtgacaccatttacacccagtagtccagccacatctcagatctctgtggctgtagataactaactgcctctcagggtacatgggaaatgctgccaactgcctaagttgtttccaaggtagcaaggttttcccatactttgagcccctccccatttatcttctgctggagggtcagagattgaaggagcagatgcaggactacaggacttctgcttcttggaagtgagttgcacacttgtagagtgactggtgggcacccttcattgtatctgggtgtctgtagaacaggacctttgaggcagcaccaatagttggctcagaaatgattatagaatgagacagaa

SEQ ID NO: 63537 - DNA, 1560 bp, Homo sapiens
acagttacacttccttcatgttacaggatcaacttcctcattgttcttgcaccaaaatatttctcagttccttttattgatattcagggattcgaacttcatatagtgtttccgcagaggatgtgtgtgtgcacatgtgtgttttaaattaaagcatacaactgcagtgttgtttggcccccgaagaatgtttacacgacatactcttcatttttttttcaaggcccgatctggttactgatcactaggtccttgtagaatcaaaacacttagaactaaaacagatttgctgttgagtcaggaggaaaatacatggcaagaagcagctccaatctgacaaaagcaggtgagatccttttaccaaggttagccactgtgtgtttggcatctagtcaatgaggtgtgcatgtcagcactccactagatgtgaaactgctggacagaaacttcaagactaggttttcctgtatgctcacaaactattcaaaatttaagttgtacaaaaaaaaaaaaaaaggcaaagtaagatccctacttcctattgtgaaaatcaaaaaattgatagacaaagtcattaatagactaggggatttgatttctataaaaagatacttgcaaaggtgcaaagaaatgagtgaaaaaataaaggaactaagatttacattgcaatgtgtaatcaagagagaactctaagtgttactgttgatttaaaaaatacctaaaaacatttgattcacagctttcccctaagtatgttgtttagtacaacttactaataggttaaatgtaggcgacattgtcccttggtagcagctaaactaaacgcactgtttctctttgagatggtcagggcttccaccattaatacaaagcataacgaattgtacataacgtctggctgcacttaccatggctaacagtgtctcggaggatcgatccacaaaaacactgtctgccatggcacagaatgcctgtgatttattggtgggtggattatccatcgtgtatctctatgtatgttctcagattcttgccagaatgtattatttggcctttgggtaccaaaagattaaaaatgagatctaagaaaacttagtgtccaatagctctgaccctgtctacttgcagtgattaaaggcatatcctgactttgggggactcctggctgctggccatttggaaaatgagcagtaaacatgtcgtaagtctggagatgaagaggatgctaaatttgaggtgtcgttgtgacactgagatgtggtcacttggcttagcgctatagcacatgaaggcaaatatacatatagtcacattttagagattattcatggtctccgaccacttgaaaaaattgtgctttctccggaatttgatgtgctgaaaattgcactcgccccctgcttatttgcaaaatgaaacataaaaatgaagtccttcgcaaacataaggcttgctttttcttctcattatttaaaaaaaaaatcaaggcttgaaaataattatgagttatagctgtgtacagggtgacagcctgccatctcgcaggttgataatgtatta

SEQ ID NO: 63538 - DNA, 1148 bp, Homo sapiens
agttggtgtatgtatttgtggaaatgaaaaatgtgaaatatgaataaccccattgtttgtccacagtctgttcacatgggcctcatggagtaaaacagaaaaccaaaagtatgagtgggcaggggtcaccttagtacatctataccaagtgcacgcaaggtccgttcctgtgcaatgtatcacaagatcagagaaatctatttctctgatctcccacctaaaacaattctggaaggaaatgaccttggctgacattctccttgtaaaagcttatctgtctgaaaatctgataagggccatagtgcccaacgctggggaaaatagtgtgttcatggagtcaacaccattgaacggtactccgccattactaaccacagtttctttgggagaagcgtggggagtgttcagtaaagacaacacagaagtaaaattccatcactcaagccatggcgtgcaagcacagagccaatgtggaagcacatttgccaagcagtgataatgtttgcattagaagatggtgttaaagatgatttttgaactatgttatttcttacagcatttctccgaaaattgctgtcaacttgtctagagccctctcgtctccatgtctttgaaaaggaccacatttgatcttctaacttggagtcctaacaggtctgcttggcagctgggataggacccccggtccatgcatcgtttttctgtgatgatctctgcattgaggagttctgcttcccttcccactcaccctgtccctccttgggacctctgcgttctgggccaggccttgggaggattccgctctgtcctccttccatgtctggtctggatgccagactaaatgtcagtagatttcagtaaaggctcagcgttgatgataatgcatgagctcataacattttataaccagtggaaccgtaaaccatttataaacatgaaatcctattgatttagagaaccattaatcctagacaaattttgacattttggaaagacagaaacagccaagctatattatctggagttttaaaacaagttcaggacccatctaatgggccatttcatgttttaaatccactgttccatttttctcattgtcagtgactctaatattactcaaaaaattaaaaaaaaaaattgccagagaa

SEQ ID NO: 63539 - DNA, 1016 bp, Homo sapiens
ctgtaagtttgcatgggagaacaagacatggatgtagatttgtaaagcctttgaaatttggagacaccctctggctcacttggagtctatacttccgagatgctgtggccacccatgtacactgctactgagtcacctgaataggtgactcctcctgcccaaggaactcactgggttctgaacacttttctaccgaagaaacttctattcttaagcttctgacatttgggggtgactcacagaactgaccgcaagctgcgaggtcatccagctcaatccccattgctcaccctcccctttctctttgctcagtgggaccctgagggaagtgaccctgtgtatcagcaactctcagccaccagggcagaatcacacagaccagtgcttggtagtcagataggattacataagccctcttagctgatgtgctagattaaccatatggccctgtcctttcacgacataagtggtgcacccatgatgctgggacccttaactaactggcttctctgtctttgtcctgtgactctctgtccttacttctcaaggttcatgcttaccaagaggatgctagatttgttcctggacctgtttatacaattagtactcactattgaaatgatgtgattattgaatgtcatgcaaaccactgaggcatgagaagatagtcattgctgtggattcagtgctttggaaagagtggggtaccacaaaatattcaatgaaaaaggtagagacaggtcaagtatggattcagaaggattctgatctcagattctgccacaggactttgctccactttaaagacaggaaaattggtgtggctcatggcagatcatttgaaactgtagtgggggtgccacattcaaagaaaacgtctgggcctcacctctaaaggctgccctaacttgaaatcattcaaatgggagatttcaattcatgcgattcaaattaaaataacatgtttaagttaggtacgtgtcaattttttatgatttccccattgattgattttt

SEQ ID NO: 63540 - DNA, 1038 bp, Homo sapiens
atttccattataacatgatagggagtttaggaagcagcatttgatgagctatgttccacttggtagtcacagtgcagtctttatttgaatactagttcatttcttgagtttcacactagtttatttcattgacaggactcaatgaaataaagactttgggaggcagcaggagtccagccgaaatattactctgcagactgtcctgggaccaaaagccttccagtgtaacttctgtttgtagcagaagtttggctgttgtagggatgttttgtcattgtgaccactccaaagggagtgattttaaaaatcaggaaagaaagatctaaaactccactcttcctcaaacactacctcttctagaatgcctctcccatttataagggggtgacagtcgggtctgcaggctaccgagggccacatctctattcagtttctgaagatgccacccaaatcacccgtctgtaaaatcacatctgcagtaaaagttctcgatgagtagtcatgcattttccctgctcgtatgagataaccagagcgatcacagtgcctcgccctctacctagtgagtcttcctaagtcttggcaaattcctgtggtgcttggtcactcgcagttcttctagcaagtggaccagtggctgatgtattcggattcatgtagagtgatgtttgagccagttcaaaacagtgaccactcgagtcattcctgaaaggacagatttctgtccttcagagacttattcagtcacttttaatgtcactttttataggagtgaattctggatttagagctaagttcatttaaattatttcagttaggttaaacagtgttcacatatatatatatattttttttcgatcacccacagaatattacgtaggtttaggctgaacagctcattctctgaacctaccctggatgtcttgactcactgttgcttggttgcgttaaagacggtatgagctttagcttccaaactaacagaagctgaactctgagtacgtgccaggtcatctacactctgcacttcctaacgta

SEQ ID NO: 63541 - DNA, 1062 bp, Homo sapiens
attcctggcctctacctgctgcataaccggcagcagctcctcagttgtggcaactgaaaacgtctccttccagactttgcaaatggcccattggttcagaacctctgaggttaaggaatgtgctgatgtggccttcggtgcctatctctacctgtggtttcttctgcctcctcccagacaaggtctccaggtgacccagctttgcttttgcttttaaggaacctgggccctatctgggatgctctgtctggatcggaggcatggacggccaggtctaggctttcccttgggagagaaccctgatgggttgaagattgtgtagcctcaagcctctttgctctccccatgtctgtgttcttaatgcagaggacagtaactttgaataactttttagagggttttttggtttggtaattgttttttgataatttggtggatcactaaaattattctccagtctaaactttagaaaaagaacttactcataacatttctcaccgcttttatattttgtttgtgaaaaattacatttgcaaaaagaaaagaaaaaaggatagccatccttctgaaggttttgactatatcttaaaatcctaaattactgatgcaggccaaacacagcttcttcctgttgggagtttctgctgtattcttgttgatgtcagtcatataaacaaacttcaaattaaaaaccacaaggaacagctgtaggggctctggagcagggattctgcccggagacaggcaggcagcacaatcctcgagagttcccaggaaatgaaattccacatttggtgtgagcagcccaggtctttccatggtattcctagcacatacggtgtgctttcaagcctttgatctataccctctgaagggcctatgttttacagcctttccagaacacagagcccagggctcacacctatcgattccaagggagcaagccatcaaacttataccaattcttgaaaccactaagatacatttgcaagataaatgggttcaagctctcctacatcccacggttctatacttggggtggggtatttagaggtagcttag

SEQ ID NO: 63542 - DNA, 2595 bp, Homo sapiens
atgcaacacctacagctaagatgatatttaaattaaatttagaagtgaacataagctcctggatgaagtaaataatatgatttcgttataagcacagggaatgtgggatgtttcaatgcagatttatggtgttttaaagaaactttgaggaaaaaccaaccacatacacatatgctgactccatggcttatgtttgctctaccccacctgtcctgctacaactgggactggcaaagtgcggcctgcaggccaaatcccgccggggcctggttttgtccagcaaactaagaatggattttacatttttaagcacttgaaaaaaaattgaaagcatataatatttgtgacacatggaaatgatccgaaattcaaatttcagtgtccatgaataaagtttttacttttgaaaataaaatggtgaaaatttttatgaaaatacctatttctagtatcctcaattttgcctcttggtctgcaaatccctgaacatttactctctggctctttagagaagaaaatgccaagccttatgttagaatgtcttactcccattgccataacttctgagttactttccctggctttattctctggtcagttctgtcagacccctgaggccgggcagattttggcctttgtaggggaggttgctaattctcccccctaattaaaaaattaataataatgatcttggggtctttctgtagtatattgttgaaggttgtataaacataaagggttgatgatgagaattttctggaccaggctggagttgccttggctgtttcttggtccagccacgtaggaacagctggggagtgtttcatgccttcacagtttctcctattttatccagcctttcctctctgacatttttaacatgcagatgtgtattttctggatattattttgtgtccaggcacagacatgataaccggaatgttaaatttgtggcaggagaaaagctcccatctgcattagcttataaacactctgggggcaaatttccacgtacagagctactcaccagagtaacagtgtgcacagaaggtcttctgtcaacattgctagtcagtactttttatcccctttgctgtgtaaacttctctgcatcatgggttttaaattgaaaataacttttgttttcctcattatattgtctgttacatcaacatttgacaaaaggattgtctgctacatgccgtgattgtctcagtgggcttgcaaaactcagacgtgacctcatggttatgtgcagtttgttgatcaagtgaccatattctgctccaaagtgttgccaggcactttctgtgattcatcatatttcagccagaattggaattacagtatggctgtctctatcgtctttccatcatcacctcccacatgaggtgcctttggaaccccacagcaggccattccgttctcccgttggctttgtcaggagagagggggatgaacagcctgtgccttatcccctccccttgttcctcaccagacacggtgattttgtagtccttacccctttcctcctcatggcaagccccaagaatgcattcctcctgcaccttcccacctggctccagatttgtccaccctatggcaaggctcttccacatgatgacatcacccttctcccttctctcttgccctatatagacttacagcctttctccatcagctaattctactggagctcggctctaagctcagtgctgaccaaggtcattttgcacagtgaagtcagtgccatccttgagctcaggtgctggcaatggcacggtccacgctgaatgtgttgttaaactgttggcttgggtggcagatgaggtactgctctactattgtgttgtgctagtgggtataagccagcagtcaggagaaagtacctagtacttgtctatatgtgctagtcatatccaaattttaggttcttacagtgggcgaaaccagggatatttacagttttctgaaggcactctttttgtgctcataggaaagtgtgaattctaagcttatagaaccttcctgccctaaacctcaggggaaatgtctatcaagcctcatcaacatcaacactccttccttgcccagtgtccaagtttcccagtgcctcacttgcattagagccctgagccttctaattatgctagccccacttacagaggagcatacagtcacacttcaggtccaggatctcattattcttaggccccaggcttctgatgctccctgtcaccttgcttgtatgctggggctggtgttctgcaccacatgtaattggcagcttgggataggcaatgaacctgacaatgagaggacaaaggcttcaggcacctgaaatgtacaagaggaatcttccaggaccttggagtacttcagtaagaaattgcttttctgaatcttttcttctcttttctttacttttcttttctctttttcttcttcttcttcttcttcttcttcttttttttttttttttttttttgagaccaagtttcgctcttgttgcccaggctggagtgcaatgggcacaatctgggctcaccacaacctccgcctcctgggttcaagcgattctcctgcctcagccta

SEQ ID NO: 63543 - DNA, 1027 bp, Homo sapiens
taaagaattccaactgagtgtggacaaaaaccctgacaggtataaattgtgaaaagttctagtcttcatttttctccccatatgaactcctttgggtgctaatgataagcatgttcattgtagatatggattttgtggcattcactatgtatcgtcccatggcagttagttgtaagtattctcttaacaatgcatatagcttggaaaacatcgcattcagcaccagggacagtgttaaaagtccaaggagctctctttttttggtgcttttgttttctgttctgttgaccctctagcctcccatccttctagaactgggttttatcccagggaccaatttggggaccctggacctctccttgcttgatgccttttgaacactccttggtcaaggtaggcttgcctgttagaggagcctggacatgaactgttaatagggaagctataagaacatagactctgcgacagtgcatgaaagagaaggtgatgctctgttagaaacagaagggatctggacaagccaattctacaaggtggtttttgtggagtccagtttttgagtcatttacatttctgttttgtagtgaaccacctttcttcacaggactttgctctactttaaagaaaggaaaataaacttggcttacagaacacagcgtggagctctagtcagggctacctctctgtaatggcctggacctctcaggtttagctcagcatgcagttccccagtttctctagctaccttatacctttataataatcggctctaattcttcagttgttactatcagcaattcctgaatgtataaataaatatatatacttgtatacttacaagtatataacatacctgaatttttttgtgtgtaaatacacacacatacatacctttgtaaatttattttcaaaagtagtgacaattcggggcatgcaggtcttcagttaatcctttttggaccaatagcaaaagagggaatatatgcacctttgtatatttattttaaaaactggtgacaatttgggg

SEQ ID NO: 63544 - DNA, 1024 bp, Homo sapiens
aagccatttggaaatctacataagcaaatgaaaataatgaaggagagtctcttacgaaaaataatttggaagctactgagagcggttgtagccagtgacacagaaattcctgcacaggttaagaactacagggaagcacttgcctgacaaactcaatagtgaaaagaagtcctattaaagagattttacaataaacatgttctaagaaacatacattgcccagggccatcagcgggattcaaagaatactggcttcccaaggagcaggcccatgacccctttgggccaggtcagaccttaagtatagtgtggaaatgtgggggcaagatttgtcacttgtattcaaactcatgggctccgaggtgcctgccctcactaggactcttctgaatgcagatgaaattctgttggaagcccctgtatgctttattggggtggcaagtggggagaggaactgactttccccagcttcaagagtgttctccagctcctgatttgtaggctttagaatattttccaagaaaagttccattgattttatttttatttttttgagatggagtctcgctctgttgcccaggctggagtgcagtggtgtgatcttggcccactgcaacctccacctcccgggttcaagcaattctcctgcctcagcctctggaggagctaggattacaggtgcccgccaccacgcccgactaatgtttgtattttttagtagagacgggatttcaccatgttggccagactggtctcaaactcctgacctcaagtgatccactcgccttggcctcccaaagtgctgggattacaggcatgatccaccgtgcccggcctccactgatattttaacttggtcatttgagttcattgtcgtatcatataataactatgtatcagtgtacacagagtgcattttcctgttttctttttttgtttgtttgtttttttaaaccatgagatgcaactaaaataccaacttcccagttcagatctggtacataaagtaagccctgtgaatccc

SEQ ID NO: 63545 - DNA, 1425 bp, Homo sapiens
gccaccatctaaaagtaagtgacatgactagccctctattaaaatgacctctatgtctcaggccagcctggtcttgtcaccttgctggcctccactgctgttcactggatgaaagagtgaaggaatcaaattcttcatacattatgctatgaacaactaacaggtaatcatgtgtaagaacaacaaaaaacaatctctgcagcatttgatttaggtgggaccagagtttctaaatcctggcactactggtatttcaggatggatcatttgctgttggaggggctttgctgtgcggtgcagggtggtcagcagtccctggcttctccccactgaagaagtagcaccgctccctcccagtgtgacaactagaaatgtctccagccattaccagatgagcctgggagcagagtcttgcctggcagagaaccactgcattagcccttgcacctctggatgcctcgggctcttgttcgattatcctatagtgtgtcctgaaaggtgaggcttgcgtagacagcaaaggaagtccttggtgctttactaggtgctgggggtatttggagattgctgcaatttgaaacttgaaaaactgggcagttttagagaggagagaaaaggcaagaaacagactggagatgcaccaatatcttggccccgtttgggatggctagatgataggtggaaggagggacaaggcgtgcctgctcaggagaaagcatcgatggcttttagagattcttatcccagcaggttaaacagatgcacacaagacagcttggtgtgggggacagtatgggtagcagtgggggtggaataagaaaattaaatcttaaccttcactctgatctcctattcattctttaactgcctttgttgtccaggtatgtcagaatgtattgtgccatcattctgcagaagaccttcatactagggaaaatttgaaagagagagcatttttacaaaaagcaatttactagtaatttatcagccttttccctgctacttctgaaaaatgtgtgtctgaataagtttgtcctgccatgctattcatcatcaccatttgctagggactgcactgaaataattttcttacatcagttggctggggtaagaaatattctaggtcttggacgcaaccatcaaactaatacaacaaatcagaagaattaattgctggtggccaaataataataaaaaattctaagctcttctctgttttatagagggttgctggtacataaaaatcatttcgttgttagtaaaaaaatgatggtaatacttaggatttttaatcactttagtttgttattgctgacttaaaaaacagtaatagtaattgagttcttattctctgatagggaaaacaccaaggaatttttgtggctggtttattttggcttcaaatgaggttatgagttctttctg

SEQ ID NO: 63546 - DNA, 1669 bp, Homo sapiens
gatgcaggcagctgccagtctgaccgagacacctcccagggcccagcagtctccgcatatagtaagatagctaggcaagcagtcagaggagtgccacaagggattgtatgaaattatgggttttcctagtggctttctcactgttcagacaccttggagtcaaagatgctggtggggattcaagatgaactgggtcagcattttcttccatatgccaagggggtgcctgaacatgaggctactcagaatgggagaatggtgaaaatgaacatcccattcttcaccaccggcttccaccggaaggggaggtaaaatagaacctcactcactaaatgaagtcactcacattgtgaaatagttaacttagagacctgtttcataggtgccaattgagtcttcagaactggaagtcctcttttccttggggcaaagccagctgccatagatggtggactgtgtcttagattcattatccggtttaattttctttatatagtgaaatgttattttttccctacatttgttgttttcagcagaggtcactgatgaggaccaaaaaggggtgactggatgaattcagacacccttgtgtgactgagcaatgcgtgaggaactgttttcttgcagaactatggctccttggaggaaacacggagatggcacgccccgttccctcgatgtgtagaatattgcagtgaaacctctgtcattaagaactgatgaccacctagtccaaagcagggaaaaggggcactcacagaggttaaatgtaggcatcgaggcagaagaaaacctatcttaggttcagcccccactcatgcatatctgcggttttagaaaacactcttaacgaacaaaaaaacctatggtcagttgctttagccacataatgtaaaccacaaaggctcacactggcctacttcggggagtgagaacaaaggagggcaagcatgcatgcttggggcttggtgcttggtgctcatgttttaaaagaaccagggaatggccctcttaaatggtccagacttttaatttatgtttcactacccagttctttgattttcagcttatgttgatgttaacctttgctcatcctgctacattcatagagatgaattaccaaaattttatgatgttggtgaaaatcaactggaaaatatgcctccttgaaatgagacattatgtcaatgtaaaaaaagttttatttgcagcagttagctatgccagctaataatggccaaaaggagttcagtacagttggttccaacaactcaccaaaatcacctgtgagattggtaaaaggaactaatttccctgcctccctgtttcccatcatcatgacagtgacagagtgtgagacaggagggctgtgctttgaacacagctcatgagtacctttagttacgatagcaggtgtcccactgaccctggaggcttcctggtgatgaagcaacaatcagctggtagtttggggcccatcagaggcgggagttggcaggacacagaagaggtggtctcccttttttagacttagtgggaatctcactcacatgaaaacacaaagatacatactagaatgtacttggggagtgctttgccttcctgattatggtgaatctttttttttttttttttttttttttaactaaacagcatgttttgactcatg

SEQ ID NO: 63547 - DNA, 1048 bp, Homo sapiens
caagagcccaggctcgggcaggcacccaaagcaggacatcatacagtttcctgttctatgaagcacccaacacataacacattaagtgttaaactcaatgaagagtcccattttcagcaaatattcctgcgtttgcctctatctttttatctctccagcacctccttggaacagatgccctgctactttacaaggcttgtggaaaagagaaagagaacagtagcaaaagcctgtgtagttcatgaatagaagttagcatcgtagtgagtaagcagtactgatgatctgtgaaatgattctctgtggacttgagcatgctaaaaagatcttgaaaaaggaaaacataaatctttccaaaacctcacatgacccctgtatgctttcgccttcttgaagctttggaggagagcataggtgtggatgaaatggagtcttttaaaagttgttttggtttttgtttttgtgtgtgggtttttaaagagagcatatcctgccacgtagaagaaaatccagggggtggctgtcctcctacaggaaggaggtaaacaagcatttttccttaagggctctattccctcagcctcgctccctcgaaggccacacttggaggccaggaagttaatccattaaaaaacaaggagaagaaagagagaaagaaagaaagaaagagagaaagagagaaagaaagaaaagagagagaaaagcaagcaagcaagcaagcaaaagcaaaagcatattggtctctaccccagtccaggtaaatcagaacttctggaggatggagactgggttccactgtttgttttaaatgcctaatataattttaataatgcacatacgataaagaaccactggccttcttcctttatctttttcaccctttgttgtcttctatttcctgctgtatctccaaagcttagagaagtttgtggcatacaaaaagtacccagaaatattgactgaacgaagggcttaatgaatgagtgaatgtcacgggggagcagggaggttgagccccttccatttttttctagaatgaacctggaca

SEQ ID NO: 63548 - DNA, 1044 bp, Homo sapiens
aaaacaattctttcccaatcaggattccctgagttggtagcaaaatcactggctaggtttgtgttagtagcctcattaaatatttattaagcacctgttatagatactactatgcttagtcatttaaggatttgcgctgtgaatcgcttcatccaatttcctcctatttcaaagtatttcttgtggacattctaggacgtaagagataatgaaaaacttattttttaaataatatttccagttgaaaattcacactcaaatatttaatagaaatcctatcttccccccccccccccccccgttcctgctggctcccagatttctgttgccattaaaatcccccaccgccttgctggccttgggtagcatctttaatcccttctttctatcttgccacattacaaagacttgtctgccagaaggttttactcatagctgccccctaacttacttcccagtgctactgagactggcacattctcatctgtgacaccttctcaactggtctccaactcctctcctctggtttgcctctagttataccgccttaatcttctgagaatatatgttcttgtttcaaacatcaacagaggaccctcttgccctgctggttcctcctcaaactgactccagactatgcctccactctctgattccagcacctcaacctttgctgaatgtcacttctcactcttcccatacaagtctgtagccctgagcaccctaccacttggcttaagctccaggactaatgtctgctgggctcaggagtgcaatctcaagcatcacccacgaagtgagccggggcatcactctctgcctgtaatctcctatcctgattctacctgggagtctttaggctcctgccacttccttgccacctcctcccctcctcctggacttgagcttcttggagtcctctcacttggtcttgtaacaccttacacattgccttggccactgctgcaacagctcagtacatatccacaaatcagaagtcctctctgaacaaagccatctgcatatccatctaccttccctatg

SEQ ID NO: 63549 - DNA, 1030 bp, Homo sapiens
aaacacaaagactgctcaatttcattaaggttggcagtgaataggatatagccccatgctgcttcctcaactgaacagctgtaaaaaggccctcatgccatcagcctgtgctttttcctctttctctctgggatgtgcctgtccatggaacccctgctttgggatatagctgtgatcatctctgctgagatggagtgagagcaacttttatttgcaaggctgcctgtagtattttcagcattccgtagcctccttcccatgtctctcatatgttgtagtttactgcatttcatttcatggccaaagctagattattaagggctgaactggaattttccatattaagtagaatataaacttcaacaagcattttgatatggtggggttttcttttgtttctttaccattctattggatagaatagtataattcatatgaatgtatgctgtgcagagatgtaagactctcttcttttctttttttgctcaaacttcctaacagcaggatagtgtggtaaagagaacatgtctatggatgtgcaatactttgaataaacagttcagtgctctataaaataaatattcacaaataatgactttggggagagttatttccaaatccctttgaaatatgttgttagccaaaaggtttatagagtaatttagaatcataattcctgcttgtccctaatatctgctgttctacattcaagttaattttctctcagtcccaattagagctgggaatacatactcagcagaaagagacacatttgtcaggttagaatgttttgtttttattcaggtagtgatttgtcatctgataacatctttatacacctcaaagtccctcaacccattcattatggtttgaataatgtctaaagcacgtacgactcaaatgcacactgaatatcctgtgacttacagtagaggggtctctgaaaggacttgaatttggagccaggaaatgtctctgaagttatggtttttctcaatgtgagaggtaagatccttggttgcctggagat

SEQ ID NO: 63550 - DNA, 1751 bp, Homo sapiens
gttcaaacctatcctttcatggcttagtgcttaacacaagacattgtccaaacaacttgtttacagcaatcctgtcagggtccctatagtttggttcctgcaagtctgtattctgtccttaatgtataagaacaatgtacattttaaataaactgattaaaagtcatgaagtttcactacatatatatcataggttagctccagtattggaataaagacttctctcaatgtttgtatgagaatttcatggtaatgaaagtgtcgtcatgtagtatcaatcatattaaattttgctttaaaatattgaagtcaccccataatgttatgaaatattaaaatcaaatatgtgagacaaaaaaggatctgcttcataaatcatgccagctaatttctggttggggaatgtaggtctccaaccagtggaatcatggtggggaggggttgtggtgcttcacatttatgaaagactgttgaaaatgacgatgacactggttttatctggggagtttttatgacctcacactcccagaatgacggtggtttgcctcaagtatgtagaatttgcctgccttcccaactgagcttcttggatgctatggacgcgttgaacagcatccttcacaagcgttaaaatccgtggtgaacctgtcactgccctcctacgtaaatatctgaccacagagctgctgctttgggaggtagctgtgatcatttctgtatcatgagtctctgagaagcataagtcacctgcttctcatattccagagttcagtagttgtctctaaatgagatagccatggctgggcgcaaacaagagaatacaaatgtctacgtgaacgggtctgtcctgccactccactgcgatccgttgttatttctgagaatcattttgatttttggactgcttatttcagtgtgtaggagtcttccttgtagatgaatgcctttcacgtacaagtctttctcttatttattgatttatttaaaaatttttccctacagagggagaaacaaaacacaaaaattccctttcctgccacaggggaaaacaactgtggcaaaacagagaagcccccgaagtaaacagagtaatagagtacccagcctcccatagagcttgcagaaatctcattgtgcagacatggagcttcccagcttttgccttgttagcctatttcttaaccagtaattctgtttcttaataggataaagggcctgacttacatgaaagctcaaagtcttaatcacaatgataaaatacaaagtcgtggcaactgtaataagtttaaagacatatgtagcttttcaaggacatcttgtctttaaggaaaagtctttcatttagctaaagaaattaaactgaattgtttagtcttttaaacaaaatgatgaatttagtgaagaaaacaaaactctccatggctaatgtaatttatgcaaaatcatgcaattagtgatagctgtgctagactttttcttttccttaaccaaatgcgcctctaataaaaccatcgtgaggagcagtgccatctaatgtaagtagtaaacatggatagtaaatgattaatatctggtgaggcatgcagatggcaggacttccattttttctttgagctccttgtgcatgtttgctaatcattcttgcaaaaaaattgcaaagataaatatgaactttcaaaagtaacattcaacaggatatgaatgtaagaaatagtacagtgtgggggaatagtaaaaaccagcactttccg

SEQ ID NO: 63551 - DNA, 1065 bp, Homo sapiens
gcaagatgcagactctcgctcttgactttgggctccaggagctgccccgaccccgggctgcccgcgggctccctcctccctcctgccctcgcccgccagctcgcagtctcttaggtctgcagcgttggttggtttcccacgcctgtcccggtctgactcgggctgccaggcaccgggaagccccgcggcgccgaccccaacccgcagccccgggaaggtgccaaccccagcgagtggaggagacgagcatttcacgtgggcatctgccttcactgctgctcgcgcctctcctcaacggccggcgtcagggcccctctgttccaactcatcccccccccgaagttaatcagccgtacttgtactttccagggcgctttagtttggaaaatacttaaaagcctcgaaaccttccggggagacggccgcccccagatctcccagttttgcctggctagggctgtcgggcgctcacgaagctgtggcgtctgtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgcccgaatcggggtcggcgcccgtcccagcggtgctctgcccgcggccaagtacgacgggcgcgggggcgcgggaggagggcacgcggggctccgcttaccttccgctgcttacagataagtcgaggtcgatgcagcgcctggctcgggcatgtctcgctgcggaccctggcaagcctggggcggcacggagcactccggacagggcatccgcggccagactcgccgcgctcacgcggaggaagcctcggctccggggacttggcccgctgcgcgcctgctgcccgccccctccaccgctgccggcccggccctgctggcccggccggcccccgcgccgcagctcgcgtcgctcgcgtccctc

SEQ ID NO: 63552 - DNA, 1033 bp, Homo sapiens
agggtctagaatgagtcaatatgctcggcttcctcaggaaaaaaaaaaagtgaaacttgatagattcattttaggaatcaattggtattggctttttatattttgcttaagatttttgttgaaaaagatagacttgcaaaggagaaaatagctacttttcaagtgggatttcctaaaagcagaggaataaaaataagggaaagttcaagacggctaactaagcaaaatatccacgtctctcttcttttgccttcttcttggaattgtgcaggggttgtacagagaattgctggaattccacccctatggtatagtgagtttgaggtctcaatttccacattaaaaagtcaagaatatacaagtcaaacatgttcaagaatgttcataacaggtttatctatatctgttccaaacgggaaataatccaaataccagtcaacagtagataaagatttcttggttcttcgtatagtggaatactagacagcaacccaaaagcactaactgctgatgcatgctttggcatggagggcttctacaaaggtgcagaacaaaggaagccagacgcccagtgtttatgacatgattccctttagatgaagtccaagaatgcgacaaagttatcaatggtggaaaatatcagaatggggattacctttgaggcatactcgttgcccgggaccacagcaacttcactggtgctggatcattctgtctcctgcactagttgcttatgcagttttccacctatatagaaattcatggagatgcttcctgtctcagtgtgacctcatttgtctgagcatcatcactgtgtcattgcaatgtccacatgcatgctccccaataacccttacccctcagtgaaccagtgtatctgtcagtgtgattaacctgtatcctctccagtgtgcaaggcaggagaagagaaaagtgtctccaaactagcaactgcagaagaggagccttccagtttagctacacagcagaacttccttctttaggagactgccgatgaaacgcctgccctccc

SEQ ID NO: 63553 - DNA, 1072 bp, Homo sapiens
gttcccttaaccttaaacatctagaggtgaggaatgcctaactttctaagaatgcagcccagtaagtctcagcctcatttctctagtcctcactcaaaatggagtcgctgtggttcggatgcctctgacatctgcatattccaaagagactcatagatgagcccaacctaagtctgtgatgggcaggttacacccgtcagttcagaagctgtggtagcagatcagccagtgctcaacgcctacgagggaaaagtaactcatatcgccttcgacctgtagggtcgagatcattcccttggggacactttagccttgtctttcaagaacaagacagacacaatcctcaaggtgccccagtggggcctccttttctgccgagaagccctgcaggaaggctttctgcatcattccccttgtcatattctgctcgagccttcactctcctctttctgggcttatttctggtttaagactctcgctttgtgtaaagccccttgcccgtggctcttgcacggtcctggcagccgagccgtgtttccttctggtgggaaccagagctgtttctgaggtgctggtccatgttccagggccatgccactcctctggctttcttttcctttcatggtaagaaactagagatggtttattggcctgaaatacaaatttgttttggaaaacctgagcatcgtgaggactcgttgagatccctggctttctatgatgcatcattgtgaatctgatttatccacagaaatggaaggttttccttttgaaagagagggaagtagctctaggtttttgtttttttctaatgctccctgcaactgaggcagtgatgtatgggaataaggaagagcaggcgtgcactctggctctcccctctcccctcacaatccctcattttcagggctctgagcaaaccccaaggctttcccctcccaactgcagcctctcctttcttttaggcggactcctggggaatgaaacagaaaccctttattttgttgacctttatttggtcagtcttgggtgctggtttctatagggtttcttactatcccattctcgtcac

SEQ ID NO: 63554 - DNA, 1077 bp, Homo sapiens
ctgctaggctgctggtacaaatcatctttctctctttctagtcacctggatacattatgatgcgatgccagacttccccaaaaccccaatcaagaaataagaaaagatttttctccatttcctggttccctcacagtgagaatgagattttttatgaagtcttacatttggtggttattggcccattacctatggaaaccactgtaaagacctcacagtgctgccatcagcatgcgctctggacttcggcggtgccacataaggtggccccagtgctcatcccaggaagaatggcccctgcttgtctcggcaaatgactcccacggaagctgtggagagccacgaaggtggcaggcggcattagaggggctgtaaagggaccgatgcctgagaatttcttctgcaggatgtagaaccgtgtgcatttggatgataatgcagtcagaggagggcttcctgtgattacggtggaataactctcaggctgagcccgggaaaccaggaaatgcacgtctaccaggagccgaagcagaggggtttctttttccctcttgctctgtctcgttgaaccttggttcttctatctgtccctgagtcctgcctctgagccactgcctgttccctgggtggctccagccatggactgcatgggtgccaggcacatagctggtgactctgcccctctggtgagtgcagcatggcctctgctctctccccctgcctctttttgttttccttttctgagggttcctcagcctcatgaagtttaaagcctaatgcagatcctctccctccgctgcattgttctaggtgtcactgaatttctccaaagagaaaaataaaaactcagaatattcttgtgactgatttctgaatgtgacacgtggcgtaatgacttaaacgtattacagccagcagctcttggtataggacccatgatattttattatattttgtttagcattttgttgtactttattattttattgtctttgttttatttagaacactttatatccacccttttcacagagttttaaatgtacgttacggtactgttaactctgggtacgatgt

SEQ ID NO: 63555 - DNA, 1054 bp, Homo sapiens
tgagttttttatatatttgagatattaatcccctttcagatatatgaattgcaaatattttctcccattttgtagggagtctcttcactctggtgattgttccttttactgtacaagagctttctagtttgatttaacatcatttgtctatttttagccttattttttattgtgctttttaaggttatatccaaaaactcattgctcagaccaatttcaagaggttttttttctttatgttttcttctagcagttttacagtttcaggccttaggtttttaatacattttgagttaattattgtatatggtatgagatgaggttataatttcattcttttacatgtggagatccagttcttccagcatcattattgaagattatcctttcctcattgtgtgtttttggcatctttgttgaaaatcaattgactgtaagtgtgtggatttatttccaggctctctatcctgtttcattggtcgatgagtctgtttttatggccagcactatattgttttgattactatagctttatattagatcttaaaaaatctggtagtctgatgcctccatctttgttatttttgcccaagattgctttagctattctgggttttttgttttttttgttttttgtttttttgtttttttgtttgtttttggtggttccaaacccatcttagaattgttcttttaattttagtgaaaaatgtcattggaattttgaataggacttgcgttggatctgtagataactttgggtaatatggatattatagcaatgttaattcttctaatccatgaacataaggtatcttccatttatttttatcatcttcagtttcatcaatgttttatagttttcagtgtacagatctctctctttcttggtttaattattcctaagtcttttattttttgaagcatattttatcacacgtttgattacttttattaatgcaactttcattaaacaaccagaaatttttgttttaagactcatctggtaattcttttctatcagagcagggttaaagtttgctttgaaaatgat

SEQ ID NO: 63556 - DNA, 1007 bp, Homo sapiens
cactgcctgtaaagtggcacaggaagagaaatttgtgtgtgattgaaagaggtcgtattctattaaagtgacagtgttgttattaagacgattatccacgggacacatctcattgtcataaggagtagacaagatacaaaggcagcctttcttgagctgaatggtatgccaaatatttatatgtttcaaaagttcacaaattttgccattttactaatcattgcctcaatggaaaacaagcattatttagctgtttccctgaacaccaacttggaatctaaatctcagcaattatcatcattcacaaataatttatatttctgggcaaatggaagatatcatatcatcattattgtgtttgttcaatttgagtaatgcgtccttcgaggactcatttggaagtagatatgtgtactataggtataaaatggattggagaaaatattggattttaacatttcactgtaaagcctgtattccaaattaatataaaagacatttaggcattctgatatattgctggtaaaaggagagttagtaaaagaatgcaatttgagagctcatttaatagagaaaaaatagggacatgtctcaaagtgtgtttcatgctataattttaccaaacttgtactggcttaatgggaaaaaatatatatcctgtgtttcttaaaatgtcattaacttagggggcaatatttaaaagcaaggaaggctttacaatgttgttagctacaaagcctagcagtgagcaattgcagttaatggcaacagaactgcctagctcacaacccgccaccaaagcaaacacccttcagggcacgcaaacaaacgtgtgcacacccacgtccacacacatactggctgcctccatttgcaacagccggagagacgtttcagctttggccctttaccttccccattcttgattttctgtgttgctttcttttttcctccttcttttcctttccacccagctccgtctggtctgagaaactcccagctctccc

SEQ ID NO: 63557 - DNA, 1047 bp, Homo sapiens
tagggtttgccttcgtgctccagtagggtgcttgagtttatgtactaataacccctactagaattttaagtgataggaatgacctggtaggaagtgagtctgccaggtaaaccgaatccctttgtcacctcgaagaaaccgtttcttattaactgctttacttttgcttgagaaaggcatttctacaacatgtggtgggtgagagagaggccagtactgaatgtaattttccctattttggaattagactttcttgttcgtattgactacatagcgtgtaacaaaaccttatccacagttgtcagctactgagacttgtaacggaatttttaaaaattcaactactccagctcacagcttccctagtcctccctgcctactgtaccctctgctctcaggataataaagacatgaaaccagcatttgcatttcctcagagctagtgtagtttgcaactgtgattatcaatcgcttccaggcattcctctctgttggcataggttttgtgtttgagacttcctgttctttttcaggctaggctgggacctacgggaaataatgattagtgttttgaagcccacacactttcatagaggacttggtatgtcttgcaagtaaaggttcatataacatgaatataaaatagaatatgtaaaattgtagagaaaacgatgctttctagaagttgaaatactcaaagctgactgcaggataaaacataaaggcaaataagacggttgccgggttctcactggttggtgaaaatgatccttgccatttatcacgggaagctggcagtttacaatgtagattttttttttttccaagacagggtctcactctgttgtccaggctggagtgcagtggcaggatcatggctcactgcagcctttaactactgggttcaagcaatcctcccagctgagcttcccaggtagctgggactaccgacacataccaccgtgcccagctaattttttgtgggtttattttcttggagagatggggtttcgccatatggcgcaggctggtctcgaactcctgggc

SEQ ID NO: 63558 - DNA, 1035 bp, Homo sapiens
aattagagacagaagtcaagcctcgctggagtgttttgggggaataaatgagaaagcgcatgtggggtgctttgttcagagcctgacctccagtgaccttgcaacaagccatgtctgtgaccccctccatttttatgaagatgacatgatagtgtgtcattgtccctctgaatctgagaattgagcccacaggtaagggtgtgaagcatagacattgccctggagattcagagcactttgtacatgtattgagaaattacattataaaaaaatacaattctttgctttcatagattcactctcttcttgtgaggatatttgtatatattcaaattgcggtttcccttgatttataggtaattaagtcaacccattttgcttgctgttttcctagaagcagcatttgtgaattgctttatgtgacatggctgacactctgtcaagcataggtcttgtgcagttgtctctgttcagaagccagtcaccaaaatggtggtcctgtctgccctggcatcttggaaggacagagctgcagtccccagagaggatcctgtgttgtccctcatgtgcagatgaggttctgagattcaggggggttgaatgagtggctccgggccccctgtgtgagtagcaggagagactgcagaactggttgctcttaagccacatccaaggccaggcacataaaatgtggacagtgacgcccaccacccatgcagtccttgggaagccccgttggcataacgagaatagagagcttgacgaggaggtcctcagtgaatgaatgccagctcctgaccacgctcagttttggtaacagtaagtggcactgtctacagagcctctcaggaaccggggactccacctgcctcctctccttctcccaccctcagagccaatcatacacaggacccagtggataggactggagttccggaagccagctccccagcgcctcctccgagctgccatccttctctcctgtggcaggggtgtcttcctctgaaatcagtgtccatctcagtcctggccgca

SEQ ID NO: 63559 - DNA, 1041 bp, Homo sapiens
tgcagtgaacaaatacctcttattctctttaagatctattagccagagctaattccttaattgaatgttgttctaaatttaccaccaaaatgcatgagggcgatctgtgtttgtacgtttcagccaactgcatgacatcagttccatcacaactgcaggaggatggaggaaggctgctgtgcacgattacttgctgttttgtggtcaacctttcccataagacttcagagaaggtttttacttaatactgtacctgtcaaattcccagagctgcaagtaaattgaagatacaaattatgttgtaaagtgaaatattttgtgttattcgcgttattctgcagtttggttgatttaggaagaaaatgaactctgacagcttgatcttttcagttcagtggattctaatgtttcaaaacaaaagacctgcactgaagcctctttcctccatgctttggcagagacaccactgtgagctcttcttcatgctcaaacctcggcagctaccggctccatgtcatggacacacagagtcctaggaagagatagattctgctaaatgctaatgtttgtaaatataaatattaaccataccccgaaagggaaggagttcttttgctggctgactgaatgggtagcttttagcacctgccacttttctcaacatgcaatctattttttatagacagaaaaaatctctttttctagcttttctggtttgctgctgttgcctcagtgatattgcttgggatgcagaggtttggcaaagaggttggaggagcacccctgcattagtccgtgttcacgctgctgataaagacatacttgagactgggcaatttacaaaagaaagagtttattggacttacagttctatgtggcttgggaggcctcaccatcatggcagaaggtgaagggcatgtctcacacggtggcagacaagagaagagagcttgtgcatggaaactcttctttttaaaaccctcagatcttgtgagacattcactatcaagaggaacagcacgaaagacctgcccccatgat

SEQ ID NO: 63560 - DNA, 1097 bp, Homo sapiens
acctggggggcagtgtctctagggaagagaagccgacccaggctaatgcctcagggctctttgatatctaggggtttagcagtggaagataagtcagcaaaggagaccaagagcaggagtcagtaataggaagaaaaaaaaaaacacaggagagagaagacagtgctgaatttctgagagagagcatagaaattaacagagaagtaaccaaaggatttggccacatagtggtcactgctcccatggaccagagctgcctcagtggagtggagtggcagaggaggaggccagcctgctgtgcggcatggaggaaggcatggaaggaggtaggcaccctggctgtgggcgttcattgggttttcatggcgctcagggtcagacagatggtgtgtcgggagctgtgataccaggagagtttgtaggaatttgctgttgatttagggcatgttgggaacactggtggagatgagcggatgatgggtgaaggtggaaacgctgggatggaggaggttcatgagggcaatgagttctagatgaaagggatggtacaggaggggctggcctggagaggagcaaggtcaggtgatttgttgcaacaggagaggacagagggaggtacaggtgtcaacctgtgtgtagatgtaggtggtggttggatgatggaaaaaaacccatgtgacttctgctttcctactgcagaatgaagtcaggtaattagtgagaaggggtgcagagaatagtcaaatattatgatctctatatctctgtgatggccatattaatatttcacctttcaccaatttccccgctaatgcccacgcatggcgtacaggccgcgttggagatccctgcggctcatgctgccttattacgtaatgccctggagaggcctcacaagtagaagagtctaaaacgatagattgctttaaataactcatgctaaatcatcctcctgtgaacatttctcgatggatcttgtcttttaagcttcaacaaaccctattagccatcaaaatcctccagtctctcaaaatagccctcatcagacttgctcccacatgcttgcgtcatggctgggtggccactggagaggttgg

SEQ ID NO: 63561 - DNA, 1088 bp, Homo sapiens
gtctttctcaccctctgttcctttaagaccacaaagcagggactcggacactggtgacacggacatttcaggctctagctgtgggacgcttcaggcaggcagcctgatcttttttccattttgtttagaggtatagattgtacacctctgctccgagctcctttatcaggccccagaaatcatggatgcagcaaaaattttgaaaatgaaatttttcctatattatcccaattactctttggtctccatgaagccattgtttttccaattcctctattgcagaatgcatgcagggaatttagaaatcacatggtaaacgttatgggccatttcctattgctgactttaccttcctagttcctcagagatgtaagatgaatgtccctggtgccagtgagcagccagtcagtgtgcacagagctggaaaaactaatagactagatgcatcttactgatcacgttgatgtggaggggcctcatctctctggtccagctggaaatgtgattgctgcctggggtggccatgactaagggattcctgtctcagctgcctctatatggagaactgagctgaactggtaaacgctcagtttccctttcagaaaagaatgttactctcaagagcagcagtgattcaaatggccttttgactttaaaaaattctccatttaaaaatgtagaagcattttatcctatacaattataaacattattggtagctaataaaaaattttgatgaggcagcagatcattaagaaaatacatatagaccttgcacacttcattttgacttccaatagataaatagatccatttcacaaagcatgtgcatttgtcaggttgctttttcttggttttgtttttttatttgacttaagataggtctatagatgagtgtttgccttcgttttctgtgagccagttttcatacctttaaagttgaataagggctgggcatggtggctcacacttgtaatcccagcactttgggaggccgaggcaggtggatcacctgaggtcaggagttcgagaccaggctgaccaatatggtgaaacctcgtctctactaaaaaatacaaaaaattatt

SEQ ID NO: 63562 - DNA, 1006 bp, Homo sapiens
tatatatatataatttttttttttttttttgagacggagtctcgctctgtcgcccaggctggagtgcagcggcgcgatctcggctcactgcaagctccgcctcccgggttcacgccattctcctgcctcagcctcccgagtagctgggactacaggcacccgccaccgcacccggctaattttttgtatttttagtagagacggggtttcaccgttttagccgggatggtctccatctcctgacctcgtgatccgcccgcctcggcctcccaaagtgctgggattacaggcgtgagccaccgcgcccggccttcatatatttttatgttgtaaaaaggggaaacctttgttctttgagtaaaatgccctggtagtgaacattttttaaggttttttttattttgacagacatacccacatttcacgcagcatcatgcttacccattcacctcatcttgcattcagagagctctcaggcacttgcaaaattgaaggccagaatgaagggagctcagtcatccttgacaactgctggggacaaagttggcaatttgttcattgttcttgcaagcacttagcctcttgccgagcactttaacatcagagaattctgggcatagatcagaaatcagtggctgcagaggcaagctacgtgcaggtaagttaagggcttactatagaaatgcaaaatgccaccattcttcactgtgttctgagaggtttcatactgttgtcgacacctgtgctggtgtagaattgcagatctctttctgtcttttttttgttgtttttctccttttcattttttcattttttactccacgctaagaacatcggaatattttcaactttaccattggtaaaatagtgcaaaggaagtgaagatcacgtcagcccatggtccatattttattccttgagttagcaaatcaccaacactatttagtttagcgagttactcctttggaatttacagtaaagccatatttaatatatttccatttag

SEQ ID NO: 63563 - DNA, 1066 bp, Homo sapiens
ccaacctattatgttgccagacttttgtacctttgaaaatttatcacatgagaaatggcatctgagtgcagttttatagatctcaatgtatgttttttggtttgtttctatactgcttagagtttataatattttggaaaattctcagacagtatctccgttatcattacttctacctcattccctttctcttcttcttttggaactcaattacagatttgttagaccttaggcccacatcacatacatgtcttatgctttttttttttttactttatttttcattcattttctctctgtattttattctagctatatatttctgatatattttttacttttgtatttctttcttctgtcctataatctgctggtaaattcatgcatttttgttctctgtttctgttatggagttttcatttggttatttttgctaattggaaactaaaatttcctattcagtcttttggtcccttaaagactcttggtggttctgtttccgtggatgtgtttctgttgagttttttgggaagaagtcagtcttgttttatgatcacgtcctggtttctggtatgcctggattttcctgaaatgaatgctgtagatcatatgtaaaagatatacagacttaattgaaggtacgatgatgttatcttactccagatagtgtttatttttttccataatttcctgtgtttttatgttgtgtatatttgtttaataccatgaaactccttttctgtgatattcaaaatgaaggtcgtggtagttttgagtggaaggcagttttgtattgtgtttttaaaactttattttccagcaattaaagatgtccacagttatgagaaataatacaaagagatcctgtagcgccttctctcagtttcctctagtggtaatatctggcataactgtaatatatcacaaccaagaacttgtgtcactcttttataggtcaagcctcttttctcctcctcgccctaccccgtttctgacaaccactaatgccttctttatctgcgtaactttttcaccgtatgaatgttacataaatgggctcatacag

SEQ ID NO: 63564 - DNA, 1544 bp, Homo sapiens
gctcacggtcagacaggagctctcatcagcagctgagcctgcatccccaggcgtttgcctccttcctttggttttgctgatttcgcttccttgtggggagacagagctcggcctttctgctctcctgttgcgctggctgtgtactgtttattatagcctacgtagagagaatagagggacagacagcatttctggtgacagggcatatccagtgaaatgcagacataaatcatcttttaaacaagggtgggtttgcggtaggaaggcctgtgtgaggaaataggccctctctgggctccctccgtccttcacagagtgcctcctgacccagggtcgcaagccaggttctgtgccaggcaccactccagagcaggtatctgtggcttgacaaggatgcacagggcagccgatccttggaaagtctgtgtgtccaaagtgcctctggttatatttcaaggacctgcctgagctgagtcacagttagcctctgacaatatttctaatagaccactctgttgttggacagtttttaccatttgcacttccagtatgaccactccaggtctctgcattaatttttctttttaaatcctctgttttaatgttttcgggggagggggggcccacttctatctgaaaatgcccatccagacactgtgggttctgtgccaatgccagggaaggaagctcagggttctgccctgggccctaagaccttagtgactcaggcagccctgctactggttgggagcgctctccactggccacctctgctgcaaagctcttttctcttgcttcatgagaagtggaagagtgtgaaacagtacacggaggcctttctggctgtttacaagggagatgggccaccagtgtttgtcaccggagcttcagggtagcatgcctaggagaggagcaaacaggggccttggggctgtggagtcatgctgggaagatgaagaaaagacagttggtaactgacaaattgcaggtgtgatcattactctctgtgactccctgtttctcagatgcactgttgcttacatctttgtatgcttttgcattcctgctgattgattcaaggtgcaacgtgcctgcttgtcaggtatgctgttgatcacattatttaagaagaaataaagtcgttcccgcagctccacctgcagtgatgggctttaatgttttgtgcttcccgaggaaaacctgccgatgatgtgaagtgacattcaacccgccgagagctgatactggcagacaaatttcatgtcctgtctcctgatcaccagtttgctgcctccaagttgttagggatattaaaaacaggggtgggaagtccccacttgacaggttcaatttgtaatgtgaaaggtgctgagaaacaaagcaaggacccaggcagctttctgccaaggctgctggccccacactcagcaaggcaaagagaaaggggatctatctgctagtagcatgagtgtgggagaggagggggctgttgtagggtgccgtggaggactcatacatgatcctgggaagagcgctgctgctag

SEQ ID NO: 63565 - DNA, 1065 bp, Homo sapiens
aagtgatgacagcttggagcatcccaaagctatgcattattcagacgtgtcggagcgagagtgcccgatttcaccacccattacctattgggatgccttcttctctgcttgctaatctgaatattactcatttcaaggttttgtttatattatcttgaggggaaacaaacagtacctaattaatcccaccaaacataatattggaaaagcaattattcccaccacgtgtaataaaccatctgtagggaaaataatccattaagtgtgaatcagtgtgaattttaaaactattattaagatcagattggttcctcgttatgagcaccataattttagtatttgttcatgcatactgtgttatgccatgttctgtaaccttaaatccttaatgtccaaacaaataatatctatatgctaattagtgtcaaaaatcacaggtcagccaatcaggtgtttcacagatgagccccttttttgggggttagctcgaatctgtgattaattagaaagtgagtcccctattttgaaattctagtgataattgtagcagagggctgaatttatttgcattttcagtaaatcatccattaactgaaatgaaatctttttgttaaattactgctcctggttcagttaggagggagttttcccttcatttttaaatgtactggagtatccttcagttctccttgagtgagaagcaatcgctttgaccattgtcaaccagaaagaatttccccacagcatttctctctttcccagctgggccataaattgtctcgtgactgaggttgctgtctgctcctgagcaagctggaagcaatgatgagctcagagctgggctttattaaatcctaggaagacacataaaaattgttagcagttgatttcgcaggaaacacctagcaaacttgtcggggtttatattacaaagcccagggcctgcagttagcagatcatcttttttgaaaagcatttgggtacctttgtcagagcttttctgcattttgacgtaggaggatacctgagggccatggttgtgagaaaggagagaacccacccagg

SEQ ID NO: 63566 - DNA, 1050 bp, Homo sapiens
ggcaggagaatcacttgaacccaggaggtggaggttgcagtgagctgagatcgcaccactgcactccagcctgggtgagagaacgagactccatctcaaaaaaaaaaaaaaagaaaaaaaaatgcaagctttcgacaaagcctgcctgcctgctttgtgtgtgccttccctttttcttgcagtggccctgtgggtttgcatggccctctgtggccagcctcaggatctagggtcctctctgcttgtagtataagctttgaatgctgtggcccggagcttttccacagcctgtgtttcctgcttctggtctgctctagagaaattcaagtcaggtttggcctggcttggccaacccgagcttgccatgtacctgagtcccaagggtgtctgtcccctaactctagccacctgttggggaggtaggaaggtctgggagggagatgctgaggagagcagagtcgtgtgcagaccaggtgggactggactacaggagagaccaggtgggactagactacaggagagccctggggggccactcctggggccaggagctgctccctgagggaattctgaagctggtttgtgattctgtgtcacagccacctgcatcccagtgaaagctatggttgctttccataggtaaaggcaatttgaggacagcaaacatattttcccccacacaatccgtcattgtctggtgatgggctgtcagtccaaaccgtagcctagaaatcgtagctcaggaagtagagtgctgagaggaacaattcaaacaattttgtttcctaaatgtattcttcagttgaagtctttgtggttaatgttgatagtttgtaggcacaatcactattctatgcatagggacagcttttcctaactctggaaaagagggggtgtgtgtgtgtgtgtgtgtgtgtgtgtgtgtgtgtgtgtgtgtgtattgtcaaaaaccaatggaagagaaacacttcaaaatgggtgagaacagagaacagcatgaaatatggacagcagacagccctgtatgcaatgaaaatgcaggtgcatggt

SEQ ID NO: 63567 - DNA, 1035 bp, Homo sapiens
tctcagaaagaaatagtttagtggcaggtgagagagcatcatgtaatcgcgatgtgtaaaaacgtgcaagaatggaattgtgcagaaaacccagtgcgggcttatcaacccgaagaattccctctgggccccagggaacattcagcaaagaagctaccttggggattgttcttagattttaacaatttgctgggatgagagtatttgagagtggaaagagcactgggctgagggaacagcacgtgccaagcgatggggaacacaagagccgggttctgtggctgctcagggggcagagctccagccaggcctacaaggcacacaggatgggggtgggggccggagctgaggctgcggagcagtcggggaacctcttccatcattgacaagtgagcccaaaccatgccattccaggagtgttaccctagccgcttgttatgaagccctctgttacttgggatgatctgagtggccttccacgcacttcagaaaataaattccttttttatggtgagcgaaattctaatatatatttgtattttcactaaccttaccaaagagaaaaatgtcagcccttttcctgaagtttcttttgtccacttgtgactttcaattaaattttaaaacctccagagtaggaggaatcccccacagagacaataagttagctgattaattgaaaacgtggaagctatttttatgattaccacataccttgtattttatttttactgaaaacacataagtgaggtcaggtgtgttggctcatgcctgtaatcttagcattttgggaggtgaggtgagaggcttgcttgagcccaggtgtttgagaccagcctgggcaacatagggagacctcatctctacaaaaaataaaattagcttggtgtggtggtgcatgcctgtggtcccagctactcaggaggctgaagtgggagagtcacttgagcccaagagttcaagattgcagagagccatgatcataccactgcactccaacctgggtgacagagtgagactttgtctgaaaaaaaa

SEQ ID NO: 63568 - DNA, 1054 bp, Homo sapiens
tgagccaccgtgaccggcccattttatgcatatttgatttggagttggtgaatcaactcgaaaacctcaaaagggggctgtgagaacactgggctttttagggataggtttccacgttcaccgatttcatctgaatggactgttgatgcttggtgctgtggccatgcccttggctcctgcatttaggagcagtgaatgtggcgtccatctgcagacgtggctcagcatcatacgttacaagcacagcttttggtacaggagctctcgggtcgctgggagattgaggattatgagaacttccttctttcacacaggggtttatcccctattcagcattacatcagctttctctgactttggcatggtgttaggaatttatcagggaaatacgttctgtttatactgactacattacgggaagcttggataactgtatgggggactttaaaatttatctctctgtgatagtttttcagctattatgaaactaaaccaaacgaaggcagtgggggccattataaaggaagtttgagaatctgaaagtcttgatttcttaaaaggaattttaccataatctctctctcgataagaattaagaaaaatacttacatgtattatgtgcaaagtgtacccgttaaattcaccataattgaaagatgcaatactctgtcaatagtttgggaattgttttaggattaaaagtgagatccatttgtaagaaaatgttttcattttagtaatgttaatttgataacttcattatattacttctcaatatattactttgagagcaggtaaaaagagttttccagagcctactggaactatgctaatcagatttatggtacctcttattttcctggcctttcattttgtttttgtatttaagtcttctgtgttgacagctgtcatttgatgtgagacaggtgaagctccttcctgctttggcccacagttgggcagcattgtccccggcctgggctggcctcatcaagtgaaacatcatgctgccatgtttcgacattttaccttttcaggttctgcactttttctg

SEQ ID NO: 63569 - DNA, 1089 bp, Homo sapiens
tgggtttccagtcctgccctgggtgggcctggcttcgcctcatgaaaccccgagtactgtttgactccctgccatagctgagtgcctgccccaaccccactctgagttcagcgcacatcctggtgtgaacgccaccatctcagggacatcctgctgcaaagctcctctctgtctccttggtctcttgccacctacagtctttctcatgggagccccacccctcagaaggctccccgtctctcctgtccgtgagttttcctggaattgtcacaatgcagagaatgagttctgtggggagggtggggaatgtagccctgtggctgtcccagcaagtggcccctgtgggctggtggctggctccatttgagactgccttgaaccatggggtctcctggggaggggctggagctgtcaggcttctttctgctggatgacgttgctgtttctggcagcaccattggctgcatctcagactgtgtcccttccttcaattctgttgatgtctcagtttgtggaaattcggaaaccacatgcctttctctctaggggtgacagcattgttggcctccatcctcctgtcagtccttacgagtgtcttcatgccaggtggtgccgtcatggcatgtgttgggcagctaaccagtcccttcagtgtggggcctggcctcctccttgccacctcgttggtggaggtgacctgggatgctggacccactcttgtttggactcagtgtaggattctctacctctttctcccagttacacagccttgaccaagcttctttattcctctgatcttttttgtttgtttgtttttactttaagttcctggatacaagttcagaaggtgcaggtttgttacataggtatacatttgccatggaggtttgctgtacctatcaacccatcatctaggttttaagccccacatgcattagctatttgtcctaatgctctccctccccttgctgccaaccccctgacaggccctggtacgcgttgttctcctccctgtgcccatgtgttctcattgttcaactcccacttatgagtgagaacatggagtgtttggttttttgttcctgtatg

SEQ ID NO: 63570 - DNA, 1031 bp, Homo sapiens
attggattcattctgaatcgactactaaaaacaaaaggctttgcttcatttcttctttcctttttatatttgaaagcactgtttgggttgtgatttttgtgatgcctttattttattttctgggactgtgggtgattttggcaaagatgtatgacccttaactcaaaagggcgcggtttacaggctaactgagggtgggtttatgagcagcattattctgcaggaacacagaactgtacagacaaggcggaccacagagtggggcctgaagcagcaacctgtcagcctccccttgctgcaaacacctgctctgccccactggatcccaggtacactcgtggccatgtgtgtgggtgggcttgaacattgccactccccctccaagaacaaacaccccctctccaacactaagaaaaatatcagcatggaacataaacgttcccctcagataatcaaataattcaccccaaactgtccactgtgccgtcactggctaaagcgagctgacttttctgtatacacgccatatcattttcctggattatttcccaaaacttgacagaccttaggaaagctatttttgagactttgctgacagtttttctggacccacagtatgtatttcagacatttcagtaataactctgtgacctcattatatgcgtatttttgtatgatcctgtgggtattggtgtgaggacacaccttgtattcttatttaaaaatcccaagttaaaaacagccctggccttttcgagtcacgtccgtacatctgagtttggactaggagagtgacttagttcactacaacattttaccaaaagatattgaagcaatgttttttccaaaatatggcataacacagaattcttggatttgctgaaatcctacagatttttctgtgttcgtttgtttgccatattcatgcaggtgatttgcaggtgtgcaacctggagtccagctgtcttgctcttcatgctgggcactgtttgttctctgctcgcccagcacaatttatattacagaactca

SEQ ID NO: 63571 - DNA, 1704 bp, Homo sapiens
catggccagggcgtggggagcttctccaggcacgcttggctgaagagataatgctgtcagaggacagcagttactagtaagtaacctacatttcccttctactctggctgctccttgctgtctaaatagagaaagtggaattaggtttatcatctgtgacctaatactaattcctcttacatcctgcctttgtgcaaagggaaaagggccatttaaaaagtagtggacgaagctttagtattgtaagcactttcaagcgttataaaacaaatctgttgaatgaacaagcatgtgagagttggtattctagagtcacgtgtgatcgcccaaattgtatatttcattacaaaaagtatataaagtcatggtattatagagtgttaaaattatactttatcaatgaatcaagaaattaaaatttctgagaaaattcttgtcaaatcactttcatgtctactaaagcttttaacttcttctctagtaaaatagtggtcaaaattagcatgtggaaagtaggccaatgatactgaagtcgtaagccatgcttccaagcctggagatattgcagcaacctcttccaagcctgacagctccttgcgaagagtgctttcaactgggtagcttgaaaaagccagctaagcaaagatcagtggaatcatagaacattaagacatggcaacttgagaaaacgatttaatttgcacctttttttttcttttttttaattagattttgttttaagtcatacttttcaaatgttactttcagaagctgttattttggtctgtttctttcatcctgcatgtgctaatttccttgattaatttggagaacatctgcatataattccgtgatcttttcgttggcaaaacctcacagctttgcgcaagacttggagagttcacattccagacagtctgggattgtatctaattgaaatgccaaacctaccgaagtgccagagcgtaagtgtgtaattatgtaattttctcttgatctttcagagtcttcctgcgagcaattaatcagtatgcagatatgctgaacaaaaaatttctggatcaagccaactttgagctacaggtaagagaagaggtagacacgacctttgtggagaaatcatgttaaaacaaattgctggtccgagccagtatcttacagtatttctaatccttgaacttaattggtctcccatccaagatgcggaaacggaatttgtagtatgtactattggaacctgaggagtgaaaattatacttttggagtattcgcttaatttagcaaggaaagagatagagttgtttcagagagaagctattgaatcagagtgacaagaagggactcttcaagcagggaggccaccaagtcccggtgtgtgtatctgccaagattgtctcagcccatcttactgtggagggaggatcagcagaggaggagacccaggtctgcacctcgagctcagcttgcttttataactctgtgttccctccatatcctctctcggccttgtgctactagcagtggcttttaccaggccagagaccctgccccccagaccccatggtcctcagaaatgctcctttggtgaatgcagtgtgtgagagagagagagagtgtgtgtgtttgtgtgtgtgtgtgtgtgtgtgtgcgcgcgcgcatgcatgctgtaaggattgattttgcctggcctgatttgtgtgtgtg

SEQ ID NO: 63572 - DNA, 1027 bp, Homo sapiens
tagcatgcttacccctaaactcaggactctaggaatctccatttgtttgaaaggagaggtcctacttgggaagatttcaggactgataagctggcaggggaaatgtggagaggcattggggtcttcgcgccccttatcccatccacctggatgagcctgcccttggtcacaggagatgagccctctcctggccttaagctgactctccctgcctcaccaagaaccctgccctcccgtggaccgcactccaagtctcaccctcatactggattttgcttcataataaaaagcatacttttaaattccctcctggcatctttttaaagaattccatttgttacgcctttggaaaatacagaactaacagctgagaattgcagcaaatgaccatatgggccatagaccattaataaaaatggaatggaaaaagctgcccagcaaaaataatattttcaatcatggagctattttctgtcatctttgtgaggctcagtaaaatgctgcacaacttccagaaattcccatttagttgtaacagtattagaacatgaataatctttgtgtcatcagtgttgccgagctcctgtttgaataatctcttcacactgcccatgccagtaaccggaagccagtaattgaatagccgggtgaatgtcagcggctctgccacttggtggaaaggccaatgtattttccactgtaatatgaatgtgaatgagtttggtagcaattctatcttgtgtattctttaattcattaggattttatttgttggtttgtttatttttgctttcaatgtcaaaataattcttgcctaaagaggaaatatggcacaagaggcttctgtttcattgaatccagacccaaagatggtctgagaggccatggaaaccaagatccttgactccaggagctgcgattatattgaatttcattcttaaaagccctccagcaaagagattcttccataatcccctttaaccagattaaacaggactaattttgaggccatgttcccagagtcctc

SEQ ID NO: 63573 - DNA, 1085 bp, Homo sapiens
ggaagataataagcatgattttgataaaaccagctctgctctatcagcaaatgtactatctccaatttagtgggacaggatcatttaattctgattatagtaacagttcatagcacactagcgaatcaattcgagtgtattctataaaaatgaacgaggatcctggaattagaggctagttgtggatctctggtactgaatccttgctaataaacagatcagggtggccaggtgtttgtgtaaattacttagtttggactagggttagtaaaattagaatcagctgtgttgtgatttacttaccactcatccacctttgttggaaatcattaagttcatcagtcagaatttgatcagcagcatacctaggtagctgtagcttcctcattgcctgtgtttgtgacagctagatttacatggaagcagagaaaacatgccgttttcataacctacactctgtgttcagatccctttggcttgaccattgatgggcattttaaatgcctgtatgtttgcccatgtcaggagaaggcacatttctctgcattctctgtacctttcttgttgtctgtactcattaaacatacatgaaattgaatcatgttttgattaaatttaatttaattttgtgtctctattatttgtcctgaagcatcagccctcatcaaacatttaatctttgaagtctgtctggatcatggcaccatctgggagatggcactgccttgaaatgccaacttttgggctactaccaagcgatctcccttgtatgtgattccaaaaagaactaccttttgcagaattcttttctgtaaagggcaggatagcagtggttagtatcaaaaggttgttattttacagtaaaaatcgttaatgtgagatttcaggagaaaaaaaatctaaagcaattcattcctccttcttcaatagaaccatctgtctgtgctgctaaaatccttgaacttcttaggccagacagaatcaaaaagaagtgtttatttgggggaggagaccatggagaagatcaagaagaaaattggagagattcactaaggtccgggttctggggatgttgctgagtcctt

SEQ ID NO: 63574 - DNA, 1050 bp, Homo sapiens
tttattttgtagaaaattgtgaaacgtataaggtagagtttggtggagctcccagatacattctcagctcttgcatagcttgtccacaccagtgcagagttcttggtggtcaccattagccaactcaaaagcaaaactacaaataattgtttcacagcgttttgtacctgttgaccaactcatgtggcccttttgcaaaaagataagcacataaattttaatgtttcacagtaagttatatgatccagtgagaaatccagttataactttaccagacataggggagttataatttttcagtctgctcttagttaactgacgccatagtcccgtgttttttatgtctttcttccatgaagaagagaaacattttgcattgcctgctggattttgcttccctactcgccttgctccctggagtgagggactgtgattgagcccttctctcttggttacttctaaagtctcgtgtcaaataattagcaagattaccactctggagactaggagaaggatgtaacctacacagcatgagtttttagtgatgtgtttattacactgagggtgattgtctaattttctatttctaagattgtttttacttctcctttttaagaacatactatgtgaatttaataactcagttacctttatttctttatggcaaagaaattctttcgatcacattgactgtaatcattggagctctttattctgatggatttgtatttttacggatttttttgtgcatttggactcagtagaaatgcagaaaatcacaatcaagtattgtgtgtctcattaaaaatgtttaagggaaaatgaaaaggaatgaaaaatttgaaggaaaattctacctttgtgtatcatctttatttttttcctgagtttttcttagtgctttctgtaccaaaagtttttaaggcattttgaattatgaacattgtaaaaaggaagtgtagccatgatttactgttgaacatagaatttagctcttgcaatcctcaacacaaattatttagtgacattttaagaacatacctctgtttt

SEQ ID NO: 63575 - DNA, 1711 bp, Homo sapiens
ccgtctggggcagttgaaaccagttgggagattcccctggttccagacgttgttcatttggggtcctgtgtttccgactccacgggagtcactaatagtgtgacatctcttcatcacggcacccagaggatacagacctccccttaggaagggcatgtcactgttgacaggggagcaccacagttctggcctgctctaggaggtgaggctggctgcccactcagtgtcctgcctggtgacggaggcgtctggccctgtcctggtcactcctggtcactgctggtcagcttctcctcttgccttcatcgtgcagcaaagacagcggttgatcagaagcacagattctgaacaaagtcttcccttccaaagaatgaataaaggaggcttagttacaagctctaaattagagacaaatttgaaattagcttcattctcaataaaaaacaaagctgaagggtggaatgagcttggagttaaagccacttactgttgctaaaggctttaattcgagtgtgtgtgtgctccggaacatacatctttaggaaagggaggcaggtggaccctaagccatgcagccttgtgcagtgcttggtgttagatggtgcgtgtggcccctgtggatggagatctacctctggtatgtaggcaccaactctggatccgtgcaggatggttatcccagaatccagagcaagggagcagcctgcgtggaatattatgtgagggcagtgccgggtgcggaggacacgttgcagctcccgagccaatagatgccaggttgtgccaggagctcacacacagcaggctccaggggcggtgctgggtcatctccaccaccaaaaggacaaaatgaaaagtctgaatggaggttaacaggctcgattaatattgaactgactttcccgccacacctggatcattctgtgggtctgcagcaatatatttatcacacttcacagatgagctggcaggggtcaatctgccaatgacactggcagttaccaaaacgtgggcagaatgtttgcgtgcttcatgccctgctggagaggagcctccaagaactgactagctgtcccttttgctttgtttttctctaaaaattggtctcactgttttttgtgctcatgttgatatttatagaccttacaaggaataaatatctttgactatatgtacatttcccccttgttttcatgttcaaaaggatcacttcagaatgcaaagtaactgacattttcagaaaatgttattcgtgtttttacctataactcactagcttttttctattaaagtctttatatacatttttattattatgttttctcatgtaaagcataagaaaaatgcttgctagtttgatagtagtctgttatccattaaatcttactgaattttggaagtgcgtggctttatatagaagccttagaagttgctcagactgtatttaagatgacatattatctggtttctgcttgacttttttttttcgggggggcggtggggagaaatagagcatttttcttccataatggtacttctaagacatatctaagcacaaagtgaaaaagaattcaattcttaaactggttctttttttagcgatttaggagaactcagaataagctggggcaagggaaggggactgtcttagtccactggggctgctgtaacaaaataccttagactgggtactttataaacaacaggaatg

SEQ ID NO: 63576 - DNA, 1056 bp, Homo sapiens
atggccctgaaatcccctaatggccctgttgaggtccgggcacttggacaaagtgttcggaagctgcaggatttggtccttcacatgccccacaaagccttagataagtgcaacgtcttttgctctactgggaagccagcctcggcccctccagcggggagcctggctccaagtgcagggggctggggaagctgcccaccaggccgagagcagtgcgaggtggctcatccctgcagacctggcaaggggtgactgatgtgctggggagtgagggcactgacgaggaggaagatgagacagggcctgcgtgaggaggagctggccgtaaagcccaggatggaacccagaggtccgtctcagggcatgttgacatgagagaaagcactggaatctggtctagaggtggatgtgagagggccagacctgtttccattgccaggacaaaaacctgagggagccgtccccatggggcaaagaggactggtgtgggacacggaggccttgcctgtgtccttatggcttcagccagctccttccctttcctcctatggaacgtaagaagtttgggataaatgctttccaagatccaagtcagttttctgaaaattttttttttttgagagagagtcttgctctgttgcctaggctgaagtgcagtggtgtaatgtcagctccctgcaacctccgcctcccgagttcaagcgattctcatgcctcagcctcctgagtagctgagactataggcacatgccaccacatctggctaatttttgtatttttagtagagacgggattttgccacgttgcccggcctggtctcgaagtcctgagctcaggcaatctgcccgccctggcctcccaaagtgctgggattacagacgtgagccccccacgcttgtcccagttttctggaatgactggcattccattatcccatctgcttaagtctagattcctgttgacactcagactgctcagtgaccctgcagtgcagggaggttggaatggcagaagattgttgcaagctagacagtacgaacgaggcagtaggataaa

SEQ ID NO: 63577 - DNA, 1026 bp, Homo sapiens
gcaaaagttctattgattttttttttcctataagcttttacagcaaattggattttaagagtttcaagtcctacagaggaaaataatttgttccccagagagcagctttatgtcagcactatgtcatcattcctaataactatattaaaggatgaattttaaagcaggtcacaggaaaggtaaaagaatcagttttctagtaacttcattaaatcaaagagtgatgaaaaatgcatattccaaacattacctgtgattttgctttcatttgcaaatgtttggaaaacccgtatcttggtattggcaactgagtcatatgttcattaaaaataagaagtttgaatttatcagaatgctttgttctctttttgtttattagttcatctggtttggttttttcctgaaactatcagggcagagtgaggtttttctcctgggagtcccaggactcatgtgcagagttttcatcaccgatatataataagctcagctctgatgcataaaatggtttgtgaaggttggttaataagtcccaggcagctcctcctcagccctgcttgctgcctcagaaacagaggatgggctgacctgctcctcgctgggtgggaggtggcagtcagggtgcacactgtgtggtgcctcttgtaggtttgcggctggcaccaggtcatgagtcactttctcaaaggcacaattccatctttctccatacacagctgtcattgtggagcatccctgccgagtatccaaagacaaatccatacagtctcatattaaactgctgtgatgtatacatatttctcttttgaaatgtacgaagatgaaaggctgaactcagccatcatccccagctgatgacaagcatgactgttgtgtccaggggtggtgctcctggagcattaagcaaggcttccagatgttctgtgctgctttcagggcatgaatctgtgcaggggacagacaggagcaaacttcaaatacggcccatcaggagggcgtctttgtagagcaggctgcaggctcgct

SEQ ID NO: 63578 - DNA, 1039 bp, Homo sapiens
aatggtttgttgcaccacagaaatggaagccggaccttccccggccatttctaactacttgtgagagtaaaaggagattcgggggggtctaacaagaatattgggttgcttggagtattgtttccctaacagcttcgttaattggtcacattctcttctctctattttattgcaaaggcaggaatgttccccctagtctccctacactagtaaactgaaaattctaaacttagaattacagccaattcctcttcttgttacaaatcaactccggggtaacattttattgtctcaatttcttggatacaccattgtgggttactgatgccacatacagttgattaagtaagggataacatggattagctctctctcaattgataaagggcgtgtgaattcaattagattaatgacccaggtgtctttggtctttgtttcttgtttaatttacttgcagcctgagtgcatgctcaggtgacacgctggtggttagtatgtcatcattaggcagaagcggttgcatttcctggggtgcctccctttgcacaggccctgagagctgttctaggataatgatcatccatctgccatgatgggggtgtgatcaatatcctcctgtcactctcattgatcagcctcaggcttgtaggcaactctgtctttagttgttgccactaagctgtcatttctttccaaatggctcttcctgtcagtaatctgagcttactgagtttatcaccattaatcattttgcttaatggtgataaacttttgacatgctcatacttggcatagaggtcatttgcagcgctgtgttggtatcaggctgtgttagtgtggtccttacctgctcctcattggcctatcagtgagtgtggctttcacatgtaaacaaacagtttcatcagacctcaaaatagatgtctcttttaacggttctaaccaaccttaaaaagacttaattgttgttttaccttccttaatataaggtcatacactcataggacatctttatatcagctttacttttccacattta

SEQ ID NO: 63579 - DNA, 1027 bp, Homo sapiens
tccccatcaccaaagccagagggctgtggggctgcagatcatgtgggcctcttttcagctgctaatttaagaaagggctttggttaatgggtgtgtgatttagctgtagaggtctggacatggagagctttctccagggcctatctggctggatctggggtggcaagaaacaaggaaggcagggggttctcttctcaatggacggggctctcacctctgctcctgccagacgtgtggaagccataaggatgtgccctctgcccatctaacccggcctagaaggaggctgctgtggagcccaggaagctgggaggctcttcctcctactcaggtgctgtccccagcgtattcatgcttgtaaatatccagtccacccctgagaaactgtaggcctgtgtgaatgtgggatttttttcttcaagaatctttactgtttcaactgttgcaccaagataaatattcatcttctgtcgagtgtgtgagaaactgaatattatccacaaccctagaaatcatcgaatgggcacacccatgtaggcgaccacggagagcccagcctggggacaggttgtttttgggcagtctgtgcctcacattgtataagcggccaccagaaacggaaagaataggccgggcgcagtggctcacacctgtaatcccagcactttgggaggctgaggcgggcggatcagctgaggtcaggagttcaagaccagcctggccaacacggtgaaaccccatctctactaaaaatacaaaaattggccgggcatggtggcaagcgcctgccatccggtaggctgaggcaggagaattgtttgaacctgggaggcagaggttgcagtagctgagattgcaccattgcactccagcctgggcgacaagagcgagaaatctgtctccgtctctatctccatctataaaaataaaataaaagtatttatttttataaatataattgtatttataaaaaataaaaattataaaatttataaaatgatataaaatataattgtatttataaaaa

SEQ ID NO: 63580 - DNA, 1054 bp, Homo sapiens
ttgtctatactaaatgtttacagagtccctgccaagcccagcccggttcagacttggtaccgaggtgggcaggacaaacgtctccaaagttcctccaggagacgacaggcaatattcaaggaaccaagtaaggccattccacatgaccattagaactagaaggggtgagacagggtagtcatccgaagggcagggctcacctccccttccaggggtcctccctgaggctgggagacttcagcagagacctgtgagctcagtgagaatccagggtacagggtggagaaagagcaggcacacaggccttgcctgggcttggactgacctgggaatatctgcaaaacagaagcaggaggtgaaggagggtcgggggaagagccagtggatggcactgagggcagggagcttggccagggcatgccatggccttgtcctctagaagagcttgagtttcatgacaaaggcaggaggaggaagagatgaccagccttcctcaggtgagggccaggtgggagggagtgctccccctgcagtgggctgcagaaagtagaaggtgcggccataggatctcctcacccccccactgtgtgtccggaattggttccttctggtggcttcttggtcttgctcacttcaggagtgaagccgcagaccttctcagtgagtgttacagctcttaaatgtggtgcatccagagttatttgtttctccccgtgggtttgcggtctcgctgacttcaggagtgaagccacaaaccctcacagtgagtgttacagctcataaaggtagtgcagacccaaagagtgagcagcagcaagatttattgcaaagagctaaacaacaggcttccacagggtggaagctgacccccagctgccactgctggttcgggtggccagcttttattcccttatttggccccacccacatcctgctaattggtctattttacagagtgctgattggtccattttacagagcgctgattgttgcgtttttacagaatgccaattggtgcgtttacaatcctttagctagacatagagcgctgatt

SEQ ID NO: 63581 - DNA, 1052 bp, Homo sapiens
tttttggagatggagtctcactttgtcacccaggctggagtgcagtggtgcaatattagctcactgatgcaacctctgtctcctgggttcaagtgattgtcctgcctcagcctcccaccaacatacccagttattttgtatagtaatcatttaatttatagcttttgctttgctctttcatgttgactaaattatttttttaccataaggttataaaaatattcttctaaattttctttggaattttaatgtcttcttttttttagatttatccctttaacacaattggaattttaaaaagttattttttgaagttaatcggcatacgataaaatgaatgcacccatactaagtgtagatttgatgtattttatatttccacttaatatattaaaatctatataccatgcatgtacacactgtcaaatgtaaacatcactgtataccactatttagacattcaactattgaagcataattgagttgcttctgttttggattagaaataatgttttgttatattgttaataaagctgataggaacatttatatacaagtctttttgtgaacacagttttaaagattatatattcaggccgggcgcggtggctccgcctgtaatcccagcactttgggaggccaaggcgggcagatcacgaggtcaggagatcgagaccatcccggctaaaacggtgaaaccccgtctctactaaaaatacaaaaaaaaaaaattagccgggcgtagtggcgggcgcctgtagtcccagctactcgggaggctgaggcaggagaatggcgtgaacccgggaggcggagcttgcagtgagccgagatcccgccactgcactccagcctgggcgacagagcgagactccgtctcacaaaaaaaaaaaaaaaaaaaaaaaagattatatattcaaattggttgttactgatataaaggaaagttgctttgaaaatgattttaacgttatatgcaggaattttaagaaatgctcttgttaaggagttttaatcatgtttcttagaaatgctcttagatttttctgggt

SEQ ID NO: 63582 - DNA, 1009 bp, Homo sapiens
tatttggcctattgtggccaaatatatgcaaacttacgttaagtgcttatgttttggggtataggagctataaaaaaagattgttcccttccatatgtgtacagttcttctggggaaatgaagacatacacaggtggaacggtaagaacagtggcgaagaagggctgcacggagtttctctccagccttttgcgcatggcacgcaggctcatcattgcagctgcagttttttactctgctttccctgcagcaacagagacaggagggtggagaagggcgcctgtgctcttttgcagctgtgtgtgctcatgccaccctcccactcaacactccctgctcagattcctcacgcagcagtgacaaagtaccactcactcagtggctcaccgtcagagaagcctgggcctggcctggcccagctggttctctgctcatcgtctcacttgacgaagttgacgggctgcagggtcatgtgcctttccagaggctcaggatgaattcactcccaaactcattcaggtattggcagaatgcagttccttgaggttgtaggactgaggtctcagcttccacacaggctgtgggctgggggaggtcctcagagctagaggctgtcccgatgctttagcgggtggctccttcctccatctttaaagcccgccatgtgctcccagtctctctgaccccctttctccctcatctctctggctctcctgctcctcgtctgcctttaagggctcatgtggtaacacagggtgcacccggatgatccaggataatctccctacttacagtcagccgtttagcaaacataatcccatctgcaaagtcccttcacaacggtacctggattactgtttgatggaaaaaaacaggactggaaatcttgggggacatttttggattctgcctaccaccccctccatacacacataaacagcaaaatgacaaaattcaaggctctcctgagtgactgtttgcagcaaagaaagttgtttccatttcagag

SEQ ID NO: 63583 - DNA, 1028 bp, Homo sapiens
atggctcagctgcaggacagtgactgtagggccagtgctctgtgcacccgcagctgctccgctggacacagacctccccggggaagcagagaccaccctgcatctgaacggggaggggtcgatggagtgtgccctggtgacatgggctctgcagggcggggtcaggcctcccgctcagttctgcatcagtacttgcaccacagaggcctcaatgaagccgagggagctcaggggagcaggagtctaagccggaggccctcagcggggcggctgtgccctccccaacgcccaggacatcagcagtgtctggagacaggttggattgttatggccaaggagggagcagtgtcattggcagttagtgggcagaggccggggatgcagcggaacagcctacagtaccaggcagtccccagcccccgcaatgtccacggtgctgaggtggagaaatcctgggcttaggtcacgcccaggtgcacaggaaggatcttgcatcccaggaaccaggggctgggagagaggagagctgggctgggggctctggaggtcccaagttggggtgcccttggattcctatgtagaggtggaaacctgggtctataggccttgactaggggtctctggctgagaaacactggctgaggctgcaggaaagatgtgcctctgaggagcaggcctgtggaggccagacactgaggcagctcggtccccctggggcctatggaaatgcaggtaacccatgatatcctagggtcctgctcccacccaagagagggctggggtgagtgatcacagctgagggcctgcaactgtatggacccattctccacaccacacacagaccagcagaaacatctggcatgttcccccagcacccctgcatctcactaactcccattcctccctctcctgtcagccaaggccactccctacaggatgccttccctgactgctgctctgggtcaggttgcatcttctcaaagaactgtatgtaatttacatcctttgttaatatgagcatgtgatta

SEQ ID NO: 63584 - DNA, 1045 bp, Homo sapiens
aaagagtgggcgccaccagtgtgagacaagccatggaactgcagtttcaggagcacattagcaccacccaaggatagaaacaccccaagctcctgcttggaagaaccttgccgggtgtcgaggtccctgccagcagaagtgtgcagcaggatcagaactacagaggcacagaaggcaggcaagtgggtggccagtgggcttgaccagatttgcgtatctgcccctgggcgtgctgtgtttcacgccttcacctgcggactaagcatgtcccacctgcccagggtgtccctctgcctttgggcctgacttgggagccaggctgaggctgcaggaccagcgtggctacaatcccagttgggactcctcatatggccaggaatcccagcccatgggagagggcgggtgtaggccaatgcagcccagtaaggcagtctctcaaaacccacccaggaacttgaagtccaggagtgtgttcctccgagccctgcctggcaattttttgatgacttcaaaagcacatggaaatgtgtgtttgagtggtttcccaactccaccctctgaagtgcattctgcatttatgttaagatgacacacatgcatcttatgtatgatacgatgacatgtatgtacttaagtgaagtcgtgtgtgcatgtgtgtaaggagaggtagagaggagactctagggaataccatggccaggggcagcgaccaggctctgctgcccacagctgcgggtactgggggggtgcagcctgtgtccaccccacctggagggcttcgggctgggggctcacctgcagtgcacggtgatggggtggttgcctgtctgctgctgctgcttctgcacggctgcgatgaggtcaatcatgcctttgccctcggcgggaatcccgatctcaggccagccgtggaagtgaaactggcgcactactcggacctgctcctcctggcgggcctggggctgcagggaggagagggggtctcagcgtcgcctgcctgccggggaacaggccccagccccatctgccctctcagggattggcc

SEQ ID NO: 63585 - DNA, 1028 bp, Homo sapiens
taaaaagcatatttaagatttaacaactgtatagcaggtggcctttaaggcataacaaaatatatacaaagaaattagggaagatattaatgtcaactatgaaataaattaacatgatttttacaaaatatactgaccattaaattaaaaaatattttaaggcaggaatcttcatttgaaattagcataatcagaaaatatatcaataaaatcttgtaccactttgtagcagaattcatactgttcctgaaaagacaaacaaggacacattaaaatgatattcccaaaaatatatttgattaatcaggagaaatactcaaaaacaagacataaataagtgtgactattcattaaaataccatatacctttatgcacatcgtaatttagtttttaggcacatgcagaattccaaataaagctgtttttctacgtagaatgtgtcagttagtgtattaacatttcaacttagtgtatttaatgggctgagttaaatgtctgtggctttcacattgaaactggaaaacaactatttttgaatttaaaaaaaaaaacaaaaaaccaggccaggtgcaatggctcaacgtctgtaataagagcactttgagaggctgaggcaggaggatcacttgagcccaggagttccagaccagcctgggcaacatggtgaaaccccatctctatcaaaaaagatacaaaaattagctgggcatagtggtgcacacccatagtcccagctacttgggaagcggagacaggaggattccttgagcccaggaggcagattgcagtgagccaagattgtgccactgcaccactgcactccagcctaggtgacagagtgagaccctgtctcaaaaaaaaaaaaaaaaaaaaaaaaaaaagaaagagaaaaaaatcagagtactaacattgccagataaatttcataaagcgatctataaaagttaaataaaatgcatatctagattattttaaagcctacatttactgtacaaaagggacattgttttatatataggctggtcct

SEQ ID NO: 63586 - DNA, 9181 bp, Homo sapiens
ctgtcacagagggaacagcttgctaccctgaagatgtttgcggtaggtaaatatttcctgtgtaatatggaccctaaccacataaggataatccatgttattttattggcgatttaaggcaagaaacagctgtttgtttctaatgtttgaaggaaaaaatgcctatatttacgtcaatgacacagggcatggcaacctttggaggaaccttctgaagcagtatttttaccttctatgatcatttcagcatctaactttgcttaatgatgaccccactatagcaccaaataacattattcttaattgtgcatggctcttataagacagatttatagacacataagtagcctcatgtcgttcagtgaatacgaagctaaatatttagttttttaccatattttatgaggctgtaatactcgattgacatgagacactaatagaatgtttttattgtgtatgtttttatttcaggaggaaatgtgttcttcagtgcacagaatgcagcaaaacagccatctgataaatgctctgcaagccctcccttaagacggcagtgtattagagaaaatggaaacgtagcaaaaacgcccaggaacacctacaaaatgacttctctggagacaaaaacttcagatactgagacagagccttcaaaaacagtatccactgcaaacaggtcaggaaggtctacagagttcaggaatatacagaagctacctgtggaaagtaagagtgaagaaacaaatacagaaattgttgagtgcatcctaaaaagaggtcagaaggcaacactactacaacaaaggagagaaggagagatgaaggaaatagaaagaccttttgagacatataaggaaaatattgaattaaaagaaaacgatgaaaagatgaaagcaatgaagagatcaagaacttgggggcagaaatgtgcaccaatgtctgacctgacagacctcaagagcttgcctgatacagaactcatgaaagacacggcacgtggccagaatctcctccaaacccaagatcatgccaaggcaccaaagagtgagaaaggcaaaatcactaaaatgccctgccagtcattacaaccagaaccaataaacaccccaacacacacaaaacaacagttgaaggcatccctggggaaagtaggtgtgaaagaagagctcctagcagtcggcaagttcacacggacgtcaggggagaccacgcacacgcacagagagccagcaggagatggcaagagcatcagaacgtttaaggagtctccaaagcagatcctggacccagcagcccgtgtaactggaatgaagaagtggccaagaacgcctaaggaagaggcccagtcactagaagacctggctggcttcaaagagctcttccagacaccaggtccctctgaggaatcaatgactgatgagaaaactaccaaaatagcctgcaaatctccaccaccagaatcagtggacactccaacaagcacaaagcaatggcctaagagaagtctcaggaaagcagatgtagaggaagaattcttagcactcaggaaactaacaccatcagcagggaaagccatgcttacgcccaaaccagcaggaggtgatgagaaagacattaaagcatttatgggaactccagtgcagaaactggacctggcaggaactttacctggcagcaaaagacagctacagactcctaaggaaaaggcccaggctctagaagacctggctggctttaaagagctcttccagactcctggtcacaccgaggaattagtggctgctggtaaaaccactaaaataccctgcgactctccacagtcagacccagtggacaccccaacaagcacaaagcaacgacccaagagaagtatcaggaaagcagatgtagagggagaactcttagcgtgcaggaatctaatgccatcagcaggcaaagccatgcacacgcctaaaccatcagtaggtgaagagaaagacatcatcatatttgtgggaactccagtgcagaaactggacctgacagagaacttaaccggcagcaagagacggccacaaactcctaaggaagaggcccaggctctggaagacctgactggctttaaagagctcttccagacccctggtcatactgaagaagcagtggctgctggcaaaactactaaaatgccctgcgaatcttctccaccagaatcagcagacaccccaacaagcacaagaaggcagcccaagacacctttggagaaaagggacgtacagaaggagctctcagccctgaagaagctcacacagacatcaggggaaaccacacacacagataaagtaccaggaggtgaggataaaagcatcaacgcgtttagggaaactgcaaaacagaaactggacccagcagcaagtgtaactggtagcaagaggcacccaaaaactaaggaaaaggcccaacccctagaagacctggctggcttgaaagagctcttccagacaccagtatgcactgacaagcccacgactcacgagaaaactaccaaaatagcctgcagatcacaaccagacccagtggacacaccaacaagctccaagccacagtccaagagaagtctcaggaaagtggacgtagaagaagaattcttcgcactcaggaaacgaacaccatcagcaggcaaagccatgcacacacccaaaccagcagtaagtggtgagaaaaacatctacgcatttatgggaactccagtgcagaaactggacctgacagagaacttaactggcagcaagagacggctacaaactcctaaggaaaaggcccaggctctagaagacctggctggctttaaagagctcttccagacacgaggtcacactgaggaatcaatgactaacgataaaactgccaaagtagcctgcaaatcttcacaaccagacccagacaaaaacccagcaagctccaagcgacggctcaagacatccctggggaaagtgggcgtgaaagaagagctcctagcagttggcaagctcacacagacatcaggagagactacacacacacacacagagccaacaggagatggtaagagcatgaaagcatttatggagtctccaaagcagatcttagactcagcagcaagtctaactggcagcaagaggcagctgagaactcctaagggaaagtctgaagtccctgaagacctggccggcttcatcgagctcttccagacaccaagtcacactaaggaatcaatgactaacgaaaaaactaccaaagtatcctacagagcttcacagccagacctagtggacaccccaacaagctccaagccacagcccaagagaagtctcaggaaagcagacactgaagaagaatttttagcatttaggaaacaaacgccatcagcaggcaaagccatgcacacacccaaaccagcagtaggtgaagagaaagacatcaacacgtttttgggaactccagtgcagaaactggaccagccaggaaatttacctggcagcaatagacggctacaaactcgtaaggaaaaggcccaggctctagaagaactgactggcttcagagagcttttccagacaccatgcactgataaccccacgactgatgagaaaactaccaaaaaaatactctgcaaatctccgcaatcagacccagcggacaccccaacaaacacaaagcaacggcccaagagaagcctcaagaaagcagacgtagaggaagaatttttagcattcaggaaactaacaccatcagcaggcaaagccatgcacacgcctaaagcagcagtaggtgaagagaaagacatcaacacatttgtggggactccagtggagaaactggacctgctaggaaatttacctggcagcaagagacggccacaaactcctaaagaaaaggccaaggctctagaagatctggctggcttcaaagagctcttccagacaccaggtcacactgaggaatcaatgaccgatgacaaaatcacagaagtatcctgcaaatctccacaaccagacccagtcaaaaccccaacaagctccaagcaacgactcaagatatccttggggaaagtaggtgtgaaagaagaggtcctaccagtcggcaagctcacacagacgtcagggaagaccacacagacacacagagagacagcaggagatggaaagagcatcaaagcgtttaaggaatctgcaaagcagatgctggacccagcaaactatggaactgggatggagaggtggccaagaacacctaaggaagaggcccaatcactagaagacctggccggcttcaaagagctcttccagacaccagaccacactgaggaatcaacaactgatgacaaaactaccaaaatagcctgcaaatctccaccaccagaatcaatggacactccaacaagcacaaggaggcggcccaaaacacctttggggaaaagggatatagtggaagagctctcagccctgaagcagctcacacagaccacacacacagacaaagtaccaggagatgaggataaaggcatcaacgtgttcagggaaactgcaaaacagaaactggacccagcagcaagtgtaactggtagcaagaggcagccaagaactcctaagggaaaagcccaacccctagaagacttggctggcttgaaagagctcttccagacaccaatatgcactgacaagcccacgactcatgagaaaactaccaaaatagcctgcagatctccacaaccagacccagtgggtaccccaacaatcttcaagccacagtccaagagaagtctcaggaaagcagacgtagaggaagaatccttagcactcaggaaacgaacaccatcagtagggaaagctatggacacacccaaaccagcaggaggtgatgagaaagacatgaaagcatttatgggaactccagtgcagaaattggacctgccaggaaatttacctggcagcaaaagatggccacaaactcctaaggaaaaggcccaggctctagaagacctggctggcttcaaagagctcttccagacaccaggcactgacaagcccacgactgatgagaaaactaccaaaatagcctgcaaatctccacaaccagacccagtggacaccccagcaagcacaaagcaacggcccaagagaaacctcaggaaagcagacgtagaggaagaatttttagcactcaggaaacgaacaccatcagcaggcaaagccatggacacaccaaaaccagcagtaagtgatgagaaaaatatcaacacatttgtggaaactccagtgcagaaactggacctgctaggaaatttacctggcagcaagagacagccacagactcctaaggaaaaggctgaggctctagaggacctggttggcttcaaagaactcttccagacaccaggtcacactgaggaatcaatgactgatgacaaaatcacagaagtatcctgtaaatctccacagccagagtcattcaaaacctcaagaagctccaagcaaaggctcaagatacccctggtgaaagtggacatgaaagaagagcccctagcagtcagcaagctcacacggacatcaggggagactacgcaaacacacacagagccaacaggagatagtaagagcatcaaagcgtttaaggagtctccaaagcagatcctggacccagcagcaagtgtaactggtagcaggaggcagctgagaactcgtaaggaaaaggcccgtgctctagaagacctggttgacttcaaagagctcttctcagcaccaggtcacactgaagagtcaatgactattgacaaaaacacaaaaattccctgcaaatctcccccaccagaactaacagacactgccacgagcacaaagagatgccccaagacacgtcccaggaaagaagtaaaagaggagctctcagcagttgagaggctcacgcaaacatcagggcaaagcacacacacacacaaagaaccagcaagcggtgatgagggcatcaaagtattgaagcaacgtgcaaagaagaaaccaaacccagtagaagaggaacccagcaggagaaggccaagagcacctaaggaaaaggcccaacccctggaagacctggccggcttcacagagctctctgaaacatcaggtcacactcaggaatcactgactgctggcaaagccactaaaataccctgcgaatctcccccactagaagtggtagacaccacagcaagcacaaagaggcatctcaggacacgtgtgcagaaggtacaagtaaaagaagagccttcagcagtcaagttcacacaaacatcaggggaaaccacggatgcagacaaagaaccagcaggtgaagataaaggcatcaaagcattgaaggaatctgcaaaacagacaccggctccagcagcaagtgtaactggcagcaggagacggccaagagcacccagggaaagtgcccaagccatagaagacctagctggcttcaaagacccagcagcaggtcacactgaagaatcaatgactgatgacaaaaccactaaaataccctgcaaatcatcaccagaactagaagacaccgcaacaagctcaaagagacggcccaggacacgtgcccagaaagtagaagtgaaggaggagctgttagcagttggcaagctcacacaaacctcaggggagaccacgcacaccgacaaagagccggtaggtgagggcaaaggcacgaaagcatttaagcaacctgcaaagcggaagctggacgcagaagatgtaattggcagcaggagacagccaagagcacctaaggaaaaggcccaacccctggaagatctggccagcttccaagagctctctcaaacaccaggccacactgaggaactggcaaatggtgctgctgatagctttacaagcgctccaaagcaaacacctgacagtggaaaacctctaaaaatatccagaagagttcttcgggcccctaaagtagaacccgtgggagacgtggtaagcaccagagaccctgtaaaatcacaaagcaaaagcaacacttccctgcccccactgcccttcaagaggggaggtggcaaagatggaagcgtcacgggaaccaagaggctgcgctgcatgccagcaccagaggaaattgtggaggagctgccagccagcaagaagcagagggttgctcccagggcaagaggcaaatcatccgaacccgtggtcatcatgaagagaagtttgaggacttctgcaaaaagaattgaacctgcggaagagctgaacagcaacgacatgaaaaccaacaaagaggaacacaaattacaagactcggtccctgaaaataaggtgagaggaagtattacagcatcactcaatatcgtcttggatagttgtgaatttctgtgttatactttgcatgtaacctgacgttataagtggttatcctttccccagagggtttcctttaacactgaataactgcaggccatggtaaagaatcttcttgggacctatagagggaatagactaatatgggaaaagaactagtcaaacatgattaatgcaaacttagaagagtttctcaaaagccaaatgagtaatgttcatcttcaaatgtttaaaaaattgatcagaggataggtgggtggttcagttctatgttctggatactgtcaccaagaccaggactgggttaaaaatcctatctatgtcactattttaactatcagaacaatatcaataaggaatgtgtattcttgagaaggggaaactgtctggactgttagatagagaggctcccactgcatgcagagaagtttggggaaactccagaaatggcaatttcctgttctgccttagcagtgatggttaaaggaataggaattcatttactccctgtaaatgaatgaataacggaccttctttctataatgtaaactgtaaaaattagatttgatatatatcttattaggcattgttattgaaatttatcctgaattccttatttataatttgtcagcagagacagtcatttctccataggagcaaagtaccaaggcattaccttgactatcctagatgacaagtctcttagacaattcatcagtgtgtgattttcaaatgatttctccttttaggttactgttgattgtgctccctgttgaattttgaagtttgttttactaattattggaattttgtggatgtcttctcatttctttagggaatatccctgcgctccagacgccaaaataagactgaggcagaacagcaaataactgaggtctttgtattagcagaaagaatagaaataaacagaaatgaaaagaagcccatgaagacctccccagagatggacattcagaatccagatgatggagcccggaaacccatacctagagacaaagtcactgagaacaaaaggtgcttgaggtctgctagacagaatgagagctcccagcctaaggtggcagaggagagcggagggcagaagagtgcgaaggttctcatgcagaatcagaaagggaaaggagaagcaggaaattcagactccatgtgcctgagatcaagaaagacaaaaagccagcctgcagcaagcactttggagagcaaatctgtgcagagagtaacgcggagtgtcaagaggtgtgcagaaaatccaaagaaggtaagccatttactgtttccctgttttaaaagacacagaatgttttgatgtattttttgcccaaggttgcaaaggcaaacaaaaagcattatcttcaacagcactctgccagctcccagttacattaatggaaggagcattatgctaagacataaatttggtcattttagttatattttgttgtgtctactttgggaatttcacttcaaatagcaaattcacgttatgaagactttcttcagaaagaaaaggaatttgtctagtggctaatttctgactgcttatgatgtacctcatgatacaattgtaggtagatgtcttcagcctttctgtagttcaaaatcacctcttgaaacaggaaaattctttttccaaaaaaaactattgaaacagaaaaatttccaaggcattctttggaaaggcagaaggaacagaagttgggatgtccctgagacacatgctcactatgtgagagttcctggtcagtgggggatgcgtctgccctccaaccctcctccagccagagactatctaagctaatgaa

SEQ ID NO: 63587 - DNA, 2058 bp, Homo sapiens
ttgtccttcctgggtttcacacctctgggaagtcatggccctatagctcataacctttgtaatagggcctgggcggtctttctttccttctcttcccagcaggagtggaaagtgatgtctggctccctttccattttacactggctcccaggggcaagcagtcctccctccatgtggactgccgggggctgggtgctcacagctggtatttactgggactgagatcagaccctgcttgtctttcactgatcaggatgttccttccacctttttacctgaaatgacctcacttcagacttggcttgcttctctttccttttccttaaatgactgagacagtctcacctctaccatagtcttcaaagacagtggcttaagcatttgatgcttcaagatttaaacagctgaaattcttaactgaataggtttttatcagtcattccagagatgttagatccttgttaaggcttcttgtaaacaattttgtcttgtcaggaacagcctcaaccatcaggaaaacaagagtcaggttcagaaatccatgtggaagtgaaggcacaaagcttggttataagccctccagctcctagtcctaggaaaactccagttgccagtgatcaacgccgtaggtcctgcaaaacagcccctgcttccagcagcaaatctcagacagaggttcctaagagaggagggagaaagagtggcaacctgccttcaaagagagtgtctatcagccgaagtcaacatgatattttacagatgatatgttccaaaagaagaagtggtgcttcggaagcaaatctgattggttagtctgacattagaatacatatattaaggtgaattttttcatgaatgctaatttttgaaaagtttcgtcttttccctttgacagttgcaaaatcatgggcagatgtagtaaaacttggtgcaaaacaaacacaaactaaagtcataaaacatggtcctcaaaggtcaatgaacaaaaggcaaagaagacctgctactccaaaggtaggggcctcactgaatggctgctttacacataccggtgtcatcgaagcttgcattcagtgtggatttatgctttaatgtcctgtttacctccttcctgttttctacagaagcctgtgggcgaagttcacagtcaatttagtacaggccacgcaaactctccttgtaccataataatagggaaagctcatactgaaaaagtacatgtgcctgctcgaccctacagagtgctcaacaacttcatttccaaccaaaaaatggactttaaggaagatctttcaggtaaaaacgtagtcttagatcttataaatcttttgactctactgttttttactgtgttaatgtttgttttgctaactttgtttatctgctgtgaaagagattataaaataaacgactcaatcacccttctggggtcttagtgttcagggaagataaagctgttttggcttgcaaagacaagtctctgctaatttttgggatcacatgtcctgcatgaaataggtgtggaaatgtcaaatgcatgtctttaccctggagagcagcgtatacatagaaagctggaaggtgctttacagtgaagagagttaacttgttaatctgcaggtacaataatagtttatcccaggtgtgggccagttgttgttgagcaacattttgcttcttcaggattgactttctaggtagcttaactttcttgaaagaaagccctatgagaagattcccataaacgattgttgaagaaatatttccattcaattcccactctcagtaaattgtggcctgacttgtgtaatttaaagtggggatggccggcgcagtggctcacgcctgtaatcccaacactttgggaggctgaggcctcctatcattccaaacagaatgataatgatattagattttcaaaaatatatattattacttgacagtactaaaaatgggcagctctttgtcattttctaaaatgtgggtacgtgttatttgtacttaaaatctagaactgagcacccaagactttgagaagcatgaaggcatttggcctct

SEQ ID NO: 63588 - DNA, 1089 bp, Homo sapiens
tagtggggaagcatcacttaggcaagggatttacattaactggtggctcaggaaaatgtgtggccgggactgggctcctgtgaattgactcagaaccacctggaggagtttttacagctcatgcattctggtcactgggtggctcaggctgagacccaagtgcatgtctttagagagttctctggctgtcgtccccctactctaaggtgaaatctgctgctgcagactcctcctttctatgtccacacataatgtttcaatgttttaaagaaagcctctgtactgtccagtggcaacttgacgtcttagtggccactcccgcaatcctttaggaactcttagtagcttagcttcaccaggattgcaagaatagaggcgtgctgtaggtactgtgtttcgatgacttttcacttggtttgtctttaatgctaacgtgaaataaatcactagtcttggtatgttttttcattgctctttccacatttgtatccgttactttagatgagagtgagggaatacctttgaaaagaaggcgtgtgtcctttggtgggcacctaagacctgaactatttgatgaaaacttgcctcctaatacgcctctcaaaaggggagaagccccaaccaaaagaaagtctctggtaatgcacactccacctgtcctgaagaaaatcatcaaggtgagttgaacaagcagcatcccattcacgcccagtggctcacacaccgggtacctattcctttccaaatactgacacaagtagaattatgatgaagacctttatttatttattaaagaaacaagtttttaaaaagacgaatgaaagctcattgatgtgggcaccagcaaaggagcccctgggtccctgaccgtggtgctgatgcgaccgagtcgggggagtccttgatgttgtccttttcgtgcagaagttcccagacacccacgcttacagcactgcgtaatcacctgcaggcaccgtcagaatagccaattacaaagattctggatacattaccacgtcgacccataaggattgttttattttcttttagagttacaaggctatagttaaggcatttacctggtgtgaa

SEQ ID NO: 63589 - DNA, 1712 bp, Homo sapiens
gtctagcctgtcagaaatggaggaggtgtcatttaacatgtcaacgacagacagatgcctaactttcccttggtgactgatggtatgctatgcttaggagagactctagatatgagaaaattgcctgttcagctgtcaactcagttctcagtagttagatagcatgtgctatttcatactggttattggagctgatatgatttatatatttgtatcataatactagtatcataagacttgcaagttttaggcattaaataatttgtaggccaagtaaaagctagcttataagacaacctgaaacaattaaaatattgaattccacaaatgttaatcattgagaaaatgctgaacttctgtttcttatttcataattcattgccaagatgagaaagctcaagattccaaggcctattcaaaaatcactgaaggaaaagtttcaggaaatcctcaggtacatatcaagaatgtcaaagaagacagtaccgcagatgactcaaaagacagtgttgctcagggaacaactaatgttcattcctcagaacatgctggacgtaatggcagaaatgcagctgatcccatttctggggattttaaagaaatttccagcgttaaattagtgagccgttatggagaattgaagtctgttcccactacacaatgtcttgacaatagcaaaaaaaatgaatctcccttttggaagctttatgagtcagtgaagaaagagttggatgtaaaatcacaaaaagaaaatgtcctacagtattgtagaaaatctggattacaaactgattacgcaacagagaaagaaagtgctgatggtttacagggggagacccaactgttggtctcgcgtaagtcaagaccaaaatctggtgggagcggccacgctgtggcagagcctgcttcacctgaacaagagcttgaccagaacaaggggaagggaagagacgtggagtctgttcagactcccagcaaggctgtgggcgccagctttcctctctatgagccggctaaaatgaagacccctgtacaatattcacagcaacaaaattctccacaaaaacataagaacaaagacctgtatactactggtagaagagaatctgtgaatctgggtaaaagtgaaggcttcaaggctggtgataaaactcttactcccaggaagctttcaactagaaatcgaacaccagctaaagttgaagatgcagctgactctgccactaagccagaaaatctctcttccaaaaccagaggaagtattcctacagatgtggaagttctgcctacggaaactgaaattcacaatgagccatttttaactctgtggctcactcaagttgagaggaagatccaaaaggattccctcagcaagcctgagaaattgggcactacagctggacagatgtgctctgggttacctggtcttagttcagttgatatcaacaactttggtgattccattagtaagtttatttaattgtaaatttatttttctaaaagatgaacaccttctatgtagctgtgagaccttcattctttcagtagtgattagctttgtggaagagaatgtaagcacataaggcacagggataagacagacacgcacgctgttttcgctaatagatgaatactgaaggcctaggtaattgtaacaaggaatgacagaagagatggaagttgtcaggcaatcatgaagcaggggttattga

SEQ ID NO: 63590 - DNA, 2786 bp, Homo sapiens
atttccatgtcacaatataggacaggggcatgcgctgtcatcgcggaggagaggtcagggtgggcatcctaccaggctcagggcagcccccacaatacagaagcatctggcccaagatgtcaacagtgccaaagctcagaaacacccatctatagtcgtcctcctgccaaacaaattctcagttgtaagggatagtctttcctttgctctgatgtcctgttaccttaaaatcaaattattttattggggttaaggaagcttttcactttccatagatacctttctcttgaaaaggaaaaatataaacatttcatctccagtggcagtccttttgcttttttatacagtactccttgaatatatcttcatgcaagattttataatttagaaataattcctaagtgtttggtcacatgacctgggtaggaagagagattcttagactccaaaggttcagatggagaacagacaggccattgcatagtttattcaaatttttaagatcacaggctagaacaggaacactgaagactccaagaacctactaacaaactcttctgattattagtttgtataggtttaggaattgtctcttctgctactttgccatggtgttagctttctgtggaaaaacaagttgaatttagattttttttttgtgtcgcttgcaaattagtatttttattgtttagagacttgaatctgtcagtaaattcagtgtagttttaaaacaacaatgaaaagcttacccataatgagcatttactatgtgctaggcaaattagtgacatgtacaaccatttaattgaacatcacatgatgtaggttctaatgtaatttctttattgtatatgaagaaactgatgcacagaagtgctagcatcaaataagcacatttggggatgattaaacctctaaacatatttaacattacaaacaaacgtttttgaaaaagcacagagtattaaaaatagtcattatccaaaattgatgtaagtattcctttgtgtcttttaagtatagcttttcatataaaaggtaattcgatttgtgttctagtgttttcccttgtttttacatactctctgttttaaagatctaatagttacatgtttaatacttccaaaagttctttgcaaaatgcaagatcgtttacattgcccattttgtttgttactcctttatgtcatatttacagatcaaacattctagtcaaattgtgttttattttgggaaattgaggtaatcttttaaaaagttgcagcaaccaaaaaaaccttcttcttttgcatgaaggggtattgaatgtgacatccgtatccagcttcctgttgtgtcaaaacaacattgcaaaattgaaatccatgagcaggaggtgagtgggttttttgaagatctacttttaaagctttttagttcacttttaatctgttcattagttacatatttccccttcttttcacttgcaggcaatattacataatttcagttccacaaatccaacacaagtaaatgggtctgttattgatgagcctgtacggctaaaacatggagatgtaataactattattgatcgttccttcaggtaggtaaaagctgattggtctaacagtaaatgtcatcttctgattaaccataaactagtgtcaaagtcaactgtcattcttctttaatgttcatggatgtcaaagtatttcaggttttcattctcaacactaatcttaatttaaaaggatatggatctaggaagatgactaattgggacaaaatgtgatggaattcaaggatttgggtgcaaataattatgcagagggaggttgaccttgtcctaaaggagtttgttattttcttccaagtgttttgaaactgcatgagatttttctattcttttttattttaaagcaaaatatacacagagaaaaaggtacaaaacaagatggacaggtcaatttatcatgtgaacacccttttgatcaccacctattatggactgatttgtgctctcccgaaattcatattttgaattcctaacccctcgtaccttaggatgtaactgtatttggaaagagggcatttaaaaaggcaatgaaggctttttgagctattagtatgggccctaatctgatgattggtgtcattataagtggagattagggaacacgtgcacagaggaaagcccatgagaagaggcagcaagaaggcagccatcttcaagtcaaggagagaggcacagagaaatccaatccagctgacaccttgctcttggacttccagcctccagcactgagaagggcatgtctgtttttcaaggcattcagtctgtgggactttattatggtggccctagcagactaatacatcctcagctcatatagaacatttccagaagctttttaaaaatgctgttgtctaatcactacttcattccctcagcaagtaaaccaccgttttggcttttaggatatcataaacgtctcgagtttcactacctaagcatggatctctgaacacgatagttttgtctgttcttataaaagtccttaacagtgatacaagaatgtatacatttgtgcctggcttgtgcttttctgtgtgtgagattcatagcatgttggacatctctgtagtttgttccttctcatggcataagtatttcactgaaaaaaaaatgtttaatatatacaataatatacataactatacagaattcattcattcttgatggacatttgactaatgtctagtctttgaaatgtgtcaaggtttgctttatgagcagatatggc

SEQ ID NO: 63591 - DNA, 1036 bp, Homo sapiens
ttagttagttagttattgagaagctttgggaagctttgagattaaactgctgaaaaggaatcttgtttgatttcatggctgatgttaaaatggaagagttgctgtgcttctcattgtagcccatggaagctacttaccaaacagccacataaagataaacacatttagctaaaaagaaagaagaaagaaagaaagaaagaaagaaagaaagaaagaaagaaagaaagaaagaaagaaagaaagaaggaaagagagagagagagagagagaaagaaagaaggaaagaaagaaagaaaagaaagaaagaaagaaagaggaggtagcaaagtttttcacagaatgtctcatccagcaaaatattttgagtacatacgacctgttatgcacatctactgaggcattcatatatgtgtaactttatacattactgtgattattattactaccataatatcaaagtatttttcaggtaaaataaatggacatttaaatactcagcacatggaacgctgaattatttcaagcatttcttttttgaagacactttcctaggaattcaaacaatgctaaaccctaatataagtaacttttgatacaaatacaccaatatctgctgaagactatctggggtatttaaataaggcctgaaaggctgtggtagaagaaatattaaaagtgagatggaggctgggtgcgggggctcacacatgtaatttcagcactttaggaggccgaggcaggcggatcacgaggtcaggagttcaagaccagcctagccaacatggtgaaaccccatctctactaaaaatacaaaaattagctgggcatggtggttcacgcctgtaatcccatctacttgggaggctgaggcaggagaatctcttgaacccaggaggcggaggttgcagtgagccaagattgtgcccctgcactccagactgggggacagagcgagattccatctcaaaaaaaaaaaaaaagtgagatggatagattggtaggattgagtgggaccttcacaaacagggattcccag

SEQ ID NO: 63592 - DNA, 1050 bp, Homo sapiens
cctaaaagtttcttggtagaataatttcctacctgtgatgcttgcgaagtcagcagaggctcccacccagccctgccgcccattcccagaagtctgggctgggggacaccgaatggatagtccaccagcggcgtggcttgtgaaaggaggtacttgttaaatctatgtgtttttattatagacatcgttctgccagtcgcaataatgtgtttatggacatttttctgcaagcacagcgcgggtggcagtttttactgacaaattgagtcatatgcatagaggtttagaaagcgcttgccttattgacggatcaggcaattctggcacgggatgttcagagatatttaggtgggtgaagagagtgaatgaatctcagggcagagaaggagatggggcattatatgttgaaatgcaataaataatcgctagttatttatcatttgtttttaaacttttagctacattgtacttcccagtcaagaggactccggtgggcagccggggatatcatgttcaggtgtctctcctgcttgtgtggggtaagagccactactggaatgcgattccagcaaggcctgacgagtcacagccccttgaacctgttgctctccgtaaagtgggatcttcacaggcaacagtggaggagcgtttgagggtgacctgggccctctgcatcagaattactgtgggtgctggctagagaggtctctcgattgcagggccccatgggagacctacaggaccagaacctggggatgccaggggattctggcagaccctaatgcttgagcacctctagggaaggccttaggatcctctgggaagtagcactctccagcccaggcaagatccgagtcccccttccagaagtatccatcggcagttggcattgctgcaggttttctgtgcatatgggtctgagtacggttttgtaactcctgagagacgtgaatctcttcaaattgcaaacccaacatgttattattgcttttgagttttcagttttgtggttatgacaagatgcagatgttaccaaaactttggcgtcag

SEQ ID NO: 63593 - DNA, 1043 bp, Homo sapiens
tcaggtttctccaagtggcccaaggggtgggcattttgagcagagcagtgggactatggatgcgggtacatttggggacctggccatagttgaatttgagcagggtgtggcaagcatgtggggctggacaggaaggcagagctagccagtggggccagggcctgcggagcccaaatgctgcgctgggtgaagggccttgggagtcttgtgagtggggaacactagcctgtcagtgcttcccagagaagatcacggggctggcaggggactgattggggcagaggatgcaggatggtggcagcaggcctggcagggcggggacagttccaggaggtatagctggggtcaaccctggtggcttctggtgagagcggagcaggtgggagtcgcagagtgtggttgtgagggactaagtttagaatcgcttttcttattgagagagacgaaagccttggtgtgtgtgctttttatgtgagggaagccagataaaggatctggctttggaagggtagacaggccgccctctgccctgcctggcatctgggttctgaggcgggagatttcccgactgcagccgcgttcaggcgaggatggcagcggtggacccaggctcattaccattgctcccaccccagcctgtccctgttgggggcaacctgtacgtcctgcaggagtcacggaattttaaaaaccaaaccgtcaggtgttagaggtacagtcacatcagaatgcaaattagaaatagtgtgtgctggggccttaaacaccatgacgtgtttcgtgggctggtgcggctgagtgtgcccctgggcagcagagattgacgagggtggctgggcttcctccgggccctgggctcgcagtggccttgtcttcaaggggctccccgtgtggtagggagacgtgcttgtcacacccatacattttgtaggtactggtgagggctggctagactgaatgaggtgaagagcctggcctttgttggggggggtgttggggagcttggtaagtggttgaagatgttgaagaagtcccctctgagg

SEQ ID NO: 63594 - DNA, 1049 bp, Homo sapiens
ggcccagctgtgcagggagcagatgctgtggtgaatacaggtgaagccagagtcctggcttggggaatgtgttctgcttcctgtagtgctctatttgaagtgtggatttcagttcttcgttatcttttatttatttatttacttattagcacagcttgtttgttgttcagttccatagtgagaatctctaagaatatgattaaccttgagggtcatcttatcctgtaattattaatgattgattctgtttatccttgaaatcaataagagaggcataatggtttggtctgtagttgggcgtgatttcttacatttcgtaaacacggttctgtgacagcagttgtatcagtttattacccagaacatgtttgatgaatctgaagtgtatgattagttttatataattattgtgatatgtagtgttccttacatgagttatgttaatatggcaaatagtgttaacatctcctgccactaatagttagggtggggacatataataattgatcttcctgggagtgctgtaatgtaaaaacaattcaggctgttggaagtatattttacaagtatgcgttgggccttggggatgttatattgaaaaacccaattgtacagttaccatgggaacccaattaaaatagattggttgatttttttttgtctttcatcttgaccaaaaatctaatgtattttaaatgttttcatatggaattgtagtcatatactgacttgctgtgccaaagtattctgctcgttttttccaactttaagctaaaatagtgaaaagttctcgagtggatccttatgagaacgtctcccaaagagaatcagtcatgtttttgtggaaaagtttgtgtgagtgatgatggtagagtggaggtggtggaaagcttttatgaaaaaagggagaacaagcattttcctacgagggcagacaagaaccctcatgttcttcctttggtggaggacatgagtgtgtttctccgttctcacgtttgtagaaggtgagattaggtccctaaagggccctctccgtgttgtggaggggt

SEQ ID NO: 63595 - DNA, 1017 bp, Homo sapiens
gagcatcttcacgtagttcacatgacatcagaacttcatcaggatgtaagttcctgcagaaataggcctgtgtctggtcagtaaacagagaatgtaatgacattcccagagcattcacaggccagagtctggtgtcctccccagcgtccagcaggctgcggatggatggcatgcagctgacaagattgatactgcattagacattcctggaggtccctgcggctggggactggcactcgcaggcctccccctgcacacagctgtctttggagagcacagagcaatgggaggcggttttgttttactatttgccatttagagtctcacttttaatttatcctcactctttaagaaataattggtaatttatttcttagagatcaaatgttgctacaagctgaaaactgttttataaatatttcaggaaacttgaatgcctggaattttcatcgtcacgcttaagtcttcctccaaaaggggatggacttcgttccatcccgctccaaaagctggtccgattcttgcctgggtgttgtatgctatttgccttttccataggctccaataacaataagtacatcttaaaattgatgaaagtttaatgaatggctagcaagcagagagactacttttataacaagattaataccttggctcaggggacataacattttagtaaaatcaaaatttgtatagttatcctagcggtgcttgcaacctctggcttccatataaaaatgtctaaataaaatactggcagccgtctctagccattatttccatctgctctaggtggcctgacccggaacccactcagggtggtgcactctgggccggggtctctgggatttctgtcgcatcagcttgtgcagccgtggaatggggatggggcactgaggctagctgtcccgtgctctagaggttcctgggaaaaaaatacagagagaaataactcacaagggagccagcatttggtgttgttttaaataaattcattcatcatctataccttttccc

SEQ ID NO: 63596 - DNA, 1045 bp, Homo sapiens
cctctttatctgcaacatgtttgcttatatggtggcttcctttaaaaagaatctggtaaaacctgtgtcattgtgtttcagccactagatgcagatgaggcttagtaggaaaagccctacttgtgaagaacagtatttcctatgcttgcttggtggaaaaagtcacagaattttctatagaattctctgtaaacatggttaggaatatagggttgacatttggactcaaatagaaaatgaaatccttttgtttcattacttatttcgttactcagctttcaccttgactcttggaaaactgatggcatgtttccaaatggatatgccagctaattagcttatttctcaaatatccatgttggatgtggaaaacaaataaaaataaagcaaggaagaccctctactgttgttatgtgaagaataacaattacctttaatagcattttctgctaatttagagatttttctttttcttacacttattttctaactcctatgatttgtgtaattcatatcttatacctacatctgattcattatgattcttaattctctttgttgtaaacagaaatattgaaaattcattcgatgaacctaaaaccctttaaaaggtctggttaaattttaacattaagggtgatacagtattcatgctatagaacacagacagtcagaaatcttatgaagtgttggagactttaatggatactgtactatgtagaatctgatcacgagactcctgcttcatcacgtttttactcgaattgggtttcctggtgacaaaagactgtgaagtagctgacggaaatacatccttatgtcagttttcacccgatgactgaaaattgttggatatatgcgtgaaataattaggtcttatttttggaagggagagaatataaccgactgaaaaataatttggagttaattgtcctgaaaattcacctactgtatattaataggttaggtgtttcctaattctttctttcttaagcatatcttccttttccttacactctttttgacacaaacttttgaatatgga

SEQ ID NO: 63597 - DNA, 1043 bp, Homo sapiens
tggtttcgcccacactgcttggatttttttttttattattatcctccagctcctattcttcaggtgtgcagctattttagtattatgaagaatgatggatgatgcaggaaagtttctttggaagcacttctgatattgtgcaatgcacttgggggtcagctacacttgactgatgcatgatttatccaatgtccctgccacttcccgagataaagctgctgctttatcgaaaatgccagcaactgtgatttagaatttataaacctccgttttcaaataattgttctgattactttctgccttggcaataaaatgataaaggtaattgcacacaaatgtgagatagcaccaaaatacaataaaattaacctgaattagcttgacttgtcgatgagaagtatttatgaaatgtggtgttgcaataagggagggagagtgatattatggctggaaggtgagttattgctttaatgtgatactctttgaaatttaaaaaagagactgtttctgttgagggtgattgtgcttttgaaattaagttgaagtgattcttataattggcaacgagaatgcattttgaaggtaatatcttttattgtgttatgcctagttgcatcaccttttatttagctgtttctggcttcagcttttctaatactcaggtagaagcagacttggaattctgtcggatccaggggctgaaatgttgtattctctttgtagcaatgcccctggtcttaatgttacagactttttcctcctacatttgattaaattgtttagatatcaaaggttaaatattatagctagttaatgtttttttaagtttaaaggcggttttagaaatgtgttttgtttccctgtctttgtgtgcactgggaacatctcattgtagcctgatggtttcaacagtatcagatcagggttccatgtctgatacccatagttcgtaatctgccttttacattcctgaaatgaaattcctggataatatccatctacatgtactatttaaatgaaacactttaggagcagtaatttat

SEQ ID NO: 63598 - DNA, 1737 bp, Homo sapiens
atattaaacattatattttcatttaaaccactataatttctcctagttcagtctgattccttcttgcttttttgcatacagtgagtactatggtccaaatgtttgttctcccacaaaattcatgttgaaacctcgcccgtaagttgttggtattaagagttggggcctttggggggagattaggttagtgcccttatgaaagagactccaaagaggtagagccctcgacgattgaggatgcagcaggaaggcgccatctgcgaggaagtggggcctcaccaggcactgaatctgccggcgccttggtcttagacttcctggcctccacaactgtgagaaagaaatgtctgttgtttatgagccacgcagtctataggattttgttatggcagctcagatggcctaacacagtgagcatgccccacccggagatggccttgcccctcttgctgtcagcatcaggactgacagaagctgggcccatgcagattttccggaagctgtgtcaggtattgggggtcattggactctaaccagtacccagcagacagatgggacctgagagaaagggttggggtctgccccttctccgctcctcagcttcctgcagtggctgggggcaggaaggagggcacagttcaggggattgagagacgtgtgctgactgtccagcagcagcagatccacctgcaggcacagtgcagcctggtgtctcgtctgagaggacacgtgtgcaggacaggcgggacccacagctgctgcttccccactcgccaaggccccgtcaggagcagcagctgcggccctgggagcccacagtccagccaggaggtggtgagcacagggcggagtgtggggttggggactccacttgtggtgttcccagatttgggggatttccgcaaggccccgttgaagggcagtgctccttagatacagtgcagagtccttggggtgagggtcctgtctcattacttgatagcacgtgtcctgtctcattacttgatagcacatgtttcagctggctctttaatgggaaagttggtgctttagtggaagctccagtcccctagatacagagtgtattgcggatatttatcccttcctggctgagcgcggggcagtttctgcctgcagatttgggctctggctctgggttatggacctttgaatgtggccatgccagagtttgtgaccttgacgtcttgaggcatcctgtaagtggtatgacctcaagggaagaaagctagcgtggcctgcatacaggtgggcctgtggactgtaaaagcaggtttacttagcgggagtaattacccatgttgatgacagcctctaacagaggtgcagtcttcaaattcacatttaaatgtctctgcctgctactgagaaatccacagcaagggaaaagagcaaaacagtctttctgtgaagggtctgttttattttttattttattttattttaattaatgagacggtgatcatccagggaacaggatctaaacgcagtctttgaacttgaactctgtatgtggtgtctacaggtttgggtgtgagcagcctcactctgtgctggttcccagcttaaacgtccaaggaagagctcatgacagtttttatattagttctttaaatattttattgtaagttcgtctcttcccagcccctcttgctatttttattgctccatttgaagttccagccaatagcccaggccctttctgtctttgatgtctgt

SEQ ID NO: 63599 - DNA, 1048 bp, Homo sapiens
agttttgggggagtcaaaaggttatgtggatttttgactgtgtggggcttcaacagcccaacccctgcactgtccgagcatcagctgtatacatacatattttgccgtttgtattatagtagctctgtgcatggggcatgtctccgcaggaagagggactgtcctgactcttgggcctggtggtgattgtctggggcactcctcccagagccctgactactgacaggtcacttcaagaatcaaagaacctcgactatgatgtcatttttctgtaagccctggactactataaattatgttttatctgtcataattaagactcggagactaccaagctgtcttcgaggggaaaggcctgtccctttctccagagaaataattaattgttagagtatatggtttttgaagaatttactgtaagataaaagactggtattttattcttgcatttattagtatttaatcaaatggaaagtgcactttcagcctggaaatcttggcttcagctgcaggattagactgaattattgtttaaagagtaaaaggtatagaattatatgttcaagttatcaagccactgataggttttgggtataatgtaactaatttagaacataaaatttcctgccttgtggactagagcatcggattaatcatttggaagcggggcgcacttcctctgctgcgtggccttgcggtgagatggagcctgtcgctccaggagcacgagacctttacggagttcagtgccgtcaaggcccacttgtccacagccaccggagcatgttgggaacaccgggagccgctggaacgtgtctggaacaccaggctcttccattcgggacactgagtcataaatcatcccatgtgtctcatgcaagaattcttccctgcagaaatttcatgaaacttagtctttgctaagggtaaagaggatttaattctctttgttctcagtggtgtgcaggcttaatgctcatgggtgttgactggtggccggcacatcagtggctcgtgggtgttgacttgtggctcctggcattgcttt

SEQ ID NO: 63600 - DNA, 1032 bp, Homo sapiens
cttgttgttagagtattctttacaaccaaagcatcattaatcagaaaggtgctgtgcggtgcggggccggctccgatgacagtaataaaaaccggcacacctcctgttccaggacccagaccctggaagtctgtgcctaagccaagacatgagcagcgtttgtggaatgcggcttcagatagaaaccttctttcaatttgcaggcctggttatgtaattctaatgcagaatctcccccttcgtgtttgcatgcgtgtagccgggttcacagaactttagccacaaacaggagtgtttccctttttccagggctcccgtgttaggcccccaccaggaggctttggggtggcgtttgggaacgccgtttggatcccttctcagtttgacatcctaggtggcagctccagttttgtttggtgaaacgatttcaatgtaacagaacccctttcggttgtgagagcagaatgaactgagccgcacttgactgtcttgtgctggatgtgacccagccgaatccacggggagacccctggttacagcggggaccacgggtggggtctcagccgtggccctttatacttggtgagcatcagccacaccacgtggccaggtttatgatcaggtgatagggatgaagtgtttttgacacatgcttttctttttttaaattaaaatactatctcatgcctgattttgaggtgggctgagcatgagtcctgaggatgagaggggcttccccaatgccccttattccctgttcagaagggagattgcaaagctagttttcatcttgtgatgtctttgtgggaggttgtgaggcagtcagacacggtcctcttcctcccccaggtgagccaatctcccccttcacacagacccgaagcccaggccacaagggacctgggctaccttgtttgtaaacagcttacaaggaggctggtgatttctcccttttaacatgttcgtttttatgtttttgaggtgtggtctcactgtgctgcccaggctggtctgcaactccaggactcaggc

SEQ ID NO: 63601 - DNA, 1087 bp, Homo sapiens
gcctgttctatgcccgttccatgctggcttggttaggtagctttgtgatacatcttttgttttgttttgttttgttttgagacggagtcttgctctgtcgcccaggctggagtgcagtggtgtgatctcgactcactgcaagctgtgcctcctgggttcacgccattctcctgcctcagcctcccgagtagctgagactacaggcgcctgctgccacgcccggctaaatttttgtatatttagtagagacagggtttcactgtgttagccaggatggtctccatctcctgacctcgtgatccacccacctcggcctcccaaagtgctgggattacaggcgtgagccaccgcgcccggcctgtgatacatcttgatgctaggtaatgtgagtccatgaatcctctaaatttatttatttttgaaaggtttggcttctatgtctcttaagtttgcctattacttttagaattcaggtgtaaatttctgcaatgattcttttttggatttcgactgggagttcattgaacctggttgtcaattttgggagggttgacatcttgatactgaagtgttcagttcttggctttgactggcgtctgcatttgtttgggttctttcattgtcctcggcagcgttgagtggtttttcagcctggaggctttgcttatctggcagactccatttctaaatactttgttcttgatggtattctaaattaggttgaaactttttaaccttttaatttattgctgcttgtgtttaacaactgacttgtatgttgatcttatattctgggatcttgacttaattcatgtattttttccagggttgttttgagattgcttaggattctgtataaaaattcatgatgtctatgaataaagacaataggcttcttcctttctgattgttatgctttaatttcttctattgagctgtccagaaccctccaggatgacttcagtaagtgtggtgacaacagacgtccttccctgtttcctggtttgggggagcttgcaggatttcaccagtgaggacttgctccccatgttgggtttcagaggcgtcttcctcactgtgtggaatt

SEQ ID NO: 63602 - DNA, 1519 bp, Homo sapiens
tgaagcttcctggtttagtagaattgggtgctgccttccctcatctcggggtgctcccacctggagccatctgtgctctgtgtggctgctgtcctctggttgctgagtgacagtggctgctgggatttggggcagcatcctgctggctctggcccctgccctcacccttctccgagtgcctatgagtcccagggtggtccttgcttcctctgaatgggtgtttctttagtagataaattacaggttgaccactgggccttcttcagtgacattgcatctgtgcttgtgtacaaagtgtgattcccgctccccaggtgaatccacttacctgtgtgtggcttcgcacggggaccaatgacttccttgcatagttacctttccctccctaaaaacgtgtgagaagcacatcagttgggaaagtggtatattttccaaaagggaagcaacataagctgcttttaagttagtttcataactgcctgacagtatcaggtttctgtgaatgccatcacgtccaggagcacttggcctctgcaagagcggagcagctcccccgcgccatcttcccgcagctgcagagctctgacctcgtcagattccctgcagtgcccacagtctaatgagaggggccaggctgtatgtgtttacttttctaatgttattttggggcttgtttagttttccataatgttgattgccgtatttgattacttgaaaaaatggaccgtatcaccctgggtcatacttagattacaaaaatagtagcagtaggacttgtagatcttggaagctggggagctaagggggctcatctttcacttaccaagggcttacccttgtttttcattcttttatttttttcacataagccttttcagaaaaatataggaaaagctgatagagtccaattgaactaaaccactttaaaactttttgtattttggaaaatgtggggactacacacagactgtcttctactgcagaggctctttttctgtcttcatggtagggatccatttacagggtttgtgggtctgcttttggcatctggcccagccagcccttggattgaggctgggtggggcatgcaggttggccctgaccctcttctgagcacctggctggctggacagatagggccttcagtcaccagctaggctggcctgaccctagaccctctggaacgtgagaacgtatcctgccgggcctctgtgttgaacctgggaggagagttgtctgatgtcattggatgccctatgagtttctgccctcgaaacgtgccccatggaaagcgtgaagatgcctttgagcttcccgaagggcagctgcagcaggaggtgacctgcgttttgcctctctcctgctcatctctaaatgtgttcaggaactcagtcgaccctcagccgtgcatggggtcccggctggcttggtatgtgcacctgccgagtctgtgctgccagttatccccacggcctctccgtgcaggtcggtctgaccagtgccagtcggatggttcctc

SEQ ID NO: 63603 - DNA, 1953 bp, Homo sapiens
gtagcccgtgatggtggcagctcttggaccttagtaaaataaagggaagcagcataacatatgcttttaagtgagggtatggcgtgaaaaccctgccgttgtgtgataggagacgggctctgcaggctgagccttccaagtcgtgaatgatgaggtttgctgtgctcctctgattggcagctgaaagggcaggtcagagctcctctctacagcactgcggagaatcccaggctgtggagcactggcccatccaccccaggacagagctgcctcgccacagaagagcgaggttctgggattcactgtgaaattgttgtatggtttctgatctagaaaatcaaacctaaacaatgcgcaacctcaccagcttcggtgctcttgatgttttctccctgcagctggttctttgctgacctgggggcagagtagacagtggtggcagccaggtggatagtatttaaacaagtgtcactgagatttagggtccttatgtgctggactcatctaagaaaaaaaaaagcaatgcaaaagttttatttctgtcaattttgtaactgtgttacaaggagacagagatggcaaacgtgtgtgcctgtgtctgtgagtcagaagcaaacttgttcatttcatttaattttaagtctgccaggaacttcttggaaggaagaaaagaatggttgaatgacagctacaaataggtgagttcagaatatgatccaaagtgtcagagcaaaagattttttaagtttccaacatttggagtaaaagagcactttagagtaacaggtaaatgggttaacttcaggcagagagaggtggatgtttctgcctctctggtatgttaaaataaaaccccttaaatcccctgctcttaacaataagtttccatttaagagtcattgggcttcacctctgttcggctctgtttgtgaagggagggcagcttttctggggagatcatgcccctctctcctttatgtggccacagagatcctttccctgttttcatgaggaggaaacatggaaccttggcacaatccagttctcatctagaattacattgtatgctgtgcaggccaggggaggaaagatcccggaagtggcagccaccggataggcacgttgccgccacagccagcatcggcgtctgttcaggtttcaggaaggtcacttcttggctcaaatccctggtatttccaggttgtcttcagactgcggctttcaccctcaggaagccccagcatggccttgggcccagcttagaggcttgtgggggtttgggtgtagccccgtgcacagtatcctgtctaggattcataatcttgcaacagccatccctgatgggattgggtaagatgacagtgtcctttctcgatggccctggtgccctgtggagttgggtcctggccctcactaccctgttgcgtgggtgggccacgcccctcctgctgatcagcctctgttgcagagagtctggccctgtggacccctgcccccggccccaggccctgtgtctgcgctgggcttgcattgcctgcctctcggtcccctcgcctcattgcagtttggtgcttctaattagttgtggtcttgaaaagctggtgaacaggcttgtccacattgtatgggaaataaggttcaatgaacccctgtgagaaacgccaagtgtgggatttctgacagtatcccacagaaacatctcagagcccatttctgtttcctcctggagtctctgtttctcccagaagaggcggcgtggccaggggtcaggcagatgtcaaggaagtgaggactcggagggactggcacctgtggaatagcccctgcttcgtctgtctggcctggtgggaggaggtgtccttccgtcactgcacttcgtccttgggacccctctgtgaagttgttggcatcaatgtgcgtttaccaataagagaaatggagatggggtgaggg

SEQ ID NO: 63604 - DNA, 1086 bp, Homo sapiens
ggtattagagctccttggacggtgatgtgctgttttagaggagaaaaagctgagatgaaacaaaaatggtggtggcagttacccagggccacgtctgtggatgccatcctcaggatgccattgcatctcgggccagcctccctctgcttttgcaaaagcacaaccgtctggcctctacgaccaccaacacacacctctcatactctggaatttgatttctggaatgcttttttattcttcctatatctgtaagattttctgatatttaaactggctgcaactaatgaatagttttcagttttgttttaaaagtgttcatgtcatttaagctctaaactctcacaatatacttggtttgttaaatgtaaaattttatcagtaattagatcagctccttgatattaatgtacagggtagctcttgcgtgctgatcagttcagaatttaaattgagttaaaggttaaatgagtttaatttttgaattgaactgaagcattgtcttgtggcaaattcatccagaatttttatttccagttgctgtacaagtgacggaagtgggtctttttgcgataaaaacattgtgaatacatttaggattcagtgagcttctgtcatttactcgctcattctctaaacgtgtgagtgccctgctccgtgtcagaccagatggcaggccctgcatggggtggggaggggccagaatgtgcagccccacctgcagcccaagcccagctcaggggcagacaggggcagacggggaagtgggctgttccacaccttgagattggtgaattcctcaagacagcggctggcaggggcccaagcctaggtgactggccacagagctgaatggggctgaccgagttaggacatcactgggtggtgaaccaggaggccctggctgctgacaggatgtaggggcatggaggggtagcagaaggaggcagttaagaggctgcgagccccctcttgggcatctgacggggtggtgcttcctcccagggctaggggagaggtgagcaaagaataacctcaggaaaagaaataaaagacctggaggaacagtttaacaagtgggtggccatg

SEQ ID NO: 63605 - DNA, 1040 bp, Homo sapiens
agctatcctcccgtccttggttggctggggcaggtgaagcattaggaaatgctctgtctctgcattctcttcgagtaacactggggagtgttcatggcttctggcagaacagcaatgttagccttcagctgctgaagcaagccttctgctcattctagaggcatcttctaaacagatctgcactggtcaggtggggctggagaaggactgggctgagagcacagctatgggaggcaatacttgttcttgttcccaagaagctgatgtgtcgtccggtgaggtctctcgtcagccgaaggttggcacaaggtcgccaggcaagggctttttgtatgtgaagtatgcacattctagccacagagttttctgccagggtgtttagacaagctaaaagtggaatataaactgtattcaatttgctaggttgcaattataaggacaaacatgtttttaagacttaacccattatagtaggaaaatacaaggcttggggtatgctgactctttcccttgttcgtctctcaaatagaaaaatggtgtgtgtaagtaggtgtttgtatatgtacattataagacattctagaaatttctgtcctatttctttaatattcttgccactaaaaatatatgctcctgaaactagggaaaaagaaactgtttatcattcttctgaattattacagataccccaaaagtagcctcctccaaatagtggtttttcttttctaaaaatcacctggaaaaatactgagctttctgatctttattttatccttttcagtggctctgtttggaagagttattgtacaacccagcactgcttttattaaaaagaaaactgggccactcatttccttcaaagtttttggtgtgtttaaatcttctctaggtaaacaaaacttttattgaaaataatattttgagaccgtgacacccttctcacaagaagcggtgctgaaagcccccttgttggctggtcctgcaggcagcctggcgtctgctttgcctgtgggccgtgcagggtgctgggggcagtgggg

SEQ ID NO: 63606 - DNA, 1057 bp, Homo sapiens
tgcatcgcaggcacatcgtctggttagcgggagacatgtttggccagcggtgaaagactgccttgcccgagttcctgagacttcggggctactgatggcagggagaggctggccgagggcagggccacgcggtccccttctgctgatgtccgtgaggactgggcacagctgccagagtcaagggcacggaagtgcaagcagtccgtccttttctgaagcctgctctttttgtttttccccacgtgtgtcaccttttaacgtttttttcctggctttttcattaatgtatgtaaaaatattaaaagcccttgtatattacatgaaaaactatgtcagctgccttgcttttttctatttattaaaacttttcaagcagtaaaaacattttacttgttaatgagggaaagtgggaaaattaatgacatagagcttggatccaccacgatgtctcctcttaaccatgcgcagccagcttcccaccgcatggagtttaatttctgcgatagggttcagtaagcaaatgcaaatagatttaatgatttgcatcagtagatcatttctcagtttaatatcctctgatattttgggtcaaggactctttctttgggagactagtataatttctagaggtagaattattaatattagtgatattacattatgttgaagtgaagtgagatagatgtatcattttcacaaagtcagatttctgcgtgacttttattcattgtggtgcaaaggaaaccctggctgctgaagtagacttaggagcaggcagaattcctggacgcaggtgccttggagtgaggtgaccctctctggcccccagcaccttgcgagcagtggtttttgcatctgttcaccagcgcatgtgaacctgtgggcccgggggacacgtggtccatttttgttgagtacgttcaacaaaggaatgaattaaaatgagaactcttttcagcaaacgctgatggagctttctgtgtctcgtgtgtggcaccatgctgacggaatgacgagaaaccacaacctggcctcaaggagctttgtctactgcggg

SEQ ID NO: 63607 - DNA, 3505 bp, Homo sapiens
cacatatttgaaaagaaaggtttgagaaggcatccattattaaaaccaaattcaacagagaatttaaaaactggctgtggtgagcaatgttagtcccaaatcactttttcacaacttgtttctgttctgtcgtagggctagtgagaccagctttcccttgagttctggggcgggacgtggaatgtttgtgaggctacccttcattgaaggggggcccgtgatgttgagtgttcaccgtctttcagaacgtttgtgcggtggcgtgtcccttctgtaaattgctgtgacctgggctgcatgctccacagtcagactcgcttcgccctcttactggtcttcattaattcgtggtccctggagtggagcgggaaatacagatatccacctcctctcattatccaaatacaataacaaattacgaagcatcttatcctaccaaccattatcctatcagaaagcatgtgctaatttcgaggaagcaagaggaactatgtcagatgtgccatgagatgtaaaatgtactcgccctgtatcttggtcttctcctagcagtatcttgtctgacaatctccttgtttaacttcttgggctttttctttgacatcttcccacctttccctaagggtttaactgtcttagatctccttgtctgcttctgcccgagactctgggtccctgtcaactcgggtagaattttattggtatttttaggctctttaacatactttaatcattgtgttgctgcatatatttcttctaagatagaagtaaattgtaattgtcctcagataataacctaggaccttaaaatacacacaaatgtacacactaatgaattttgtaaatattacataactcggtaattattgtttcaaattagataatgcagaaatctctggatttttatgtcggtgtttataaagcattttaatgataattggggaagttggttgtgggtttttagctagaacaggaacccattataatttttcccaattataataatgggacataagcctctgtaacctgaaattttcctctatgacatgttttcagaagtagaattattagatttgatgagtgtggatgcctaggtttgtagtcaactttttgaactgagctaatcaatgcatatttgggaagagcatataatccaaaatattgggtctacaaatgtaagattgcctttggtgatgagttggtgtcatctgtcttctgtaggaaatgaagggcctcttgcagtgtgctgtgcctcattttaaacctttaactggcaagtggtcctgatcttccctctggacagctgcgggaagaggtttcccggtttaccttggcccccgtaacaccacatcatcccacgtgtgcgtgaagagcccgcacaggccccctgtgcgcccggggtcaggtgtggatggggtcggggtatttccagtacttgcgcttcggagtctttttaaaattgagagctcatctattgttgataaatggccaaatataaatgtataacaccttgattaataggctgctatgaaattgaaggtggtcttttctaggaaatcctcattgaaatactgcccattttgaataagtctaatagtacgatgaaccacacccttagtggaaacgttataggatgcaaataggaagatttgtgggtgtttttccttcatgaatttgttgttatctttgcagaagtgaagaatatcaatattttatggcctttctttgggattcgtgtttattaccagtgatgcagagcgtggccctggtcctcagcgcctctgcctttgtggtggcgggggccagtttgcctggtggggaggtgtgtgtgttttcaccaagttagcaaatttcctgttttctcttttaaaatggaaggctagcttcctctcccattggctttttctggagattggaaatggtattacagtctttgttgtgttattgtggaaatctccggcgtctctcctgatgttgccgccctgcacggccgttggagagtacttgcaggcagccccgctccacaccacttttatcatcttcattttcattcttttgtgaaaatgtagttgctttggagcctttcgaaaagtgtgtcagatcatttttgccatttctctttttccttttactttctgttattttccatttcgatctcagatacccttcttaggaagctgcatccccgacgccgggctggtctgttctgctctgggggcggcgtgtgctctcatttcactcccataatcagctttggcatatgggattcagagacgcagtgcttggtcttctgagatgttttgtgcagcagctaggtgatgtcccagttctcctggaatatttgcatcgaccaggatgctgtttctgcgtcggaacgtggtgtctttgtttacccttaggcattatcttgcttgtttacctaaatctttaactctccttaggtgagtgacttcactgatactaagagtgattaaaataatgtgatgtatggagtcaacttaggcaatacatttacctgtacaccacacgtccaatatttattcagaatgatttttttcaaatatttaataagaatgaataattgaatgtactatagccttcttactttgccctgcgatcccataagacctttaaagctaaaactagtttgggcccttgaggggtttatagaaattaggtatgtctgagtatggaaatggctggcatggtgaaagaattgagtccttaagtaatttgctattcccagtgataattagaagaaacccctgttctagctccattttcccattttttttaatgttttaggggagatttctttaggtattagcggctgatcttttttttcttaccatgtactcccgctgtaaggtgagtggttttggcatattgtgttgccttgatgggttattaaatcgtcacttggaaggatgaatgtgggttatagagtatgttgtgccatatatcatcttagtcatcaggaatgtttcagaaaactgaataagagtaaagttttttaaatttatgattgaaattagcaattttattaggtccttttaaaaaaacctacaaacttttaaagtttttctcaaaatatacatctttgttctcagaagaggtctgcagactgccctaatttgtcttttgaaaggacacagaattttagcagaatacttatgctgcagaaatggacaaatgcaggtgctgttccttggatggtcagcatggaaggttgacgtgctccaagatttactgtgcgtcaccttagccatcagtcccatcgtattcatttaactccactaataagaaacggagcaaaagtggaattatgagttcagtagtattctatgaaaggtcagttgttaaaaaggcagagtctgacattctgtgaaaaaggtgccttcattaatcattctgatgggagagcacggggcgttcttgaccaataccagtgaaccttgcaatgcaaagtttcagggtctgatgtgtaagttcttatataaaaacg

SEQ ID NO: 63608 - DNA, 1352 bp, Homo sapiens
ttcgctctgtgggtgcgggcagcgacaggggtgggtcagggtgcaggcggtgagacggcgagcgaggaggtcgggaaggagcctccacaccccagcagggcccattccacacgagaccccagacgaggggagcagaagctgctggtgcctctctgttctttgccggatgctaccgttgtctgtggccacacttgcttcttcaggtgtggaaatagaagctcagagaagttaaacaatgcgccaaatgttacaccttcccattctaacgattttgtcaatttcggtgtcaaggtgatatcttgtctgatggtggaggtcatagttgtctgtgaggacatggtatccaccctcaagcatgtaattatgcatggagagggctcagttcagttttaccgagacacagtttattggagtctacaaatagcataaactgctatgtctgcagtgttaccattctctttccttattgtcataatttttgtttaatggctgtttgtgctacattgaccaggtccatgggttgcttaacataaatgattacatttgcttatgattaaaaacttcctccattagaagcactgcacccaggacttgtaaatgatttgttgttaaagttttctacttcattagccacgtcgttgactccagagtcattgtctaagagttaggaacacttgtaatgagctgtataatatggaccctcgaacgaaatttaaaaagagaccaagccttctaggaacagcttagcatgcagataaaaggctaggaaaatgtgtgaacagcgccaggctgtaggctgaggcacgttccattctgactcagaatggcatgggtgaataaagtcttttatgatggagcaagacttgttgtaaaaaattatataccattcatgaccaaaatccttcaaaacactccgtcaccattcccttctgaaccctatagcttaagttctaagcatcttgtgagtctcttgatagagcgttgaaaactccatgcaatggtctttgggacgccattcgaacctggcctgccccttgctggcaccttgttcgtctttggctccatccggggatttgattgtcagtgacccacctgattacagtgggctgccatggccctggcctcgtggtacaaaaacatggacgattttgtgatttattatcggaggacagctagcaaagagaacttcctggaataactgcattaaatgtgatgggcatttttgtgacagatgtaaaattcttaatcttgaaagcagttgcatgtgtcaggcagactgggtgttaattttctgacagcagtaggaggagctttttttccccattacagatggaattaggtctactttgtac

SEQ ID NO: 63609 - DNA, 1440 bp, Homo sapiens
aggccctcaggccagttcccggggcagccactgagcagaaccgcccctcccagcgcccacctatggccactgccctcagggtcccttcctccagcatggtgctggcggatggcgccataaacaggctgtcactcatctgcaggctgccttgtctttcccccagcagattaaagccttcatgaaaaaagatggagggcgcttgactttgcgacacgcacattctgccgtcttgggaagggggaaagaggggcatctagctgggcgctgcgtgtagcctgcccggcggggccggggtgtggcaggaccgaagcctgctcctcgtgtggggcccggcgcgaaaacagcttgtgcagccgctgagtgactgaggaccgtgtcccagtgtagtgtcatttcctcgtacatgtggagtttaaagaattataggtaccttgagctactggcaggtaaaagacagtaaaaaaaaaaaaaatagtgaaagacacagtctaccctctgaactgatctacaaggctatgaaagcatcactttgaataatatgcagtagatatgttagaaaaatgtaatattggtgtgtggacccctcagcctctttgacgagtgttgtaatatatcttgttgaatgatgaatatgctaccgtatgtttcaactattcctttcttgtggctgaaagaaaaatatattgaaaatgaatgtaaaatattgacatttagtagttgttatgctccactgtaatttcttgttgctttggatgtggtagacacctcactaattacacggtgtgtacatgcgcacctgtaacaggagccgcgtgaaagtctgattggaactctgacttgatcagcccatgttcttctgccatagccacaggagcatctgaacgtggtgatggaagaagaccctggcgccccgtctccccgtggattagcggccctactgtgagatcctggtgatcttgatgatcgagggttatttgaagcagttcattttgtgctgcagttcattgaaatgccaccacccagaagacccctgagtttccagaggtcctggtgctttttttgctggggcttggaccggagcgtctttagagtgaccactgccagggaagacaccgtggtcggggcctgtgattcctgccggggccccaggcaggctggagccacaggtctgagttctgtccagttcaggttcgtaggccactcttgcagctctgttccttcttcagctcctctggtcattcacacgtggcctggccacttgcctattgtaccagctctccagggctggggacttgctagagcagggttcccagtgcccccaggctctactttgctctgcctggtctcagggtgtaggggatggagagctggacttccagcctgcttcttggctgtctaggtgccaggggctcgggacacagagctcctggaggccgagca

SEQ ID NO: 63610 - DNA, 1022 bp, Homo sapiens
agcccccgtggcgaacagaggctctaagagaggggtctttgttttggggcagtgagactgagtggccagtgagcaatccgtcatcaatggagatcaatacccaggaggtgccatctctcttggcgggtgacacgtaactgttacaaatgggtgcctgtccctgtcacgtcaccggagtgtgcgtcttgatgccctggctccctgaggcagctcgtgttttcgagtgtttccattttagagacccggaaaagggatccttagagctgctttgttttcctttttcaccagaaacaaatgcctttgtgcttctcccgcctgcggactcccactgcgttcagcccgtgcgggtggtcatcggccagacccatccagcctgtggcccgtcccctccacctctcacagccacctaggaaagtagttctcagctctaaggggcattgtctgttccaagaagaatgactgctccctgccacctcccacccccatcccatgtccccatcatagacccagcaggacagacccccccagagagccagtggccttcttgcccataactcgttggtgctggagagctgtgggtagcgtagcaagtgccactgagcatcctggaaaccctgggaggggtcccggcgagaaagagccatcaccctaagaagattcaggaatgggatgatcatggggttcagggtgccccaacagtaggttgaaaatcctgtccctggccaggaggcagggaagtagcaaccttattcaaggggaaaaaaaacctcctggagtctagatacagtatcttagtagtaataaaagcacgggtacagatttactggtgtcggagttttaactgtaatactgtggaatggtaggttattttgtgttcaagagctacatttatcacaaaaatgatgatatacaaatcacttccatatcacaaaatgttcttggtcaaaattggcttgaggcaagtgatatcttcgagtaaacagtatatgaagaccatatcttaaaatgatagatcacctaat

SEQ ID NO: 63611 - DNA, 1049 bp, Homo sapiens
caagtaagtgcaagaatcaaaggctttgagtaggaacaaaaggctatgttactttgtatccttaactaagaattttgttgttcaagaaatcctgggcttttgttggtgtagctctgcaagtcagcagcacccgggttccacccggtgcttacaggtcacgagtccagtgacgctgattgaggtgtgtcaccaaatatgctgcagatccggggccagcccacctgggcctccggccacggtctgtgcccacgtgtcacgaggcacatcccgggtcatccggagagggacctacaaagtctattttcaaaccaagttattttgtgaaatattgtagtgaacttatcaaaactggtgaagttgatgaagtgaaatgaaaatactgccatgaaaattattttagtgcaacataatgagttctgtttttcatatctggcagatattacctactaaatctaatctgcaatgctgagaattatgccattttttatgatttgtttaattttgactgaaaaaaattgactattcatcgattcttgacctgcgagtattgagggaaaaatttagttaataagaattttcatgaggtgtaaatttaaatgtatgaggattctgcctatcctttaatactatagacattaatttaaaaattctataagggcctgagggcctggggtgtctgaagaacagaacatggaggcagttatggttgttaactggtagacaaggtctgtcaagataatataggaatattttggtgttttccctatatccttggttatatgtggctgagcataattagaagttaaatttgttttagataatctcttcggctgtgaaatggcatcaatacacttaagagtaacaagtcgaatagaaatcagggcctgttgttagtgtatgagcacacaccacacaaagtttcttcttggttccctatttccgcagttcaaagggggttttaaagaagtcataaaaaatgaaggatcctaatattgcagttggagactgagagtgaatgacatattctttacacacctcaactgtcaaca

SEQ ID NO: 63612 - DNA, 2155 bp, Homo sapiens
agattaacactgaatacattaaggttatttttcaaacaggttatagttcagagaaattaatttaaatcagttggcttacagaagacccagtttagttttaatttgccttaacagccagggtcttcctgctctacttacttagacgtcctcagagtgtcttctgagtagttggctaccatttgcatggcatgattccgctctcggagcttgatatctttccagattttcagaatttagaattaagtgtggaagtcaagcatactgaaagttttttatactatggatgctgataaatagaaataaactatgacaaattaattcagaaatctttccactcagtgtagatattaagttgtggtcatacggaagaagtcttgaaacacgatttacagtaaattatgataatttgggatagagactgtgccattaagagttgttaaacagcatgattcagacagctctgttttttccagtgactgcctattcctttattgtatatgtgtacccaagtgatgctctcacatttatcttaagtccctattattaatatacatttaaagtctcccgaggttttgtttggtttgctttggtccttttttggagtgatttgaagcaaagttaattgtggaacctatttatagacatctttctatacttgcacaagtctgtgtataatcaattctgagaagtagaatttaaaatttagtgctttgaaaattgtcctcattttaattttttggattttaattaggtaaggttgaacatttttccttattttcattgattgtttggggttccttggtaaaatgcttgcttttgtttcctgttgggttattttgtctttttcttattgatatgtgagaactttttgcatattaaagaaagaccatcatttctattttgattttgcccagggaatttttttcagaataagaaattcaactagatttttaaaaaacttttaattgggcaataatttcagatttacagaaaagtcacaaagattgtacagatccttcacccaggatctcccaatgttaacagcttacataaccatagtacatggtttgtcaaaactaggagattaacattggtccattgtggtcagatttttaagtcccttcctatggcttctaaatttatgaggtgcttacacaaaggcctttttaaccttaagattttttttttgttttgcttttgttaatcatatatgtttatttccttctactttttaaatgttgtttttcatattttcatctctatttatttatttgaaatgtgttttaatttaaagagtcttggttggaacctatctttattttcatctaaatgctaactaaccaactttttcagtatcttttgaattactcgactttgtgtttacacacattttacaaggacaacaaaaaagtgcctgctgattgactttgtagtcaatcataacccttgaccatattttttttggtggtacttcatatatgaaagagtataaaatctaggttatttaatgttgttataaaattattctaagatcaccgaatggagaatacttagattctaaataagtgactttgtgagaattgaatttttatatcattaaccaattctaagacattttaaagaaggcagaatgatctaacccaatacttcatatacttagttttactgtggaatcccaagggcaacatgtcccccgacccaacgacaaaataacatatattcctattaagtttagggattgatggagcttgtaattgttaatttgtcacagatgatactgttatttatgcgcagttactgtctccctttggagagtttcatgtgctaaattttcagcaaatagtttgagcctcacctacagcttcttgaccttttggggaaaaaactatcactttaaaagaccttttacgagtgagcaaatatatgcttttctgttttcacagtaactttcagagaaacccactggtctcagcatggcctatgccttggcagccctttccacccgtagcaggttgttctttacctttcgtttttaaggtggcttccagttcataccaagctcacatactgtggcgaagagctttctgagaaacttcataagattttgctaagatattaatgaataatttagtatattgttgcatatatgactgag

SEQ ID NO: 63613 - DNA, 1048 bp, Homo sapiens
ttcctccttcacatttgcttacaagtgctccttttttgagtgttgggagcacatctgtgtatgaaggacatcattcggacgctttccagggtggtgggaagcagcctcccttagcccggctacgtctcatgaatgtgcgtggaccccgcctggccttctgcccgacatgtactccaccccgccttctaccaggagccaaggctgtgaccattgtgatctgaacaagccgttgagagtgtgctctgttgtcagtgaattagttcagagagtccctcctcgtgttatagttctcatgaccactgcgcagtgttgctgtgctctgcctctgacgggtggctgccaggcattgaaaaaataacatcgtaagtccttactgctaacactgacttttaaaaacatttaattgtgtgccttttaaacttttgttctccgtacaacgtcttcccgatatttagattttaacttttaaaagacagttacaaattatttctaaagtataaagtctggttgttgtttttttttttgatggagctgtgaggaggaaaaaaatgagatatagaattttagtgtaggtgatcttgtgctttaggataaaaccatttttctgttactgctttttggtatctaaatccccggcagtttcccccttcggataaagcatcatgtaggttttagcacaccagcgggttcctggctctttagtgaaaaggtggctctgaggattgccctgtgcccgccatgaccatcctggtggcttggcgacttcatattgactgcaggccctgtggacagaaagaattatttcttttttagagaaaagatatttatgaccgaaaacagtgctaaaaacatgagaatattgatcatggttttgagagatgcttgcactgaatcacttgatatacctaaatatcggctttattctatcttccctaaaagacagattgccaacacaaaagatgaaccatcttgagggaaaaaaatcttatatctttctgataggctgtcttgcttccttccataacaatggggagaaaagaagtctgtg

SEQ ID NO: 63614 - DNA, 1788 bp, Homo sapiens
ctatggcctgcggcggggctgcttaacgctcacatgggtggtcaccaaggaagggctgctggacaggcagactcccagagcagttgctacttacaaatccagcttccagcagggagaccattaaagggctgcttccacctccagggcgggcagtgaagcctccagctgggagccgcgtgaaaatcagagccaatgggagctggcagcccatccaccaggagggtccagaagacagaggcagaggacgtgggatctggagcccaagggaggggtcccaggtgggttgaggctggagatggcccaggaagccctggtttggggtgagggtgggcgagactgagaggctgctcagacaggatgggtggttgaatggagtgcggatcatgagatcatcacagggccacagcatatcaggccatgggttccctgttaattcctctcccacctcgaggaccggagcttctgttaggcaggcgggggctctgccgcaggcccacattctctgctaattcccttctctcctaaaggtttcagatctgtctgtggtcttttgttttacttggaaacacatgtttaatatatcttataaaatacgtttaatataaaaatatagttcactttatagttcagttgctttgagcacatttagtaaaccaagatgtgcttatatgaacttttccctgaaaagtacctggatcccagagttctacatggattgaatacttatgtttcgattttaattccttagatggctaactcagcattatttaaattttaataaagagactggatacaatgtgagcgaatttctctctatattttgtgaatctctatcagagcaaaataaaactgtttctgttttgcaatgaatagtttctagccatggaattgctggtcgaggcaagaaagtatgaatcttatttttgtggatctagccaagaaaaagaacgtaaactttgaaaagtatgtcatttgccattcacagtctaatgagaaactcagagaggctagaaactctcaataaaaattctgatatcagcatttaagatccagcaagatagggtatacgggcatttaagggattcacaatccacagtttactggcactttaaatgctgtgaatcttgtactggcaatcacaatcttgattttattaccgagggggacccctcgtgaggaatatgtcggtgcagtgtgcaggttaaactgtgagctgctccagcctctctcccgccggctgacggaaaggtggtcaaattaccttcgcaaatctgaagggtgcttggctccagcaaattggccatttagtcaaaaagtgtctgaaaatgacgtagtcgttggaagtgtttgggaataagcgatgagttggccaaacgcagtgtgttttctgtaggcaagcacctgtggcagctggcagggatgggcaggcctgcagagatggcttcctgggggcgcagcgtggtcaggcttgagggtggtgacagtgcccccaggagaaggcgagactggccagaactgggacgggcatgatgagtggccgtgtttcaaatattgtccatttttaacttttgaaaatgccaaaagcaagtatgctgccttgtggaatctgtgcaagcagttctttccaggctgaccttgaatagcctgacagcagagcgaggagtgaaatgagcacgcctcaggctgtggtccactcgtgcgggaagacatggacctgctactgctccctgccctctgtctccccaggaaaggagcattctggctcagagattctcaaactgggtcttc

SEQ ID NO: 63615 - DNA, 1010 bp, Homo sapiens
ctttccttttgcataagaagtctgaggggtcctcagatgttttatcttcctttacaaagttgtgttgtcaacaccaaggaaacagtcttgattctgaacaaggaggtagcctgggtactgaaggtgaaaagagctcagatcagaagtttcttggaaagagatttaaagatttttaaaaaatcagattactaaggcatattaaaatatgttcagtcttacactgtgttctttgaaaccttgaattactctagcaaaaggctcagagggtactgctatgagaagctggatcttggacatctctttcaaatgcctcggtacctttcaaagggctttggatggaatgaagggacaccattgggtctcacagctttctcctgcctaacataccacagcagtgtatgaaattgttcccatcagctccagcgcgtgaaagacaatacgaacagtaacacccccaaagaaacagtggggctggagacagcagaatccttggagggttctctggctgaagaaatctctctcctaccacagatactgtccccagagaaggtgcacctctaccaccaatgccctccatcctcagttgacaaggattcaaaaagtttgttggtgacgctgacatgtaatattcccctgcgagttacacacatccaggtgaccttcggaccagcattgccggcacacccgtcacgccatcaacctgccaggctggagaagaccgctcagagcttttccttgactggggagaggggagccggagcagcgccccacgtctcacggttcacccctgccgtctctcggggccttccttcaggctttccctgtatcctcagatcttcgccagggtcctgtgatccagtgttagttcattccatgtgtcatatatgaatgatgtcatttgaatcatttcaagtccttttgtaggaaaactaaggcagaaaggccagcaccacaaagaggcatccagaattctcctcggcacaggagggtgcagccatggtgcctttgag

SEQ ID NO: 63616 - DNA, 1050 bp, Homo sapiens
ttgacattatgtgagttttagcatggtattttctgcattgggctatctgtataatgtcatggagtggtgacataaataatgctagacttttccaatttatctaccatcccagccccctccccaactcagtcatatgtggaaagtcagtttctttttccatttattatagttgttaactaaagattaaaattttacatttcattgcactgttcataaattgtttataaatacagtgaaatctaagcaaaccaagatgatcttggaaagaagtgttctgtatggaatttatctgttcagacccaacatgcacacccttccttcgggatgtatcaccaagatgaaggcgggcagatctcatgggcatgagcttgtgtgcaccgaggaagttcctgcaagcagtcctgctgcacctgggcgggggacaccctgtggagaaccacggtgcttgagtggaaggagtctgtgtctgtttttcagaatgccttcttgccttcacaactaatatgcaacaaaaataataggattgcacctgcttttgatgcctcaagatatgcagaaatacatttccctcacttgagcatgtctctggatatactaggacagctaggtcgtgcttgcgtttcaggccacggccctgctcaggagtcaggttcagcttcttgcattgagtcttatccgccacagcccaactttaacagtggatgatagccaggaaagagagggaagcatttttggagctggttgtggttttaatgaggcatatacagacactgctttagtggatgtaggagtgaggggggtggggtgtagtggttgaggaaggggcttagtgggctggggtgaaggtctctgctggagatctaggagttttccctaaatcctcatctgatcttcctctcctgtagattgttaggataaatgagcaagaagattctgcgcaacaaactgataccttgctttcttttgtgagcagcagagctggggcgtggagagggtacgtccagtgttggatgtcaggaagttcacgtcccagggtatctagtacatctg

SEQ ID NO: 63617 - DNA, 1615 bp, Homo sapiens
agtggtttcagatcttaatcctttttcctagtcacctaatattctaagatgtggctatacaaagcatttccaaccattgtccttcccccctcaaaaattatggtaataagcgtccttcccaccccacagataatactgcagtcagtgcagacatatgcttgtacatgctttcacacacgattcactgaggccggcaagtctgtgggagggagttctataactgaatgtttacacagggtgtgcatatctttctctttgaataggttgtttctatactgtttgtcatgaaaactcagaccattcccattttaccatcctttcttcaccagggagatagagtgacagagcaacttaattgttgcccatctgatgcggatcaagtgtcatattaactgtgcatatccctgcaacgtttgcacactaatgtacattggtctttctagatgcctgttgttacctataggtaagtaggtaggtaggtaggtaggtaggtaggtagatgtctgctagcaatttgacgggtcatttctttttgaaggataatgaacaaatttgaaacctgtggcacagcctgggacctaagtctgtgtggtgcagggagtctaacttctgtctaagtcagtagtatctccagggatacagccttacatccactgctggctgcggcttctctgagcgacccatctctgcgtccgcccatccatggctgccatctcgcacaaaattattttcctgggatggtcccttgagttagttcgtggttaggggtagctctcaccttagtccctacaaacccacctgaatttcctttgtctccgagccacatgggaaggagactgtggaaaataaaccaagagattctctagtaggtagagctagaggcaacaggttaaaatcacatctttataggagaatgtttggggaatgcattcagcagtcacccattctcattaatagacccagaaaacaattaaaaaatacacattgtgatttggactgggcagacatgccgactgtggagccatttcttaagagagggaggttggcaggtagctggtgagcctatttctttgctcattgagctagcaagagcaacacccattactttcattggattacttgtttgaaaattaaattaatcaagtgaggtaaacatccgtattgcctcttagcacccccataggctgcccgcaaaatggcctgcgtgggtatcctaagagcaggaattggctatgacctgccgaggtggccaactcagatgtggccagttttccatacaagtatgaagttcctgaattaatgggaaacctggctgcattgtctgatggcttactggcaagcagtaattagaaaacatttttcatagtggaacctcaggtttagctatccagagaaattggatatttcaaaatactcctagttggttagtgaaacattagtattaatgacaaattaatattaatatcaatatcagagttgagtatgtagcctttgggaagagaagggaaagattttaaggaccagatttaagtagcctccatatgcctttccttcttggtggcatttttcatctgaaagcattttttttttttttagctcaaaaacttagatgtga

SEQ ID NO: 63618 - DNA, 2481 bp, Homo sapiens
catatcaaatactgtttctcttccagggcttgtgtgtgcactgggaacagcaacaaaagttgaacagcaactgggtggggtttctttatgtcttctgtttaatcagagtttcctgatggtttggccacttcattctcctttggcttaaggggttctaagccatggggcagaccttgggtggctcactgctcttggaaggagggtgtccagccttcctggcagtgtggagatgagtaagggaaacactgcaggggcttctggcttcctggatcctgcccctcacctggggactttgtctaagtcctcatcctagcaccacctcgagatcgattcaggcctccccagcagtggcagaaatccaaccatgggagctagtgggttccattactgtggagtagggaagaagacatatgtcccttctaagtcactttaatttggtccaaaataaataaccaaagtccttggggagaccgtcagggaagtatcttcccacatcacacttggtctttgcaagaagtgctggtgggcgtgcagggcttcttgacacttcgcagcaacgtaaggatgtggtagtagagtgcttggtgttccagtggccactgcaatacaaatagagtgagttttgtcgccgtggtacattacagccatggaaattccccgtagttcattggtccgtgaccaacaaaaatccccctagactaacaattaatcaggctctgctgagcctttgactggcgacagttgcagatgtcacatcatgcgaaaagttaaatctcagctttccccaagaaggaaaaaaagtttatttttacagtttatggaactagttttccttttgatcaaatgacctggtctttaggggagaaatattttcatttttatgttagcaagtgtgatacagaatcatatacatttaaaatcttcatttttattgctttttttttaaagtacaaaattttaatagtaatagtgatttcaagaaaatgttgtgagtgtcactttactagtcaggcatgttgaaaaggaacgcgcttcctgaaatctccaagcgaggttggcatttgagacctctgggtacgtgagcttaaaattaatataagtacctgagcctagagcccaggaggtttagaaagactcagagatgcgcttaaagataattggtgtgctcctcttgtgagagcggattcaccaaaatgaagttaaaatttgtttgggaagttgcttgtactgtgccttgtgaacttacaaatctgtgtcacaatccaaagggttgagagccacacaaagcaaaacagatgggccgtgtgtcgtaggatttcctgctgtcctttcggcttcaggtaactaggacttgtgaagcacaagatacatgggaggcaaatctgaaaaggaatggtgagtgcgccccacgtgcctgggtaatacctgagtgctcccggcattacctgggggctgccaccctccctccccctccttcctttccagctcaacattgaggtgaactttttaccatgatcgatgtagctttctggtgtctacacagatttctggatggcctcagaaatgtcacatactgcttcgggaatgtctgcaagtatatttcatacattttacctggcaattaaaaaaaagtcatctttaagatattagcatgtggataccgaggttccacacaaagcaaacaaagaggtcattcttagcagctaattttaaatcttcaggcaactatacgaacctatgtcacagtctctcccaaaatttattataatgcccttgttataaatttagaatatttttgcaaactcatataaacaagtaattgatgcgactaaaattcttgtcacatatttattgcactatcagctaaaatttttaagtgacaagaaccaaaataatcgttaatttttatagggcaaggatctggctttttgtctgacacaaagctgtataaaaaactgcttctgattttatgcacattgtttttagttaatgattttcagctgtttgttgtttctctgatagcatgaaaatgtaccatatgctcagcccaaagacagatgattagcaagtgagattccgggcagctgtctgactgagcgcgttgggttgatagcattctgctatcataattagcttaagctttgggttaattaactttctacctggatatgcataataatagcaaactgcaaaaagcaagaagctttcagtacatcaacaacattgctgtcttttttatttggtatttcaagagcatattagaatttcaagagtgattaatcctgggaatattgtcatctactgtagattttatttgcaagccagataatactgaaacaattggaatctattatagagcagaaatagcattttaaaattgtaattaaagtttctaaaagcaattgctaatttcaaatgcctttgttggcaagaatattaggcacactgcttcttgtatgggcagcttgtcgggcacaaaaa

SEQ ID NO: 63619 - DNA, 3194 bp, Homo sapiens
tccatcctcctccttgtttgcatgatttaccaaagcactctctacgacgctcatcatctgaaggggctgccggggcctttggagagcacaagctagtgaagtggatggtggatttggagtaaaaattgtagtttacatttcccaaagcaccagagagcctagcacttaattctgaaataagtcatgcctgttgttacactcagaaaaatattttatcttctgaaaaaaaaattctttacatatgcagtggatggtgaagatttggtggcggtgaatttgccctggctccagaggactttacttacagaatcagcagtcgtgaaaacgtgctttctcagatgtgtgacttgtggtcagtctgtgggctcaggagcacccatttggtcaatccatgcaagttttatggggctgtcagaagccatttttcaaaattggcttcatctgaggacacgtggaggagccactctcttggtgtgggtagtgaaaggagtggctccctgtggctctgtcttgggagttgggggctgcagtggttcactgggaggagggggtgcccctgcaggccccacctgcaccccacctcgccgccccaccccctccccccggctttcaggctgtgacctcaaggccttttatcattttcacaatgatgtctccaacagacctttaccccagtctcaaaaaagatactgccagagcctgcctttgctttttgtttagtctgcttcgggctgcgtcaataaagatagcagaggggtcaagagaaaagaagtgaacggaatcacagttttggtgttgaacccttaaatgggggccccactgtctctgctgtgtagcaggcacaggattatctgtctgccttctgagatttcttttaatgttttaccaaattaaacatgaacaatttcaggatgcaaaaacttgactgcatcttgttgtttcttaaataagagcactttaagaaggcaatatatggagattcttttgtgggaaagatgtttcaaatgggttattactggccattgaaagaaagaaaaagaggaaatgcatcgaggcctcattttttggcctgcacatttgattattttattttaaatgccatttcaaacatagtgtaaactaatgatattattttttaaaaaacttactctactatttgcggtccttgatctttaatttcttttaatgtcaaaattatttatttggccagttccattccagatgtgactgttgagggcacattaatttctattctgttttcatgggcccctgtccccatctgtacatcatttctgacttccgtgtgctccctagggagttcacttattcatattgtaggtttcatttgctgtgtaaacagaataaacagacaatgcaaaaatccccacaataccagaaaataattcttttcaacaacatagtggatcatatttaaaaaaaaacatggaaaatgcaatacatgtgaagcccattttttccactttattgtcctcccgaggaaaggcttgtgttaccagtgcatttcccttgaatttgataagttcatttttattaaaaatccatcccaaacagcattttacgataattctcaaacacgtgttgtggacatttctttgttttgcgtattagcttggtcttgcgggttaattcggaatgtgttactcaactggtatgtgcttgcgtggccaaaaacacccgttgtgctgtgtgtgtgtgaaaagcaacattcaagaacggtgattttttttttttgacatttacaaataaagagggacatgagttatttatgctccaatgttgctgcaaagtccttatctccatttggcactaaacaaggatttgttgtgggatttgtgagggctgcgcagtgcctctgtgctaagcacccaaaactctaggggactggcactaatttcctctctctcgtaaaacaacgtagtattcataacaactcaagaggcttgacataagtaatgatggcatgtgcaggcgaagattaccacccaacagtgtaatcaaggtgctaggtactaatgcaagttaaattgagacaataatgccgaaacttgcattgtgggattaggagggcacttgaaatgctgacgtgagcacatcctgcctgcctgcctgtctggcgctccgttcctgtttatacttaatgacctcaaaatttgtatgtcgttaacaccgtgtactgaagtgggagagaacacggtttgggagggagaagactccctgtcttcgttgacttttgtctcttttggtaattggtggcttttcctgccgtattagggagcaaagcgtgcagcggggaggcccctgaggtctctgtaaacatgctgtgggcaccgagggcctccgcacccggcgctaggcagtaatttacatactttgaatgaaaagtcatttgtgcctgcaaaattgttattgctggaagaaatttaaatactagtcatatggaaatttgaaataaagtcatattaaattttgatgctcagatcaatattgtggagccccggtaattaaagtgggtttgtttatttggctccttataaataaaaagggcttaatacagactaattacacagaatctttcgtctacggtgggataataatggcagcaatttaaagtgatattaaatgagaattaataaaggaatattgagtcactttgactgtattaagctgtgaaatgattcctcatctcaatttaactttctgtcttgagcataatgtttgataagcaatgcatttttgtaggaataatctataacagtatttgactgcaatatttaataacaactagacttgtgactttatgttgtttttaaatgggctgggaaagcccgttttttctctgcaaatttataggacaacttagagggttcttgccctatggtagcttcacaagagttctgagttggcaccctccggtttgggaggtaggtggagatggctttgacttttgttcaacttacaagggagtaacttcttggaagtgcagtccgggccagcagaaatggtcatagtaggccatggtggaaggagaatcagaaccacgcgtaaatcctcagaaggaagagggcagtcatttttttttttttctcttggaggaatatcccgggaagaattacctggaagaaatcagagtggttttggaagatggattgtcggataacattttaacttaaggg

SEQ ID NO: 63620 - DNA, 1756 bp, Homo sapiens
acttgtgtgtaatttctttccactgtgccgcacagcatgtcatgtccacgttagcatttctgcccttttaaagggtcctgctgaaggtcaggacctcacactgaacaccctttttatatatattacaaattgctggaattgttcattaatttctgtctttgaaatgccatgtcaaccctctaaaggaattcgcagtgccagtttcccttggacagctgctcaccatggtccagtgcgaatttctgatgaaattacaggtgcagggaaatgcagaattagaaatatatctgatgttgcaatacttgtgaagctatagctttgttgatgacaggacaattccatttttgacagtttaatttactgttgccagtggacaagagcaagaggaggacgtggggttagccacctgccccctcgtaccgtgtttcacatgcgaggttgccaaatcatgactccctcaacctgtcgggctcaaatgagaaggttttcagctgggaaaatggaatatatcagtgcatgtaatattgcctgacctcataaaacaaaagggaaaattgcagattctgacagccattatgaatcttgtatcagcatccaaaacgacttggagccagggtatagtacatgtttataatagaaaaaaaacggggttgccacgttgacttgcaatatggagcaaaaaatgacttgtcataattcgttctcagatgttaaagaggctgttgaatttactagtatatacacagaagaatgcgtagcccggagcagagtgtggaaatagtccctacacagaggggtctgctgaagttagtcatcgagttagattagaatggaaggcaggaggggaggaactccgggtttgcgccgcagctgcgtcggtggggccagatttctcattacaagatgtactgaacctttccactttcacccactgtaaatctataagtaatcaggcttctaaaataaagcaaacaaccttgttttgagattatgagaatcatttgaattgaatgtattctgttggaaaactggtgtattgaggcatggctttttatcttacgcttaaaaagttttatttatattaaaataaggcataatctctctgcgtataattatacgctcttcgatttagtttttctatttaatagtctattccttcaccttcttgcccatttctttatgttattccttaaaaaataatttctaagtacaataattgtctcagctgcttttggtgatttctttgggaggggagatgtggagtgacagtccaggaactttctgcccaggggcaggaggcccagcgcgtgctccccagctgaggccccgtccgccttggccactccctttcatctcccgggctgaatgcggagtgtggtgacttttattttttcctttgctattggtttagaatgagatgtagcagttgatttaagtgaagtaaagcatgcttacgcagtacactgtgtccctgtcggggcctgctctctcatgtcacctgccggcggtggcatggagacaaagccttctctcctctcttactgctgctgggcctctcctgggcaggtccgggctcagtggcttgaacaggtgatgcagggaggggcagtgcctgtggccacagtgatggcacaggtggacatgatcctgagagtccagtgggggctgtagcacaggaaaggaggttgtctacagcctttctcaccacacctttccctcctcagtggaatctctggccccatctggagtccctgga

SEQ ID NO: 63621 - DNA, 2262 bp, Homo sapiens
aggcggcaatggtggaggcgttggctgagcagggcctttagaaaaaggcccgggagcttggcagcagaaaggagggtggaagtgcagaagcatcgagatgcccagtgacgtctgtgcagtttggattttgctgttgaaaagcaaaggagatgaatagaaagctttaggcagacactgagagtttttgctttggaggtattttgatatatggtaaactattgtttggattattttggagtatgctttggtctattattaaatatcccagtcaaagatagcagatattcaatatttgagttaggatttttcaaatacttagaatatttgaaaatatttttatcattagaatttattgattttttgagacactatcatattctaacaattgcaccttattctttggcggtatcactgtcattgtattaatggcaaaggcttcaaaatagcctgtcaggcccatgtcatctgcaagtcaaccctcaaccctttctctctaaactcctctcctccagtttgccaaaccactgtgctccagccatgctgccctccttgctgttctggaacttgccaagtatgccccaccccagggccttggcatgtgcctggaacacttgagcccccaccctgcacatggctggccccttgttttcttcagctctccgtccatatgcaatagcgattcctcatgcccctcatagcacttctggactttttccttgctctattttttaccaactaaaacaggggttggccaaccatggctctcaggctggccacctgttttgcaaatacaattttattggaacacacttataaagacttgatttcttatggctgttttccctatgatggcagagttgaatagttgcaataaagtctgacctgcaaatctaaaatgtgtgtaatatctggctcattaggcaaaagtttgcaaagccctcatctaggatatagtgcattcatttgcctctgtccctgactggaatgcaccctcccttaagacagagcctatctctgtttggcccactgctgtatccctagagcctacaacagtgtctagcacaaagtatgttctcgtgagatacttgaatgaataaatgaacaaaagtgaaagttccagccaacaggatgatgggcagtagttaactatgcctctaattctggcttaaactttggtatttcagcctttatgtatgttctattttgcagtttttatggtgcacaggatgaaagaacacatcaactcctagggagtagaggaggcctggaaatagactcagatgcagaattgtgtgcaggtggctgttggggagtgtattcattcattctcacactgctattagcatctgagactgggtaatttatgaaagaaagaggtttaattaactcagagttatctgggctggacagacttctgcttctggagaggcctcaggaaacttacaatcatggccgaaagcaaagggggaagcaaacacatcctcatggatggagcaggaagaagagagagagtgaagggggaggtgccacacactttcaaacaaccagatctcttgagaactcactcactatcatgagaatagcaagggggaaatctgcccctgtgatccagtcacctcctaccaggacccttctccaagactgaagatcacaagtcaacatgcagtttgggtgtggacacagagccaaaccatatcagggagtattcccaggatacactctgtaaggaagtgcatactgcaggatcgggcaagggagaagcaggggcttgcattatgacctagttgcagttgaggtctcatcctgtcctgcagggaactctggagagagaatgacctgtagagtcatcccaaattgaggccgggggcctaagtcttggctcccgggtgcgctctgggggggccataaccttggatgagatgcttctccctcgagagcagcggtgaagtatgcacctgcctctgagctcctagagctggggtgtgatgcactggtcctgaaacaaggcctgggcaagtacccagaatttcagttgtcaatggaaagagtcaaactctgtaaaatacttatagggatttattctgagccaaatatgagtgaccatggccagtgacacagccctcaggagatcctgagaacatgtgcctaaggtggtcggggtgcagcttggttttatacatttagggagacatgagacatcaatcaaatacattaagaaatacattggtttggtccagaaaggcgggacaccttgaagtccag

SEQ ID NO: 63622 - DNA, 1026 bp, Homo sapiens
catgtacgtgaatatcttgtttgagaatgaagacagttttgtttcttcctttatactatgtatgctgttagtttctttttcttactttattgtactggctagggtctccatactgcattcaacaggagttggggaagtaaacatcctctgttcctaatcttaggggtgaagcactcagtattttactgttaaatataaatacacattcttgtaaattcccattgaagttctattcttgtaggctgagagttttattacggaagggtgtgtcattttgtcaggtgcctttttgcatctgttgtaatgtttatgtggtttctgtcttttattctgatcatatggagaaatgcagtaattgattttctaatgctcaacaaaccttgcttgtctttgataagtgccacttgctttgagaaatgcatgcatacatctctctgtatatatatgtgtataattccagcattatttctatatacatagaaataataaatatacaaataatgctggttatatttgctaatattttacgaattacgggatactggtctgcagttttcacattttgtcttttttaggctttattatcggggtaatgctggcttcataaaatgaactgatgtattctctcttgtactgctttttaaaattgtttaggattggtattttttttatttaagtgtttaaaaacatctgggcctggaattttctttgtgggaaggttattacttaatttaaaaaatatatgcaatactattaagattttgaatttcttcatgactcagttttggttatctgtctttcaaagagtttgttttatctaagtggttgagtttattggcattaattgttcgtaatcttctcttatccagttatccctctcaggtctctagggcacgccatgatgatgctattccactgcccttttttccattcctggaatggtacttcccaccttctaaatcagtcttgttacaggtttattcattttctcagttctgtattttattgatttttatttttttgtta

SEQ ID NO: 63623 - DNA, 2545 bp, Homo sapiens
tgtactgtaattattgtaaatggtgattacactgttccatgtgcatttgcgagaatataccctgccattgtgtgcagtcttctataaatgtacgttgggtcaggttgttttggcgtgttgtgcaggtcttccctatcttctgactttgtctccctgttcaatcagtcgagaaaggagtgtcgaagtctgcaactcgaattatggatttgtctcttttcccctttggttctgtcaactcttgccttgtgccttctgtacatttgctagtaggtgcctaatcacatgagatcatgacgtcctcctgatgtgctggctccttaacagtatgaaatgtactctttatctccagccatttttcttactctgaagttactttgatattaatattgctagctttcttgtgatttgcctatgcatgtgttatactcttttccatccttttgcttttgatctatttctttatatttatagtgtgtttcttggaaccaggatatagtgatccagtatgcaagtctgtactttttatttgaaatgttttagttaatgtactcatcaataggtatgggtttagtctgccgttttgctgattttttcatttgtactttttattcttcattcctgttttcctaattccctgccttcttttggattgaatccttttttgatttcattttataattactattgcgttattagtgctacctttttttaagtagtttgtttagtacagtactttttgttagaaattccagaaatgatggaatgcgctgtatccacactgtccagtatggcaggcactggccacctgtagctgttgagcacttgacatgtgactcgggcaactgaaggaactgggtatgcaattacgtttaattttaaataatttaaatataaatagccacttggggatacctgctaccacactgggcagggtgactgtagggtttctaatattattgttaacttctcatgatctacattgaaaatggtgttctgtgacgtcacatgcaatgcaagaccttcaccacagtgaacttccatttgccccttgaagtcccatgtacacggccattgatcttacttctacatgttatagactctcaaatacatggttgtgactttttcctttaaacagtcatttgtcgagaaataatcatttagaattgaaattgaaagtgagaaagtactcttttcacgtacgcattttgatgttctaaatatgttgaaagggcgcaggggggtttaatgcccttcatcagatctgtgctaccttgtggacagtaattggaaaggatggggaacagggacgcacgagtgggtagatgaatgcgaggctgttgaaatggttccatggtgagcagtgcatggttgcttggaacaggaaggagcggaggtgttaagaagtggttgaatttgggatctctttggaagtatgatgctccagctgttatcagcagagctgtaagtgaaatgtactttgattgtttgttgaacatccttgccacctttcctatcgaatttgcttttcaaaaatagtgtggacattaaaaagccatccccatgtgcctaatttcaattagaaaatgttgaatcactgtgaatttggtgagtcatcctgcatgtaagtagagctatccatctaactcttagaatttgttaactattaagagaggaagacagaaggtaatatagagatgactatttatgagtcattttatttattcattatccatctaaagagtagcaattgattgtatcacagaacggtgtttgttttacatcttttgattaggagcagtggtttatggcatagacttgcttaatttcctcctgtttcttcctctggagtggataactgtttcacaacagaaggcgataaaagatttctggtttattcattaattttgctttgagacggaatacctgatctcaaggataagatgctgattggtatgacctgaatcgaatgattagcagtatgttgcccttactctgatctccccacagtgtgagagattttctcatcttcgcatcagtttttagccatgttttggtgtttaagcagagatacgattccactttgaaagctctggaagtaattctcagatcacatatattcatctcaaatttgaaatctggagtgtttgtcttgaaattaaattgtggtattgtaagctgtcagtggcatgatctgtgctggaacctgatgcggtctagtttacacggtattgaatcatgtaagtatctcatctttcctctttgaattcagtatgacttcacataggtgaggttagcttttaagtgtacacagaggtatggttaactatcagcagacttcagttatcaattgctgatctcagaaagctaatttatctttagtgtccaataacattacatggctttctttctttgttttatgttttgtgtatatgtgcttaactgtttaaataagttctggattgcatccaaataaggtttgatatgctctcattaagaatatgatattgtgaataaatgtaatcctgactttcaataaatggcctgt

SEQ ID NO: 63624 - DNA, 1947 bp, Homo sapiens
ctcaaagaaaaatctaggcccatacagcttcactgttcagttttatcaaatagttaaggaagaagtaattccaatcttatattagccctttcaaggaatagcagaagagagaataattcctagcttgtttcataagaccaacacaaccatgacaccaagatgccaagatgtgtcaaggatgtttgagaaatggtaaccacagaccaatgtctctcatgaacccaaattttaaaatcctaataaaatattagaatgtcaattttacaatatagaaaaatatgtatatttccagtggggtttattccattcaaaaatcaatcggtgtaattctccacattcacagaggaaaagaaaagaactttatgatgataatgatcatagtaaccaaaaaaagcatttgacaaatttcaacatccattcacgatgaaaatgcactgcaaagtaagaatataaaggaaattctcttacatgacagcgtgtatacgagtgtgcacacgtgtgtgtgcgtgtgtgtgcatgcatgtatgtgtgtgtacacgtgtgcacctgtggttttctctccatgtttcttccagtactgatcagggttgcttgttttcaggagttttcaagtgctctaccttcaagttttccccagctaaatctttcccatttctttctctaaatccctttttgatatttgcagttcttttcaacttaccaccaatattttagtcttgattagaatcttcccagaaaagacaagttttccttctgattcccacatgtcccttcagctcgtgatggcgcagaatatgtttgcttgccagttaggggaacctgaggctgccttcctgggcagagtggcgatttgtactgggccaacggggcagccactgttacttatggacaggtggactaggctctttttcatcctgaggaactgctccgcgcttgggaagagccactggagtttatcagcctgcgtgtaagcatgtgggaagggggatcaggaacatttagtagaatagtccgtgctccaggtgatcagtccccacccacccgcatgcctctccttctccatcccacccgcattttgggtcattgggggattaatttattcgtgtctcgtaagcactggcagaacaccacccgtgtgaacagcattggtgaagcctggggagttctttttgagacttccttgagcttccggcagcacgtgtgagtttcgggggtgattggaatgtttctccctggagggaggcctgatgccctggagctggctccagcccgagccccgcggcatgttctgcctgctgccgcctacctgcagggagacgcctgagctgggaaggttctgagggttggcagggtgctctgctgtgctctttgggaggatccccttggctgttctgcatgcccagggccgtgctctccgtggaaatctatgttggagacgacaggctccggttccagctacaccagcctgacttccactggacagtgccattttctgcctctgataacaccgtggtgaagcgccttacgtaaagcaacagattttttgttttaagatgcactataattactcttttcagaaccaataatattaacccagtgaagtcaaaactgaattgttttataaactgactatggagctggtgtaaggagatgcagggaaggcttctcatctgagtcggtagcagagtacatagtgcaagaagcgtgggcaggctcccagcgcacccagagatcaaggagagtgatgggtgctgcccgcctctgaggggacggaggcagctgccacccgccgtgtccctcacgctggctttcagaaggcttcacgcaagtgggctcacaggcaagaagaaaagctgtgggccgtgtgtctcccttggctatggctcagttttaatgtaattagaagctcaacttgaaagtgagatatcaaaggaagccttcagttgc

SEQ ID NO: 63625 - DNA, 1006 bp, Homo sapiens
tgctttctgtgcatctccgtgctcacctttctggaacacagcccctgaacagaatcatttggcaaaacatcccagtacaaaaaccagtgggttttacatggggaaagaactcaatgagtccacagttcgtgtcgatgaaggaggcactgcgtgttgggctcaaacgcatctgtaactgtgggtgccaagagacaagtagagctcagactgctgggagcgttggctggaataaagctggccctcacggggctgttaaaatacttgaacttgaattcaaagtcagatttaagctgacttcacccctcttcccttgcttctgaagattctggtttttcacgagacagaaaaaagggtggaaccaggagcttatccccttccttccttccttgcaagcagcagcaacagccattgaaactcaaagacagcaagagctctcttcccgcccactcccagcgccactcccgggggaacccatgtgggaagggctcttcctgacacctctcctgcagcacacagcacacgtcagccttgccctgcatgcagccttcccagctggagcaggtcccaccagcgccctgccaggcggcaatggtctacaccgccattttaccttccccaggtctgtggcattaggtcttcccttgtgagtggctcgtattcttttcaagatactgtaaataatttggcatcatatggaccacttgatgcttctatatgaaacatgccttataaacccttagtactgcatgatttcagattacggaaatatctgcatgagtattggctgcgatatctctgtactagaaatttcagtgctacctctacacaaacagacacactggggatgtgctgtgtgtattgtatgagtgtatcatagaatatttcattgtccgtggtagtacatttcacatcataggctgtctgtggctacttttaaaccttagacatttgaattttccctcaagctttattctggtgaagcgtgggatggggtcttagctcactt

SEQ ID NO: 63626 - DNA, 1791 bp, Homo sapiens
agattcttctcatttgcatcattgaaaaggggtctttgcaatgatgcttatagcccagtttggggtgaatcatacctctaagcaactgtcattgaaagaaggccttaatgctgatagtcattgtttcagttttactttttatttctttgtcttggctctctggctaggcctttaatacagttttgaatagaagtcgtgataatgggcattcttgtcttgttactaaatttagaggaaaagctttcagcattccactgttgatttcctgtgaactctatagattgttttgtggatacccattttcccccagaatgaaagatctttttgaaattatattattctttctttaatgaggccattttcatatttgcatttatgagaaaatgtttaaaaaagtatgtgaacataaattatataatcttttgagtcaatcagaattatacaattgaaaaatagtctacaattaatgatattcaagtatctttagattttaaactcattaaatgaacattgaaagttctgttttctaattatagagccgagtttaaattgacaagagcagccacactcgagttgtctaagtcagaggctttataaacctgttggattttccaagggttgcttctcttgaataaaggtgtttttgtttctcacatattttacattttcaatgacctgtttaggcagaagcaccttttgtcactaattagtgtggtgtgacaagtaacataatgcgtatctgaaaagctccactgggtgtaagtggagttcacacctcttaatgagtgccttcaagagtgtttttgtcattcccagggagaactagtgccccttgaatagaaaactgctgtaaatggaaaaaggatgtgtcttaggagcctggtgtaagtgcagatgggcccaccctgtcctctgactttagggccttcctcaaagccaaggccctcttgtgcgatggggctcttctccttcttagaattcctacatccagagtaatggagacgacttgggatcatgcttcaggatatatgtaggtgctcaacacaggctggtttctgtttttaatttctggcagaatgaaccacttgaaaatgaattttcattacgattttaggagggctgagagtagatgaggtaagagatctgcctagggggcaggatcgaaggaggctgtcactctcagatttgtgcaagtgacttgtgttccccaaattcacatgttggagccctagccctcagtacgtcggagcgtgactgtatttggagatggggcctttaagcaggtacttaaagttaaattggggttgttagaataggccctaattcagcctgactagtgtccttataagaagaggagattagggcacagatataccataggcttctgtgcacagagatgaccatgtgaagtggcagcaaggggtggccgtccgcaagccaagaagagaggcgtcagagaaaatcaactctgccaacaccttgaacctagacttgcagcatccagagctgtgagaaaataaatgtctgttctttaaaccacccggtctatggtattttgttatggcagcctgagcaaattcattcagcaagtgccagccttgcactcgcgggagagtgagtgcctcctgcagtgctcagtctggtctcaggctgaaattctaggtagatgcacattttcccagttggcaggtgctggctcatgctgaaggggaacatatgctcaggattcctgctttatgtacttcaaaaggagacatgtgacatgtttcacttaacttcatctaaatttcc

SEQ ID NO: 63627 - DNA, 1174 bp, Homo sapiens
tcctacagctattcagtggaaggtcctagccagtccagtacatcaagggaaaaaatgattttggaaaagtaagaaataaaactttatttatagaaggcatgattgtctatacagaaaattcccaaaaacctacaaaactacgcaacatacaaaaaccaattgcctttctatatactagcaatgaatattggatactaaaattttaaatatagttccatttataatagatgaaaatgtgcagtagttcatgtccaatgatatttgcaggatatatatactgaaaactacaaaaccttaaataaaataacatttaaagaaatggagagatatactgtgttcttagattggaagactcaatattctccccaaactgatggatttaacatgattccagtcaaaatcacagcaggtcttttcctagaaactgataagccattctgaaatctatgtggaaatttacagttgtacaagttttccaaaattatttttgacaacccatcactagagaatgttaaagtaactgatcatataattccttcaagaatggtcattaaattctggatttcacagtttcttttagttcgtatttcacaagatagaagctttacatttttcagattaaggtagttttcacctttgtgcatgctacatcttggggaaaatactgagacaaaatgactcattggaattatttttgattttttgatactcggctgacaattatagtctgtgttatgacagttatagcctgtgtcatacgtactcagaattaactaacatagtcttcctcctaacttccctgcatattggaacattagaattcttttggttggttgaagaaacatcctagaattttaaaatattttgtatctaatgtaatgctgaaaacatgaaatccacataatgtatgcggcatagctaatattagaagcatgttcaaggagcagcctctggggttaatagagtttaatttgcaagacaaatgaaagcttattttctcctaggctctctgctcataattctagtagggccacttttgaagaatagtaccttcaacagacacagagaacccttgttggacagcaacagaacttgctcacagtgagacccgacatcccctccgctcagtgggcatttcctacagtgcagagttgtgcgttgaaaagtgcctctt

SEQ ID NO: 63628 - DNA, 1050 bp, Homo sapiens
agctacttgggaggctgaggcgggaagaccacctgagccccgaagttcaagactgcagtgagccgcgatcccaccaaggcattccagcctgggctgcagaataagaacctgtctcttaagaaaaaaaaaagaaaaaaaggtaataaaagagcaccaggaagcataggtgatgcacctcccatgtagagaaggctgggcgagcgaatgtgtagtggtttctgcggctccattgttagtgatgacttacggatggaaaagggagttttgtagctgagtgaaaactgttagaaaaccaaatgccgctgtcatgtttttgtctcgtgcgcttccccttcaccttcatccttgggcccatgctgtggccaactgaggagtaccctgaggttaagcgtcccccatggcaggtgaggctgtggggtgggaggagggctgggagatagcagattagagatctacaagagaatagaaagtttgattcaaggagaaaaactggagtaagcagtttggagaagtcagatgtttaaaacatgaaaagaaatgtaactttgagttgcagtggttttgagtttcctgatcttgatgtgccagtaactccctgggggctgacaaatccagggggaaggttcaaaggcagagagcctgtttgagctgggccagggcacagaggcttgctcagaagacgtggacggcagcagagcctgggcttgagagtcgagctccaccttcttcaggctctttccagcggggcgggacaaggacccacacatgctaagcgagcagggaccctcaagcctgtgactgttcgtgccagtgaaaagggcaccagtgcactgatttcttccgttcacccagaaacaacgatttcttcaatgttcacagtagtctgttaaccacctcttcgtggtgcatctttgagcctgtgtttacagcagtcctctctttggtcttaacaacccaacgtgaattttgtggcatgctacaaattgaggcatcaaagctatgctttttacattgacttttgagaaattcgacagagttctgaaacccaaa

SEQ ID NO: 63629 - DNA, 1026 bp, Homo sapiens
gtcggccgagggcctgtctgctcatggggaagtgtcctctgatggcagcccagtgtcttgctaaccagcagaccactgcagaaggcaacgctggcctcctagaggtgtggcttgtttgcatctctatgtttgtgaccaagtcgtttccttccttggtctcagaatctgcttggcacttactaatagcatttgttcaacatgcatgatcccggtatgtgaagtacagatatgacatttataagccagacactgcgtttgactaatgttggcaaagtcacactaagagcctcccagtgttcagatggcggaagggaaggcagataggagtccagtccccaggactctgaggccccaccttgtgccttggtagaagtgaagacagatcgcctggggaagttggaagaagtagccgagacatttctcctggctcagagcagagggggatttacgttggcctatgaaggaagagtaagtatgtagaaccttcacttgtagagagctgagactttactgtcacccttgttttagggagcctacatggcacctaagactcaaatttacatttttaactaactgaagccaaataaaagaccttttatcccaactgggtacactctaaagtctcgacatgattatgcctgtgatcctgcacaaatcgtctcaaagatcttggaaaattggttagtgtcggggcacggtggcagttagtactggggcattggaagcaccagagcttaccttagctagacgtttccatcccgtggcagcttaacacgtggcatcctcactggtcttacagcattatggggaatgcaaaataaggacttgtctccttccagaagcctgctgcccatcagaaatatatatatatatatatatatatatatatatatattttcagggaatggtagagaacagtggagaagtagatgcttgtcaggcgtcttgtctgctgggccaaggtgaatcaggaggtgagagcggcggctttcctcttgtttgggcagcgggtgaaggacaggcgtg

SEQ ID NO: 63630 - DNA, 1026 bp, Homo sapiens
ataaagcctgcgagtctgtgaaggaacataaatgtgctgtgctgtttacatactaacttaattgtaatttaaatgcccttttcattccataaatatagccataggcttttcatttccttcaagccttcagctcacagagcagtttatatgtaaactggagtcagttgcttcataaagtgaatttctggaggaaataatatagtatatatcaaaatctagataggtaatgggaaattgattgtgacaatacaatattagaaacacatctccataatattttatttattacactttccaccttttgctgtcaagggaaaatatttcatcttgcaccgcgaactccagtctgtagagattttgacctcaatattctcacacaaatgaatatagtgtgtaaggtagcacaattttccctgtgtaaaatcatgcataaaaaacaattcatttaaagcatctaaatgtttccaaattactgcaggtaatttttacagcttaattcctccgagacaccattttaaatgaacccataattcaattttcagactttgcatttcaaatttttatgttgaaagtaatttcctttcttgcttaagttgtgctcagaaccagattcataaaatgtgtatgatgtatgtctgtagaatcagtgactgttagaagcttaataacaaatatgcaaggaagaaattaaatgatttttctcttcagtagttcagtttaacattgatttctaaaagaaatgattctgactttgccgctaagtttctttctttcactttttttcttttcttttttcttcttgcagtgttccaggggataaaactgtccttgtatctgtattttgaatgatttggaatcttttatctttgcatattcctttagaccagaaaagaagttgaataatgttcagactggctcccatgttaaggtagcacttagagattctctgaatatcatccctgaagctatggcttcctaaagacttttgacctcttaaattagtgaagagtggacaccaccgcttaa

SEQ ID NO: 63631 - DNA, 1050 bp, Homo sapiens
tgtgtcgctgtatcttcccgcgacgtggtaatgcaaacttagaaaaaaaaataagatggaaatggtgctgcaagtttttaaaatcaagggttgggcagtgcagggggagctattgtttaaaaaataaaagttgggaggaagatataatggattttgtcagtggtattagggcgatgaggcattcttgagttcagcaaatattggcagataattctgctttatggaaactattaaatgtaattggtcacatcagagacacaattggcatctgtactttgaagctgaatctcctcaggttgagagagagaaagagagattaagacggactcttcagagaccatggactacagggcccaaagttataaatctggaagatgtaaataaaggaatattttaggctaacgttgctccaagaagcagtatttgcctgtaagaaatgtaataatagaggtgccaatacaagatagcaaaagttacccaggaaagatgttaagtgacatgctgtcttcatttttaaacaggacaaattatttaattgggaattttgccgacactgttgaagcaattatcatatttaaactgtttatcttctccacattctgcctgtattttttttcttctttgcattaatctttttcctctttagcatctagagagggtccctttctcgtggagatcggcattgtagaccttaaaaggtctcacttgagaaatatttttgatattattgaataattattaattcatgcaagaaacaaaaggaagggcactcaccggctcgtggccagagcagactctcattctttacttctgagtgtttgggggcttctagcgaataatccctggatgacgggtcctagtggttttgagaccaccagtgggtagcctcgccctgggaggggcttgagcagccttgaggtgcttttgtgctttgcacgttcgtaattgtgaacctcaacgcaaagcaggtgttgttgtaaatctggtgtctctgtggaagcaatgccagtcctctaattcatcttcgccaagctagaggacgcgagcaca

SEQ ID NO: 63632 - DNA, 1004 bp, Homo sapiens
tttgttctttttgcgaggaagagatccatgggttggctcttactgaacatgaaatgttggaagtggaacactgcagtgttaccagtgagctgtgtaatcgccacctctgacagggatcctgctcgaggagcacgtctttccttggtgtggccgtctccaagtactttgggtggtggtaaatttacccttctcggtcacacactgtgaagatgtgagtttcccaatttcagcatttggagccatgtccttggtgagggcaggaggaatttgtcaccctttctcgatgtgcctgggactagggcagagacggttagtctcaggagagccaggtgtgccagctgcccctgcctgccatggctcccgcattgtggccaggactttttctggcagtggtactgcccgagggccgcagtcctggtcacattccacttggggacagagtgtgcaaggggctgatctgaagatccggctggaacctgggagccacaggatcctggggaccctctttggctgtaccccgtacctctgtatttgctcccacatgctgtctgatttctctggatggcctggatgcctctgttcccagcatctcctcggcatgctccctgcagcccttggcctgtgtccagtgggccccgacccggaggctcctgccccgtagctcaggtcccgtcttggcctcagccttcccttaggtgctcgtttctccagtacctgcagcaccggcgcttttagattgcattctttatgcattaattagtaatgtggtggtcccaggtgactaataagctaaagaaagaactagtgtgagtgaatttctttaaaggtcatttggctctaggaaaaccttttttttaagaaaaaaaaaagcattttatagaaatgttcaatggcaaagtgaaatgtaaagtattacatgttttttactatagcgaacaaattgcccctttttattccgtttatgtcttcatctgctacatttagccagatatatttgtctacct

SEQ ID NO: 63633 - DNA, 1066 bp, Homo sapiens
ccaactctcgggcttcttaacccaaaagaacttccacgcagaaggcagcgaaaatagtgcacttcattttctaagacatctaaagctgccacaatgactgtgagttaggtgagctctatgaattaggctagggatttgcaaccacttagcaagttctaagtaactgtaaaagatcccatagactgcaaattgtgtttcatttggggacagataccctgtcttggggatttaagtgtgtttacctgcccagagttgacacagacgactgtcccttagcttcctttcctcatgctggttttaagtgcttcgaatcgggattttcctacccatctgatgcattccattgaaaattcaggaatacacatgtatgtgactgtttattggcaagtaattgtgaaataggccagaaatctaccagcttcctttaattaatgtaacaaatacttagcaaggacctcctgcattctagggattgtgggggtgggggggggagcaacaaacaaaacagataaaccctgccctgaggcgccccttgtcttgtctgggggtggaggtggggcaggcgtgagacagaagaaacaggtaaaatacagttcaaagtcaggtgctggtcagtgtcttggagaattctaaagcagggaggagggatggggtgagttttaaatgtggtgactgctgaagaaatggcctctgacagcctggaggaggagctggagctgggggggggacaggctggccagctcctccaacacacacacacacacacacacacacacacacgcacacacacacacacacacaccccctctcccccaaggacccacaaggactgcggcctcttagcgtgtgtggagtcatcacactgacccttagcagtgtggcctgacttcatgaggcccccgttgtcatggagatgctgggaatgggaggatttgccaccctccagtgaggagcccccatcccatgagtgcaaagcctgaaccggcccttccctaattggcacctctatcctattttctttggctgaggaaattctcgtaaatgtatatttaatgtggtgttgaga

SEQ ID NO: 63634 - DNA, 1071 bp, Homo sapiens
tggctggagatagaacagatcctgcctctatccacggcgtaagggagttagcttcatggcaagctctctggagaacacaggccattgtacctgctcatgagaacagaagtgaaagtcacacagcatgcatattagttccgaggctactggcattattatttaatgatgagttagtgcaaattgaggggtgaggaagtagcatgtacaaaggccctgaagatgaatgactgtgtgaaattttgaagagcagtttagcccgaaaatattccatgagtagctgccaggagagcttttctggaacagtattaaactttagaaaaagtgttctgacatttatagactgacacgaaaacagaagtaaaagtctaaattgaaccaaagtcctccttaaagattgcctttgaaattgagtaatggcggatgcccagcacctgatgtttgggcacgggcgacaggacgtagggtggtcatccgaatatccctgccccactccccagctctctatggcattagtagatgctggaagatgaggccgtgttttctctttcatcacccgtgcagtgaaggatttgcgtggtctttggtgcttttcttctaaataatgaacaattatttcttgcgacattttggttttttactgccaattccaacagccatttgtcttttcagagctaagtttataacttcctcctttctctcctgtcacttttaccccattctgatttttcatctccctgccaattgtggtttcgtttctgagcactcatttattaatccttctttttcatttcccagaacacgtgctggtgtaaatctttttgcagttaaagtattacattaacctttttgatagcatggggtggtatctcggcggatgggcgagtgctgttcgcctgtggtctgtctcaggggttctagttggaaggcgtcctgcagccatttcttcagaggctaaggtgtgggggagcaccttggggaagaagaaaacatagtttctgcccttacaaagctgataccccatcaaacttgagattaaaacagacaaaaaacccaagaacctacagagcactg

SEQ ID NO: 63635 - DNA, 1037 bp, Homo sapiens
accagccctctggttctgtccacatcggcttgatgcccattcaggggttgcaagttctcctggtctggatctattagttgaagaaattgccacctcgtaatttcaaattagtgggaattaaaaatttaatgggatgtatgtattttttggatcatatgaaactatgttttatgtggtatttaatgtgagtttaaatatgcttactaaatatgacttttgttaatatctcagttgatgctcgtgcgaaaaaagtctgcctttctacctttctttcctacctttctgccaaacccagtccttttactaatattttaaagtattgatttgaagcagcagtgtggttgcttctgtctgggtttgaacaagtaactgaattttaattcctgagacctcttacatatagcaattgtcttggctgttgtaggaaggcagcaccctcattcctctgatttagctctctttgattctacaggaagttgttgccactgtctctttttattaaactaaatgccagaattctttcatgtcatcataagatgttaatgcatattgctttggggaccaaagtcatacaattagaaaccactcaaatgcttttttattctaattctgaggttaccaattccttaaaattagtaaattttcactgattttgcaagccagttgtaaaaaaaaaaaatagtataaactcctcactgacggtagtttggaagctgcattgtttggatgtgatgtttcagtgccacacacgttagcggtgggaactggaagccagtcacgaatcggctatctgcttcagggatctggctttgcactcctgcccctgcccctgaagtggctctagggacagctgtggtttgagtggactcttgctccttcctgacctcttaatggccacatggacccccttgcttatctttgagagcagggccttgatggaaatgcaaatgtgtttctctttggtaacccagataccaaaaccaagtgcagtcctggaaggtgaaaagagtttccaaaggaaaaataaaagacacatt

SEQ ID NO: 63636 - DNA, 1053 bp, Homo sapiens
gaggctgaggtgggaggatcgcttgaacccaggaggcagaggttgcagtgagccaagatcatgccattgctctccagcctggatgacagactgagactccatctcaaaaaaaaaaaaaagaatcgtgatattcttgataggaagtaaatgttagtcataggattacaagattttattctaagctcttacaagcaagcagttcagattaatgtgttttcttagaaaacttgatttgattaaatttcatactttttatctattccccaaaatttatgcggtccttgtgtgcttgagggttctaggaacaaagtgattggggaaacaccggtcccctctgctgtgggaccctgcgggcttccagaactggcgtgaggtccgagtcgctgtgggaccctgcgggcttccacaactggcatgaggtctgagtcccggtgtttcacaatattacttgaccaaagagcgtttttttcacaaacacatgaggcagcccatgtgactccagggacccgcaaagcacagcttgagaaatgttggtatgtttcaatggaaatgtatgtaattaagaatattagtacaatatttattaaaagtttctgtcttgaatgaagtaataggatatcctttaggaagcctgatgtcgggacgtgctgtggggtatttttatgttaggtgttaacattcagcaaacaaatccaggctctacttttatcctttaatgaaagattttattttttattcagcattggtgcattgaggacttacagccatcttatcttacctcgatgccattgaaacaaaaaaattagtcatagaaaacaaacctaatgccttcctttgcaagttccagtcagaagtgtcgcatataccagacaacacatcatttttatagttatagagagaactcctatgtacttcatgggaatacaaaaatgtcacaaaattaaaaggaatttttccaaaattactgtgactgaacagatcattccacgctccgttataccattctgatcctaatcccatagtttaagtgtagaggctggaaaatgtcttcga

SEQ ID NO: 63637 - DNA, 1050 bp, Homo sapiens
tgctgatttttaaatatgccatatgtgtcaaatgtatgaattgtgatgatggacaagaacactttcgcagctttaatgggagcatgtaatgacttgaacaagactgcttagttttggttactgatgatcaagtacagaatcttgctggtgtctccaaaacttcctgcctggcctgggcagctgtcctggctccctctggccagttctctgccaggcagccagtgtgaatctggaaggggctagtcctgtcttcccctccctgtctagtgcctttaacgtctccgctgagcctgccacctcctggcctcctcgaccctccacctccccgagccgtggaggtgagtcctagaccttcttctgtgggctcctctccccggggccctttcggctcagccccacttctcttattcacccacttgtgttctctgtagctaaatgatacataacaggaactcgttaagtagcttgtgcagtgaatgagttaatcctaggtgttttcagaacagtgaatttcaggttcctgactccgctttgagctcattcaaagaaagtcatgtaaataagacctaatcattgcaagaagtctaatgaagaaaccattcattatctctggagatgggcaggtacacctcacagaaagtgaagtctgttgctgatgaatagtctgcatgcccacatcttcctctgggtttctaagtaattgaataagaaacgtttctatttatattcttatttatgtgcaactgtatttaattattccctagttttgaggattggccaataaaccttttcttcccttttgccattgattattcttaagtttaagacaatgcccagtggcagatgtgcttaaccgccatccttcatctagttcatgtgactttttaatgtcaattataaagaaaattactcctttggcttcagaagtttatttaaatctcttctgagaaaattggcagctcttcggagttaatgtccagagcagcagaaacagaaactggagggcacagactggtggatatgtgaacagaagcactttttttaaacaaa

SEQ ID NO: 63638 - DNA, 1039 bp, Homo sapiens
ttcccagaagctcttctcagcgggaggctccctgtctttcacctctgctcttctgaggtaccagttgaagggtttggggggtgaaatcaaggcatagggctcctggcaacactacccctggctccggggtttgcatgccggggcttcttccttgtcctggctgtcagagaacacctggaaataaatgctgcattgttttgctggaaaatcctgacaccacctcctgccttcccctgggagggctgagacctggcctaggcatggagcttacggtccacagacctgcctgcctgcagcatgacagcctcccagagggctgtattgatttttgaagaggaggaaaaaggcatacaaaattggacttgccagccttctttgagtagaaattggtgcttcctaaagggaatcttaattggctagcttcgaagctaaaatgttttctcccccttcccttctcagaactctccagcccccctgtttgttcttgtgagacttttccaagccccagttacttttctttcctgctttggaacataattggattcttcgctgggtagagttttgcttggaagacctgagggtgtagctgaaccaagtttgagcaccctggaaggaagacagaagatgccgggagaccagccagctcaaaggagaaagggagggggacagcatctgaactctggcctccagcatgatttcatcctttaaactgaaaaccctgagtttcagtgccagcgacgacacttgttgaaaaagtacaaatgttttctgcttcttgtaatctacttcttgcaaatattagtactctggaaaaaagatttattttaataatgtgagtttcagatttttttctgtagttaacgttgttttattactctatatccttgccagaaagcgtgttttaagagtttcaattcaaaattaaatatgacctcagtgttttaaaatacaattatattaactgtccatttaatagttgctgaggatttttttggccactgatggatagtcaagatacttgtctgagattaaatgcagt

SEQ ID NO: 63639 - DNA, 1123 bp, Homo sapiens
agaatgttgagcactctaaactgggaagagcctggtagccgtggtaccaggaacactcactcttcctgcttgctgctttcctcatgctgagctgggctgagatcaagactcctggggcacttgcttcctctaccctttgtctgtggccaggtgggattcccacacagtcaaaggaagcccgtgtccaacaggggccatttcccttaaatttctctcatcacccccagctctgctgtgcctcaggtgggccgctgccactcttccttcacgttcttgataatatcagtgtcttgaaaggaagcttcttgcaggtagggaggacgcttttccctggaatagctgctgtgctcatatgagtttgtgctggaacattctaaccacctttctgtgccctggtttgggttgaagggaaggcgatttaaatcaaaataaatctgcaaggcagttcatcactgggacattgtttttccaagccggggaaggcgaatgggttagggcagcttcccacagacggcaactccgggagaatatcaccggggccttccagtctgccgcagccccgggagcttctacccagggcaggtcagtgttgtccggtttgattttaaggaacccctggcattgccaacagttgtgtttttcttaaagaaatccttgagccaggtccacatggctctagctttgctgtgttaaggtgcccgacgccctgttgtcacatgtacacacgcccagcaaagctgggctgcttcacccaccagccaccatcctctcgtgccaagtcaaagaaagtgaaagccaccagtgtcatgatatttgcctcgggattattctgtgggtgacacgtgatgtcctaggagaggcctaggggaggtgcgactctgatgggctctgagtgtttccccaccaatgctgggagagggtcttgtctcctgctgggttcaagggatgggataggaaggggctgaggtgccaggcaaaagtcttgtctcctgcagggtttgagggatgggacaggaaggggctgaggtaccaggtgagggtcttgtctcctgcactggctcctgctggcatcatgagctggcatccgtggcagcccccggagctgcaggatttgggcttccga

SEQ ID NO: 63640 - DNA, 1031 bp, Homo sapiens
tcctctgaatcatacagaactgtctccagaagggttcagtggggatctctaggatgggcagataggaagctagagtgggtgggcctttacatggaaccacaaacgtccaagaaacctctcatcatctctgcccaccaatgggctgctgccaggacaaaggcactaccaaagcctcctgggctgccgccagctgggggccacctctccccagcgccacaagccagtgagccaattagacggtgtgggggaccttgctcactgtgcacctgatgggccgggcacagggcaggatgttgctgaatggcccaaggaagtcagagattggttttgtttattaaagttggggcttggggatcttagagtggtgaactcttctctatacgatctctttttgggggttcgcctgccaggaggagcaaggctgaagagctgtccagaggcttttcttctccttaagcctgtgaaatatgtgagctgaaatgtaaggtctcaggacagaaaagttctcttacaaaaccagggcaggaggtatctgcataatcatatggaggctgggagaatgagcctgcaaacccctgaagtttacctaaggtttgttgggcaacttcatgaaaaacataggggcaaaagttccatgaaaatcgttagttttctccaagtcatatggtggccctggccatggagctagaccctgctggcctggtctcaccagggtccagagagtggtgtgctctcaggcaggccaggaagaaccggaggaggaggcctccgcagctgctgacaggagctccagggcaggagtggccagcaaggaaggtggcaccggaaataatcagacactctccaaaccacccctgcaagcactgaacccccgctgagccttttccccctcacttctgcccatggcagtgtttgctgctcctagagccgaggacaggcgggcccctggggcttctcagtcaagtccctagtgcttaagcagagttgggattggccacacctacccctgcctccctggctttcagcccacg

SEQ ID NO: 63641 - DNA, 1613 bp, Homo sapiens
tgagtctgtgaggccagagaagagaagctatgaccgtgcaaacatgcatgttatggtgttggctgatgcggaatcaggaagcttggaggagctcttgcatgaggaattgcagaacttaggggcatgaatttgcacttccagatgtgaaggttgcaggcaccgggcgttgcagaggaagtgggcaagctcaccttgtagagaacttacttggggtttgtaatttgtatacacttcttacccagcagaaacagcttactgaacacccctcgggtggctggatgatgtgctagcaactgaaaccatctctgcgacttaagcttctctggtgcgtcgcgccccacgtgcttctccagaatcccgtttggaggggccaagcaagtccaatatagataggtttatactgaagccatcagttttgtttcttacatcgtttgtaaacagcagtattatcctggaacttgtttcctacagaactgtaagataaggataaaatcccatccacctgaattgctgagaaacgtaagaggtggtgtgacccgctggagccctgtggagtggcggactctggggagtagctggtcagtgagattctcgcagcaatgtgaggcatcctcctcacagaaatgcatttacggatgttgctgtatcccctgacctggcctacaaggacagaacagccctgggggccacgtcccctcccggtctcatctgccgcttgctcaccttggctgtccatgcacccgtagctgtgaccatgggcggtggcgccagctcggacttcaccccgttggagcgggcaggatgtcacactgagctaatgtgagattgttcatgaagctacagatcttagtgctacttgggcttctcacagcacagaggaggattctgaagtgagagataaattggcttcatgtatgagcaagggggaaagtgttttattttactaggaagattttactgaaagaccaatcccgaaacggcccttgcttcggccacagctgctgggatgtcctcgggcctcccctgtttgtctgcatgtcttcttgttgccatcggggcagtggagtccccggaaacagtccaaggccctggggtgggggatttaaatttttggcttccctcagacctcagaccgtgtgggtttttttttctttctttctttcctgttcatgggcatttgattaaaagtttgtgtttaaagagctgaacttcacatcagttttacttatcagtttgaaagacattgagatctaaacacggctctgcccaagacctctgccaagcagcgccgtctgtctgtctgtctgtctgaagggacgggaaggtggagaaactgcaggtactgacctgtctctaagccactgagggcagccatccagtgtcctcgggaccccatggctccagctgctgacagatgtgaaacgtctggcctccatcacccgggtcgccccgacaaggatctgtaatgggggcaggggtgggggtggatgagaaagtaggaagtggatgctgggcagcgaggtgtgaactgacggcagagcccagcccgacagcacctttgattgatgaaaggacattgttaacaagcctttaaagtttctcattaatgtttt

SEQ ID NO: 63642 - DNA, 1865 bp, Homo sapiens
ttctaagaaagaaatagttgttatcactttgaaaatatgatccatgattgtgttttaaaactatatatatggccatgttgtaacattttttaaaaagaccatctgcagagcaaggtgcttcagtgattatctcagcacgaggaaatcacttcattttttgtgtgcttaactgtacattctcaatttttgccatggaaatgcattatgtttgtaatcataaaagaacacacttactgggtgaagaggaaggaccctgacacatgtactaagaagacagcatgggcccacgcatctgaccacgtgactggtgtcacgtgcttgaccagctgtttatcagcttcgcctctccacttgcagggcagctgagcacaaatactccaggtgaggtcatgcccagcctgtcatcagatagcacatcaacataaatgcagtatcacttcagggctgtgaggtctcagagggaggggaaagggtgaactagaaaatgaagaggggcgtcctgaaggaggtggcaatcaaactgcatcagctggagctgggcaggacatagagggcatcttgagtaaaagaagcaactggactccagggaagaggagaggagggcccaggtgccacggtccctacaagatgagacttggggactggagggccaggctgggagagggcagacccctttgccatgagcacaggcaatgtggggccagttcttagtgacatttcagatggtgaccagtcagaggacagcaggacgtggtggtcatctactctctttcacaggggacacagtgggcccagcaccccggccacatgtgatggagcctccaggcctgcccagcacctactgccctgggacaggctctctttcaagtcagctcctctgtccaggaagcatctgagaggccctgtggtcctggccaaggaggcaggccgtaaggagggcaggcccgaggacgtaggtgtggcaacactccgtgtggagtagtctctgaggccagacctgcggttcctgtttcctgtgccctggggacccagagaaagaagacggatgggcgctgcagtggggcggagcaggcctgagcccagctcgaggaaagcttgccttctcgtctagtgtccccgtgttttacataattaggtaagtcacttaatgtcgctgtgtcttgttagagaagctactaatccttagagctaacagaactaactaattagtgtagaacacttggaaaatataagaaattcagatgtagagtgtaatgtcccagtcctcccggcattgatgctcgcacagtgtccctggtagagccgcgggcctggctgcatcaggagggatgggtcttggaggcggtggcataattgagacacctgttctgaagccccagggctgccggccacacaccctgccctgcttagccagctgtaggccacgtggggacaacaaaaagggaactatccaggggccatctgccttgctaccccggcaccttgaggcaggggcagccaggtcaggggaccatgggctcagagcccgtcggagccacagggaggtgctgacatggcctgagggctggagcttccccctgggagtgcctgggcttccacagactggtggtggccgaggtcaggggagccggatgtggcaagccccgggtttggctctggacactgcccatgactggccatgcctcagcaaacctgctttgccctccgccttctcttctctgaaacggagctaatgacgccgcctcgcagctcctccagaaggtaaagacgggattacgggacacctggcacacagcctggcggatggcactcactgctgttttcctccgtgacagagaaccgcagaacttccttcacagttggcg

SEQ ID NO: 63643 - DNA, 1009 bp, Homo sapiens
aaaaaggagcagctcttcctggtggaaattgcgagcagaggctgcgtgagttccgtaactcgcacacagcctccatttggagccagaatgagcacgtgagggaccccgggcagaggggccagtgctgacattatgctccatgcaacctcccatcctgttgtgggagatggtgcagaccaggggagggagtcagtgtgtgaggggatgaggctccagtcctttcctgggcaccaaagccaaatcccccctgagcacaaggatcttccctgggtgactgcagaagcaaggagacctggcccaccgtccctgctggcttcctactgcccagccgcgtctctgcctccctaccccaaagcctgcagctcctaagtgcactatttgggctgtcttgtttgcagcggatgtttgaaagacagaccctcttctctagtgctggccttgagtcctcagagagctgctgtttcctgggtttctagctccatggaggcagaaagagaccccagggtggcctttggaggaagatgagccccctgggttaaccgagcttctgcagtggtgctcctgggtcatcactgttgccactggtcagagccagagtgtgtctgcctgtgctctcctgaacacagtggagctatttccaagttcaggtgaaggggacatggaggttaagcaaggccagaaagacagagacgtcctcttcccctggtagcaggtatttagcagatgggaaaatattagcagatgggaaatcagcagatacactcagctcaagatgcaaatttaaaagccgccagcccctgtactaaatatttacactgaacatctctactccatcatccgtcttttatttttgtgagcccgtacaactgctcttattacaaagtcatgtaaaagttgaggaaagaaaatttcacccttggaaacaaattcatgatgaattaaatttcagcatgaaaatagaaaaaaaaaattcaaatttctgttgacttttgggcttatgtcctgaaag

SEQ ID NO: 63644 - DNA, 1092 bp, Homo sapiens
ctctcccatgcagctggctgcattgtacctcacctccagcaccactctgcctccacacctgccctcccagtcctgccagggcagggcctcctcccttttgtcttcctgctgggctccaggctcctgagaagcaaagcagtgtctcccttggtcactgcccccaggcgccagccaacggccagcactgcacaggcatggcaggcccttgataggcagcgatgctaaatggggtagctctgtttgttccaatcacctttaaaatgctgttttatagacagtatttgataggcttatttcagctgatttctagacctaatttttaaaagcaattattaatctatttcccaatgactttgattgtaacttgaaaaccaaaatctaataagaaacattttgagaagacagtgaagttcaaggtcaggcatcataaatggagaagtgaggagccctaaaccactggccgtgcctcgtcagctctgagctcctcattcccacctttcctcctcgttcagctttatccttctcttccttccatcagaccagaacagttttcccaatggcaaaaacatattttcattctaataacactgagacatgactgccctttctcctttctgtctgtatctacatttaagttacacgtagttacatttgaataaaacagatttgaaagattatgtcataaacctggtaccaaaacctaaccaagatattgagaaaaaagatatgtcaatatttttatgtacagaaatgaaaaaaatattttacaaaatattagcaaaggaaatcaaatcaagcaatgaacaagtgggtttatcccaggaatgcaaggtttgtttagggtctggaaatcagtcaatgtaatttgacacattaacagaataataaaggagaaaaaaacaatcatctcagtagatgtagaaaaaatatttgatgaaattcaacactcctttattataatttctcagcaaactgtaaatgggaactatcctaatctgataaaagtcacctatgaaaagtccacagatagtatacttaatggtgaaacattgccgtgcttttcctctgagatgggggcacagccagtgtgcc

SEQ ID NO: 63645 - DNA, 1030 bp, Homo sapiens
ccccccctaccctgcacagccatactttgattcatatgtgcgttttaagtttacacctttaaagtgactgtggaacggtagcccaacgattggagatttttttttctgtctttcttctttcttttctttctttcttcttcttcttctttttttttttttttagtcaacagtgtttcctttcacttcctgtcacaaaggtcaaagagagccgacctttgctggcagtcctgctcactgaattattcatgggattgactttttgtcagcacacacagttgtgctctgggacattttattcatttacctcatttaaagcgcctttctgcacctgttcaagtattaatatcgtgtaatttgggcctaatgccgattttgctgaacactcattatattttttattagctatatttccaaacgattatgtatgattattaccaagccttacaaacagcaccgggttattccctagccctttacatcttcttgtcaggttgttttcagaagcggggaggataaacatttgaccagtcccaatgtttttattcctactccatctccaagcagagaacttaaagcttcctccctcatggctttgcacgagcgtgattaaatccaactctgctgaagctgtacaaatgccagcatttataaggtcaacgcttttgttaaaaatgctatgtaaatgaggatctgcaaaaagggacattaaataaaattaaattcattgtcttctttaatgtcatttacattttggctaagccccggcctgtcaaggaggattttaaaaataatattaattacacatcatttagggatccaaggttttctattcagtagcatttggataacctgcaaaacggagactgtttattaacttcttaaatgacaacttgtcatttcatctgcataatgcaatgaaaacagtatagtttggtgttaatttttccttctcagttttcttaaagatgtgaatataattatcattggataggccttggggtcctggagatcctctcttggcggaggctgt

SEQ ID NO: 63646 - DNA, 1052 bp, Homo sapiens
ttgataagcaaaagattgagtcaataaattatggagatcctcaattgacatactgtaagctactgtgttttacgatgataagcactgattttgtttcaaacggagacctgaaaccatgacagccatcaccgtgtctgatgacagggtgaacctctaattatctgaagtccttagacaaataggaaaacaaagtttagtatgtaactcattccatgaaggtatactttgctactttttgtactctctttagaaaaattttcataggttatgttgcattctatggtgtaattctgaacaatgttgaaattaaagatccagcaacttgaatttagtatgcttatgttgattcatgtaactgttaaacataccctagaatacaaacgaataatgcttactttgagaactatgcctccattggggttgcattccttgtttgccgatgactgaccggtgccttctttgtccccaccccatttccatggaatgtatctttcacatccccccatctgttggaagcaaacacttggaatgtagtacagattcttactgctttgagagcttgtgttctggcatgaatggcttaaagaaaaaaaaaatttagttcaagcaactgattggatcattttggctaatattctgtttgaacaacagtacctatttgattagggtttttcctttctttgtaattccccaagcttgcctctgttatgtttcgtaggaaatgaatctatgagcagaaaaccttcattgatatgtaaatatcatttttttgttaatactcaatattcttttcatctaaatttcagaaactgactttaaaaaatcagtttccttttatttgtagttattctcaataaaatttcacccaggcttgggcgttttaatatttacacccactacttctgaaagtctaatgtaaataaagattgaaatgtgaatttgaaaagtcacacctcttgatatttgaacagactatagctgcatatatcttcttcttctaataatatggctagtttctctcctaagcttttaaaataataagacactatttt

SEQ ID NO: 63647 - DNA, 1030 bp, Homo sapiens
gtgttgtgtgctttatgagaccatctaaagtaaaattttgtttgtttcagaaacgggtatgcaggagattagaagccagtgggcatgagcgtggctgccaccaggtgaatgcctgtgccctggcgtcctggggcccagaggaccgggagcttccatcaagaggctgcctcccagcaccaaggccagagagtggccaggggaggctaagtacaggggtatgttcctcttcccaccaaactacttgtgagcatgttgaaatattttaatagaaagtgtaaataatcattgttctgatatatctgcaactgtgatttgttaactagatttctcagaatggtggaaggagctcagcccagccttgcccaagatgtattgcaggggaatctgtaagtgcattaaccttcttgctgtgacataaaagatagacttcttcttaaatattagatccataaaacaaagttaataaaaactgcaattatgtttctgaagaatgaggaacataaataaaaaggtgaaaattgatttaagcttttcttagcattctatcggtgtacaaactaatttgtgtccagcttcagattggaaatataaattgcaaatacatttaaaattccttctaaaaaacagggtttaggaaagggaccaggccactggatttggttaaaatagagaatcatttaaggacatcttggagaaaagatctttctcatttaattttccaaatagcaatcaacattgcttttttcttttccctgtttatgcttttcttgcatgtttctatcataaacttcacataaatcacagatttcagaagcaaacacagtgtttacaccattaattcaaagtaaagggaggtcagaaactgccagagtcagattctcagtctcttctactgggcagaatatcataaagtatatattagcataataatacctttgttattaattttgaacttactccaagaacaagttaatatgtctttgataacctctataattcttgggtttctttaattttacatttggaatct

SEQ ID NO: 63648 - DNA, 1055 bp, Homo sapiens
ttgtggacttattaattgcattactgatttctaatgatttcctttggtattttatttatataatttatttttttgaaatggagtttcgctcttgttgctgaggctggagtgcaatggcgcgatcctggctcactacaacctctgcctcccgggttcaagtgattctccttccttagcctcctgagtagctggaattataggcacgtgccaccacgcctggctaattttttgtatgtttagtagagacggaatttcaccatgttggccaggctggtctcgaactcctgatctcaggtgatccacccgccttgacctcccaaagtgctgggattacaggagtgagccactgcacctggctagctcctttggtatgttaatttgctgtatatttgcttaactcatatgctcgctcacgtgttaacacatgtaatacatatgcttaattcagtgtgtttgatgttgaagagtgtgccattttcttgctttgctgactgaagagagtatgtggtgcttttctgttgaagaggtcagagaaccatgcctcttctctattctccaccctcctcttgagcccagagcggaggctgccagcatggcagagccccaccggtggcagagctggcgctgggctctgctcaccctgctccgtgttctctggctctgctgtgtgtttctaggggctttggggagatgtcccctgtctggttcatataagggctggctcttctcagcacagaaaccaaagctttgaatctcatctctggcaaactgttaggtcttcaaccccctatcccttatagacacttcactcattaagctcacttgggaccatcacctccggaaaaggaagaagtccccctcaacaaatggttggtcttgcctcctcaggacaggcagcaagacttcctgagatctgtggcagcttcgtgtgtttctatcattgaggcagcaccatccctgtttgctattttaatttagcatcgtttgaaacagcgtctatttctcggccacgctcctgcttcacctttctctgatgaggatgctggtcacttgat

SEQ ID NO: 63649 - DNA, 1573 bp, Homo sapiens
gggctaatttgtgtatttttcgtagaggcagggtttcctcatgttgcccaggctggtctctggaactcctgagctcaagtgattcgcctgcctcggccttgtaaagtatcgggattacaggcttgagcccccgtgacctgccctgttgatctaaattgagtgaaattttgccgactgaatttgaattagaggcaagtagtactctgattttgcaatggagagtgcaggtgagatggggtgttgcctttggaaatggggaggggtgcgagttactgactaatggttagaaatgctttatgggggtgatgaaattaaagtgttatttaaacagctctttaggcatttcaggtttacctgggaaattgttacggaaaaaagcaggggttggggagggacatgtgacatttactcactgatggaagctgggctctgactcatccagtacagatcagcacaatcacaggagtcaccagaagtggcctcttgaaatgagcaggtcttgtgtggacctgccctaagtaaacgttttgaatttaccatcacctgaaaggctgttttgtctgttttacatgtttgttttaaatgcttcatgttttaaaaagtccttaaactatcaaaatgaataaaagtgtttttttttttttttttttttgggggggagacagagtctctctctgttgcccaggctggagtagagtgcagtgacacaatcttggctcactgcaacctctgcctcacgggttcaaatgattctcctgcctcagccttctgagtagctgggattacaggtgcccgccaccacgcctggctaatttttgcatttttagtagagatgggtttcaccatgttggccaggctggtcttgaactcctgaccttaggtgatgggcccgcttcccagcgtgctgggattacaggcatgagccactgcgcccggccaaaatggataaaagtttaaatgtaagtaccatttggatgttgtatccttgccgctggcctgtacttgaaatggcccaggaaacaatgtgcactttccttagtgactagttcaaacggacacgtgataaatgatgtgtggcatctggggaaggagcacatttctgcagcttttttggtgaagatggagacatttaagaatattaggccgggcgcggtggctcacgcctgtaatcccagcactttgggaggccgaggtgggtggatcacgaggtcaggagatcgagaccatcctggctaacacggtgaaaccccgtctttactaaagaaaatacaaaaaattagccaggcatggtggcaggtgcctgtagtcccagttactcgggaagctgaggcaggcgaatggcatgaacctgggaggcggagcttgcagtgagccaagatcgtggcactgcactccagcctggacgacagacgaagactccatctcaaaaaaaaaaaaaccaaaaaaagaatatcatggtggcttacaccagcaaacccagcactttgggaggatggcttgaggccaggagtttgagagtagcttgaacaacatagaacccatctctacaaaaaataaaaaaagtagccaggca

SEQ ID NO: 63650 - DNA, 1087 bp, Homo sapiens
ccctagtaaaataaacatataaggattttcttgtattaaaaaggcccatcccttgattttgtctttttctctgcctgtacagatctcttagagtacatctctgcttcctcatcttcacttcagtcctcagtggactgcagtctgacctgtgcttctgctattccattgaaggtactctctctgttagttgccctttcctgttgcattggatgattgtcactccctcttgacactcttctcttgacttctatgtgacccttcaatcttccagtaccgcctaggaccccttaatcttccagtaccgcctaggaccccttctctgctttactacataagttccttctcctccatctgtcctaacttaatgttgataagccccctgaggcgctgacctcgggtctcctctgtgtccctctgtaaccctttgcggtgtggtgctggcactgttcctttcttgattcccaaatctgtatatcaggtgcagacttcttccctgagctctagacatcatactaacaacccattaaacttcctttcctcaggttggcagcttctgcactatgatttgaggcatagtgccaccactagccatcagtctctaagccagaacttggagccagctgtagactgccttatctgtcaccaaatcctgccccttctaccttcgaaatcctcatgctgctctttgcttctgctttcctgacactttattgtaggcttattctcttctcgctggtattatttgatcagtttttacagtttgttattcctttccttacccataggttagttgtccttggttctttttgccatggaacatatttctgttcgtgatttttcagatttttttgggaggtggtattatatttgaacagaattccataaaactgaaggattttttagttggatatgaccatagatatctttgccaagataattttgtgtgaaaactaactaaaatagatactgagttattaatatattctgtgtgttcatactataaatgtttagaattttttttttttaaatgggtcttgctctgttgcccacactggagtgtagtggtatgatcatggctcactacagc

SEQ ID NO: 63651 - DNA, 1034 bp, Homo sapiens
gacagagcgagacgctgtctctaaataaataaataaataaaataaaaaattagattttattaactaatataaagatggagtggtatggaattccaaatatgtataattggtgtgggatctgttatttttgcacatcattcttaaaaatcttaaaataattttgcattttttttttttttgagacagagtcttgttctgtcgcccaggctggagtgcagctccagctcactgcaacctctgcctccccggtttaagcgattttcctgcctaagcctcccgagtagctgggactacaggcacatgccaccacacccagctaattttttgtatttttagtagagatggggtttcaccatcttagccaggatagtcttggtctcttgacctcgtgatctgctcaccttggcctcccaaagtactgtgattaggcgtgagccaccacgcctggccaaatgtacacttttccttgatcatcctcgggtgtgaggcatgactaccaaatgtcaaggtggctgtgggctggagttttggagagcacaggcagacaaattagttccctgtgggtaactgtggttttaaggcatttaaaatagtaacacaaattatgtcattgaaaagctaggtgtgctgtagaaaataattcaggaaggggtatgtaaatgctgctagggaccagggaacaggaagttgctatcttggtttagatgaaggcagacctccgggagaaggtgaaagtctttctaacctgttcagaatgtagaggaagatggaagccagtcagtctcttccttgcctcttttgtttttcactctggttatgtgtactcctacattcctgctgtctctcttgagtggatgagtgctaggaaagctgtagttttgactgtggattaactcaattggtttagcacgttaaagatattattcaggacttagtactggtttaggcagcagggccaaaatatgtgttgagagtcttagaaatgaattatcaggaggggaggtgcaccttgtattcccaagcctgaatcctta

SEQ ID NO: 63652 - DNA, 1054 bp, Homo sapiens
ttgagaaggcccaccccgttcctctgttgtcacccttgtgtcccaccacataagtaactgcttgtattaattttgtatgaatccttctagtgtttctttatgcaaatagggcagatgtgaatatagtgattagctttttaaaatttaaggacttatttaaaattccaatgaaatgtataatgtaactgtagagtgtaaccctaaaatgtccaatataaataatagaagggggcattaaaactgcatgtttggtcagtgataaaagataatgattacaagtgaaatgaatgattaaacatttcaatcataagattaatcaagatgatggtaattgttctaagtctgcttttatgtgtatcatgttactggtttaggtaacacattgttcttagctgctatctgaatgatttatttaaagtgactatagaattacttctcacattggtaccagacttggcagtgagattttaagttgttcaagtgcttaagtatctctgtgagccaaaggttggaggagccctcagcgattttgggttgtgggggatacctgagcctgactgcacctgccactcatgaggatgatgacagcgtaagattggtcattcttccaggagtcatcactttccagaaattcactctataacatagtttttctttgattagccatcattaagggcaaaggtactttccatggcatttgtaaggcagctaattaaaaggcacttgccggacaatagtaagcaaaagagaagtagaatgagagatcatcgttctttcccagtaagagaggcgtgcaggctgggcgcctcggctcacacctgtaatcccaacacctcttgaggctgaggtgggaggattgcttgaggccaggaattcaaaaccagcctgatgcacatagcaaaaccatctctacaaaagaaaaactaaaaaagttagctgtgcatgttggtgtgcacctgtagtcccagttacttgggaggataaagcagaggattccttgagcccaggaggtctcaaggcggtcacaccactggacgtagagtgataccatgtc

SEQ ID NO: 63653 - DNA, 1050 bp, Homo sapiens
ttgcccaggctgtagtgcagtgatcttggctcactgcagcctctacctcccaggctcaagcaatttctccaccttagcctcccgaatagctgggactataggtgtacacccctgcccagctaatttttgtattttttgtagcgatacggtttcaccatgttgctcaggctggtcttgaactcatgggctcaagcagtctgcctaccttggcctcccaaagtgctcagattatagatgtgagccactttgcccttcagtctttttttttttttttttttttttttttaatgatgaaatggtttggcatttttggcttgtgaagtaaagggatcagttcatttttgtgactgggatttataaaatcattaaataagtgatcatacactagatatttttaaacagattgtaaacttttgtgactatcaacaatttcttattttgtaggagctggtaaaaatagagttagaagagttagtcacccatttttggtcagagtagttagtttgtgctctttggaattgaatgctgaaagacaaggttttcatatttattgcatctgaatccctcattctctgtattgatgatatggtcgtaaagtgtatttggggtggggcacagtggctcacacctgtaatcccagcactttgggaggtgtgagtgggaggattgttcaaggacaggagttcgagaccagcctgggcaacatagggagacttcatctctacagaataaaaatttaaaaaactagctgtgtacacctgttgccccagctacttgggaggctgtggtgggaggattgcttaagtccaggagttagaggctgcagtgagctatgattgtgccactatactccagcttgggtgacagagtgagaccttgtctcttaaaaaaaaattaaaaagtgcatctgtactccttttgggtgctgtgtttataatgggtggtgttccatttacctgagtcactgccatgtctagtgggctcttctgggctccgtcctgagtttgtcacacctcctagggcccagaggagatgatgtggtatttctat

SEQ ID NO: 63654 - DNA, 6738 bp, Homo sapiens
aaatagcttacagtaattgtgccctaattatttagaaattgtgttactaaatgtgttttaaattcatgcatcagatatcacatcctgtcttgttcaggggccttaaggaaattatcaaacacaatgcagtcatcttatttaaaaggtatttacattgtaaatagaccggaagcaagtaacctagcaagatatctgcctagtgtccagcagccttgcaggagttaaaagcaaaatttatcagacatcaatagtttattgaagaaatagtcctttttgcttcataatttgcagaaggctgcaactgtcagtcatgatgtactgcctcttgaaattagtcaatagagcaaacagcaagaattgctgtgggcagaaaataagcactgtaatcatgacataactggggtcagtgatttatggatttcaatatagtagtagctgcatatgattgaaaatttactaggtcactagtgcaccaaaaattttattcacagcctccaggcatcttttgaaatgtgcaacaaaataaaaacctctgaacctgttttgacactgcaaactcagtggatgacatgccagcccagtgagtctcatttaaatgtaaatgtgtcataaacttttgtaccatgctctttaaaaaatgccagctacttgaagggataatgcatgtgaaactgatttacatattaaagtagtgaaaaaggaccttgtaataatcaagcttgaattcttttattttaaagttggaagctgaaggtgttcctgaagtatctgaaaaatatgaaattagctctgttcccacttttctgtttttcaaggtaaggataaaggtggtacaagagattatccatttgtagggtgccatggggctacctattttgtttctttaccctctctctaatccccgaatattaggtgtttggctgtttctggccctccacctttcttctgatagtctcatttttgcaccgatgctgagaaagaagaccatgccagctgcttgccagcatcttagaaaagtagcatggactgtgtagggccagcagccagaatcagagcttcttgatcaaaattcagatatgtggctgtggaaccccagtgttccctgagttggttaaattggttgtttagagcatgtgcctggacataatggaatctctggctggttctggtttgatgaatgacttttaggaagcaggtgcacacctgtgcttccaggcacccatgggtgtcatcgtagttccccaaatacctcatttatacttagtaatagattcattccagccaatgtgggggcagtcttttttgtattatgttagactgacctgatttgactttgagatgttgcagtgttttctcagtgtgtttctgagaaaagaaaaaaattatgtatttctaaaattgagatgcagtgcaggcaattggcaatgagggtttctttttttacatctccggtaatactgttgtcccctttaaaaatctgctataacaatgtcattattatggaatgctgcatgtattctaaataactttttaaactttagaattctcagaaaatcgaccgattagatggtgcacatgccccagagttgaccaaaaaagttcagcgacatgcatctagtggctccttcctacccagcgctaatgaacatcttaaagaagatctcaaccttcgcttgaagaaattgactcatgctgccccctgcatgctgtttatgaaaggaactcctcaagaaccacgctgtggtaagaagctgcctttaacataatataaacaaaatgggtgctttcccagaatggggtatggttgagatgggcatcctgtttccaaggatgctataccatacatcttatacttgtgttcacatacttttagaaaatcaaaaaggttataattcccaatgacactatataagaattagtttgcattatggactcagcatgttggaaccaaaaggggtctcagaactcatctaattcagatttttgttttatactgaagtcctcagactcaaagatagaggtgacttgcccaaggtcacctggtaagcagagttaggattaggttccaactaccatattgctgtctcttttgcctgtttatctacttttgctgttaacagttattttttctttcttggcagcctcctgtttttcacctagttcagattcagcaattaaaaaatttgcggaatttttcagtgtttttgtgtccagcctgtgtgcttttgcctcccctgtgtcatcactgtctaatgattctcttcctgcattgctgtcatttccagtttatagctgctggtaatggaaagattccgaattcttggcttgtagtcactcttattttctgtacacatggatgcttataattttgtccttaagtaagttttagagttatttgacccctctggtagtgggtttatgttattttctttttactgtgcctagtacaacattagtatgctgcataattgagcatttaatgccatttgatgatgctgttgagactctaagagtatttgtatcaactacacaggagggactttattaagataggggcagtaacattgagtatgctcttgatatgattacagcatgtccagagtgactttataaagatagccaagcttctagtgtgaatttgattctaaattcttccctgtagggttattaaattacatattagcttatgataatgtctagttttaaaaataaagtttcatgatgaattcttattttttcgagatggaatttcgctcttgttgcccaggttggagtgcaatggcacgatctcagtgcgacggaacctctgtctactaggggtcaagcgattctcctgtctcagcctcccgagtagctgggattacaggtgtccaccaccatgcccggctaatttttttgtatttttagtagagatagggtttgtccatgttggtcaggctggtgtcaaactcctgacctcaggtgatccgcctgccttggcctcccaaagtgctgctgggattataggcgtgagccaccatgaattctgtcttaaaagtatctcttagttctgcctaaaaaatttccctgccagtatttatgtgtcagataatgcctgctatttgtgtattgcaaagctaacttagtctgtactaaactaaaggtagcaacagatagtctctgttgcgtttgttattttgtttttaacgggggttgcaaatggttcacattcaccttcttccatgaaacatgaaaattatttcttgtactttgtgcggtggccactaaatgggaacttaccacttcagttgaatggattgtattcagcaccttcattcagatctcaggtacagtagaactggctgtgaaatgtgggtgaagcacacctacagtgaaatctctacagtattctctcctttggggttgaacagcagcagtctcagtcttttctgaatgataaacctaatgaaaaggcaggtggcaacactgaagcttggggaaggagtgctcagaggagaaggatgtcctgggaagtgtgctgcactgggtgtcatgccaggcgagcctcaggcccacccctgcggccttagcaactttggggacaagtcaggtaccctccttgtgcctttaattccttctagtgctgttgggaacaagattggctgttggagccaatcttggagggccttttcagtgtagatattgtatgattattcaagtaaattagagagaaacttagacattttaatttttctgcttaccttttactttattaaactgaatttaaaatatactgctagcatttttatatttatattaaacttatttaaattatgtttattataatggagtgagatttggaagactgtacaaataacagaataaaaaagaagctttgaaatatttcagggctgggcgtggtggctcatgcctgtaatcccagcacattgggaggctgaggtgggcggatcgcttgagatcaggagttcgagaccagcctggccaacatggcgaaaccccgtctctactaaaaatacaaaaattagctgggcatggtggagtcctgtaattccagccacttgggaggctgaggcaggagaattgcttgaacctgggaggcagaggttgcagtgagccgagatcgagccactgcactccagtatgggtgacagagtgaaactctgtctcaaaacaaaacaaaacacatttcagagccatctgaaaacgtagtattatagttatttaattaataaaagacaataaatattttgagatacatatggttgaatggttacagtttcttcttttaaagtacttctatataatttttataactacattttcagtgggtttttctgtttcctgatattttctgtttcatgtctttctgtcacatatagtaaatagatcatttaagaatgttgctgttctttaataaaatacttaggattaattggaaaatatttttaaactgttttcttatgggaacataagtcacctcgaccctctgctgttcctttctgagcctggttagtggagcattgtttttgctcttcttctggcattttagagaagggcgtaggcaaagctccctttataaaagcactggccatctcatcttgtgaacacgcacgtggctgctctttccttattttgcaccaaattagctttgaaagtgctatctctgctaacaccactgaactcccactgcggagtattttgatgtttgttttttgattagtttgtccccaccttgctttctgctaatcagaaaaacatgaatgaataacatttaaattttatatctagaaaaccttgaaagccatttttagggtctctcctggagccccactggactcagcctaacccctgcacaggtcatgtctccatcttcttatccttcatgtgggctctacctgcagaattgtatggtgtgttatgagcctgacgtgtagatagggtctcagttgaaaagaattggattgtccttactctgtgctcctcatgaagatgggaaaatgcttgttttaggaagagtttccagaagcactgaggtatatgtcatcttaaacagaatcttaaatccttgagcaggttaattatttgggaattcttataactatttcagttaacaaagcttttagcaaagcaaaaggtatttgaggcatagtcagatattccttctgcagtgagagtcatccagccgggctcttacttttgaatcagccacagaatcaggtttcagagatgttttttagggtttattgttaggtagtgatgagatgcggtgttaggcacctattcatgtcatgagtagaaatgactgggggtggaaatggggattctgtggcagttaaacattacttttctacatttaaatatttttattgcatgcatgcatttttcttaaaaaaaggtgtgtaaatattttgttactagaataaagccttcttgccatcttatccttaagcgtaacatttctagtctgccactttaactcttaaaaatgaaacactaccaatcaatctttctagtctgcatgtaattgcctaaagctaaaataaagcttcttctcagccagttacagtaaaaatgagttaatatattggcaacagaataaccatcagcaatcagccgttagctgtttactaatgaactcccagatgaataaaaaaatttcagaatcagtgttttacttcaggctgtacatgaacttaacacttcagatgtaggaaaagcaacttatatgctatacaaataaatactagtgcttcatctcaataaactgcagatttggaaaatgtttagagctcacttgtagatccatgttttaatagtaaatatgattttgggtgacatcagtaaagcccattcttgcaattaatcttatattgaattttatggtttgattttatttaaaaacaattgctgacactgctaagtcttatagaaattttgaatctgaagaataggttcttttccagtgaattacaactgtgtttgagaagaagaatgaggcgtgaaagagtagggccctacatagtattgggaacaatggagaagaattagcttatggaaagaaaaatactttttttttcagactaggctaataggtttataaaagactgatattcacactcttattcttcagttataatgtcataataagatgatgtcaaaaaagtacagaataaaaatgtgtcacaaaagtataataaaatcatggaacataaaattgtcgctatagtgtagtaaaaaaattacattacatactttagggaatgtaaatagttttaaaaaagaaactgtcaagttatgacatgagatgagaaagaataccgtcaatctattgatggttcatatataacaacagagaagatagctttaaaattcaatgtactgtgtgtattttagactacaggagaacacatgccttcttgatttctaatttatcctacttagagatagtgaagattgagaactactgaagtgggaactcaggaagtagtaaaatggcagtagaaatgcaacagcattgggttttaagtatagtcaagtagtagttaaaaataacaattgtagaattttttcatctgcccagaattgattctcatagattcataacagaaaggctgggagggactgtcagagcatcaggtcagtctcctgattagtaggaaagtgctgagcggaggccacccatggcctcatcatgtgtcaccttggtgggtggagggagcaggtgtcagattcagattt

SEQ ID NO: 63655 - DNA, 1447 bp, Homo sapiens
gcctacctatcctcagctctatgtttctggagagctcataggaggacttgatataattaaggttagaattgagaagtctgtgctttgtaaagaaattccatttagagcatactttttaaaatgttgtgataaatctaagatacaaatttcttatgaatctatatttactaataagaacctgcaatgaatacacagtatttctgattagttgattgatcaataatctgtgttatggtatgatcaaggagatttatgttataataatttttttcataaaactggtatgtgtgcttattttaggagctagaagcatctgaagaactagatacaatttgtcccaaagctcccaaattagaggaaaggtaagtgttttagaaggtttcaaatagcctatcatttaatatattaaaaatattttaaagtcctcaggttttgcattgctctttctgtgtagaaatcaaggatttggtatgccagacgtcataattgtttagtcacattagccattcaaactttggcaaatctaatttgtattggagaaattttagcaccaacttagtgatcatgtggaggatctgctttgcttttatagaaatgtcattgtttctgtggaacaaccaagttttgcttacctctctgcatttcagagccagggtccagttgttttgtcactgctccttggcgtaacctcagcacactcgtgttttactgggtgcagccttggtgactgctgcgggtgctgccccaacgccagagcactgagtgacaagtggtgagtgtgaaaaactcatcacctcgcaacaagctttgagcacttctcatggcctttctagaccacgagaacttacatgaacagattttggaggtgtgaaacatgtatttgttttatcaaggatctcacttggcttttagagacgttctcttacagaaatgttggactttggtgtgtaaggcaacttaatgggatttttattgcagtaaaattaatatagaactttaaaaaggaatttattatatcagcaatcagccattcatagttggggctggagattgtaagataaaccttcctttggtaatttttttttgccatgtaacatcttgagaatttctaaaagtgtttaataataataaatacctcatttgtctgtcgttaattaataatttctataaacagcgtccaatccacgtatgtcaggctgatctttgagtgccgcattctgtcctgtggttggtaccatttcctgtgttcttcatgagaaaatgatactcctcatcccttttttgactctgggcgtcttcatgtgtggttcttgcctgtagcctggtgatgcccttggcccatggaggctgtgtggtctccaaagacagctgtgttttttatatgcttgtatttgctcttcagttgattttccttctctgctgagtgcacttgccgctgttaatggcc

SEQ ID NO: 63656 - DNA, 1973 bp, Homo sapiens
gcaattctcatttttaatgggatggttcttacagctttttgatgtaagtacatattgattatgcgtcattttgaatatcaagtttgatagattacttccaccgatagtttgagcagaactaattttctttcagattgagatcagagtggtaatttccagaaaccagccatacacatttatatcatattttgtaattttcatagcaattgaacctctacttaattctcaatcagttgttgaagtaggcagggttggacagactttggcctgttttagagataaagaaaccaaagttttgaaaggtgaggctgttggaataaagaaactgcctcacttgttagcaagatgcaccgggcaagtgacatggagaaccactttgctcattgggaaagggacacaatacttcacagggcagactctggttgccataactagtgtataagttaacataactagtataatgaagctaattagttaacataactggttaatataattaggtaataatgaaagtaacagtaacaaagaaaatgttaatataaatttcagcatgttggaaacattaggttagggcctaaattctttgattttggttcagtgtattgaaacaatagaggaagttaataattcctagtaatgataaagtgacattttttcttattctcggtaatggtttaagtggatatttattctcaaaactatttttttctggaaacctagaaagtattaatacattttggaaacaatgttattggggctattaaaatgttgacatggtaccatatcttttccacaagattgctggaatttggagtcctgtggcatgaaaaaagcttaagattttcataaactcaaaaaagtgttagtattctgtaatgtaaaaataaatgaggctggatgcggtagctcatgcctgtaatcccagcactttgggaggccaaggcaggtccgaggtcaagagatcgagaccatcctggctaacatggtgaaaccccatctttactaaaaatacaaaaagtttgctgggcgtggtggcgcatgcctatagtcccagctactcgggaggctgaggcaggagaatcgcttgaacctgggaggtggacattgcagtgagccgagatcacactccagcctggggacagagtgagactctgtctcaaaaaataaataaataaataaataaataaataaaataaaaagaaaaatgggagtcagaatccagttggaaatgggaaaataattgtcataatcattgcaaaaaggctaagtgagttaagatcattttgcatgagtgaattaaacaatgaactcaaatctctgtagaaaatctcggtttcacttagaggaactttttgaccacagagaatataaactgttggaacacatgtcatctcaagtggttacaaaccaaaggaaaaggaagtctgtgggtcacgtgtgcctgggttgatgtgtagatgggttcgtacttgaagaggggatgagcagaagctctgggagctgagtgaaagtagtggcagctatgctggacaagtgctgtgctggttgacaagagtattaggtacaaccatgctgcttgggtcatacaaaaattgtaatctttgcaaattttttttcatttaggaagcaaaatgtggattcagcaaacaaattctggaaatactaaatagtactgggtatgtaaatgttgttttcaaatggtgtattaaaaaaattccaacctggccaggcgtagtggctcacgtctataatcctagcactttgggaggctaagacaggaatattgcttgagcccaggtgttcgagaccagcctggacaacatagtgagaccccatcgccacaaaaaataaaaaaattagccaggcatggtcacatacatctatggtcctagctacttgagagactgaggtgggaggatcactggagtcttggaaggtgaggctgtagtgagccgtgattgcaccactgcact

SEQ ID NO: 63657 - DNA, 1015 bp, Homo sapiens
tggcctgtaaagcctgaagtgtttagtgtctgactctttaagaagaagtttgcccacccctggtctaacccaatattgtccggagaaaaatccagataaagtcatatgttggaatgactaattctgtgtagtaccagacagattaagaagtaaaatcatttccattggtctgtagtacattttgttagcagtgaaacggttttcttgattattttaaaaacatcaaatgcatagaggttttacactttgatttaactgtatttccagttaaaatgtcttctcttttttgcagtgttgaatatgaaacattcgatatattggaggatgaagaagtaagttctgtgtttgatgtttcacccttgtcttagctttaatcttaagggcctgataggatggtttcaggattcctgttgtttctttaggttcggcaaggattaaaagcttactcaaattggccaacataccctcagctgtatgtgaaaggggagctggtgggaggattggatattgtgaaggtaaggccagttcttctgctgttctaaagaacggaaaagattttggtatgtttaaaaatgatttcatattgaatggaaacttgagagttgtttttgactcctgtttccagcctgactctcagacatttctagaccagtatcaccgtttctgtgtgcatgactaccctgccattctcactgtccccacgtggcagcctgttcttactttcacacctgagctaaccattgcatctcctttctgtggggtgatcttccctgtcactcagggtccttgttagatcctgcttcagctcccagacaacaaattgttttttcttgccttactcatctgcccttgggtgcatggagtgacagcagtgtgaggcctgtggcccggtgctgcccatccttgccacagaggctgaggatcactgcccctggtcccccgaaagaaaaaatgtaggtcctttttggttttgagatgcttggaaatctgttatctgttagattgtgttttagat

SEQ ID NO: 63658 - DNA, 1576 bp, Homo sapiens
tttacatttttttttgagagagtttcgctcttgttccccactggagtgcaatggtgcaatctcggctcactgcagcctctgcctcccaggttcatgtgattctcctgcctcagcctcctgagtagctgggattacaggcacccgccaccacgccccactaatttttgtatttttagtagagatggggtttcaccatgttggccaggctggtcttgaactgctgaccccaggtgatccgcccaccttggcctcccaaagtgctgggattacaggcatgagtcaccgcgcctggccaaaataaaagtttttaacacgtgcttttgtaaagtgaagcactagcctaccactgaaatgacatcagcactttggaccaatatgttttataaaaacaaagcttgagttccattgatgcagaggctctttttgtcctttggtggcctctgtgtaggttttgtttcctgtggagttccaggtttgatatcatacttcttaaacaagccagtgagacatttttcctggggaatggtctcactcctggaggaaaaaatttttaagactattgctcttgaatagccctgaagcagcagaaacagatctgcatttgtttcttccctccctccctccttccctccctccctccctccctctttctctctctctctctctctatatatatatatatagtcttatttttgtaagacacaaagaatactcaaaccccaaatactcttgagcctgttcttgtctgaatgttttatagcctgtaccttagccattggtaactcttgggaagatacaatcaataaatctcatttaattctaaagctaagctgcgtgggtaacttctttttagttatataacagagtgttatatgattttttatgttcacctgctaagaacatatacgtttgaaatgtgtgatattgttaacgtttttccttgagaagatatatggaatagatcttacgatcccattttgatctgtttcttgcagaatgcagttcttcatgttcagttcaattaaaagatgtttgaaatggtctaatctggctggcctctttggagcaatgagcgtttgttttgttgaatgagggactgaatgatgatttagttactcagctaatctagtgtcctgagaaaattgtgagttgttattgcctctgaagagtaaacggttcactactgctgttccagaatgtttggacttaagacagtttgttgagagagatagaagatttggttaggtttagactttccacctgccggctcgcattaacagcagtgagggtggcgaggactgccttatttggcgcgctcccaatgttccaggcacactgctttggtgctttaagaggctgcttcacgtaatctcccaagcagcctcagagagcagaattcttcttagtcagtagatgaggaaacagagacatagagaggtcaggtgaattgtccaccatcccataactagtaagccattgagtccagattccacctgagggccacctgcccttgcccactcagctgcgtggtcctctccgtgccttcttgagtgtgtgctcagaaaagtcctgctgg

SEQ ID NO: 63659 - DNA, 1051 bp, Homo sapiens
caactcctgacctcaggtgatctgccctcctcggcctcccaacgtgctgggattacaggcatgagccactgcacccagccttatttatttattttttaagagacagatttcaccatgttggtcaggctggtcttgaactcctggcctcaagtgatctgcccacctcggcctcccaaagtgctgggattacatttgtgagccaccacacctggccaagaataccttgttaaattttttaacctgatagtgtattcagggtttatggctcatttagtttgagagtgttaagagactggagttttaatccaataggtgtttcttttggttctcagatatacatacaagctgtgattgtttagatgtttccatctttttatatatgcatatacatattattattgttgttttttatttttaggaactgaaagaaaatggtgaattgctgcctatactgagaggagaaaattaataaatcttaaacttggtgcccaactattgtaagaaatatttaattacattgggagcagttcatgatttagtcctcagaaatggactaggaatagaaaattcctgctttctcagttacatgttttgtgtatttcacaatgtcgtgctaaataaatgtatgttacatttttttcccaccaaaaatagaatgcaataaacatcttcaaattattaacaataattgtatgaaaaaagtgtatctttacagcagtattaaacatacagctactataattaacccaccttaaatctctttttcttagtacatgagtatcttctagcagttaagaaaggcagtcttcagaaaatggagaactgtggcggaatgcagtacacaacagtatttaggacaactcctttgccaacacaatggctcccctcgctggtgaaagatctctttacagcttaggaaaaacaacggaaattagtttctgatgtcattgctgagctcggcactggttacattgcagaggcagtgtaggatgtctgcaggtttagagactcatttcacaaggcaccagtagtgaattatcaagaaacattt

SEQ ID NO: 63660 - DNA, 1030 bp, Homo sapiens
tctggggcttctgaaatgacctggtatttttatgttcctgttagaaatggtgtggctttcacaaattaagtgccaggctgggcacaatggctcgtgcttgtaatcccagcactttgggaggcggaggcaggcgggttgcttgagctccggagcttgagaccagcctgagcaacatggcgaaacctcatatctacaaaaaataaaaaattaactggtcatggtggtgtgcacctgtagtcccagctacttggggagctgagatgggaggattgcttgagcccaggaggtcaaggctgcagtgatcgtgccattgcaccccagcttgggtgacaaaataagagcctgtctcagaaaaaaaaaaaaaaacaaaaaaacctaattgccaggacccgcaaattctgactgaaaaagaccttcttgttctccccacggtcattcatctaaatggttgtcagtggtacagtgttcatcttttctcaaaaagtcaagttttatttgaggaagttacagatttccatatgaactcctagagagagagcctgcccttgttcagggttgcccgggggatgcctgccatgtggtaaggtaagggtttctctgcccctcatctcccagcctgctgtccccaggagcgagttccttaacccctagccgtgtcgttgagcccaagcttgtaacctggatatgggagctgtctatttaggaagaaggcatgtgtggtaatttctaaaagaattaaaatagatttttatgctcttgtattatgttttgtgcttaaaaggaagagccccgatataatggagaaaagccagaaggagcttggatgccctcagagagccctgtcacctgtctgtaggggcagaaaggaggatgcctttcctcacccatcacaaggggcacagccaacacctagaatagattaccaaggaaaagtataaaatgtatgtaaagacttaggtgacacaggagccttcagaaataaaaacccaagagaaactgcatgttcacactcagattcaacgaagagtgg

SEQ ID NO: 63661 - DNA, 1043 bp, Homo sapiens
gtagctggcagtgggtggctggaggcttggtgggggctgtcagtgagcatacctacatgtaagatacacacacacagaagggcaaattcccagaaaactgtgtgacccaggcccaatgacttgagaaataagccattataggggttggtgtcctttgaagatatggccatggactttacctaggaggaatggcagcatctgcacaatgctcaggggaccctgtaaagagatgtgatgctggagacctatagcatcctcgtatcatcgagtgagtgaaacctgccagtaactccaaggagcaacactttattccttcctgataaatacaggaacctgtataaatttactgctatttaggtatcagattccagtccatgaagaatgtgtcatcctctccaacgaaaggctgaaattggctccttcattgcacagctcctgaagccaagctgttgtcattcttcaaaggacctgacttagcattttgacaaagtcttacattatttccaattaaaagggcattgcattaccaaacctgaactgatctttgagttggagcaaggaacacagccacggagggtggaggaagccccaaatcagagcctctcaggtcagtcagcatgtgctagacagggacacctggagcagtaaagcccagcagatgccaatttgttttcaccaatttttacccaggtcctagacctgagaacagttagtctgcatgcaccaaacacaggcactatatagaccccaagaatacctctcatacatataacccagccttttattttgatgaatagtctatttgctcaaaacctaattcctgccttcctattcttagacatcttcctttgctttttattttctcaatattctcagttgtcctcctttcctctatttgcatggacgggtcttttttcagacatgtattcatacatcagtttattctttcaacacatcttaattcagcacgttttaaatattggtaattttatagttataactgtgatcaaaataatgctcctttttcatggagtttctgttct

SEQ ID NO: 63662 - DNA, 1059 bp, Homo sapiens
tttttttttttacaatattttgcagttttcaatgtacaaatcttgtcattctttgattaaatttattcctaagtatttattctttttgatgatattgtaaacagagttgttttcttgcttttatttctgaatttttcattgctaggtgtagaaatgcagttgactttattggccttgcatcctgtgtccttgctgaacctgtttattatctctgataggttttgtgtttgtggattccttaggatttcctgtatacaatataatgccatctgtgaatagagatatgttactcctttttaatctggatgccttttatttattttctttgcttaactgccccagctagaatttccagtagaatgtttactagaagttagcaaatcaaacatccttgtcttgttcctgcttttaggggaaaagccttcagactcatcatgaagtgtgatgttagctgtggttttttaggtactctttgtcaagttgaggaagttgcattttattcttagttggttgagtgtttttatcatgaaaaggtgttggatttgttaaatgctttatctgcatttattgagatgaccatgtggtctttgtcctttaatgttattagtatggtgtattacattgatttgtttttgtatgttaaaccaaccttgcattcctaggatatggtatacttctcatatttcaaaaatattgtttgttcctgtagcagagaaatttttagttctttctgacttctgtattttagaataatttgccacaaacttttttttagtgcttaagtgactagaaagtagtatgcagaattttctattttgtcacattttatccagtctagtcataatgatgcaagattttttttgctccttagttcagctaaattcagcttcttgtcttgcaaccaggaaaaattaggcatgcggatacattgaagggtgaggaggcagaatttattaagcaaaaggaaagctctcagcaaagatagggattctccaagcaggtttccccctcacaaattgaatacgaggccaccacgcagaggttgaagaagccaggccc

SEQ ID NO: 63663 - DNA, 1021 bp, Homo sapiens
ggggtgtgagacaacagagagcccccatggagagggcctgggagaagctgctgtcagggattgcaagtttcagactaagaggatgaatggagccttcagagagggcgggtgcgcgggtcggacgggtgcgcgggttggagtacaggaggcccagagcttggcggcggtgagagtccgagtgaagacggatagctgcttgggcctgaagtcagcgggatgatgtttgctgcagaatggaatacctgcagagggcacaggtcccagatatgcagtactgactgtcgcccagcaaagacccccagtaaatacccagccccactaggagcacgttgccaggacgccaggccctccctccctccggggcagctcctaccccagctggcatcgcacatcggacaccccgttcttgaatgtggtataagtggaattgcaccctaagtcctctgcagtgtttggctttctgtaactaacctggggtgttacgcgatggtcatttgttttcattgctgtgtgatgttctgttgtatgaatatgccacagtttatgcatcttttctactcttgacggacatttgagttgattcttttgtgaacgtgctgtgaacattctcgtaagtggttcagtgatgcacatatgtagttctgggggctgtgtgtctggagtggagtttctgggtcacgggatatgcatgtttcaccttagtggatattgtccgatggttttcagagttgctgtacccatgtttgctccaggagctgtctacgagagctgccgtggatacctggaaaagtcagtctcatttcagctggtgtgtgagtgtgacattgcagggtggcttgtactgacccttccctgacagctagggagggtggacaccagttcatctgcctactagcctagggtccgatttgctagtgcctccggtagggcgctagttttccttataaccacctcctgggctgctaggccacctcagttcctggtggccaggtggagaccatcaggaaggggcagtggcctc

SEQ ID NO: 63664 - DNA, 1033 bp, Homo sapiens
ggagtttgactatttgaaaagtctagaaattgaggaaaaaattaataaaattaggtggttaccacaacagaatgctgctcattttctactgtctacaaatggtaagaattgtgttctaagtggctgtttgatttagttttttatttttaattttctgtgtgtgtgtagattcctttttattttagaagttattcctgctttaaattttggggggagggtaagttatctagggtagcaagtgataggttgaaaattcaaagtatgcaacaaaaaccacacgtgcactttattatgctgttactctgcacgtctgcacatctttctttattgtacaaaacacctccaattggaaatattcatgttcagagaccccatagcttataacccaatataggaccacaccgctttctaataccagtactcaaacagtagtgatgcatgttatagtttttcttttcatatggagaatgaggtttttattttcagataaaactataaaattatggaaaataagtgaacgggataaaagagcagaaggttataacctgaaagacgaagatggaagacttcgagacccatttaggatcacggcgctacgggtacacgttgcctttgctttatccaatgctgttgagaagttaagaataaacgtttcagtctgctgtctggagagtgctgcgcggtggagtactgtgaggtctgctgtgaggtctgcctcgtgattcctgaaagtcgtttgcactcatgtgtgtgtttaaaagcaaggtctttctcctgttttcacaaaggcagaaagtcacatgtggtccttaggaaacacagcaatactaaggggaaaactcatatttaattctacagcagaaatctttgtggacatagcaaccacccttctctcagaaggttcagaacagcacctgggaggttggagttcagatgaaattcagaacacctcacaggtgcagtagcacaggttgcaggtcgaaagatgagctgtgggccacaggtacattcaggacgcttctcggggaatttc

SEQ ID NO: 63665 - DNA, 2200 bp, Homo sapiens
aagggggtgccgttactagattggaaaaccgttggttgtttgggtggttgggtggtttggttgcggggggtgggtggttgagttgggtggtttggttggtttttaatgagatttcagccccttttacactattgtttatcaagtgaagactgagtgagtgagcccattccacattagtcttggagagtgctacagaggacgctgtaccgcagaagcctttccctaacacatgtgcctctgggagtgatgttgggtctgttctgatgccatttctccagctttgccgtgtggggtggctacacctggggttgtgcattcctcaggaggagtgtcctcagacttctcacatcgatgttgtcaccgtatttcctatgagttcatcaaagcgagaaaggctgtggcatttgctgaaaatctagtttatagggtcctaatttgaaccaagatgttttgatccaaaatgttggtgatgtctgatacacagtgctgccgcctttgcacccctgaattagtgtaaatcacttttagtgacagtaacacgagttgtgcagttccatcatcatgaaactgctgatcctaaagtagaagtgtgatgggacccccgagggtgggcacttgaccccctccagccttgtccatctcttctgcagccaacaccacctcccacccagttacctgtgcacaccccaccctcagaaacccctgttcctcctgatcagaccctgccacaacccatcagctcacgtgctcattttgggagaacagtaggcctttactaggcccagtcttggttttattcaaggctgcttttgtaggtttagcctaaataaaacgggtataattggtggccctactgaaggtgtgtgagaagtctagttatttcattagttggtgcatggggaagagaccacagacaggtaattctgtacattgacttaggtcggtatttgagatcttacctctctaacagttcagagtgggctatttatgtatctgagcctaactgggtaagagtcagacatgttgctgtttttaaatttttgctcttaaattattttagtgccagaaaagggatataattaaaagaagaaatcttggccaggtatggtggctcatacctgtaatcccagcactttgggagaccgagatgggaggatcacttgagcccaggagttcaaagaccagcctgggcaacatagccagaccccatctctaaaaatgaaagcaaattattttatatgcaaattaaaatgttttcaataaaagaaggaatctttgtaagtattgcagctatcatatgttttgattaatgggaaatttgttagaggattggggtaggtgtgtgtttttaagcctgaacttggtagaactgactcttcttgctctagagaatccaagggtgtggtcagcactacctgggttaaaatgagggaagcctccctacacacacttttccaagttggttttttacagaattcagccagacaagactcagttgagagcttttctttttcccctaagctttcaaggctctcccttttggtttctaattacaagaataacaaaaaatactatcattaattttttgttttgattttaaagcttatgtttttcttccagctggatgttagtgagacacaggcctttttccttttttcatgtgtgatgctattcctcacgcctgagctctcacctctgaccataggcggcctgcagccagcgcccactcctctctgtcctttctatttctgtgcgaattgggcttccctaggaagcctccctgaccacagcactcaacacagagatgggggcgggaggtaccttctactttttgttttaacctcaagtgaagtgtaatatataatacatacctccagataagacatctgccctataagtgaccagctccatgaatgtttgtagggtgcacatgcccatgtagccagccccagaccaagaaatggaatatcctcagctccccagcaccctgctgtgcaccctgccagtacctggagccagtggaggtttgtggggtttgcaccgagaagcatagtcctagtgcagtgagaagaggtgtgtgcatctagctgcaaggagaggacaaagggaggggtgcagctgagccacccaggaggactttgctgtccagcgcctcagtgtggccactggaggacacacaggagagggagccgcaggcctc

SEQ ID NO: 63666 - DNA, 1011 bp, Homo sapiens
gacctgagaattaatttatggcacttagaaatcacagatagaagctttagtatccttcctcagagggacactggcgtcttcccgagggtgctctttagatagtaatttctctcgtccctttatacacctgtatctcggagtctagtcttgtaaataccatcactgcacagcagcctgtgatgtaagttctctgtgatttgaaatgtttgtccctaaaaatacaaatttctttctacctttgggaaaaagttatctgtataatgggaattacctgaagtccactgcctgcctggtttaatcagaggcagttttaaataggctacatttgaaaaaccaacattatgtgttctttttttttttctaaatttgctaatgaataatagaaaatactggcttaggttagagcagtgtttaatcacccatctgagcagcagcttccagttagaacctgtgttcttctgtggctgtgcacagtctgggtggccccagccctcctcacatgggcccctttccagccagcagccgggagcatggggcttgcttcgtctgcagcctctccagggtccctgccgtcctccctctgctgtccagtggcttgagctggggttccatgtcgtatgttggttttcttagttgtttcagcttgaagggtgaaactgggactgctagtctgaattggcccacagctgaattctgccctttcttatttttttcagttgaaggatttctgtataggatttctgttggatctgttctagctacacagaataagctcttcatgtcaggaagagcagcatcttttggaatttggcggcattcttgtgttgtagttttgtgtgggagtgtgggattttgcacagatggtactagcttggttttcctatttatatgattaagtatgtactatcttgctattaagggctttctgtataacattaataatagcagcaagatgaaagcggtgttcgcttgtctgtgtctccccctgggccggggcgttgctgtagtctg

SEQ ID NO: 63667 - DNA, 1599 bp, Homo sapiens
gaaagatcagaagacctagtgttgaggccaagcccttccagagtctctctgaaggggccacttcctacttgaacttgaaaatgatttgttctctgatttttaaacagaagctgaaaacattttattttgtttttcagtttttgaagagcctgaagatcccagcagtaggtccttcttctcagaaataatttcatccatatccgatgtaaaattcagtcatagtgggcggtacatgatgaccagagactacctgtcggtgaaggtgtgggacctcaacatggagagcaggccggtggagacccaccaggtccacgagtacctgcgcagcaagctctgctctctctatgagaacgactgcatctttgacaagtttgagtgttgctggaacggttcggataggtaaggcctgcgtggagatgagctgtcgccccaagcttgctggtttccgagagtgcaaggtcagtgagggaggcgagctgtcctccagcgtcagaggaggacgctcatagggtgttgttttccagaccttttgattgatggatgatagtatcaaggtagagaaaataggatctctgagcaagtttctcacctagcttgtcattccatttatatttagacaagaagtatagcactaggtacaggccggctatgtgttaaatgcttagtgaatgatagtgtattactttttattatgctgataatgagtgaaaaggaaggaagtggggaagtgattcacctcactggaatgaccgcgttgcagtctgcctttccttctggagagaagtagatgaaaacaccccagagccactgcctgtcatgcccagacacagcgtggtcatggctggtctgaaacaccaatgtaatttgtaatgtgatggttctagtaccttgataatttattttgtatacattctttaaagatagctatgattagtgtggttgagagttacgttttttttattatgcaaaaagttacgtttcagatgatggaagattgtcttgcaccatttttatatagaatttttgttcagaattcaagagaacagaggagtctattggcaataagtgattgactggatattctgcaaaaccctctggcataaacacctagaaatgctggatatgatacagcaggtgtctcttcaggtgcatagttgagctcacagataagcaagggaaatctcacaacggccagaaactaagagggagctgaaaccagaatggcagcctctgaaggcgtctattccgagagcagccttgcagccccggctggcctcaggagcatcagcccatagcaggaaccactgcccctgtgaacagcaggttatggtgcaaagctgaagccttgtcccacacgaggtgacttgctcatggtggcttttcctgtatgtgcttggtaattttcaagagctgaagccttggcccacacgaggtgtagagttggaacagggacccctgaagatggtgtctccctccactggcagatagggtccaaagggcagtttgtctgtctgaggccttgcatgggggtggccagcactgccctgagaagtggaagcaaaacctcccctcacaagggtttgcagtttgggtttgtgc

SEQ ID NO: 63668 - DNA, 1354 bp, Homo sapiens
ctgtctgctcttgttttgaacagcgccatcatgaccgggtcctataacaacttcttcaggatgtttgatagagacacgcggagggatgtgaccctggaggcctcgagagagagcagcaaaccgcgcgccagcctcaaaccccggaaggtgtgtacggggggtaagcggaggaaagacgagatcagtgtggacagtctggacttcaacaagaagatcctgcacacagcctggcaccccgtggacaatgtcattgccgtggctgccaccaataacttgtacatattccaggacaaaatcaactagagacgcgaacgtgaggaccaagtcttgtcttgcatagttaagccggacatttttctgtcagagaaaaggcatcattgtccgctccattaagaacagtgacgcacctgctacttcccttcacagacacaggagaaagccgcctccgctggaggcccggtgtggttccgcctcggcgaggcgcgagacaggcgctgctgctcacgtggagacgctctcgaagcagagttgacggacactgctcccaaaaggtcattactcagaataaatgtatttatttcagtccgagccttcctttccaatttatagaccaaaaaattaacatccaagagaaaagttattgtcagataccgctctttctccaactttccctctttctctgccatcacacttgggccttcactgcagcgtggtgtggccaccgtccgtgtcctctcggccttcctccgagtccaggtggactctgtggatgtgtggatgtggcccgagcaggctcaggcggccccactcacccacagcatccgccgccaccccttcgggtgtgagcgctcaataaaaacaacacactataaagtgtttttaaatccaaacagaagtattgtctttttatttaattttattgcatagaatgaagttatgcagggttcttctttggaactaactgtttgagaaatgtgtgtccttctttggcagcgtgggggtatgtgtgcagcatttctgtccccaagctgctgcccgctgtgtttctgtagaagtagcccatcagatacaccaggtaaggtctgggaaaagccagaaccgaggccacctctgagaaagaaaattgcaaggaagaaccaaaattgctgccatccagtaagcctggtttaaagtagcttcaaattcactacagttgaagaaatacgtgcttgctttctaaggcttttgaaaaagcactttggggaaagtatactttttaaacattgctaaaattacatgcatgctaaatttcatcctgcatttcaagccagcaaaattaagcaattttaattacacgatgccaccagtacgttgg

SEQ ID NO: 63669 - DNA, 1610 bp, Homo sapiens
acgatctgatgttttctaagttaattaatacaaaatacatattgataaaacactagataaaagatcacagatagattcattacaaaatttttataatgggtataaaatcaccagtccccttgcataagctctaaccacagtgagctaccctgtttcagctgtaacacagtctcctgtgaatcacaagatacattaactactgataatttttctgtgaaggatctatattggaaggcgtctgacaacctccaccagcaccttttgatgaagaactggagtctgacttggttcgttagtggattacttctgagcttgcaacatagctcactgaagagctgttagatcctggggtggccacgtcacttgtgtttatttgttctgtaaatgctgcgttcctaatttagtaaaataaaagaatagacactaaaatcatgttgatctataattacacctatgggatcaataagcatgtcagactgattaatgtctactgtgaaaatttggtagtaaattttcatttgatattagatataaatatctgaatataaataattttaatatactagtcatgatgtgtgttgtattttaaaaattatctgcaaccttaattcagctgaagtactttatatttcaaaagaatgaataacattgataataaaatcgctactttaaggggtttgtccaaaataaatattgtggccttatatatcacactattgtagaaagtattatttaatttaaatggatgcaggttgtctactaaagaaagattatatataactatgctaattgttcataatcaacagaaaccaagatagagctacaaactcagctgtacagttcgtacactaaactcttcttgcttttgcattataaggaattaagtctccgattattaggtgatcaccctggatgatcagttttctgctgaaggcacctactcagtatcttttcctctttatcactctgcattggtgaatttaatcctctcctttgtgttcaacttttgtgtgcttttaaaatcagctttattctaagcaaatctgtgtctactttaaaaaactggaaatggaaaaaaaaataaatctttgccaaatccttcagattactgtatttacatatggtttaaaatcagacgtcatgatagcttcttaatgaaaccaggactggtccctattttgacattatctttcctacagcaaactttttagaaaggctgcctgccgccttgatgtttcacctttccacgcttaattcgggtgttaaatctaacgttttcatttgtaaaaatctttgttgatgctaccttggaagcagtcatctctcagtcttacatttggagaatgtggatggcatgacatcagaattcctttatataatttaacttcagaatagtctgagatcatcgaagcacgatggtcaagggaattccgtttttgttttagagcaaatatgtttgctgtttgtctttcatcacaaacatcagtggagtttcagcaccttacagagctcagtgaaccccctggtcaccatcaaagttagcacacaacaaagccaaccacgtgtccccctcacagatgacaatggctgaactctgagtgaaaccacct

SEQ ID NO: 63670 - DNA, 1057 bp, Homo sapiens
taaatcattcctgggaatacagcttttgggcccaaagtcattagccatggacaatctggagtgagttttttttccttgtttcctggatttttaggtcctttctggggtgatgtttaaaaagcactgctttggttcgaatgtgttcctccatgttgccagtgggatggtagtaaaaggtgggcctttaagaggtggctcggccataggggctcctctctagtgaatgggattagtgctctaaggggctggatggagggaggtgggtccctctgtagcctcattgaagggatgaggcaggaaggccctcagccgacaccagatgttggtgcgtggatcttggacttcccagcctccagaacagagatcagtttctgttcgtaaatcactaagtctgtgggattctgttgcagtagcgcagaggatgacagagatacacttgtctctccttcatcttcctctccctgttgtcttcagcctgccccttgtgtgatagattacagtatgtgtttggtcttgaccctacctacttcctggtgcagagcacctaaacccctggggcttcctgagcagtgtcttttttttttgtttgagacacagagtttcgctattgttgcccaggctggggggcagtggcatgatctcggctcactgcaacctccccctctcaggttcaagggattcttctgcctcagcttcccgagtagctgggattacaggcgcccaccacgcccagctaattttgtatttttagtagagacggggtttcaccatgttggtcaggctggtctctgactcctgacctcagatgatctgcccgcctcggcctcccaaagtgctgggattacaggcatgaaccgctgtgccaataagtgtcttaagcatgtttattaaagaaagtaaaacagtaaaaagatggtgactccataggcagaacaacctgaccagtgtgtgcgttattcataaagtcaccctattagcagtgtactccaaaagtgctccttggttaaccatttttggtgtaagttgtaaggagccccttcagaatacactgctaata

SEQ ID NO: 63671 - DNA, 1021 bp, Homo sapiens
gagcctcggctgcgcccggggagaacccggggccgggcggcctgtccctcggagcgctagcggctcctttctcccacggcggtcgggtggcgaggcgggcggacgcggccctttgttggcccgggctggtccggggcgcggggagatgccgttcccggcgcagcccgtgggtcgcccgccccttggacgcactggcgctgcgtcgggagctctttgtccgagacaaagcgatttagccccggccgctctggccggagtccctggtggccccgaacccttccagtaacctgggttcagcgactccaaggaaagcgagcggtcaagggccactggccgggaaccctggcagcccctgaaccttcgagagcagagacccctccccaacacccacacgcaccggcgcgggaggtcccgctctgccagaaacaaagcctccccgctcgggcggggggagatgggggtgggaggaaggaggcttcgggacccggcaggacctgggcgggggagtccatggggtcccagacccgactctggacttggcctcggcgggagggccgtggggtctgacctctggcattagctcgagccgtgggctgtgggctccactcccccagactctgagcgaggaaggagccctcccctctccagatgggaggggctgctgcctccagagggttctgcccggctgggtctggtcttgatgcaggaggtcttgccagtcagctggcatgtgggggtcgagtttgggggtggcaggaggaccccttcccaggggaggtcaggcaaccatgtcagtgcggaggggcagctgcttcccgggaactttcacctccatccggatgagtgcagtaagaagagcacagccccacaccccagctgcgtctcctctgggttccaaacccagtctcagtgcgggtgcctgaacacttgggcgcctatgagcagagagcccagaccacacgtctcctcaagcctccttctgcccggttgcgttttctagggcttccttgaaaatgcgtgg

SEQ ID NO: 63672 - DNA, 1099 bp, Homo sapiens
cttcccggccatctggtaggattcttagaagtggatttatgactgccaagcactggagtcaatccctgtctaacgccacagctctgtgctgccagggctgacctacaaagagcgggcctcaccagcctgacgctctgtgtcccactgggagtgcgtccgagctgcactggaaccgaggtcaccccatctcttccccatcacccccatggcctcttggtcagcaagtcctgccctcctgactcccagcctctctggaatccactctcctcccgtcccttcccatagtcctgtcccagagcccctcatctcactcagaaatcaccccagcaatgatccggctcccactgttacctgtcacaagctactttctaacacagcagccaaaggtgatctctttaaaacatcaaaccaggattgaaacctgcttaaggcccccagtcagggggcagccatggagtccccaggcctacatatcctgcccctgccaagctctgggcaccgacttgcctctggcaccaccaccccaccagaaggttccatccctcggcctcctcccaggtctgctgatggcagctcaagccctttcctgccccaaggccaggctgcttcctggctggaacgctcgccatgtctgccttgcccctgtatcagccaccctggccccagaggtccttctcccagcccctctctcatggccctgccatggcgccctcactgtgctctgcgcattcgtcaccgactgtgatgatctgtgcacgtgtgtttttgctgccgttggtctcccctcagtgggaggcagcctcctggggtggggaccatgcctgtgggggcgctgtctgcctccgcctcctggcaccatcactggtctgtagtgtttgggtggaaccaaagtccagctccgtccgctcccagcctcctctgcgtgggtggaagacagggtggaggagagcaggatctctgaggctgcacaggaggccatgaggcagcgttcgcctcccacctcaggctggggctcctcaatccagtggtaaatcagaagatataaatatgacctgtggcactaccacactttcaccaacacgggctttgccctcagcga

SEQ ID NO: 63673 - DNA, 1412 bp, Homo sapiens
gtgcagggggcaggatggcccctttcaagtcttgtggggcactcgggaaaccagcccagctcccactgttctaggaaggcacccagaggtggggcccagcaccttggacagcgcactggcccagcctggccctcggggtgcctcacccagcctgacaggagctggaggcagggcaaagccccgacctcctgtgctcctccaagtgcgatgtgggagtagggatggtttggggtggggcttttcctttctcccctctcccttctgtgctcagagggtggctggggcacttgggacagaaggttcctctttgaacaaagcaatagaacgggttcgtggcagcgtcatcctctctcaggggccggtggcctctgctgtgtctccctcaaatggtcctctggtctcttgggaacatgaaacagaatctcccatggaggaggcagaggtgggaaccagggaccagtgggggaagctgctgaccatgctgccttcacagtggaccacgtcttccccgacacgggtgtgagcctgctggcggcctacgagcagtggcgggagcgggcggacagcgcggcctgctgcgactactccctgcacgtggacatcacccgatggcatgagagcatcaaggaggagctggaggccctggtcaaggagaagggtgagggtggctggaggggctggagggcgggcatggagcctggtggaggagcctctgccctgaccctgtgttctgccgatggtgctgctctgccctgggggctggtgtccaggtttgagtggaagttggagaaaagtcatttgaaggcccatcccaccttcaaaggctctagaccaagaggccttctctttcccaatccgagggacccatcctggaattgtcctcctgatgaaaagatgcagcagatccgtcgtttcttagaagagaggctgcccagggtggaagagcagcagttccccagtctcctagcatctggggatcctttcagagggagacccttttaaatccatatctctttgttgtcaccaatgctaaaacagatcagtctataaacaagttaacatttttccccacaaaaaaccctgaagctaaaactacatcagagtttcatagtgggtttgacaagtggcatatctgattatagccgatctctcctaatctgagtccggcccacagcttccagcctggaggtgggggcgggatggggtccaagcaagcccaggagcctgtcaaggccctggcactcccagggatgcctgctacccgtcccctacagacctgaaggaggcaggggcatttcttcaaggccattcctctgggttcccattcctcagagggtgacggtcatcacataggtgccccttgatgtcaggacccctcacctccctgcccgggggctggtggagcccgtcaa

SEQ ID NO: 63674 - DNA, 2053 bp, Homo sapiens
gatgagcaagggggcggccgacgccatcgctcaggccaagcgcagaggtgagcacccagccccgcctctgatgccgaggggccatggtctcggcctcctgggtgcagccctggggagatgcaggttccctgagtccctgcatcggggcggggcactggaccctgagtccctgcatcggggtggggcactggaccctgagtccctgcatcggggcaggggctggacctgagtttccagccttgctggagcagcagctgctcaccaggggccctgaggcaaaacatggggacgctcatcccatttccagtgggggtgggtgtggggagaatggaatgatgaggagggtctccaagagagaattccagttccaacaaggaggccctccctacattgctatttgctgtgtccagagccggggtgctacctgcccacagaatgccagccagctggagcctggcactgcagagagcctcaggcctgggcgggggggtgccacccagagctgtgattggcagcggcttgactgtggtgtcccccagaggctactgggctcagagggtccatggagccccagcaatcactggggctggagagggccaaggatccaggcacagaacccaggtgacgggtaaatgagggggcatcccctaggcggcctctggatctggtctggtttcccctcctcctgctgtccgcactgagtcctgagagacctcgttttctgggcctgcctggggctgtgcaggtccctgggcagggtggggggcggggtggtggtggtggtgggtggtgcccttctatgtgtttcctgcatcgagggttgaaactgaaacccactcagttaactgggaaaaggactctgaggcgtgcaggtgaatgggggtctgcaggggtgaggcccgggcctcactcaggacaccaagcagcctcggggcagcaggccaggcccttctcaggggtaccccacccgccaggctcttctcggggggtgccccaccccacctgggagcatttctcccccacccactggtgggagctgcctcagctgtgagctggaaccctggtgaggccatggccagggcacccccggccagtcagccgccatgcagttcactgtgcctcgcagcccacaggcacgccctggccccgctggagtgcccggggtcctggggtggggtgtgggcagagagaggacttggcgtccgcaggccagactccctttcccagaaggacccccagggccaaccacgtctgcccgcgacccaggcctctgccccacttcctgcccagggccagggactctagactgggcacaagctgtcccaggcaaggaaagtgaggggcagtcgtgggtgtcagcagcagcagttctcggggccccagggggtgcaggtggtcggtggggcacctctcatgggcctcgtgctgcaggggtggtcgtgtttggggagcccatcaccgccagcctgggcaccgacggttcacactactggagcaagaactgggccaaggccgcagccttcgtcacatcaccccctgtcaacccagaccccaccacggcggaccacctcacctgcttgctgtccaggtaagcagcctctccaggtggccccaggttggccgcccgctgcacaccctgccaaggctgtggccccgacaccccaggcctctcccacggctcccatagggcagcccggacagtggcgggtggggaagtctgagccctttggtcccagcgggggctcccctggcaggaaccagtccccgctcccctgcacagaggcaccagctctgcccagcgagagccactcagatgacctctagcccctgcggctgtgctggccaagggggctggagctgacctggcctctgccggctcaggaaggccaggaccctctgaccctggcttgtttccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaa

SEQ ID NO: 63675 - DNA, 1064 bp, Homo sapiens
gcctccgggctgagcagggacaaagactcctgtcccatccatggccccagctccccgtgagcggtaagagggcgcccagcagcgcttcctccatctaggcgggtctcgggggcccacgggaaatgccctccacaggtgtcccctgcacccacagcctcttgtcccctgcaccaccacgagcctgaggtgtgaaatgtgtccggggcactgtgggcaccgccagccaggctgggtgggaacgtgaatgccaggcctcggcccatggccctccctctggcagccgagtctccaaagcagctcaaggggtgaggaccacgggcgtcccggcctagccgctcccggccgaggggcaaatggggccgcacatgggcagggcggagcgttccgcctcgtcctccacaggctccgcagcatccctggactcaggggcggggagaggctccctcgggaggtcctggctcctcttcagcctggggtggcaggaacacatggagggcgttatgcccccacctccctggcctcacggtcccatgacctgcccacgggctcatggggtaggccatggcgtggatgcccaaacgtgggccacaggctcggtgtctgctggagaggccatgctcccgatacactggcagggagcctggggacgggtgggggcacgtgagcatgctggcgaggctcggcgtgtttccagccagaagccgaaaggcctgactgtgcaggtgccataggtcagtgacttgggaatgaggctcggctaagcctcattcttcacccggtcatctgatccccagggtgccagtcagtgccctcagccgtctgcacgtgctgccctgcacgtcctgtccataagagctcagacccacctcctccaggaggccctccttgccccgtgcgggcagagggagcatccatcctcccttgggccccaccgtggcagctgctgctatttctggcctgccttgcctgctgccagtcatctgtgccctttctgtcccctggggcctgacattcaggaaaggtctgctgagagactgagggcgtgcctgggtgggggagttgac

SEQ ID NO: 63676 - DNA, 1016 bp, Homo sapiens
cggggcggcgtcacgcgcggggctgacccggcggcggcggcggcggcggcggcggcggcggggcgggggcggcctgggacgcggcgggagcatggagccgcgcgccggctgccggctgccggtgcgggtggagcaggtcgtcaacggcgcgctggtggtcacggtgagctgcggcgagcggagcttcgcggggatcctgctggactgcacgaaaaagtgagcgggggcgcgggccgggacacccccggggtccccacgcgacacccgcctccgccgcccggagacccgggacccgcctccgggttgggggtggcgtggccccggcgcccgctttcggtttctgccgagcctgagtttcggggcgcgcgagcgcggccgccactcgggggggcaaaagtggttctcaaagtcgtcgcgacttttcggggcgggcgccgggccggggcgggccggggcggggggcgcggggccggggtcccggaactccacacatctgccataattaatgcacttttctttgttcagagccactgttgaattcgactgttggcagaattgtcgttaaagcaggggagggtcagatgcgccgtggccttgccctggcagttcctcacaggtgggggtgccctgtcgaaggccacgggcccctggctgctgggagtgactccgcggctgaggtttggattcggggagagcagttgcgcccagctgtgcgatttaagaacagtttcaggccagggagccctgagtcatgggggcgtgaagaggtacaagctgtgggagccgtgggcacatcccccgggagccctggcttcctgggtggggggcgcagggcagggcggggcggttcctcctgagaggcacctgtgcacgggctgcagggacccatgcggtgcagatgagcctcctggacaccgcgtcacatggcagggagctgtcgctgccagatcaatgattaggcatgaatcaggctgtggcctcgctgcgctcctgcagggctttcttttgaaactggg

SEQ ID NO: 63677 - DNA, 1045 bp, Homo sapiens
ttggcctacccccgttggctccgctgccccaggtcgatgagtcccctgtcaacgacagccatggccgggctcccgaggagggggatgcagaggtgatgcagctggggtccagctccccccctcctgcccgcggggttcagccccccgagaccacccgccccgagccacccccgcccctcgtgccgccgctgcccgccggaagcctgcccccgtaccctccctacttcgaaggcgcccccttccctcacccgctgtggctccgggacacgtacaagctgtgggtgccccagccgccgcccaggaccatcaagcgcacgcggcggcgtctgtcccgcaaccgcgacccggggcgcctcatcctcagcaccatccgcctgcggccgcgccaggtgctctgtgagaagtgcaagagcacgctgagccccccggaggccagccccggacccccagccgcgcccagggcccgcaggaggctgggcagcggcccggacagggagctccgcaagccggaggagccggagaacggcgagcccacggctgcggccaccgccaggaggagcaagagggagaggcgcgaggaggacagggccccggcagagcaggtcccgcggagcccggtcatcaagatctcctacagcacgccccagggcaagggagaggtggtcaagatcccctcccgcgtgcacggctctctggagcccttccgtccccagcaggccccgcaggacgacggcagccaggaccccgaggtgctggacagagagtcccgggaccggccgtcctgcgcgccctcggcctccatccccaagttgaaactgacacggcctgtgccggccggcgcggacctgccgccccctaagatccgcctgaagccccaccgtctgggggacagcgagcacgagcccgtgtaccgggccgagctggtgggggagctgaacgggtacctgcgggacagctcgccggcgccctgtgcggacggccctgccggtgggctggcggacttgtcttctggaagttcgggtgaggacgatgacttcaagagctg

SEQ ID NO: 63678 - DNA, 1075 bp, Homo sapiens
agccgtctggaaaatggttgccctcactggtgatgccatctgcgcttctgattcacacaagaggcgcactgcaaggaggccagccaccgctggtgcttgttggaagcacacagcgagtttgtgtttggcagccatttttcaaaggccggaagggagcttctcatgctctcagtcgttgtttggagtcagggatgtggtttgacggatcctggggaggggagagcccaggctgaggccctgtcttgcgttactcactcagggaacaaactctcactgctctttccaaagatcagagcgggcatctccctcctcctgcacgcggataggccatcccaggacattaaaggagggagggcgaggtgagcttcccaccctcagatgaagcccccaccccaactccccagactggcccagccctgccccctgtgaccccccaaatcttcctcctgggtcagtgcgcactccgtcgtcagcaggctgtgtgcgtggccaggcgcccgggacctgggacatggtgtgggggcctgttcccggggacggcgtctcactgtcggcctctactacgagcactttctagaatctccagccaggccttgtgtggattctctgtgcctggggggcactacgctgtgtggaggtgtgggggtgtcaccttgtggggctgggggcaccacccatgcccctgtaatcaccacgtggggcatccggagcctgccgaggggctgttttctgccctgagctcctgaaggccactctcccagctccagaggccttctcagcacctcctagatgcccctcttgtcttcccagcaggagaaggcaggccagggagcagtcctttctgggtgggggcagctggtggccctctgtgctcttcttcctggctccatggcctaaccaccccatggatgcagagattccagggccaggggctgtacgcagagggcaggggcagggctccgcctaggccttggtgacgtctggtgaccttgtcttccctggccacctgcccagaggccttagagtttcccaggtgaccgtcctcgggcctttgttgggggcggggactggagcg

SEQ ID NO: 63679 - DNA, 1022 bp, Homo sapiens
agcagcagaggcaggtggagatgacaggtgactggatgtgtgcactgtgcgggagcaggaaggagggtggcggagagtgggtggcactggccagccgtgtggggaggacctgaggggctcgggaccttgcccgtcctgcacctcagcaccactgcaggggaggggggcgtgcccagaggggcggcgggctgcctggtgttttgggagccatgagggccaatggggacacctggtcctgggagccgtgagggccaacggggcacctggtcctgggagctgtgagggccgacggggcacttggtcctgcacaggcacctcctgtgcttccctgtcgtggccagggcaggccgtgctccaccgacgtgcggactggaagctgggcacctccctgaagtggggactcaatgctctcctggtgtcccggcctcttgggcaagggggagatttcacagcttccagacagtgcaggctggaggggtccagcctcctgtggccccaggggcccaaccctttcccctcctgccctggcaggggacttttgggggcgtacccagcacagcctccgtcagcagttgggagcacggggtttctgcgccactggacggtcagtgttcctggggtcgtccttgtcttctgtgagtttcctgtagctgctgtaacaaacctccacacactggggctctgagaccacaggcgtttattcccacgcctctgggggtcaggagcttgagtcaaggcgagcagggctgtgcgccttcagctccagacaagaatccctcttgcctccacagacctgggggtccaggcttccccctctcatgaccacgtcgccccaggctctgcctccatgggctcaaggccgctgcctcttcgaagtaccctggtggcatctggggacccgtagatagcgcgggaggggccgctcatctggaaaccctttaatcacaacgcaaacacgatgtggcagaaggtgccattcccaggctcccaggacgaggagcacccggtctcattcactccac

SEQ ID NO: 63680 - DNA, 1048 bp, Homo sapiens
ctcagggtctagccctcccttcccaccctgggatccccatgcgtggggctgtgtcctggtggagggggcttggggctcctccccaggctcgggtctccacggggccgtcagtgcgaggcgagggtccccggagtcatgtatgggggtccttccacaccatgagcccggcacaggcatggtcgtcagcccccaccaagaggccacaaggctccaggcccgctggcttctccgtggccctgcgtgtagggcctgtggactgcgggacttcagggctgtggtctgagcccccaagcatggaagaccctgcactctctcccagcacagccgggctgtgggccctgagggaaggagggccggcaggagctggggggcggtggaggtcccgggtgagcctcaggccctccggggcaccctgacctgctgctcagaccttgaggggctggtcccccatactcgaccctgagttaaatctctgcccctttttgctttcccccaaggtcaccgacgatgagggcgcacctgctgtcctggagcttccgatctctgttcggggaccctgtgagccttctggccggctgcgtgcagagcccactgggcacggtggtcggcctggtgtgaggccccccggggaccggcagtgtgtccagggaggggatggccctgagcccagcggctcctcccgctgagtgtatttcttcccaccactcagcgcatggctgccctggctcacgaggcagtcgggactcgtgacttgctggctgctggctgctgctgcctcgcgcgctggggttccatggaggaactgggcctgccgccccggcctcacctgctgcccgcatgctggggtcccatggaggaaccaggcctggcgccccggcctcgcccagcggctggtgtgggcagctgttccctgcctcgcagtgtcctggaggcagctgtctcgcagactcagcttggtctcccgcaggcttcagaaaaacccaattgcacgtgtgggattcttccccagcccttgggtgcggggtctctgtgcacttgagagctgggg

SEQ ID NO: 63681 - DNA, 1099 bp, Homo sapiens
cggcctgaggtgatgagagtgtggatggcacctgcactgtgtccactctttaggctctaatgttcatggtgtgtttggagacgtggaagtggctctggaggagcgtccaccaggtcctgcttgtgtacgggggccggcagcaccgttgtgttgggatgagtggccgaggcgtctggggacgtcctggagcctgcagcccttggccgtgtcacgccatgtgctcatgtgaccgaggacgcttccgaggatgtggaagccaccagtcgtcctgggtgggttggggctggacaccacttctggggcaggtctagggtgatggcgctcccagcccgcgggggtcttggcgttggcgcagaagtggtttcccagcggcgtgccctgagtgttgggaaaaggccctctgctgccgctccaggttcagaagatgccgcttctggtttttccccgttgtgagtgagaacagccccacctccaggagcatggcctccggatcagcctgttacttgaaccctgagcccctggtgggtctcggtgaccttgagccggttgtcttcttgatccttctctccgacaggagtgtgagactcctcttcaggggttgctggggaccagctggttgctgtgtcggggggccgtgctcccccttctctcttggaaggtgtaagggcttagtagggctgcctcggctgctggggcagctttccccggccccttccccgcctccttcccactctggattgtcctgggcgtctctgtgtggggtctcctggctcctgcagatctgtgtagcctgcactgaactgcccctcttcctgggtgcactgcataccccgggccccctgggctctggcctgtccccttgtccccacctgaccgcccagccactgttctccctggcccttccctctcgtttctgcctgggcctgcctggctggtcttgcctggccctgcttttggtcctgtaggcaccaggactgcactctggcaggggcagactctgtttcctgctcagcagagcccaggcctggccctggttagcaggctgtgtcatctgccgcagacagccttcctttctgcgtcctcccctctcggggtcccg

SEQ ID NO: 63682 - DNA, 1044 bp, Homo sapiens
tggttgcaaggccgtggcaactcaaccaccattctcgctgccacttctgggaggagcagatggggacagaactacctgggccctggggtgcatgtgccccaacctgtgtgtgctggtggctactgggggtccaatttctctcttaagaccaagcgtgagctatcaggagagcccccagagcttggagttgcgcttccctggcatgagaccttgggtgagttctcaatgtctccatccctgggatgcctcagaccccggcatctcacaggctgcgtggagaccagagcctgtgggagcttgagctctgcacatgctgagagctgaacgtgaggccagctcctgcggtggctgccgccattccctgccctctgcctgtcacgggtggatggtctcacggtgatgtacctatgtgctggagcccctcttataccttgtggtcatctcatgaggtgcaaggcgtctgtgtggcttttcctcaggaacctactttcttccttccagagaactattgtcgagtgatgcgatgaaagaatataacagggctcgagtctacctggatgaaaactacaaatcccaggagcacttcacggtgagtccctcccgctgcctggtgcaggggtcagacaggctggccttggcagaagccagcccttctcctgtgtaaatggagagaggtcggggtgctccctgcctgaagcctcactcacgctgccctgcctggcactcccgcagcctgcttggtggtctgctcgtggtctgagcccatggctggcctggcagggaaggtggcccagcacgcacagggtcttggggctccagaccaagcccaagagggaattggggagtgacaggtggggagaggcccagggcctcagcgtgcatgaaaataagagggagtccggggctccaggcgtgtagatgagaggttggacagcagccggtattgcttcaagagccaccgtcgccagccctgctcccatgctgggtccgtcccttcctgatccctgagtgtgcagggctggggcggtgtcctgcctcggagag

SEQ ID NO: 63683 - DNA, 1118 bp, Homo sapiens
cgaagtttttgggtcagccgagaaatggtattcagcaataaatgtgtcagagtccagggttcttgatctgttttttctttgaattgatttttcattatttacttcctaaaagtgttggaatttggtcctccactgtgaaatcccagtgtttgggcacattatttctttggggcttatgaggtgctcctaatccactcccttattgatggattgatgtttgactccataagcctgctttatttaggaccttccatcataattttttgtacatttaggcttgactcttttatttccttctaacagatgagctgacattgggctatcaaacgggtgggaaaacaattgccatgaggttaatttcatggtcggctccgtgcgttctgagcagacgggtgtttcctggctgcaggccgggccttggatgcagccttgacgcgtgtcgatctgtttacacacagggctgagtccgccggccccccgggggtgctcatgggtgcccgggtgtctgcaagctgcccgcagctgggtggtctctgggcacggatgctctaggccctctgggctccaaggaggctgggttgtatgtctcttgagaagctttcctttcgaaaggccaccaagaccaccgagactgctgagaccgccaaagccaccaagaccgccgagactgccaagaccaccaaggccgccggctgctcccggtggctccatgcacccggcaggagagtggaaggcgtcgggcctggggcagtttgaaaagataggtgccgccagcatctgcgcttcctcgtgggtgctcaacaggctgcctgggaagctccttctgccatcacctggagtcagctgccgtccacagtggaagctgccagccaccaaggctaccgacctgggccctggggatgagcagcccaggaggcgaagatgcctaggtgggtccccagctctgcaggtgccactccccacgccagtgttctccaaacttccggggagacctgtctgtgctcctgtaggtgtcaggcagactcagaggcacaggggttcagattgaggcctggggctgaggaagcaggaagtcctgtcaggagctggagcactgagaaaggcaccttgctgagagc

SEQ ID NO: 63684 - DNA, 1047 bp, Homo sapiens
tggggaccattacagagttcagggagagaggtgaggcagtcagaactgggggaagatggagaagggacaagtgtgttgtttcaaacgtagagtcctctgatatctaccttttaaattcttattgaagtaaatgcacagagaggaccagaagtggtgatccatattggtgcacatttatttttttgactctgattcctttaagcctaaaactagggcagtgtcccatactgagcactaaagagaagtagggtcaaacccaggagggaggaaaaccagatccctgcaccttggccaagatgaggatgccggatggagcatagccagtcctggaatgaggcctgcatctctcccttgcacaatgcccccacccacaatccagccaggtctctctgtgtccccagctgcatgctcccacctcttcgtgatatggtttcaaaaacacaatccagcaccatgtgtaaattgtttgatgcttgagatcaactttactgaattgcctacattgaaagtgatgaggacaatacctccttcaggaagaaaaaggcaaaatgaagtgctttcatgaatagtcagaagggtcttactaacataaaaatattttgattatgtcttcagaatctctttatgtagttagtggcttgtaagctgtcaacttgtaaatgatgccgttggaaattgaaatgtaaataacattaccatttataatagcatcaaaaatatgaaatatttaggaataaattaggtcaagatgtgtaagacctgtatactgagaactatgatatattgctcagagaaattaaataagatctaaataaatggagagatatactatgttcatggatcagaagactcaatcttgttaagatgtcatttctccccaaattgatgtaaagattcagtgcattactaatcaaaatctgagcagacttttttttttggtagaaattaagctggttctaaaatgtatatgtaaatgtaaaggaattagaatgggccaaaacaactttgaacatgaataaagatggagtccttatactacctgattaa

SEQ ID NO: 63685 - DNA, 1059 bp, Homo sapiens
aactcctggcctcaagtgatcctcttgccttggcctctcaaagtgctgggattacaggtgcgaaccactgtgccctgccaaaaagacatttttaaggttaagtaaggctttgttgattttgaatgtaacattattcccactcaatgagtgattttggtcgacgttcacctgtactttctctgcactctgagccggcaggtgccacttctagcttctggctggggttggtttgcagtggagtctgtgcctgtggcagccgtctgcatgactttgggtcattgcgctttccttgccttttggggagggtccctggtgctctgtgagcagattcgcccctaggggtgaagtcatctcgctcctcttctgagccgtgagctgggcagggccgcgctcacatcattcctctccccctgtcgccgggtgggaaatccgtaacaggctctgtggcaaaggctgggccaaggtgcctcgtgggcagccgatccatcaggcggccgacaggcgtgatcgagtgccgtgtcacacgcagcccaggaaacaaacacgccgcgcgaaaggtattggtgaacgaactgaaaaattgtaaagctcttaaggactttcatgcttgttagcattttttgacagaaaatcactgaagcagtgaacataaagaaatagccatggttgattcacagtttagcttgttgttctgttcatttggcctcaggtgatgtttcacttccggagccccgtgagctgctccttgctctgcctggctttctttcctgtgcaaattcttgcgggtccctcagctgtgctcacccaaccacagcctccctggagatgggtttttatgattttgaaggagaccgaaggaaactgaatgaacaaatattttctccaaagcccgtccaggtttggcttcagatgctgtgagccgtgtgtacatttctaggcttaatccacagaatgaatgtgagcttttatgtcacagcctgcccaggaccctgctgtgtgcctggagggcacctgacctgctcttgaggcttcactacctgatgtcccaaagggaacatc

SEQ ID NO: 63686 - DNA, 1936 bp, Homo sapiens
ccggccccttcctgggctctggggtccatcagatgtttgtcctttgggagcctgcctgaagtgctgagataaagcagtttttaaacagtttcccgcagatgccttttgggagacagagccgtgaatttcctgagccgcgtcctgggatggctacaatggccgtctgcctgccaagccttctcccattcagggaaagcagcttaagccacttaagcccattagcatctggatggggccggacctccttgggacacaggggtgggcagggtggccccgctgtgtggctgtttgggtgcttgttctaatcctcacgctgtttgaaggctccagactgatttgtgacacatgagtccaaaagccactttggggggcttgaccccatcagccggtctgtgctcggaatgtcaatggcctgccctggagtgtgctttggggatagcgggtggccgcctcctggcccaggctgagacactgcacaccagccaccaggaggtagacgctgcatcttggcaagaggcgggtcgggctgccgaagggctccagagttcctctcagttcctgctgagcgcatgcccggaacctgcacaggaaggccgggcaccggcccaggggtgtcctcctgagccctgtctccgagccccggccagcgcccggggcaccgaggtgctcctcagcagcaccagctcccaagggccctttcagggagaaatttttaaagccaaagttacttttggtgcagtcatcattttataaaacaaaaatcatatattattttcttaaaaaaacagatttataggccaggtgcagctgctcacacatgtaatcctagcactttgggaggctgaaatgggacaatcgcttgagcccagaggttcacggccaacctgggcaacatcatgagaccctgtctctacaaaaatttagaaaattagctgggcatggtggtgcattacctacagtcccagctactcgaggggctgaggtgggagaatcacttgagcccaggaggtcaaggttaaaacgagccttgatcacgccactgcgctctggcctggatgacagatcaagaccctatctgcaaaaaaattttttttattaaaaacaagctggattgaggtataatttacacacaagctataatccaattctagactctctctccatataatccagttctagactatccctccagcccccgccccagtcagttccctcccggcccccgcagtctccttgctgcctctgtctctccgacttcgccatgtctgggtattttgtgtaaatggaatctacagtctgtggccttttgtgtaaggcagcagctgtgccctcctccacccacaccagcgatgcagaaacgccggtgcctctgcccgccatgagcacgggccctcgctgtccacacagagctttgatttctctcagatgtgggtctcacacttcccttgttcggtgaggttctaggcattcttgttttcatgacttctgccaagctcggagagctcagtgcccacaaggcccctgtgtcggggccaggggctccccgtggccagtccacccaggtaggggtctccagctctcttacctttagggactgaccctcagtgaccattccctgcattgtactgaggttaagacgagaagaattttcaaaacaggcctcaatgtaatccttcgcggtgatctgtgccggctgtccgccagccaggaccgtgcctcctggagcagctcagccatgcagtgtgggagagagatcggcactcactcagcctccctctcctctgctgcccagatgactgccccttcccgtagctggtcaggccagtgagcatccacaggcaccagaggccgcaaccctgaccctgcagcactgctgccccagcccctctccttggtcctcctggtcggtgtgatcgctgggaccctggcgggagcc

SEQ ID NO: 63687 - DNA, 1072 bp, Homo sapiens
caggcggcattggagtctaggagctcagctgtgtgtccatcaacacacaaattcgtaaaaaacacacatggcctcgccatcgtgggtaaaatcggccccacagcacgtctgcaccagcgggccgttactcccatgccgttcttctgtgtaatattaagaactgaatgtgaagtttatagctagcctgggtgtaccttttaagaattttgtaaaccgtttgtctgtcttttgttactgttttatggtgccaagtatcctacgttacaacaataatatcatgggagaaatagaaatagcctagtttgcttccaatagaaactgcttttaacatgggctgtatataaaaatattaaagagaaacaaaactgtacatttcctcattgctccgctacagacaacccatgtcataaccttgttgcaaatatttttctcctatagcagtaagtacagcattagaaggtgattagagagtctgttgatgaaacacaaatgtatgttttattgattttactttagaacactacagagttcctggaccgggtgaaggcattagctgggtgtttgtgtgggataaatactaccactgcaagtgactgctgtccgctgcggaatctgttcttggtggaagcacaggtccgtgtcgctgctgtggttgccgctgtccgcggttcaacacggagtccgccccgcgggtttcagctgttggtcgttctgaggggcctttggaagtgaccggtctggttcctaagcaataaaattgaccgtggtgaaaatagtcccgtgttgctttttcttcctttcccttctcctgccacctttgaaatgctaactcaggggagcggcctcctgtatagcctgttatttgagatcaagctcattagaaatcctggaatttcactgtatcacacgctgtcacaaaacactaagccgttcattgagaggagaaacacagccttttggactttctactgtaataaaggatttatccctcaacattttaaaacgggattatatcaacgctttgccttcctcaaaactttaagaagcccctctgctctgagctgagaggggc

SEQ ID NO: 63688 - DNA, 1012 bp, Homo sapiens
ctggtctctgggtccctgtggtggggggggtctctgggtccctgttggggggtctggtctctgggtccctgtaggggttctggtctctgggtccctgtgggcgggtctggtctctgggtccctttgggggggtcctggtctctgggtccctgtgggggcggctggtctctgggtccctgtggggggttctggtctctgggtccctgtgggggcggctgatctctgggtccctgtgggggggtctggtctctgggtccctgttggggggtctggtctctgggtctctgtgggggttctggtctctgggtccctgggggggcggctggtctctgggtccctgtggggggttctggtctctgggtccctgtgggggcggctggtctctgggtctctgtgggggggtctggtctctgggtccctgtgggcgggtctggtctctgggtccctgtggaggcggctggtctctgggtccctgtgggcgggtctggtctctgggtccctgttggggggtctggtctctgggtccctgtgggggggttctggtctctgggtccctgtgggggcaactggtctctgggtccctgtgagaggttctggtctctgggtccctgtgggggggtctggtctctgggtccctgtggggggatctggtctctgggtccctgtggtggggggggtctctgggtccctgtgggggggtctggtctctgggtacctgtgggggcagctggtctctgggtccctgtgggggggttctggtctctgggtccctgtgggggcggcttgtctctgggtctctgtgggggggtctggtctctgggtccctgtggaggcggctggtctctgggtccctgtaggggttctggtctctgggtccctgtgggcgggtctggtctctgggtccctgttggggggtctggtctctgggtacctgtgggggtgtctggtctctgggtccctgtggtgggggggtctctgggtccctgttggggggtctggtctctgggtccct

SEQ ID NO: 63689 - DNA, 1001 bp, Homo sapiens
cccgggatggcagggacctgggaagaggccacctgagggctggctgtggtggcggcagaggaagttgggcagggccctggcagctgggtgggggcacaaggaaccgggttggcccagctccggtggaggggctggggggagagactcagcgccccatgcggccctcagggcatcctctagtgcctgtgaggccagagtgctgggcagaggcagggccaggcccagcgggcagtggtctggagaggaggactcagctttgctggggcctcccattgaggcagcagccgcctggacctgtgcacctggcagccacccccaacctgtgcacctggcagctggccccttctctgcccgtctgttcctctggaagcagccgctgagggccctatgggcgcggagtgtttctggggccccgactcgcaggtgacctgggcgcagatcctcgccctcctcacctgctgtagcagcgtgagctggctgaagagctggtgagtgctgtactccgtcaggaagtagggccccttctcactggtcttggcgcaggggccgtagaagtcctcgaggaagcagggcttgggcagggcggcagcaatggtgtaggggcgctccttgtgtggcggcagcaccagcccgttgcctcggggcagcctccaggggaagctctgcagggcaggccgggcactgaggggcctaagctccgtgtcccctctgggtcaggggtccagggaggcagggttggggggtgaggaccaggccaggtgcaagcccagtactcctcagactggcccagccagagccagagagcagcctgcccacccgcagctgtgctggcacaaggatgcctgtcctggtcgtttcagcaggtgccccacgggcaggacgctgaggtttaatggagagggcatttctctccccacactggcttctgccttagtctctggcccgtgggtcaatgagtcacagcaggaccctcctcccctgagcacccgggatggtgcagg

SEQ ID NO: 63690 - DNA, 2073 bp, Homo sapiens
ggggcgggggcagcactgggggccggacaagggggcgccagcgccttccggagcgggaggggctccgcacacacctcgacgggggcgggggtaggctcggcacaggctaaaaacgagcggagccgccggggcttaggcatcgcggcacctccgttgaacgggtctaagaacagaactcctgaggaccctccgtttccaaccgaagccagtctttgctctgcgtcttcccggccgcagcgccaggaccgaccccttaggacccggcgggcggggcggggcgcgcggggcggggcggggatggtgggagggtcgcgtagacccggctgggacggagggacggcggcgcgggatgctcagaacgcgtgtgggcggcccgggcggcgtctggccctctccccatcctcgcgcgccgcgccccagccccgggatgctgctccggccccgcaggccgcccccgctcgcgccccccgcgccgccctcgcccgccagccccgaccccgagccgcggacacccggagacgccccggggaccccgccccggaggcccgcctcgcccagcgcgctgggggaactcgggttgccggtgtccccgggctcggcgcagcgcacgccctggagcgcccgggagacggagctgctgctggggacgctgctgcaaccggccgtgtggcgcgcgctgctcctggaccgccgccaggccctgcccacctaccgccgcgtgtcggccgcgctggcccagcagcaggtgcgccgcacccccgcgcagtgccgccgccgctacaagttccttaaagacaagtttcgcgaggcgcacggccagccgcccgggcccttcgacgagcagatccggaagctcatggggctgctgggcgacaacgggcgcaaacggcctcgccgccgctccccggggtccgggcgcccccagcgcgcccgccgcccggtccccaacgcgcacgcgccggctcccagcgaaccaggtaggcgggggactggggggccaggtggggccgaggactgcggaggaaccgggggctgccgagggctgcgggggaggggcgggcgcgccccgcgaaaatccgcccgaccgcctgctccgcgttcccagacgccaccccgctgcccaccgcccgcgaccgcgacgcggaccccacctggacgctccgcttcagcccgtccccaccgaagtctgcggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacatcctgggcccgctgcgcgaccagctgctgaccttgaaccagcacgtggagcagctgcgcggcgccttcgaccagacagtgtccctggccgtgggcttcattctgggcagcgcggccgccgagcgaggggtcctcagggacccgtgccagtgagtcccggctgcggccagtctcccctctccaggccgaggcccctccgccctgacccctcctgctgccttcccacccccgttcttgggtatgttcaataaaaggattgttttcctagagtccgggctgtgtaggagtgcgggtctggagacggggagggagtggcgccctgcagtgctggggctgcaaaggtcagggcagggttgcgacgctctcatcacagagaggggctcccactcgctcctaaggtgtagacagagctccgtggggcgcacccaaatgtaggccgaggaggccaggctcgagggtggtgggcgtggtgcctgctgccgggtcctggtcacacactcggttctcaaggccacaccagactctccctgcccctcccggggagccccactgagtaaaacgaagtgaacgggtgggctccgctgggggtccggagagaacctgaggctgaccccacctcttcactcaatgcaggggtaggggtta

SEQ ID NO: 63691 - DNA, 1056 bp, Homo sapiens
accagtacctgagccctctggagcggaagaggctggccagggagatgcagctctcagaggtccaggtgaggtgggccgggcaggctggggtgggcaggggtgggcaagggtgggctggtggcctagtctcacccctgttctgatcttgcttttcctacagataaaaacctggtttcagaatcgccgcatgaaacacaaacggcaaatgcaggacccccagctgcacagccccttctcggggtctctccatgcgcccccagctttctactcaacgtcttctggccttgccaatggcctgcagctgctgtgcccttgggcacccctgtccgggccccaggctctgatgctgccccctggctccttctggggtctctgccaagtggcacaagaggccctggcatctgcgggagcttcctgctgcgggcagcctctggcgtcccacccccctaccccaggccggccttcgctgggaccagccctgtccacggggccccggggcctgtgtgctatgccacagacgggggatgcattttgaggaggcacctctgactcccacactcgcggtcttgctgatcgcacctggctcctacctggaggactcagttgttctgtttacatcctggtggcacctctcaccctgacccacacaaaggttctggagattactggagaatatatataaatatatatatgtacgtatatatgtaaatacacatatacgtatatataaatatatatatacatatgtgtgtgtatatatatatatatttttttttttttttttttttttgagacggagtgttgctctgtcacccaggctggagtgcaatgacgcaatctcggctcactgcaacctccgcctcctgggttcaagcgattctccagcctcagcctcccgagtagctgggattacagacacccgccaccacgcccggctaattttttctatttttagtagaaatggggtttcaccatgttagccaggctggtctcaaactcctgaccctgtgatccgcccgcctcggcctcccaaagtgctgggattacaggcatgag

SEQ ID NO: 63692 - DNA, 1016 bp, Homo sapiens
tcaaggctgcagtgagccaagatcgtgccactgcactgcagtctgagcgacagcaagaccctgtctctcgaagaaaaaaagaaattagaagaaaaagaactcatcttgatgatgaagcacaaatatgcatctgttgtgtggcactttcctggcgtgggctccgaggggtccgtccaccaaggagcccgcgtcccagtctccaccgtccagctggctgggggtgtccctgcagggcacaggttggtagacggtgacagcttgtgctgggcagacgcaggagcagcggccgtgagtgtctggtgtgctgggaggggcgcttgctctgcagaggaaatagccacgtccagagaacgtcctccatggctgtcctccgtcctccgtgtcacttggtgggcgctgtcggggccgcgtcctccatggctgtcctccgtcctccgtgtcactcaggtttgctggggctttcactctgcggcagcgaatgctcaacttcgtccagaatattcaatactacatgatgtttgaagtgatggaaccgacctggcacatcctggagaaaaacctgaaatccgtgagttttagctccacagataataacgtttgaaagccactttcctttcacagggagacaggaagtgcaggagaggcagggcgaggggagaggcagggagtgcaggagaggcagggaatgcagggagacgcagggagtgcaggagaggcagggagtgcgggagaggcagggcgtgcgggagaggcagggaatgcgggagaggcagggagtgcagggagacacggagtgcaggagaggcagggcaaggggagaggaagggatcccccagggcggggctgcacccacactgctggccacacacgggaccccttgctgcctgccgtcctagggggactctgagccgtctttgccccgaggttgtctctcccacattgcgcatctgaggctgaggggcctgaaggcagaatctgttggtaccaaattccagaagctgccgcagcctcccttc

SEQ ID NO: 63693 - DNA, 1258 bp, Homo sapiens
ctgcagaaaatggcggacaagatcctcagcacaggtgcggcgcagcgggcggggacttggggtgcgcagcacagctctgcctggagagtctcctgcagcccaggccctcccaccgggagcctgtgcctcaccctgtggttgccctgagccctggtgtccgtgaatgcggggctgaggtcaggactggcccgtgggctgggctgcggcgctgagttaggccttgagatggtctctgttgccaggttccctcaggtttccatctccgggactctgtccctgaccctgcgaggctctctcacaggtgccttctctatttctgtttctgatttctaaaactccgctagcatgtcaggaaaaaccagcaaagacacacgcctggcggccggcagtgtttcctatctctgaccacacaggttagggcctgacctggacccagggcagtggcgcggggacttggactcggcacatcggggccgtcacgaaagggttgggaagcgattagccatccggttctcataatgcctgttcgaaattatttctgtgcccttggttagaaaattccagatgtgcagagccacggcaaagccctgccaccaccagctcagtctgtagccgctgacagtgatttaccgggaaggagcaagggtgtggagccgcctcatgcagcccagtttccattccactgccttctgtgtagacaaagacagctggggcctcagactgaccgtgtggagagcccattcaatgtccattccactgcctcctgtgtagacaaagacagctggggcctgagatcgaccatgtggagaataaaattttgaatttctgtgttttcaggaaaatatctaaatgtggtcagagagtgtggccatgacgtcacctgcccggtggctaaagagatcatctacacgttaaaagagcgggcgtatgtggagcagatcgagaaggcgtttaactacgccagcaaggtgctgctggacttcctgatggaggagaaggagctggtggctcacctcaggtgattccgtgccctgtccctgtgcgggcactcacctccctctgaaaccggaacctgtgggacgtggggctgagatcgctgggtttcttctggcagctccgccttgtctttttgaaagtgggcactgctggatggtctctagctcaaggacctggcactcacagtgggtggtgtaggcccccggtcaccttgtccaggggccccagctcccctccttgcccagggcccaccagccccttc

SEQ ID NO: 63694 - DNA, 2021 bp, Homo sapiens
gcttgaggaactgaggaagcagcttggcagcgtggccacaggctccacgctgcagcaggtactgcgtccatggctgtccacaggctccatgctgcagcaggtcctgtgtccgtggcgtccacaggcacccacactcagtgctgtgccgggcccctgctggaaggacatgtctctctgtcatttattgaaaatgaatcccttagagaggccaaggcttaatgcttgatcatgacctagctctatatgtttagttttttttttaaccaagaattctggaccacaagaatcaatagcagcaaggttctgacccacgtgggagttgtgctgccaggtggccacgtgactctgagcctacccaatcctgactccccatttccctcctccaatttttgacaattttgagggaatgctttcagatcattatattttcaagattctcgaaaatacagtaatttttattattccttctgtatttgctacttgctcttggttttgattttatgccctaccctggtcttttgacgtaagtcatctcccagtctctctcattagagctgccacgttcctgcctttgtgacctttaaactccctttggagctgtgtccctgaggcgtcctagcctcctgggtgcgtgttgagtgcagcggctcccaaggacccagccggttcttgctgggcacgttctgtgctggacatggtgctaggcctctgtccacgtctccctcagccgtggcagaagactgggtcttactgccacgtgcagagacagtttgcatctgcccgtgtccctgaccagccctgagtgggagtcagtgcttccgaaagctgggccagcccaggccgaccccatcagcctctggcggccactggcgcaggagggcaggctctctgaccacatgtcaggagccatcctgtcacgctggggcccttctccggcagggtaaggatgcatgtctgttgctgaagcctgtcttcacccatcaagtggtgttcagacctagtcactgccagaaagaagcaattcagcttgttcacagggcgccctcctttgaaacagcggctctgtgcctaggtgcaccctctcccgtggttcccactgctggtgctcatgttttcccaggggggcccttgcaggacctgcactcctgagaagaggggctagggctccccatctgccctgttgtccccagcccctcacgttgtggcaggcagggatgtcgaggcgcatttcatttctatgtggttgaccctttgtgggtgttgaattgagtaatcatctttgccgtagatgctagcttctatgcatgtctttagttgagtgtttgcgctaaagtgtatctttctggttttgttttttaaaatgtccttgctagtctctggaacttaaaagaaagatgcttcgagacaagcagaacaaaaaaaattcaggccagcacctccccatcttcccagcatgggtgtatgagagacctgccctgatcggggatttcctgattggtgctggcatcagcacagacaccgctttgccgataggtacgtgatgcgttgatttccgggctctgccgataggtacgtgatgcgttgatttccgggctctgccgataggtatgtcatgtgtttatttctggcctctgggcaggacactttgcaggcccagccctcccccgggcctgcctttcctcaggttgtgaggctcaatgctgactggctgccgcctccatattcccatcccaggatggcagcagagaacggctcacccgggtccttgagggttcttctcctgtcccttctgccagagctgtggggcagcctgcagcaggcccctccccagccggcatcctggtgccctggtgcagacctgcaggcatcagaattgtgtgcagcacttatttctgaacagcgattcatgactcccatagattctgttacagcagtattctcagaggcctcttaagtagtgttcgtgtaaacaagatgcgggtgagaccacacagtcatttcaagacgttgttattggggac

SEQ ID NO: 63695 - DNA, 1063 bp, Homo sapiens
agcccagtccggaggctcgcggaggccgaggcgcactgtggggctcggcccggccccttccccgcccctccccgcccctccccgcccctccccgcgcctccccgcgcctccccgcgcctccccgcgcctccccgcccctccccgcgcctccccgcccctccccgcgcctccccgcccctccccgcccctccccgcccctccccgcgcctccccgcgcctccccgcccctccccgcccctcccagcgcctccccgccccctcgctccgcctccggcctcctccgagagctccagacctcccggctactcagaagccctcggactgcccggaccgcgcgatggagtcgaccggcagcgtcggggaggccccgggcggaccccgggtgctggtggtgggcggcggcatcgcggggctgggcgcggcgcagaggctctgcggccactccgccttcccgcacctgcgggtcctggaggccacggcccgcgccgggggccgcatccgctcggagcgctgcttcggtaaccgcccctcccggagcccctcccggaacccaaccggctgcgcccgaactcgccggccccaacctgccctgcgcgcagccgacctgcccggccgcctcaccgggctccccgagggaatccccgctcgcttaatccgccagagttcaccgccccgaaactcagggctcagagttagtcaggagggcgccggccagggaaggcgacctacggctccacaaggccgccctgattctgccccacgggggcccccccagccccggggtacgcccaccctgcgcccctccctctggtccacaccgcccgacaagtgccctcctgcccaggtgctccccttaaactgggtctgacagggccctgccctgggggaccacagggcccttggggacagtgtggtacatcctccttgggaaggccagcgtgggcgtggcccaggagaagggctcggggtgacccttctaggaaagggacctccaggtggcatctgctgtcccctcgcaggtggcgtggtggaggtgggcgcgcactggatccatgggccctcc

SEQ ID NO: 63696 - DNA, 1071 bp, Homo sapiens
cctgaagctggtggactgtatcatcgaggtccacgatgcccggatatcctttcacagagcaggggaggcccctctgcctgaagtcatattacacattagaattacctggggaggcttttaaaaatatgaattgcgaggcccctttctagaccagttaatcagaatctgtgatgtggggtccagactgcgtgtctttgaaacttcattgttaatacatatatctgcgtcactcaagcctgacggtacggtgcagcagtggaatcctctagatgggctatgaaactgtttaaatgttcctgccaactggggcttttctcctgtacttgaggaatgaattggcaggatgtgatgattcgttcactgatggcaagaaaaaaagttggttggctggtaaagctttggaggaatttttaccttaattttgccacatcccactttcaggccgcaaccctctgtttcaggaaacccttgggcttaagcctcacttgctggtcctcaacaagatggacttggcggatcttacagagcagcaggtaaaggcctttctctcagacgccttcagcagtgtggctgtgttttcccgaggtcgcttgttctaacggaagagttgccggacgcacacttgtcagtttgcccaggcaggctctgctttagaaacagccctttgctttgcagaagcgtgccagcatcgtttctcatatggcgtgcccccatctaatgtgtggttcgtgacctggacacccagggagtgcacgtctcctgtgggaagtggccaggttgtgctgccagagcccgagtggtcagtgagtgcgcattgtgggcagcaagccacccaggtgccgaggcaagagaccgaggacacgagcttttccagtgtaataaaacatatgaaataagaatagttatactagatataggtcatagatatgattgtatatgaatattactaatcattagtttgtagcaattactcttcattccaatattattataattcttgctctataatcataacctaggaaaaaccaggccatacagagataggagctgaggggacatagtgagacgtga

SEQ ID NO: 63697 - DNA, 1047 bp, Homo sapiens
agaggatgcaggtgtactggctgcctggaagttaccgagtgccatccttagcagcaaacagagtatgtttgcagatggtctgctgtgctcctcttttagtttccaggacctgggcctgcacagaggcctgcctgtcctaccccggatagagtggatgaagcctgtgtgtgtgaacagctgttactcctcccgctgcggcaagggctccggtggtgggagccgccccccatgctgctggccgtggccacacaggacgaagctcagggatgattcttagatagtggctctcccccggggcccagcaccggtcacctgcagtctcatcttggtcatccacagcgccgcagtcactgtcacccacaggaggtgcctggccgtggcctttgtggcattcaggaggaagggcccggcctggctggccgcgcggtgtcagtgctgggccccctggtgctgacctgcagcctatgtgcaggtacgtgcagcactacggcctgggcagtgcctgtgacaacgtagagcgcgtgctgaagagtgtggctgtgaagctggggaagacgcagaaggtgaaggtgctcacgggcacgggtgagtgaggtcgctgatgcgggcaccggagcctcaccccatcaccctgggggaccccggccatccctggaggaggcagggaggagaggaacgtgtcaaggagcatgcgccgggtcttctgggaatgggtttcagggcaggggagctacagaaagttctggagaggaagggcttgtagtccaggcttccgagggtgagaccagccctgccgcgtattgggcagtgctaggtggacacctgcaggcctcacatgcctggccttggaggctccgggcagcgtagctcaagctgttttctttctgagtgtgatcccgttccctgggcttccctgatgccatcatggagcctcttagggctggtccctcaggtgggtaagggctgggcctgtcctgctgtgaaggctccttcctcactgaaccctcccgtcccccaggtaacgtgaacattattcagcctaactat

SEQ ID NO: 63698 - DNA, 1037 bp, Homo sapiens
ctggggccaaggtggccagaagctatgctcccaggtttgaacacagagcactcagcagtagtagctgtcacagtgtctagggaaaagggcagggtctctgcttccatgtccctgaagggttacctgtgggcctagtgctggaaatgtacagggtcctcagggtgcaggtgcctcccatccccaccccacccctccaccccttcttggctgtgtccttccatagcctgaccctgtttcccctcgtctgtgtcccagcccccctccctgctctttcctacacatccctctgggccaggaccctgccccaccctgacccctctgagctgtgctcttcctggaccttctcagggctgtgggcgcctggtcctggcttgagggtcttgtcccctgggggctccacacgggcagccatggtgtactgcggagccttgaacttggtcacccgcacatcagtttggcggtaggctgcgggacctggggtctgagaggtaaaggaggctcagaccaactcggcctacccagggcgtgtggccctagaggacagggagcaaactcaggctctgagtcaacagggtcagctacaagttggtgcccgtgcatcaaggtccccttctgtcttctgtcacactgtggagatcacaccccactgcttgtggggtacctcatgtgggggtcacttcctccatttcagcctcacgctggcaatggcatccccagtgtgtgccagtcctgggaacatcgctgagcgtgtgtgagagaggctgttgctgccctgttggacctgagggcctggggctggcaaaatcaacatggacgagggctgttgggtgccatgatgctgcttccccatctcaggcccctcaagctctcaggcatgtgccacccaggggctttgcactggctgtttctgaaaccaggaccctcctcccccaaatagctcatggtttattttttcctcctcctcttctttccatgctaccctatctaagattgcctctctctctccagacagtgcttcctaaaccccatctcttgtc

SEQ ID NO: 63699 - DNA, 1025 bp, Homo sapiens
tccttccgggtccgagcagggccgggtttcggccggcactgccgttaggaccgaaggcgcgcgtggcggcccagcagctccagcgaggggtcgcgcagcagcggggtctccccactccccgccgccccctgtgagatcgttctgcatgggttcggggtgagcgggagtcggcattcgacaggtcccgaggccaggccctaggagtagaggctgtgctccgctggtgtccaagcaggactcttactttggcctcggtggccccatttcccctcctggagcccgtgttcttgtctgcaaagtgggatattgatgcctgtctctgtgaggtgttatgatgattaaaggaatttataaatatgaagtggctggaaggacgctggcatcccttcctgacactgaagctagggaggaggtggttctcacgcacctgatgtgacagaacttccttatcccctggcccagcctgtcacaggccaggcctctgcgagcactctgccctgggtgttgcaggaagccccatgcgggatgcagaccaaggatcccgctcctggtcgacctcagctcccgtctcggggaaattgggaactttgctcagccattttctgtgcggtaaagggccttcccaatgttctgtcctggttccttgccacctcttcaggacctagctcaaaggtcgtctctgcaggagcctttctgctgccttgctgggtacttttcccaagtcttttctatgctcttagcagagtttactctttttctataagaatgggctccacatacacagatggtgacctccctggatgcaagtgtcacatcatactagcaccccagggctgggtccagtttttgctacacagtctcagaaggtgctggttggaccgaacccattgtgggtgcttgcccatccccaccttgatgtgtacacaggacatgtgttcacatgacaggcccttacacacatcgtcctttatgcagcctgtctcatgtgcaagattcacctgctggaaccttggttagggccccct

SEQ ID NO: 63700 - DNA, 1822 bp, Homo sapiens
aaggccaaggagatgccagttctgggctgggacctcaggaaaggcttctgagggaagtagaggccccttctggctcttgctgcctggcaggagggctgtgtggtgtctggggagactgtaagagatcctccaccatgaggctgtgagtggggctgagacagagtgtgacttcatccctaaggtatgtgttagcattcctaatcagggaagtgctcttagaagaatactcatggagtttttaggaagacagcagtggtcatcttttgcccccagcactacccagagtcacctaggaagaccccaggggaccaggtatgcagtacaggaggtgcacagtcattgccacacagtcctggagtgcaacagacagtggagcctcagcaggcagcagtgggatgagtggggctcctcacaggaacccttctttctttggtcaggaagacgctgccctttaccgacacctggggacccttctccggcactgtgtgatgatcgctactgctggagaccgcacagaggagttccacgggtgagaatggggctttttctgggagggaagtgtgcccacatgtctagatggtcgtcctcaaccccggctctgaaccagaaccacctgagagcccaggccccaccctagagagtctgacgttgtctgggtgagtgagactggacatagccatgaatttgggggcaggaatgtgccaactgggccttgggtagtggcaacagtatggtacttactagggcacattggttccttgtccccgtttttggtctacctgcccctaggctggtctgggtttccagagatggtctggcgctttggctcagacagggtcggggaggcagtgtgtctcagtgcccccacttccccaggggaccccactgtacagctgagtggcagtgcctctcagatcagtccctgcccttggctttggtccctagcgctgcccctttgggactcagatgccagctcatgtaatgtgtggttcagcggagtcacaaagattgcacctgtgctcagggattagccctgttgaaacccctacctccatctgtccccagccacgcagtgaacctcctggggaacttgcccctcaagtgtctggatgttctcctcaccctggagccacatggagactccacggagttcatgggagtgaatatggatgtgattcgtgccctcctcatcttcctagagaagcgtttgcacaaggtaggctggggatggctgtgcaggctcccccagtggctctggcactggttctcctgcacagatgtggtcagtgcttccacactgtccacactggtacgtggagattgtcttggtggtgtgatatgggcgactcttccggttgttctgtggtccagcctggcaagaagccagacccttcctccatgagaagcatgtggacaccttccacacacttgaaggtttcacttcttaaatctttggggatctttactgagtggtccagagaagccccccagtccctacttttaagtcttaaacacaggcagcccttgattacaagcatagttgtccctcagcatcctgaggagacccataggaacctcagatcaaagcttccttctgattgctgtgactgcactacagggcatctggacagctggggctctaaccatcttccaggagcttgcagaaagcaggctggagtacaataaaccgagatttagtagacctcctgggaatctacctgcctaagcaagggacacacaaggtgcctgcgagccagtcaggatagggagctggcactggacacacagctagggggttgtctgtgcccgtcgctgccactgc

SEQ ID NO: 63701 - DNA, 1050 bp, Homo sapiens
taaggccgggcgtggtagctcacgcctataatcccagcactttgggagactgaggcaggtagatcacaaggtcaggagatcgagaccatcctggccaacatggtgaaaccccatctctgctaaaatacaaaaaaaaagttagctgggcgtggtggtgggcgcctgtagtcccagctgctcgggaggttgaggcaggggaatcacttgaacccaggaggcagagcttgcagtgagctgacattgtgccaccgcactccagcctggcaacagagtgagacttcgtctcaaaaaaaaaaaagagactaatgtcgccagatttattggagatggcccagtgtccaaattaagagcctgcttaaggccaatttagatgtttaaaataggaaactgcttaaagccaggaggcagcagttagggtttgggcccagttaacagaaggtccaaccaggcttccccagtaaatgggagcagcctacttggtagagaggaaggtagcagccacgggtgagtaggacccctgcctggccaactgggccccttccccagccccactgcacctttccccaacaggaacagagtcatccagccaatggggatgagtccccggggtcatcttacgtccctgcaggatgccatgtgcgagactatggagcagcagctctcctcggaccctgactcggaccctgactgaggatggcagctcttctgctcccccatcaggactggtgctgcttccagagacttccttggggttgcaacctggggaagccacatcccactggatccacacccgcccccacttctccatcttagaaaccccttctcttgactcccgttctgttcatgatttgcctctggtccagtttctcatctctggactgcaacggtcttcttgtgctagaactcaggctcagcctcgaattccacagacgaagtactttcttttgtctgcgccaagaggaatgtgttcagaagctgctgcctgagggcagggcctacctgggcacacagaagagcatatgggagggcaggggtttgggtgtgggtgca

SEQ ID NO: 63702 - DNA, 1064 bp, Homo sapiens
gggcacaagtgtcatctcatgggaggctggcgccacctcagaaggtgaatgggttcagcttgggttccaggccagagtctgaagttgagaggactccgttgggtgctgggctgtgagcccaccatgggggcaagactgggagcagcagacccagcagggcccttgtaggtaatcaccggctggcactggctgggggccaggtaaagccagcagaggctgaggggtgctggagtctgggtgtgtgtgaacgcagagtgggtacgctggcacagtgcatgggaggccgtggattcccaaggaccccagggctgtggctggagcagctggaaagacggagccgccgcttcctgagatggagaagcctggtaggtgggtttgggggagctcaggaactcagccttgtttccacggatttgaggatgtgctgcggactggaggtgttgagcaggtggacatgagtctggagtccaggaaggcccagaggcaggagctggggtgctggagtgagcagacaggagagcccagggtgtggacagacatgagaatgccatgctaggcctaggatggagggacagacacaggaggagcagtcagaggggccatggtggtcagcacagtgtgggctgagaccagctgaccgtgctggccaccaggtgtggacacttgggccaccagccatctttattgttgaagtgaaatgaaaatggcctttttcctgattataagtgtatcatgtgtgtctttgaaaagattcgtacattatataaagatataaagcaaaggatcaactttttaatcccaccaactgttagcattttattctgtgtcctctcagctttcttttttttgtacaaatgcatacgtacagatggtaattttaaactaaaagttggacagcactgtacattctattctgcagcctgctgttttcacgtaacaatgtgagtccatggagatgtgctgcgttgttaatgccaacagtttcccttacacggatatgaggtcccaactgagaaacccatgtctgtaaggctggtgccatcatgaactgaatgagctggtgt

SEQ ID NO: 63703 - DNA, 1014 bp, Homo sapiens
agtcagtcgttcatccaagaagccctgactgagctcttattctgtgccagactctgttctaggtgctatggatggagcagggaccaggacctacaaacacgtggagcgcattctaatatctgtgatactctgcaaaactgttaaaacaaatccttgcggccgggcgcggtggctcacgcctgtaattccagcactttggaaggccgagacgggcggatcacgaggtcaggagatcgagaccatcctggctaacacagtgaaaccccgtctttactaaaaatacaaggaaattagccaggcgtggtggcgggtgcctgtagtcccagctactcgggaggctgaggcaggagaatggcgtgaacctgggaggcggagcttgcagtgagccgagatcgcgacactgcactccagcctgggcaacagagcgagactccgtctcaaaacaaaacaaaacaaaacaaaacaaaaatccttgctaccactggccctaaagcaggaggcatagggctgcgtgtgaggagtagtccattgcatgggcttcctccagtttggctttggatttttgagctctctgaatttgttgtttgtgtcctttgcacagtgtccctcccaggttgcacccatgcctgcccctcagggtcccccactcccagtgaatttcacaccatgcagcatgtactttaagccatacatcttacgtatgttccagacatttggtaaaacgccgtttatgtgtttttcagtgactcacaaacattttatttacgtaaatgaggaatgtactcaggcacccttcgtgataccttgccctcagcaggcactcaacagcaataataactttcattccttttgtgcttctcttaacagttcgtgtttagtaggagcacagtagctgtttggggaacgaccttaagtgaatagatgtctgaaatgctgtgtgaagtggggcgcttaataggtggtgagatggttttagaaccagggttttccctctttgcttcttgactccttaac

SEQ ID NO: 63704 - DNA, 1023 bp, Homo sapiens
ccggcgcgcccaggtagacgtagaggcgagtagaggaagttccctagtctggtgtctcatctctcgccccggaggtcaaacctggagccagcatttctgtaccctgcgctcacacctttttcaacccggatggcggtgatagttaatactttctgagcgcttttactatggtcaggcattatatttacacctaatcctcgcaaaacactactgggaagatcctcatttgacaggagcaattccgggtcacaaaggctgacaccacaaagctagtccgtagcgggttcgaccacaggcgcccacactctttgacgcctcaatggcacagccaagtgcgcgggaagtgggctgcaaacgccggagagttttgtccggagcgcagagacgcgctgtaaccgagcaaccagcggggcccgcccccggcctgctacggcgctcccagcctgccccgcgccgctcggcgccggaagtgagtgagcatttccggcagccatccccgcggtgctgacatcccggttgttcttctgtgccgggggtcttcctgctgtcatgaaggacgtaccgggcttcctacagcagagccagaactccgggcccgggcagcccgctgtgtggcaccgtctggaggagctctacacgaagaagtgagcgccgagcagacgggccctgggccccggcgatagagggagacggagggggcaggcgggcggaggagcggacccttgatgggctgagggcgcccagacccaagttggggggaaacggggacgtgtagcgaccggctgtgccggcaaggtttgctgaggaaccttgagtggcagggtcgaggaataagagggatgacagaccacgagggccaagagctgtagccaggatgtttcggtctgagattcactgcttccttaacgggggactgagactgaggcttctgaactcctacctcgggtcttactaaaacggttcaggagtagcctttgattttagctcttgattccatctaacaagcaaacacactttcagggc

SEQ ID NO: 63705 - DNA, 1031 bp, Homo sapiens
atagaaatgatcatgtgtgtcctctggttcggccttgcactctggacagagaccaatcttcagtgcttcctagtctgtgtccctcagaaatgcccctgaaacataatgtatttttttcttcagtgcttttgcacatgtttgttactgtctggaatgttcttctctcagcttcttcccctcccacaccaaatggccacctctctaaccgcccttcattccttgaaactcagtattgccacttctacagtaacctttgaagcctctccctttggctgatgcacttctgcccctttttttttctttctttctttttgctcttaaactcactgtattgtcatttatttgtttaaagactgtcttcagtggaccaggagctccttgaagacacatcatttgtcttacacgttctatgttgtagtatctagtatggagtctgaggaagtgctcaagtgtgctgaatggctaagaaatttgaaaacggtgcataattagctttaattaaaatctgaaggaactccattctgtttgattagcaaacatttctctttttgttttaaattttatttcattaacttaataggtgaacaaaatgtgtatttcaaatctaattgaaattcatctgaaacatgtttacacagaagatagatataagatttcaagtaacttattgtacagtccattgtccattttaagatattctttcttccaaaaaaactgcgttgaatgtcaaaaaaaatcttttatactccataaaattgagatgcaaacttctgatataaatttttttcactgtcaactccgatgataaagatgggaggcacaagcgttcacagttcagttaaatgatgcaaacgaaaagcttctgttttcctttgatacaaattagaagcctccattcaggtctcttacagtagtaccgcatacttgatcctgatactacattatgtctttttctttttctcttttttttttgagatggagtttcactcttgttgcctaggctggaatgcaatggcacaatctcagctcac

SEQ ID NO: 63706 - DNA, 5239 bp, Homo sapiens
actttgttttataaaggagcagatccaaatggtggttaaaattgaaatataagttaactgaacttttgtgttttctgtatcagatattatgtttttattatactttatggtcaaaacctaaagattaccctacctaagggtgtcttggttagcagaaaccagtctgttgatggtccttctgattgttccttcttttccagatcctaatgtggctcttacttttctggaaaagactcgtgagaaggtaaatgtggcatgtgggcaataccttttagtaccttttagagtatgtatgacttaacagcttgtgttcatgctcactgtccagacctttagagaccacaaggcctctagtcatcaaggttaagttaatgtacaagtagctagcttcctttgttagtcaactgcccacattctgaggtttcttgtttttgtttttgatgtcttaggtgaaaagtagtgatgaggcagtgatcctgtgtaaaacagcaattggagctctaaaattaaacatcggggacctacaggttacaaaggtgagatcaccataatacagatttatctttggtttaaaattatttaaaaccctaggaaaaaaaataacctatttttcttctttactgtttattttaaaacatttttacattacagaaaagttgcaaaaataacacaaagaactactataccccaacctaaatttcccattgcaaacctttttttttttttttttttaaagacggagtctcgctctgtttcccaggctggagtgcaatggtgcaatctcggcccaccgcaacctccgcctcacgggttcaagcaattctcctgcctcaacctcctgagtagctggaattacaggcgcgtgcctccctgcccggctaatttttttgtatttttagtagagacagggtttcgccatgttggccaggctggtctggaactcctgacctcaagtgatccctctgcctcagcctcccaaagtgctgggattacagccgtgagccgctgcgcccagcccccccgattgctaaccttttaccgcttttgcctttgtgtgtgtctgtagcttttttccaaaaccacttaggagtaagttgctgatacaatgcctgttgcccttaaacaaaagagcactcccctgtgtgaccacagcacatccgtctaataatgactccacatggcctcagtcagcccaaagcacattggttctccctgaccaaggtcagcctacacaccactggcatgtcacgtgctatttctccatcttccttctgcctcctaaatgttgttgaagtatcctgtctatttttatgtctttcttatgttcaattatgttttggtgcagttgggagacaggtatggatgtgggtggcagtgaaaccgacatgtggctggtccacctggttgaaccagaacgtgtgtgtgtgtgtgtgtgtgtgtgtgtgtgtgtgtgtgtttgcatgtgtgttcgtgtgtttgtgtgtgtttgtgtgtgtgtgtttgtgtgtgtgtgtgtttgctaatcacaatgttaaagaaaatattgggggtaagggttaaagtgttcatgtcctcattgccctgaaaagatactttttattgtttattgtcagtcctaacccatatgcatacttagtgcattttattttcaaatattttaagacatattgaaagctataagtcacagtacagaatgctgtaataggcatccatgtgccccaaccagcttaggaaggaatgaagccacacggcacagtcagggtcccagtacccttcagaccacacttctcccccagccaggctccctctcatgcccatgcatttccttgtccttcattaaataggggtgtgtaactcaagcgttttaacattggctcaatactaggtttcagagtcatgtgggtatgtgtaaccaatgtgctgttactcctatacggtatttcattgtataagtgtttcacaacatatgtatccagtctcctattgaagagatttagggccaggtgcgatggtcacacctgtaatcccagcactttgggaggctgaggcaggtggatcacaaggtcaggagttcaagaccaacccagccaagatggtaaaaccccgtctctactaaaaccacaaaaattagccgggcatggtggcgggcgcctgtagtcccagccactcgggaggctgaggcagcgaattgcttcagcctgcaaggcggaggttgcagtgagccgagatcgcaccactgcactacagcttgggcaacagagcgagactctgtctcaaaaaaaaagggagatttaggttgttttttttactatcacaaacagtactgccataagtatttctgtgcctggtcccttgtgtgtgggcagaatctcaccaagatgtatgcctagagactacaggtacaagctgtgtgcatctctgcctttcccagatacatgctccctcagcaccatatgagtactctggaagctccatgtcttcaacacctgatagtttcaggctctaactcttgctgatctaatagaagtgaaattatatcttgttgggggtttaatttgcatttcacaattactagtggtttattggccattctgtttgtgtccccaaatttgtcaattgcctgttaatgtcttttgcccatttttctactgtgttgcttgtctcctgactcatttgtaagtgtttttatatttccttggtcataattgctggtgggttataaatgttgtaaatattgtttcccagtctgtagcttgtctttgtacttttttctgtgttttggattaagttttccattttaacgcggtcacattcatcagtctttgccttggtagttgatgcttttcatctcacaatatattactttaaaaatcttagccaagcacagtggcttgaacctgtaatcccagctactacagaggctgaggtgggaggatcacttgaggccaggagttcaagaccaccctaggcaacagagtgagaccctgtctctaaaaaaataaaataaacttttaacttaaaaagagagatgattttccttcctgtgtataggaaacaattgaagatgttgaagaaatgctcaacaaccttcctggtgtgacatcggttcacagtcgtttctatgatctctccagtaaatactatcaaacaatcggaaaccacgcgtcctactacaaagatgctctgcggtttttgggctgtgttgacatcaaggatctaccaggtaacctaggccattaaatccatgtcacacaggagcatattctccaaacttagcatctgtgagttgcttgaggtgacagttctcagaaattactaaggtggggctgggcacggtggctcacgcctgtaatcccagcactttggaaggctgaagtgagtggatcacctgaggtcaggagttcgagaccagcctggccaacatggtgaaaccctgtctctactaaaaatacaaaaaactagccaggtgtgatggtgggtgcctgtaatcccagttactcaggagtctgaggcaggagaatcacttgaactcgggaggtggaggttgcagtgagccaagattgtaccactgcaccccagcctgggtgacagagcgagactccatctcatccaaacaaaaaagaaattactcagatggattcatcctgttttgaagaaaaaaatgggaagatttgtgtaacctttagtttctacattatatttgtctccagcatttaatttacatgaaaatgaggctaattcctcctcgctccttcactgtcccttctccagtccctcactgttacctaagccacaggtatttgtaggaagcaccatgacgccaacaccttctgagccctccccgcccacccctctgctgcagaataaagggcacgtgaaatccctgtagctgagacccttgttttgaaaactgaaattccagacccatggggacaaattattaaatctttcaaggatttgagagtggaaagaaaatgacctgtgagttttggaaaaagtgtaaggaatatatgttcagaaaataaattttcagcatattttagatgtttctcacaaaacactgttgaagctaaggagaccagcaactcttaacagtgttgatgcagtttttattactgtatgtcaagaaaaatatatcggaaaaggaactaaggtggtcaagagaacaatagacttgctgtctaggaacagaaagtaagttagttctggtctgaaaagaagctaggttaggtaacttaaatttattccttgccatagcagaaaagagatttaaggcacttcctggaagtggcacagctgaaaatatgaatagattcacatatatttaggaaaaaataaatgaatgctcctcccaaaaaacccatgtatatatggttcttggtataatctaagtcaacccaatacttcagaagaggtgactaatgtcaaggctttgtaataacaaccattacaaacaatgtttttttactttttgttatatgagatttttaaagctaaacaggactgattattatgactggattgtaagtgggcctgtgttgctaccatagtgtctgagcagcaggagagagccttcacgctggggctagcaggacttctcggcgagggagtttttaactttggagaactcgtaagttgaccctgagctcagcttccttaacgagagagactaaagtgttactagctgaccatctccatcctcacagctcatgcaccctgtgctggagtccctgaggaatactgaccggcagtggctgattgacaccctctatgccttcaacagtggcaacgtagagcggttccagactctgaagactgcctggggccagcaggtaggactcccacgatgcccagcccttattcccccatgtatctactcgctcatacaacagatgttcattgagcgtcttccctaggcacacaggaaagaacagggcaaagaggagaccaagataggctagtccttgctctcatagagcagagagttaagtggttggttagctacagcattactcagtgctgcagacaaagagtgagggtgttctgagaaaacagaatcgaatgtgggccctgcatctacgctgggtggagggggtgtcacagaagatgtagaagtcatagtgacctaaggtctgtgtgaccttaggaatgagtgaagaggtacgggaagagtgcactcagcggagaaaacggaaaagtttagtatctttgctgaactgaaagagggatgtgtgaggct

SEQ ID NO: 63707 - DNA, 1490 bp, Homo sapiens
gtccatgggggtgtgtcaggctatcttgtcttacacacgcctccctctctgcacaggtggagcttctggtgatgaaggccctttcggtggggctggtgaaaggcagtatagacgaggtggacaaacgagtccacatgacctgggtgcagccccgagtgttggatttgcaacaggtgatgtgtttgaaacccattattcacctctgtggattttgaggggttgtgtctataccgtcttagtttcatttggatggaagccatttgggaagacagcattattagacaagaggttttggagaaggaaatactgctgttgggtttttctaagagcctaatttaatgcaagcctagggtttgaaccctgcatttaaaagcttatgatgacaatggcactggttgtgctgacggtgccttttaatcttaagataggagctctgatcagatacgttcctggttctgtgatttgagctcacgtcgctcttacatttgctggaaatgcgatcctgtggatttcctctgtccttgtctgctttctttcatgcaagttttttctaacgttcctgtgaaaagaattaacccggcaagtcccgtcccactcccccagctcagaggtcctttttactagagctgccctagagagttagctggagatgtagagtcaccccatcaggtgctgtgccggccgctcggcctgtgtctcctgcgtgtcttaacgtcccttgtgtccggatttccatttcagatcaagggaatgaaggaccgcctggagttctggtgcacggatgtgaagagcatggagatgctggtggagcaccaggcccatgacatcctcacctagggccccctggttccccgtcgtgtctcctttgactcacctgagagaggcgtttgcagccaatgaagctggctgctcagacggtcgacattgaatttgggtgggggttgggatcctgtctgaagtacagactgttcttgctctaaaaacaggactgtccctgatgggagccaggccacagggaggaggcttctttgtgggtctctcctgcagagggtgggggtctcagggtcttaggtgatacgggagagaaagaacgtgccaggcaggaggccccctgaagtctgtgtactccgaggtggatctccatccccatccacctgtacggacatcttttccgttgcggtttgagaatgttcctataataaacccctctgctttgttcttcttgtggctctgttttcttgggcttagcttccaggccaagcctgtgcctggaggttaaaaagcatgagttggaaccttgggaagacacggtgggggtagccttggcccttctcctccctgcacatacagtagacgggcagaatccagcaccaaggactaacgaagacgctggtcctatctttattgttagtcaagagagacctaggggtatccactcccttctccagccctctcaggtacctgccccgacacaggcatccatccacatc

SEQ ID NO: 63708 - DNA, 1038 bp, Homo sapiens
cgtggagcccggtactggaggccgacgggggtgacggggacgctgagggcacagagcggaggggcatgatggctgctgggcgtggaggtgtcgagagtgactgtgctggggctgctccatcgttgtctgagcctcccggtgctgccgctgtggccgtttctttgatgaggctctcagaggccgagtcattcactgccagcctgaagctgcccatgcgcatattcgggctggagcctctgaggccacacaaacgccggctggggaggcgaagtgtggggctgagcaccagaactccaggagcgtctgggctggagacagaactgggtgggcaggtggggagggcctgcagatctgagtgggcagccgaggaggaacccagaagacgccagcgatggagctctgccggggcggaatgtggccaggaggggcgggagcagtgacggcctgtccggcgctagaacgagggaccgtgctctcaggacctctggatgttcccgagtatcctgatgttccacccagaagccgccagggccatcctggagtaccgcatccgcacgctggacggggccctggagaacgcccagaacctgggctaccaggtgaggggacctggggcactggcccgtagggccctgcagggcctgcagcccccacacccctcccaggcctgtatccctctccccaggccccctctggacaaagctgggacatcctagattccccaccctgaggcttgtggggcctcagcagtgccctgcagcccgcacctgagagagaggaggtgggaaccgcagcgggctgggaccctgctttggcccaggaccccctggggtgcccttgctgccctgcaccagggtcagcactcggtgagaactgggcagaagccacctggccccgtgaggacgtgcagtgggccttctagcagtagcacccgccagggtacctggcgcaggccgagccccccctcctccagggcgagggcacgggaaagttggggggccaccgctcccctccaacaaggtcaagtctgccccctcc

SEQ ID NO: 63709 - DNA, 1454 bp, Homo sapiens
tgatctggggcactagccccaggacactgaccccaggctgctgcccctggggcccaatactgactccccggagcctggccctccttctgtggggcctccatccctgccccatcctgatcctggggccctccagccccaacatgggcacctaaggctgaaccagtcagaccccggggtcttcaccctaacccgagagttcccgggccctaactctgcccccgatcctgcccctccctcctcacactccaggcccctcggttccacgattaaaagtgcctggttccagaaagtgcctcctggcctctttcctgcctagcgtgggggaaggagctgccctagggaccaccaaagccaaatgccacagggccagcccccagagtcagtggcgggagcgccccccgcagctcagcagccctgcttggccccaactgtccccttctctcagccactgggcggcctgtggcttacggggcggaggcccagagtattttagactaagtttgagagcccaggcctttgatctctgctgctctgtggtttagcggcctgtgctccagaacatcatgggtgcgtcccaaccccacgtgtgtccaccccatctctctgtgcgcatgtgtgtgcgtgctcgaagtctgcgtgagagtccgtgcctgtgggtgggctccatctgcggtctggtgtacacctccttcctttctgggtcattctgtctgtccccatgaccctgcgtgcccccttaattctgagaaatcccagtccccacggtggtttccctccctcctgggccagtgagggtggctagaaaggcagggcggggacgatcccatgggtggggctggacacacacacaaacacatgtgggaaggatagcagcttccctttctctctcacacacacacacacacacacaccccaaccaaactatatccagaaaggcagaaaatgggcatgtgtgcaacattctctgagtcccctggtgctgggtgcatgttctcatattattttacctgcgttgtgtaccacagcctccccacacacccaccacagcctggtgatgggagagggccagggacatgcacactgcgaggctgcggggaggccctggggcctcgctgaggccagccattgccgggaggtggtggttaacagcacagtggcccagggttctgagcaccccactccggggcccttcccttcccggggaatcgccgttgcctgcctgctcttcctgggctgtgggcaggaatcttttggtctactcggagccctgggcagcatcccctatctgtgatatgcctgcagccaacggctggcgtggcagggactctgagggcaggcccagccagccctggaggcagaggtgtgtggaggccatgctgggcgctggagacagacaggaccagtcccacagtggaccaaggacaagggcagtgtgcccacctgtgcttgccttg

SEQ ID NO: 63710 - DNA, 1766 bp, Homo sapiens
gggcctggagtgtggaggcgtcagcgcaggcctggcaggagccctgaaccgggacagtgaggtcctgcagctgctggcctggggtgtggagactcccaacacaggggaagtctccaggaccccacaccactaacaagatgagacttgtgctcctttgggctctagagaggaagcccctcttagccctcagcccctctttcctccctctcctaaagtaatttgatcctcaggaatttgttctgcccttatctggccctggccagctctgcatttgacaaatgccaggaagaggaaactgttgagaaaacggaactactggggaaagggagggctcactgagaaccatcccggtaacccgatcaccgctggtcaccatgaaccacattgtgcaaaccttctctcctgtcaacagcggccagcctcccaactacgagatgctcaaggaggagcaggaagtggctatgctgggggtgccccacaaccctgctcccccgatgtccaccgtgatccacatccgcagcgagacctccgtgcctgaccatgtggtctggtccctgttcaacaccctcttcatgaacacctgctgcctgggcttcatagcattcgcgtactccgtgaaggtgcgtatggccctggcggaaatccagggggtgccggtgagcctggggctccacctgcccacatgctgcctggggtggggacttgtgtgtccctgtgactgtgagtttgtgtgcacgtctgtcctgtgtgtgcccacgtcagtggctttgtctgtgtgatctgtgtgtgtgtgtggcttggggaatctgcccagtgcaggtctaggaggaggctccaggaggctggctggctggctcagagtctgtccccggctatccactagcccagagcagttctccctatagcccagtaagaaattacaccttcaccttccagactggcacccaggctctcccagaaagtgagaagggaactcacaggtgacttcaccccatggtggggagaacagcctgtgctggggccaaggcagaaggaggatgagccccgaggctcctggagagtctgagccgggtgaggaaggggaggaggtggtccctgatctcagggcagggaggagacagtgaggagctggagccatagcacgcggctctcagctgggggatcctggtcccctcaccatctcctctcccccagtctagggacaggaagatggttggcgacgtgaccggggcccaggcctatgcctccaccgccaagtgcctgaacatctgggccctgattttgggcatcttcatgaccattctgctcatcatcatcccagtgttggtcgtccaggcccagcgatagatcaggaggcatcattgaggccaggagctctgcccgtgacctgtatcccacgtactctatcttccattcctcgccctgcccccagaggccaggagctctgcccttgacctgtattccacttactccaccttccattcctcgccctgtccccacagccgagtcctgcatcagccctttatcctcacacgcttttctacaatggcattcaataaagtgtatatgtttctggtgctgctgtgacttcacctggggagcggtcctgctggttctgagattaaatgtaatgccaaacgttcttgccttagccacaccaaagaattgggtgtggcggctgcccgcggcgagtgatggagacacagaccaagagaagaaaaaaactgtaggttttattgagcagagtgacagtacaaagcttacac

SEQ ID NO: 63711 - DNA, 1649 bp, Homo sapiens
ccagggccccctaaacccaacacttaggaagtcactagtcctgacttgagtttctgatgaggaagcctctctccttagccttcagcctttcctcccaccctgccataaagtaatttgatcctcaagaagttaaaccacacctcattggtccctggctaattcaccaatttacaaacagcaggaaatagaaacttaagagaaatacacacttctgagaaactgaaacgacaggggaaaggaggtctcactgagcaccgtcccagcatccggacaccacagcggcccttcgctccacgcagaaaaccacacttctcaaaccttcactcaacacttccttccccaaagccagaagatgcacaaggaggaacatgaggtggctgtgctggggccaccccccagcaccatccttccaaggtccaccgtgatcaacatccacagcgagacctccgtgcccgaccatgtcgtctggtccctgttcaacaccctcttcttgaactggtgctgtctgggcttcatagcattcgcctactccgtgaaggtgcgtatggccctggcggaaatccagggggtgccggtgagcctggggctccacctgcccacatgctgcctggggtggggacttgtgtgtccctgtgactgtgagtttgtgtgcacctctgccccgtgtgtgctcacgtcagtagctttgtctgtgtgatctgtgtgtgtgtgtggctttggggaatctgcccagtgcaggtctaggaggaggctccaggaggctggctggctggctcagagtctgtccctggctatccattagcccagagcaattctccctatagcccagtaagaaattacaccctcaccttccagactggcacccaggctctcccagaaagtgagaagggaactcacaggtgacttcaccccatggtggggagaacagcctgtgctggggccaaggcagaaggaggatgagccccgaggctcctggagagtctgagcccgggtgaggaaggggaggaggtggtccctgatctcagggcggggaggagacggagccatagcacgcggctctcagctgggggatcctggtcccctcaccatctcctctcccccagtctagggacaggaagatggttggcgacgtgaccggggcccaggcctatgcctccaccgccaagtgcctgaacatctgggccctgattctgggcatcctcatgaccattggattcatcctgttactggtattcggctctgtgacagtctaccatattatgttacagataatacaggaaaaacggggttactagtagccgcccatagcctgcaacctttgcactccactgtgcaatgctggccctgcacgctggggctgttgcccctgcccccttggtcctgcccctagatacagcagtttatacccacacacctgtctacagtgtcattcaataaagtgcacgtgcttgtgatgatgctgtgacttcatctggagtgggggccctgctgaggggtcccggcctagtcctgagacagcccagtgctcagcccctgcacagccgtatccctcctctgtgaagctctcaggggagcagggatatgctcagaatctgctggtttccgcctcctgctgtgggcagcatctggaccaggaacgtggggtgggc

SEQ ID NO: 63712 - DNA, 2241 bp, Homo sapiens
tcctcccacctcagcctcccaaagtgctgggattacaggcgtgagccgcggcgcccggcagaggtgagggctttgggggaacggttgtggggcctggagtgtggaggcgtcagcgcaggcctggcaggagccctgaaccgggacagtggggtcctgcagctgctggcctggggtgtggagacccccaacacaggggaagtctccaggaccccacaccactaacaagatgagccttgtgctcccttgggctctagagaggaagcccctcttagccctcagcccctctttcctccctctcctaaagtaatttgatcctcaggaatttgttccgccctcatctggccccggccaaatcccgatttgacaaatgccaggaaaaggaaactgttgagaaaccgaaactactggggaaagggagggctcactgagaaccatcccagtaacccgaccgccgctggtcttcgctggacaccatgaatcacactgtccaaaccttcttctctcctgtcaacagtggccagccccccaactatgagatgctcaaggaggagcacgaggtggctgtgctgggggcgccccacaaccctgctcccccgacgtccaccgtgatccacatccgcagcgagacctccgtgcccgaccatgtcgtctggtccctgttcaacaccctcttcatgaacccctgctgcctgggcttcatagcattcgcctactccgtgaaggtgcgtatggccccagggaatgctcagagggtgccgctgagcctggagctccacctgcccacatgctgcctggggtggggacttgtgtgtccctgtgactgtgagtttgtgtgcacctctgtcccgtgtgtgcccacgtcagtggctttgtctgtgtgatctgtgtgtgtgtgtggcttggggaatctgcccagtgcaggtttaggaggaggctccaggaggctggctggctggctcagagtctgtccccggctatccactagcccagagcagttctccctatagcccagtaagaaattacaccttcaccttccagactggcacccaggctctcccagaaagtgagaagggaactcacaggtgacttcaccccatggtggggagaacagcctgtgctgaggtcaaggcagaaggaggatgagccccgaggctcctggagagtctgagcccgggtgaggaaggggaggaggtggtccctgatctcagggcggggagagccaatgaggagacggagccatagcacgcggctctcagctgggggatcctggtcccctcaccatctcctctcccccagtctagggacaggaagatggttggcgacgtgaccggggcccaggcctatgcctccaccgccaagtgcctgaacatctgggccctgattctgggcatcctcatgaccattctgctcatcgtcatcccagtgctgatcttccaggcctatggatagatcaggaggcatcactgaggccaggagctctgcccatgacctgtatcccacgtactccaacttccattcctcgccctgcccccggagccgagtcctgtatcagccctttatcctcacacgcttttctacaatggcattcaataaagtgcacgtgtttctggtgctgctgcgacttcacctggggaggggtctggctgagggttcggagcgtggttctgagactgagcaggttggtcagcccctgcactgccccttccggcctctgtgcatctcttggggaccgggcaagtgctcaggccttctggtttcgggcctcctgccgtgagcagcagctggatccaggaccctgggaggagttcctgtgtcctgcaggtctcagctcctactcaacgtgggctctttccgggaacgtcagtgctgagtccgggacaccctgggcccaaggccacgctcgcggcctgtcggcaatccaggctgtcggctcaggacagagggaagggttaagcccccagcagggccagggaggggcaaggtggcaccggctccccagctgctcccaggccctgctctgtggtgctggggacctggctttagttcctcggggtggagggggcaccgcgctgcctgcctccgagctgtctggagcagccagtcctgcagatgtgggcagctcagggcccgtgggagggagggggctttgtgcccagggcagcagctgaaggagccccgggcctcgcagcccctcctgggtgaccaggtgctgcttcgtggcagctgccccctcccgtccag

SEQ ID NO: 63713 - DNA, 1126 bp, Homo sapiens
gtgtctgagtgtatgtgccaggtgccacaggtcagggtttgcatggctggggctcacgggcatttagggctgtgtggatacatgttggaaggggtctttgtgaaggtttgtcttggtgtgtgtgacctcctccctgcccttccaaccctgaccctgttgccttttctctcctgcagcccgaaggtcgggacctagacatgctgtttcctgggggggctgggaggctgccactgaacttcacccatcagacacccccatggcgggaggaggtgagctggctcggcctgtaatgggctgggaggcagggcgggggctggggcgggggggcggcgggccgtgcagaaggtaaggcccccccatccccagtacaaggggcaggtgaacctgcacgtgtttgaggactggtgtgggggcgccgtgggccacctgaggaggaacctgcacttcccgctgttccctcatgtgagtgccggggttggggggtgccgggtgggcagggcacgcagggggcttcgacagcaacagtcactgcccccccagacgcgcaccaccgtgaagaagttggccgtgtcccccaagtggaagaactatggactccgtatttttggtttcatccacccggcgagggacggtacgggggtgagggtgccccgggggaggggtgccgtgaggctccacccccctgagcctagtcttgtggactaggagacgtccagttttctgtggcctcagacgacaactcggagttctggctgagtctggacgagagccctgctgctgcccagcttgtggcctttgtgggcaaggtacccccaccccagccctggtgtcgtcccgggcctcctgcagctcagtcacctgtgcccaccagcctcttgggaatgaggacccgatgggtttggtgtccccagggagagagtgaacccccccccccaccaccacccctgctctatcaccccccagactggctccgagtggacagcgcctggagaattcaccaagttcagctcccaggtgtccaagcccaggcggtgagtgactgtggggtgcatgtgcgtgcacttgtgtattcgtgggagggggttacgcgctgtctccttatcctgtgcacacttgcgcacactct

SEQ ID NO: 63714 - DNA, 2892 bp, Homo sapiens
gaggaagggagggaggaggaaaggtgaggaagggagcatggtggggtctggccctgctcccagggtccctcagctttctgggcttccttccccagcttccctgctgccccttcttggaacgccccggacccctctgccatctcctctcctgcatcctttaagggattggtcctattagtcccccggccctgagccagggtagaccctttcttccctggacccagccaccgccctgtccctgacccccaccctctctgccccgcagtggcgagctttcctgcccggcctgaagttcgaggtcatcagctctgctcacatctccctgtacacaggtgcgagcggacgcctctggggatgtggggctcctcgggatgggctctgggtgtgagtgggaagagtggaggagggggtctgagcactccctggaactcttctgcccccagatgagtcagccttgaagatggaccacgtggcgcacgtcccccagtctccagccagccacgtgggggggcgtccgccgcaggaggagaccagcgcagacatgctgcggccagatcccagggatacctttttcctcagtgagagggggcccgcgcgggggcgagggcgggggtgcctgccccagccaccctgtgaccgcacctcctgcagctccacgcatggaatcttcgagcctggagaacgtgctggagccctgcgcctacgcccccacctacgtggtcaaggacttcccgatcgccagataccagggcctgcaatttgtgagtgcggctggagaccccgtctcccgtccgggactccgcggagccttctccagccccttgggaggccgccccgggaggtccgcgccctgagccctgcgcccccccaccccccaggtgtacctgtccttcgtttatcccaacgactacactcgcctcacccacatggagacggacaacaagtgcttctaccgcgagtctccgctgtatctggagaggtgggcgcgcggccgggctaatgcggggcggggtgggcggggcgggactcggctctgatgccccgccgcgccccaggtttgggttctataaatacatgaagatggacaaggaggagggggatgaggatgaagaagacgaggtgcagcgccgagccttcctcttcctcaacccggacggtgagtgtccgcagcgcccctggcccgcacccacctgcgcagggagcttctaacccgcgtttcccgcagacttcctggacgacgaggacgagggggagctgctcgacagcctggagcccaccgaggcggccccgcccaggagcggcccccagtcccccgccccagcagcccccgcccagcccggagccaccctcgccccgccgacccctccccgcccccgggacggggggacccccaggcactcccgggccctgagctgggccgccagggccgcccgccctttgccgctcttcttgggccgagctccgcccccgcgccctgcagtggagcagccgcccccaaaggtgtacgtgaccagggtgcggccgggacagcgggcatccccccgggccccagcgccgcgtgcgccctggccgcccttccctggcgtcttcctgcaccccaggcctctgcccagagtgcagctgcgggcgcccccacgcccaccccggccccacggccgcaggaccggcggcccccaggccacacagccgaggcccccagcccgggcgcaggccacccaagggggccgggagggccaggcgcgcacgctgggacctgcggcgcccacagtggactcaaacttgtcctccgaagcgcggcccgtgacctccttcctgagcttgtcccaggtgtccgggccgcagctgcccggggagggcgaagaggaggaggaaggggaggacgatggggccccgggcgacgaggccgcgtcggaggacagcgaggaggccgcgggcccggcgctcggacgctggcgtgaggacgccatcgactggcagcgcacgttcagcgtgggcgccgtggacttcgagctgctgcgctcggactggaacgacctgcgatgcaacgtttcggggaacctgcagctgccggaggcggaggccgtggacgtgaccgctcagtacatggagcggctgaacgcgcgccacggcgggtatgggggcggccgaacgcgcgccagggcggttttggaggcggggacagccggggagaggaggtcctggccttggcggactcctcagaccttccccagggcccagtggtgtaccggcctgggggctgaggcaccgcgccccaccccagggaagccccagcttctctccttccttcctggcgtcctgactgcccgggcacttgtccagcctcagggacctccctggagccccacccagggctggcgccccatccttgcacctgtgtaccccacttctgtcatcctggacctgggcccagggatgagtccaagctgcagagatcagcgtcagtcgcatccagttgctgcgcagacagccccattccgggggggccaggcagagacccttagggcaaagctcaagacccctgggcccctcctcctctcccctcgcagtgcccctgggcgttcccagactgtcaggacccgactgcagaggaaggtgcagggcttctgccccattggcccctctggtctccctgaggccccaggaatctagtgctgtctgccctccctgcaggctggtgggcaggagtggggagtctaatttggccttggggaggcctgtggagttctaagaagaggcagtgtctgctgtgcccagccttgaaggcgagttaggagttgcacagtgatgacaggcagaggcaggggcagaggatggaggcagaaccgggactgtttctcctgtgcgtgatggaaggttgcgagcagagcaaag

SEQ ID NO: 63715 - DNA, 1050 bp, Homo sapiens
tgccggccactgcgcctggcctggcgccaggacgtgatggttcacttcatcgtgccaggttcgcagggcgggctcggggtgtccgggagacctcgtggaaggaacatggaccctaatgactaggaaagggtgtgggtgtccgggatgaagttcttcggagctgggaggccccaccgtagagtcagcgtcggctcagcgccccccccgccttttctcctccagtgaaaaaccaggcacggtgggtggcacagttcctggcggacatggctgcgctgcacgcgcgcaccggggactcgcgtttcagcgtcgtcctggtggatttcgagagcgaggatatggacgtggagcgggccctgcgcgccgcgcgcctgccccggtaacgacccctacttccacctgggcggacccagcgcagctttcctccccgggagatgggttttcctgaccccacccccagagatcgtgcctgtgactcgccctccccaggtaccagtacctgagacgaaccgggaacttcgagcgctccgccgggctgcaggcgggagtggacgcggtagaggtccgagggccccatgggggtcggggagcaaaacggggcgtgcccggggaggagcggagggcggggctcagacctcccgcaccccccaggacgccagcagcatcgtgttcctctgcgacctgcacatccacttcccacccaacatcctggacggcatccgcaagcactgcgtggagggcaggctggccttcgcgcccgtggtcatgcgcctgagctgcgggagctcgccccgggacccccacggtgaggccccgagcgtcccaccctgtgataccagggttcccaccaaccgccgcggtaaagtccaggaacccggggcctctctcaattcccaggggaggcctgggagtccatcagtgctccccgtagtgcccagagccccagtccccccgcaccagcacacccagggccatgccaggggccccaggaacctcctccagtatcccgcgtttatgcaccgcgctccagggtcatgacccagtaccaccgga

SEQ ID NO: 63716 - DNA, 1248 bp, Homo sapiens
tcaagtgccgtctcaacgtgctgctctggtaccaggacgcgtatggggaggtggagataaacggtgcgtggggcccgcgtgggcgcgaggaggggtcgccacggcctccctgagagtgcgctgctgagctcggctttggaggcgtgcggcggggaggggttagcccccgggtgctctgtgcggcccggctggggttaaagtccggggcgggtctgcccctgtgcacgtgggagatggttaggggtgttggggaccccgagggctggtgtgaggcctcgggagccatcggggtgactggccgccgtccgcagacgggaagctctacgacgcctacgtctcctacagcgactgccccgaggaccgcaagttcgtgaacttcatcctaaagccgcagctggagcggcgtcggggctacaagctcttcctggacgaccgcgacctcctgccgcgcgctggtatcccgggccccaccccgtgccccgcccacccggagggcccgccccgccccgccccatgctccgtcccacccggggccccacccccaccatcgagctccgcccccatccccgcccacccgaggccccgcctcaaaaacccgcccaccccgcaggccccgcccctcccttagagctctgcgtccggcaccgcccctgagcctccggccccgccctcccccgcccccgcccctgcgccgccgacgcccgccctcccgcagagccctccgccgacctcttggtgaacctgagccgctgccgacgcctcatcgtggtgctttcggacgccttcctgagccgggcctggtgcagccacagcttccggtgggtcccgcgcggggttgggtgggccccagcgtagcacccacccccctgacggtcccgccccgcagggagggcctgtgccggctgctggagctcacccgcagacccatcttcatcaccttcgagggccagaggcgcgaccccgcgcacccggcgctccgcctgctgcgccagcaccgccacctggtgaccttgctgctctggaggcccggctccgtggtgcggagcaggcgcgggagggtccggggctagcggcgggttagagatgggcggtgcccgggctccaggctgggacccctccgtggggagctctgcggcaccacgctttgtgaatgggccctggggggaggttccgctgcctggggccccgatgcggggagccgcccttgaggcccccggagccacggaatagctgtcgcagggcgtggaa

SEQ ID NO: 63717 - DNA, 1065 bp, Homo sapiens
aagggggcgctgccctcccaccccagcctgaagggaaggtccacaagatgccatagtcccttgtaactgctcacccatcgggggagctatgtctgggagagggacggggagagggcggaagagttctgctggagccccattgttgaccgggagtttctgaaggccctgttccccggggtcagaggtcaaagacacatgggggagcaaaccggccccttggctcctgagtgtgagctctagtagcgtctggaaggcatgccgcgcggtccccggtcctccttgtatgtgtgcagggtggccctggcgggggtctcctggctggaggaccccccatgcattacccctggaacctgcccctttgagcaccccccaccccacaacacacacgcacacacacaaacgcacgcacacgcacatactgcacacacattgcacacacgcagacacactgcacacacacacacacacacacacacacacacacacacacacacgctgcacagaggaaagtgccgtgcctgggtgggttggggcgggctccagaggaaggagccgcttgactcagagctacaggaagagccggggcaggcggggtgagaaccaccaactgcccgtcctcccgcccgcctagggaaggggtgggtgcctgggtggggtttagggttaggagaggatgtgactgcaaggccaggaagctacagggaaagttctgatcaaaatacacaaagacacaagccaggtccccaccgcgcttggcgatgcatccatagcagccttggtgctgtggacactccctggggcccagcgaaggggagagtttgctcccaaaggcgcaccaatgaccaacatttgccccccggaggaaagaactggaaccaggtgactgccttccccgctgctctgagtgagcctgtgtcagggcctggctgagaggaggcccacggcgcccaagacccatatgcatgtgtgtgcatgtgtgtgtgagacagagcgaggggcagcaggaggctgtgtcgcatcagcggccaagggtgggtgtcaggtgcagtgtgtgtgctgtggggt

SEQ ID NO: 63718 - DNA, 1144 bp, Homo sapiens
cctgtgtgtgtgtgtgtgcgcccacgtgcaggtgcggttcgtctgggagcctgtggcctcccctgtgtgggggtgtgtgtgtgtgtgcgcgcgcccacgtgtgggtgcggttcatctgggagcctgtggcctcccctgtgtgtgtgtgggtgtgtgtgcgcccacgtgcaggtgcggttcgtctgggagcctgtggcctcccctgtgtgggggtgtgtgtgtgtgtgcgcgcgcccacgtgtgggtgcggttcatctgggagcctgtggcctcccctgtgtgtgtgtgtgtgtgtgtgcgtgcccacgtgcgggtgcggttcatctgggtgtgagcacctgtgccccgctcacctgcagggcctgccccgcctgttctgtgtctttcctacccgcttctgtcctgctgcacccaccctgtcagaggcagggcgctgcccgcagtgccccagacttccccttcctccccaggatcaacggccaccccgggaagtccacgcgcctggcgggcttgtggaagctggaagaggtcagtcacccccaggcttcatgccctgtccctgagccactgctcccctgaccgtcccccaggacccctccctgatctcctcctgtctggccccgcagtgccacgccagcggctgcatgatggacctcttcgtgcagatggccatcatcatgggcctgaagcagacgctcagcaactgcgtcgagtacctggtcccgtgagtgccgacccccgcccagccccgggagccccaggcccctccgccccctgcgccctccctgccacgcagctctccccgcaggtgggtgacccacaagtgccgctctctgcgggcctccgagtccgggcacctgccccgggaccccgagctcagggactggcggcgcaactaccttctgaacccggtcaacaccttcagcctgttcgacgagttcatggagatgagtgcgtgggcgctgcggggcgggggttcgcggagacgaatgcggggcgggggtccgcggacatgagtgcggggcgccggtgagcctgacccccaccgcgcagtgatccagtacggcttcaccaccatcttcgtggccgccttcccgctggcgccgctgctcgcgctcttcagcaacctcgtggagatccgcct

SEQ ID NO: 63719 - DNA, 1055 bp, Homo sapiens
cacaccctcacagatgcccccacgcccacagatgtgcttcccattcagactcactgatgccaccaaaagagagaccccctcccccacccccctcccaccctgtccctcccccactgccccctccctcccccatccctcccctgccttgccctcccaccctcatccctccccgtccctctcctgtccctcccccgccaccccttcccaccccgtccctcccccatccctcccctgctgccccctcccacccccatccctttcctgtccctcccccaccgccccctgacagctggccttgacccctgctgcctgcaggaactactttggggaaaaggtggccctgtacttcgtctggctgggctggtacacctacatgctggtgccggccgccctgacgggcctcttagtctttctgagcggattctcgctgtttgaggccagccagatcaggtgggccgcagcaggggccgggcatggggggccggggtgggccctgctgcctggaggagccgaccccagcctcatccctgccccttcagcaaggagatctgtgaggcccacgacatcctcatgtgtcccctcggcgaccacagccgcaggtaccagcggctctcggaaacctgcacttttgccaaggtttgtcgcctccgggtccaccccagggcctgcggaagatgggaacggtgcatccacccgaagcgggggagatcaaggcctggagccctgcagagctgctcagctttccccacagggctgacggggaggcccagccccagcccacccgcccatttcctcagcccacctgcccccttccccggctttcctgcctccctccctggctcacctgcccccctccccagctcacccacctcctctccggcccacctatcacccccccagctcacccacctctttgacaatgatggcacggtggtgttcgccatcttcatggctctctggggtgagttgctgcgggacgcctctgcggggccaggggaagtgccagcccaagctccgaggtccacctggcgtagtgcagtgatgcccctccttgc

SEQ ID NO: 63720 - DNA, 1050 bp, Homo sapiens
ctggacacctgtgagcccagctactcgggaggctgaggcaggagaatcacttgaacctggaggtgaaggttgcagtgagctgagattgcaccactgcactccagcctgggcgacagactccatctaaaaaaaaaaggtatccaccaaaaacctactccaaacttaacggcgcaagtttagaagcatcactcgtaaacacaaggcagggatgtgtgctgactgcttctgtgcaacaatttatgggcaaaagatttgagtactggaatggaaaaaatgaagaaaaaaaattcacttttcagagagaaattgtgcctaattctgagttacagctttctttataaaggctctcccaggggcctgtgaagggcccagaagagacactgggtgtgaaggagccaggagccggcctggggctgagcggggccgtggaggcctggaccgggcgcactaacgttctgtcgtctgtctttgtagcttactggaggttttggctctgcgtgagtgtggtctacgagctgtttctcatctttatactcttccaggtaagctgtttttctgggttggatacctgggaacttaggtgacagtgtggccccaggcatggtgacaaaggaggccttgcccacacagccctcgagtgatgggaggaagcagggctagacccccacaaagtaggccgagctgcggggggtctccaggagcatctgtgcggcccttgagtgatggggggcagcaaagctagaccttcaaaacgtaggccgagctgcggggggcctccaggagcatctgctggtggggcgctgactgtggccatttagcagggccacacttaaggagggcagggccagtggtgcaggcacagaagagggcagggccagtggtgcagctgccagggtggctttgcccacagctgtcgtatctgagtgctggtggggactgggcgtgaagggagccgcaagtcaggtcctgcgatgcaggccagcgtctgcatggccggggcaaatctgggcctcagaggggaccccagcgccaagagggacggggtctttg

SEQ ID NO: 63721 - DNA, 1029 bp, Homo sapiens
gtgactgagatgcagtttacaaccatgatctcctggccgggcgtggtggctcacggctgtaatcccagctctttgggaggccgaagtgggcggatcacgaggtcaggagatcaagaccatcctggctagcacggtgaaaccccgtctctactaaaaatacaaaaaaaaaatactagccgggcgtggtggcgggcgcctgtagtcccagctactcgggaggctgaggcaggagaatggcgtgaacccaggaggcggagcttgcagtgagcccagttcacgccactgcattccagcctgggcgacagagcgagactccatctcaaaaaaataaaataaataaacaaccatgatctcccgtttcaagttgccaccactaactgtagccccgctgacgggggcactggccttgcagactgtccaggacggccggcagtttctaaagtatgttgaccccaagctgggagtcccactgccagagagagactacgggggaaactgcctcatctacgacccagacaatgagactgacccctttcacaacatctgggtaagacgccgggggccctgaggcgagcccctccccaggtgtggccccgtgccggaccaggcgccatccacgctcctgcctcgcacccctcagcccacacttggggtctcctggtgcagagatgtgctgaggccctgtccgtctggatggtgctcatggtgggcagggggcccctgctctctaggctgtcgtggacgtggtctccacaggccacggcagcacctgtgagtccctggccttcttcccggggtctggcaggtgctgctcaggtgtgggctgatctgccggtgtggggagtgggggtggctgtgccccagggtcaagggtcataccctgtcgcccacaggacaagttggatggctttgttcccgcgcactttcttggctggtacctgaaggtacggcacctcctcttcccggcctccccgccccggttctgaggcctgccgtgggctctggaccgtttctgtccatggagttgag

SEQ ID NO: 63722 - DNA, 1139 bp, Homo sapiens
ctgcccaacttcagcgagtgctggtgggatcacgtaggtgccagcacagcccccggggcagtcggtgcaggctgaggggcattctcggaacccctgtgcccagcgcggcccctggaccccctcattctccccggggggcagtgggtgcaggctgaggggcattctcggttcccctgtgctcttccggggtcctcctcggggggctcgttacccctcacccctgcaacgagtgctggcccctccctgcagtggatcatggacgtgctcgtctgcaacgggctgggcatctactgcggcatgaagacccttgagtggctgtccctgaagacgtacaagtggcagggcctctggaacattccgacctacaagtacgtcgtgggggctgcgagggcagggccgggtgggggttacctggaggcagcctcagcgtccgtgctccagcagaccccgagcaccaggcccgtccagtgtgcggctcaggaggggtgaccgtggggctttgcctcctggaacctccctctgacctggtgtcactcaagcccggccgcccctcacagtggccatggcgtctgacccacgtacctccctcctcaatccctggccggcctggcgcaggggctgtgggatcattccgtgcttctccctcccttggttgctttggttatgaaatagttgcaggtactttgtcattatgactttggaatttaaaaaagaaacagaagtctaaggaaaggcctgggggacgggggtctcccctcctgcctgtgggtgccccggctctgcctggctctgcagacatggctagctcacggcaccgtggagcgccctctgaggcgctgcagccactgctcaagctggaagagactgaacagcagagggccgtggagaagcagggcttgtagctgggtggccagacctcggagaacagccgggcagcagctgggtaaccaggaacagagtctgtggcccgatggcacagggcggggcggggtgaccaagagcagagctcgtccgatggcacagggcggggccgggtgaccaggaacagtctgttgcccgatggcacagggcagggttcggtgggctgccttcctcaggctgccggctctgtggttcccaggggcaagatgaagaggatc

SEQ ID NO: 63723 - DNA, 2264 bp, Homo sapiens
agttcacgccgtacagctgggttcgcttcgagtggaagccggcctccagcctgcgtcgctggctggccgtgtgcggcatcatcctggtggtaaggccgggctgcctcgcgacggcgcggcgggcggggggccagagctggtgctcaccctctcctcccctagttcctgttggcagaactgaacacgttctacctgaagtttgtgctgtggatgcccccggagcactacctggtcctcctgcggctcgtcttcttcgtgaacgtgggtggcgtggccatgcgtgagatctacgacttcatggatgacccgtgagggctgcggcagtccgggtggagacacccccggggggcaggggccggagggctggggagcagagcctgggaggccggagcctgggcaagtccgcctggaggaccctgcggggcccgggacgctgaaccccctgctgcccctgcaggaagccccacaagaagctgggcccgcaggcctggctggtggcggccatcacggccacggagctgctcatcgtggtgaagtacgacccccacacgctcaccctgtccctgcccttctacatctcccagtgctggaccctcggctccgtcctggcgctcacctggaccgtctggcgcttcttcctgcggtgagtcagggcagggcgcgtatgttctgaaggagggccgctgtccgggtcccttggcacaggcactgtgggagtttggtgtcgttggtgtctcactgtccctgcttcaaccctctggccgcctctgcgggaggcgcctttcctgacccagccctcggggccttcgctctgcactgacagatccaggctcctcagggctccagtctgccacggctgccgtcccagggccagggtacccggcacccacccagtccattccggacctccacagggactaggtgccagctgtccatggggcctgcagtggggctggtgtgggggcaggtggtgacgctgcatcccgctccccagggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgcgtgtgtacgcgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggcctctggcccaccaagctccctgtcacccagccatggtgtggtccaggcagggacatctcggtaccctttctgcactccgtgggccctgggtgcgctgaggcctggaggcgtctacactggctccacatccacttcccccgcagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttccagccctccccccagctccccgtgtcctgctttggggtccagtgcagccctccagcctgccctcatgcccagtgcccacttggggaaaaccacacagaggacaggaggcactcagcctctgcacctgagcaaagacttggcgcctgccccgccccaccccccagagagagcaggtgccagatgcagcccctctcccattctccaggagggtccaggtggcacccaccctctgctgcgcttgtccaagggctggcggccactgggcagtggacacaggattcctggggtactgtgtttgtcccag

SEQ ID NO: 63724 - DNA, 1118 bp, Homo sapiens
aggggcccaggctggcccacagctgcgactggcccttcccctgaaggccccacgtggacctgagcaaaaacatctgacagcctcccagcaagtgggcacctacacctggtccttggccccaagcactgttcccatcaaaccacaggctgctccctggcctatgcattctgaaggtcggagctgagcccagcagcttccctggagtcgctcactcctcccctggtctcctcggtcaccctggccctctcttgggcgacagggccctgccccgacagccacactcaccacagcgactccagctggcagccaggttccagcagggtctcacacagcagtcgggcaccctcatcccccagctcgttgccggccaggctgagctccttcaggctctccttggccctgaggacacggcacagatccccgcagcccttggcagtgatgccacactcccagatcctgcaggacatggaccaccacagactttcctcagcaccgtctcatggcctgagatgagcccaggggcgggggagagctctgaggacggcccgccgcccgaccctccgggaaggaggcctcgcggagatgactcaccacagggtcctgagcctggagctggggtggagcagccctgggcacagctccgccatgcccacatcacccagcttgttgctgcccagggccagctcccgcagcgaggccttggaggccacaatgccgcacaggtcccggcagttgtctgatgtcacaccgcagctctccagcctggggacacgggtcacacgtgaggcagcacgggaccccccctagcccacaccccgcacccccccaaggcccagtgcctacttgagcgcctccagctggcagggggagtccttcaggccctggcacagcacacggacgccagcctcattgatgtcgttgttgctaaccgtgagctccttgaagtccggcttggccctgagcacggaggccaggggctcgcagctggcagccgagaggctgcaatactccagcctgggggacagcagagctcagcaccacacaggaatgtgcaccagccaagggtgtgataccagggagcacggggtgtgctggtgtctcatctcccctcagtcttc

SEQ ID NO: 63725 - DNA, 1030 bp, Homo sapiens
cagaagactgaggggagatgagacaccagcacaccccgtgctccctggtatcacacccttggctggtgcacattcctgtgtggtgctgagctctgctgtcccccaggctggagtattgcagcctctcggctgccagctgcgagcccctggcctccgtgctcagggccaagccggacttcaaggagctcacggttagcaacaacgacatcaatgaggctggcgtccgtgtgctgtgccagggcctgaaggactccccctgccagctggaggcgctcaagtaggcactgggccttgggggggtgcggggtgtgggctagggggggtcccgtgctgcctcacgtgtgacccgtgtccccaggctggagagctgcggtgtgacatcagacaactgccgggacctgtgcggcattgtggcctccaaggcctcgctgcgggagctggccctgggcagcaacaagctgggtgatgtgggcatggcggagctgtgcccagggctgctccaccccagctccaggctcaggaccctgtggtgagtcatctccgcgaggcctccttcccggagggtcgggcggcgggccgtcctcagagctctcccccgcccctgggctcatctcaggccatgagacggtgctgaggaaagtctgtggtggtccatgtcctgcaggatctgggagtgtggcatcactgccaagggctgcggggatctgtgccgtgtcctcagggccaaggagagcctgaaggagctcagcctggccggcaacgagctgggggatgagggtgcccgactgctgtgtgagaccctgctggaacctggctgccagctggagtcgctgtggtgagtgtggctgtcggggcagggccctgtcgcccaagagagggccagggtgaccgaggagaccaggggaggagtgagcgactccagggaagctgctgggctcagctccgaccttcagaatgcataggccagggagcagcctgtggtttgatgggaacagtgcttggggccaaggaccaggtgtaggtgcccact

SEQ ID NO: 63726 - DNA, 1040 bp, Homo sapiens
tcacccaggctggagtggctccctcatggcttatgcggcctcaacctcctgggctcaagtgatcctcctgcctcagcctcccgagtagctgggattatgggcatgcgccaccacgcccggctacttttgtatttttagtaaagacggggtttctccatgttggtcaggttggtcttgaactcccgacctcaggtgatctgcctgcctcggcctcccaaagtgctgggattacaggcgtgagccaccgcgcctggccacgtgcgagcatcttaaacaaaactttcatggaacagttcctcctttttgtttcatttctgaaatgtcttgtgtgacttgccttgctgtcttctgggcccactgataggttgtaacctgcacgtggggtggtggtggaggctgaggccagtgctgtctgcgtggtccacatgaccctggggtctgctcacaggctggacgactgtggcctcacggaagcacggtgcaaggacatcagctctgcacttcgagtcaaccctgcactggcagagctcaacctgcgcagcaacgagctgggcgatgtcggcgtgcattgcgtgctccagggcctgcagaccccctcctgcaagatccagaagctgaggtgaggcggggcctggcactgcctctggcctggtgcagtctgctttggtagcccggcagcaggggacagagccgccaggggcgcgtgggcagctgcaggtggacaggcagtggcagcagacatttccaacatcagccagaggcacacaggcctggcggtctcacagcgggggggacagggcccttcctgccttatcccagcccccgcacccaagatctggccctgcccgccatccctagccttccagcatcaccacagacccccactgaaaggtgtgtctgcagacaaggtttccctgggtcgagccacatgcgtgccctccttcactcggcctggagaccccagaccccagagccccgtccagggaaggagcaggtatagacctgccgcctgaagagtgctgctccgggctctgggctct

SEQ ID NO: 63727 - DNA, 1062 bp, Homo sapiens
gtctgcctgtcctgagggtgagacacaggtcaagcccacagacccccttgctcccctgctggggcctccaggctcacagaccaccccaccctaccctgtccttgcccaagcaaatgagaggcaggggcttcccgggctgctgctgtcccgccctctgtggggcaggaggaggtgcccacagaggctgggtggtgatagccaggagatgggctggcatctgcattacccaagctctgctgcccatggtggcctttctgggggtgggtgctggtccctgccccctgccccacccctgatgtctgctccagagacaaaggtggggagggtgctgaagaggaagtgtttgcccagggagaggctgcggctcctcctgaaacatcagccctgtgggtcctgtttgcagaatctccggcctgtgaaactgtgaggggattcggccaagacgtcctcttccctctgcctcccacccaggccactcttcacctccaccatgagcctggacatccagagcctggacatccagtgtgaggagctgagcgacgctagatgggccgagctcctccctctgctccagcagtgccaagtggtcaggtacgcttgctctcggggtggccttggggtgctggtggggcaggctggcgggtggcggctccctctgaagggtgcattgctctggaacgccttgtttgtggacatgaagtatgaattctgtgcagctaccacgtgcatgagatgtgattcttgtgtttctttttgacaatttaggaatgtaaaacccattccaggctcatgcagcatgggctgaggtgggcgggccgaggtgggcggccactggccagtgggtctctggctccggtgtctcagctcctctccctcccttggagacacgagggcaggacacagcttgggtcccctccgtgagcctccatggggcgctgcttgtccctgccaagctgggggctgggagtcctcggccctcgaggtcctcacaaacccagcagcttcacaagcaggacacgagtgcctgggtgggccgcatcttttctctttttacctggtgat

SEQ ID NO: 63728 - DNA, 1048 bp, Homo sapiens
taggaggaccccgggccgcaggcccctgaggagcgatgacggaatataagctggtggtggtgggcgccggcggtgtgggcaagagtgcgctgaccatccagctgatccagaaccattttgtggacgaatacgaccccactatagaggtgagcctggcgccgccgtccaggtgccagcagctgctgcgggcgagcccaggacacagccaggatagggctggctgcagcccctggtcccctgcatggtgctgtggccctgtctcctgcttcctctagaggaggggagtccctcgtctcagcaccccaggagaggagggggcatgaggggcatgagaggtaccagggagaggctggctgtgtgaactccccccacggaaggtcctgagggggtccctgagccctgtcctcctgcaggattcctaccggaagcaggtggtcattgatggggagacgtgcctgttggacatcctggataccgccggccaggaggagtacagcgccatgcgggaccagtacatgcgcaccggggagggcttcctgtgtgtgtttgccatcaacaacaccaagtcttttgaggacatccaccagtacaggtgaaccccgtgaggctggcccgggagcccacgccgcacaggtggggccaggccggctgcgtccaggcaggggcctcctgtcctctctgcgcatgtcctggatgccgctgcgcctgcagcccccgtagccagctctcgctttccacctctcagggagcagatcaaacgggtgaaggactcggatgacgtgcccatggtgctggtggggaacaagtgtgacctggctgcacgcactgtggaatctcggcaggctcaggacctcgcccgaagctacggcatcccctacatcgagacctcggccaagacccggcaggtgaggcagctctccaccccacagctagccagggacccgccccgccccgccccagccagggagcagcactcactgaccctctcccttgacacagggcagccgctctggctctagctccagctccgggaccctctgggaccccc

SEQ ID NO: 63729 - DNA, 1033 bp, Homo sapiens
gttttcaccttagggtggcaggtagaagaaaggttaattactaatttggcaaaactacttctacaatcgctgtttccaggcagtagtaagatttggcagttgacagttggatggagttgacattcttcactgttttataaggcatcatcttagaatctagggttttgcactgtcttgtcagatgggaagtgaggccgtcctggtttctgagccccgttagggtttgttgtccaggggtttccagacagcagtggcgctgacagccactttcccccgttgctgtggtacatgtgcagcccacagtggtggtgggagctgagctccaatgcaaggaggccctgaactcgagggcagctctggccccctacttcctggcctcttgtgcgatgcgctttcctctgatcatggatggaggttggacttggtgggaaacagagtgctgcagggccggcttcactgcctcgctggattcctgactcactctcctaggacaggcctttcctccgagagtcgcctgggaaacaaggtcaatagcactgatgagaaatgaaccacgtgcacgtatctcctttcttatctgggaccaaagtttgaggccctggtgtggaaggaggagcgtgtccaactagatttcccaaggctttgtacgggatcctgtgtggtttcacagtgaccttgcagagtgggaagggcaggggtcccggctgacgggtcagggccttgagcaagtggtcttgggagccgaggggtgggcctggcctctgtgccttctgcctcctcagctctgggtaccactggggactcagcagcaccctggtggatggggttggggtgcggtcagaggagcctccaggcatcccaacagtggccagccttggcagggagagcaccctacgtgtcactgaggcccctcttgtgcccagctgataaagcccggctctgcctcagctcaggatgaggccgttttgttcgtatatggtgttgcgattcctcaggagcattgcagttttttgagatggagttttgctcttat

SEQ ID NO: 63730 - DNA, 1071 bp, Homo sapiens
ggggcgttggaaatgggggctgctgtcagggggctgctgcactgaggggctcgcttggaggctctgaaatgaacctgatggtctctgggacctgtgctaggccccagggctgccctgcctctcgaggtctgcctcagccccaggctcagcttagaggagctggtctggcactcaggacgctcagcttcccgcccctcggtgcagggcacccgaggcttcaggttaggtgcagggcagggctcccagggttgtggatgtgctgagcgtggacgtggaggtaagtggcaggagcctgcggggaggtgggctgtgcattgccgacctggtgtcctgagcgcagcctgggcccgcttgcctccagtgccgcggttcacgctgcccatcctgcttgcaccagctggcatgtttcctctccaggttccgaggattctgaagacgacggggagacattgctggaggtagcgggtactcaggggaaactggaagccgctggctctttcaattctgatgatgatgcagagagctgcccaatctgtctcaacgcattcagagaccaggccgtggggacgccggagaactgtgcccattacttctgcctggactgcattgtcgaatggtccaaggtgagttcacctctggttgggtgcttcctcccttcaggatggcctccctgtttataggtgacccagcctgtgttcagcctcttgtgaggttctagttgtctgctctgcggctgaccctggggccacaggattgagtctggcttggtctttgctttgtgagcaccatggctcttgggggtgtgggtgagctcatgtgaggcgtttgtggtgtattggtcaggggcaggagagaggatggccgtgggtctcccaggaccagctgcagaaaccctggttgacataggggccatcttggcctgcaagccagaggcaggtgtgctgtggtgcgtggtcactttgctgccttgacatgtggttctctcagttgatacagaaaacaccggtacgatttggcattcattcacaataactggcatcaaaagagactgtccttaaaacaggtgaatag

SEQ ID NO: 63731 - DNA, 1670 bp, Homo sapiens
gtttcactgtgttagccaggatggtctcgatctcctgacctcgtgatccacccacctcggcctcccaaagtgctgggattacaggcgtgagccaacgtgcccagccttttttttttttttttttaagaggcagatcttgctcttccgtggcagtccagcacctgctgcctcgccctactgcggcccactttggggccgcagggcttacccgctcctttccgtgcatcatactttgttttctgttgaatactttcctcttagatcaccaccctgagatggtagaaaacataaaaatccctgtgtacacgtggagggagaccctctgggcctgtggagcccaaatatgaatctaaggcaatgggtggattctggattaactgcgtttcacgctgggaagtgactgcggggagtttgggtcctgtgtggtggtgaccgacgattctgtcctagatcccagtggagaacaccaaagcgagcgaggaggaggaggacccgaccttctgtgaggtgtgcggcaggagcgaccgtgaggacaggcttttgctctgcgacggctgcgatgcggggtaagggacggttgggactggcacacgtgccctgctgcgtgcaaggcgggccaggcgcaggagggatgcagagcctcttcgctctgtgaagtctgagtcccagcacctggagctgtgctcaccaccctcagcagcgcggttcagtcctgcgggccttcctgttacactcatttacacttcagtctttccccaaaaaacattctgaggctgcccacagaagtgcaggtaatacatcaagacaaaaaagaaaacagccggacaggaggctgtggggctggtcagccagagggtgggacgtgtcctggtcccggcctttgtgggggaggggtggctatgcctgcgtccatcattctggctgccttggtccctcacctttcaccctgctcctccttcaccctctggtgcatgtccagttatgctgcacctgctgctctccctggcacagctgagagcgcctgctctggccctgcgtggccctggcttcccgggagcctgtgacacttgtctcctcatccctgctttgtgtcgttggctgtaagcagatgcccccttccccgttagcctcctgcgaggggctttccctgttgatttgaataatttttctgctgtgaaattatggagagaggattctggaaatctttcccttgttgaaagaaccagtgaggctgctcgatctggggccttctcttgggtgggaagtagctgggtcagggtttggactacggaacagccggagccaggaggccttgacgtgccgcggctggagccgcaccgaggatgggctcctggtgaaggcctttgctctgtggcgggtggtcccggtcgtcccagctttgactcgtccttgagcacagccgcttgtgcccccacctgtcacctcgttgttagccacatacccaggcctctgctccactcacgctgttgttggtgcaggaatcgctggctgtccttttgcagacactgcaggggcctccttgggggtcctgcaggcggccaccacgtttgtctcatcgtcagttcgccctcctcctcatggcctgtgggagtacaggggccttgcagtgcgctccgccggcccttccaggtccccagcccctgcttggt

SEQ ID NO: 63732 - DNA, 3156 bp, Homo sapiens
cgcctcgggcaggagcagtggccctggtgaataaggctgtcatcagaggtcaccttttggccagttcttttgtttcgccacaagaacaaaaaattaaccaaaaccaacaaaacaggtaaaggtgcttgtctgccccctcccacctgttggtggagttgggggtggcaaaggcaccagaggtgacttctcccaaaaacgcctggtttccctggggccagagctgcgaggtggggctccctccctccctccctctgggaggccccggtgagcacctcttagaacagcagccggagccagggctgtgggggaggcgcaggcccggcccagccccactctccctggctcccgcctgctgcggggctctgcctgggtgcgggccctcaggccgtgggaggcagtgacggcagggccttgggtctgtgcccacaggaggcgcctccctgccgcggtgccagagccagacttggaggaggagccagtgcctgacctgctgggcagcatcctgtcgggccagagcctcctgatgctgggcagcagtgatgtcatcatccaccgcgacggctccctcagcgccaagagggcgggtgagtgccttccctgccacggccccttcctctgtgggctgctggtcctcaggctgttcgcaagcactcagcccatgtctcagtcacggaagatgtagctgaagttggggggaccattcctcagccatttttctgcattgatttcccttcttgagcagtttctcagttagctccgagttcttacccagccccacagcttcatgttcataagaacatgtcctgatggggtactgcccccgcccctggttaatatcgtgtcctgatggcctcaggcactgtactttgtcatccacagagtggctgttgaagcagctctccgggtgtggaaaggcgaggtgtccacctcaacaggcagacaggagtttaaagcgcacgacctcacagaaaaccagttgtgataaaaattaaaccactgacatttaagaagagtgggtgggaaatgattgccattgacttttttgttttttagctccagtttcttttcagcgaaactcaggcagtctgtccagaggggaagaaggattcaagggctgcctgcagccccgagcactgccctccgggagcccggcccaaggcccgtcaggaaacaggccacagagcacagggctcagctgtcaaggcaggtcccgcacccccgcccgcaccgcgggggcgcctgtgaggctggacttgccagcagcccctggggcggttcaggctcggaacttgtcaaatgggagtgtgcctggcttcagacagagccacagcccctggttcaacggcaccaacaagcacaccttgccccttgcctctgccgcgtctaagatctcaagcagagattctaagcccccatgtcgcagtgtggtgccggggcctcccctgaagccagcgcccagaagaacagacatctctgagctacccaggataccaaagatcaggagagatgacggtggtggcagacgggatgcggccccggcccacgggcagagcattgagatccccagtgcctgcatcagccgactgactggcagggagggcaccgggcagccagggcgaggcacacgggcagagagcgaggccagcagcagggtgccccgggagcccggggtgcacacgggcagctcccggcccccagcccccagctcccatggcagtttggccccactgggaccatcaagagggaaaggggtcgggtcgacctttgagagcttccggatcaatattcctggaaacatggcacattccagccagctctccagccctggcttctgtaacacgttccggcctgtggacgataaggagcagaggaaggagaacccctcacccctcttctccatcaagaagacgaagcagctgcggagcgaggtctacgacccatccgaccccaccggctccgactccagcgcccctggcagcagccccgagaggtctggccccggcctcctgccctctgagatcacacgaaccatctccatcaacagcccgaaggcccagacggtgcaggctgtgcgctgcgtcacctcctacacggtggagagcatctttggtacagagcccgaaccccctctcggaccgtcctccgccatgtccaagctccggggtgcagtggctgccgagggggcctctgacacggagcgagaggagcccacagagagccagggcctggctgcccggctgcggaggccatcccccccagagccctgggatgaggaggatggggcgtcttgcagcaccttctttggctctgaggagcggacggtgacctgtgtgactgtcgtggagccggaagccccacccagcccggacgtgctgcaggctgccacccacagagtcgtggagctcaggcccccttcccggtcccgctccacatccagctcccgcagcaggaagaaggccaagaggaagagggtgtccagggagcacggacggacgcgctctgggacgcgctctgaatccagggacaggagctcgaggtcagcgtcaccatcagtgggtgaggagcgccccaggaggcagcggtccaaggccaagagccggcggtcctccagtgaccgctccagcagccgagagcgagctaagaggaagaaagccaaggacaagagcagggagcacaggcggggcccctggggccacagccggaggacgtcccggtcgcggtcggggagccctggcagctcttcctatgagcactatgagagtaggaagaagaagaaaaggagatcagcgtccagacctcggggaagggagtgctcccccaccagcagcctggagaggctctgcaggcacaagcatcagcgggaacgcagccacgagcggccagacaggaaggagagtgtggcgtggccccgagaccggaggaagcggaggtcccggtccccaagctcggagcacagggcacgggagcacaggcggcctcggtcccgtgagaagtggccgcagacccggtcccattccccagagaggaagggggctgtgagggaggcttccccagcgccccttgcacagggggagccagggcgggaagacctccccaccaggttgccagccttgggggaagcacatgtctcgccggaggtggctacggccgacaagg

SEQ ID NO: 63733 - DNA, 1264 bp, Homo sapiens
aggccacagaagccccgagaaggagcctgggacatggaggatgtggcccccacaggggtcaggcaggtgttctccgagctgccctttcccagtcacgtgcttccggaacccgggttcccagacacagacccctctcaggtgggtgtctgggctggagggctgtgggccgtgggcagtggcctggcacccgtgccacacacaccacactaggctggggctgaggcctcacagctcctgggcacagagctgctagctgtagggcccagtgctcagcaggggtgtccctcccaggtttacagccccggcctgccgcctgccccggcccagccctcaagcatcccaccctgcgcactggtcagccagcccacggtccagttcatccttcaggggagcctgccgctagtgggctgtggggcagcacagaccctggccccagtgcccgctgccctgaccccagcctcagagccagccagtcaagccactgcagccagcaactcggaggagaagaccccggcccccaggctagctgcggagaaaaccaagaaggaggaggtgagtcctgcctcctcccactttccccatgttcccatcttactttgaaactaaagttgttggggctgagtttatgggcggaagctggtcgctgtgcctctggaactgcaagggtgtccagaaccacagtgcctctggccagagggactcccggctcccttcctggccgcatcacacacatgtcccctctagtacatgaagaagctgcacatgcaggagcgtgctgtggaggaggtgaagctggccatcaagcccttctaccagaagagggaggtgaccaaggaggagtacaaggacatcctgcgcaaggccgtgcagaaggtgggctgtgtgcgagcctgtgtgtggggctcggggtcacgggcggtacgtcgctgctgtctcgtcagcatggactttggggtggccatgagtgcaggcccgaggtcagccagccaggttaggggtcagggggctgtattgccacatcctgtaggcctggggtcaagcctgttcgcctgtggctgcccctggcagatgcttaggaaggagggtgcctcagtgcaccctgggtaatttaaaactacccagcccacgcccagcttacaggtgggagaacgacccccagaggtgagcagttgcctggtgacgtctcagcccatgctccccccgcccaccgacaccgtgggaccctcagtggccttgtgagcggcatagcgaacaggacgggggt

SEQ ID NO: 63734 - DNA, 1010 bp, Homo sapiens
ccttcaccaggaccaggctcttctccttgggcctcccagctgacaggtcctgcccgaagcccaggtagatggtatagcgtggggagccacggcgctgccgtgcccggaattccaccagctctgaagaaggggactctgctgagtacctggcaggcaggtgctcccaaggacccctggagacagccccccaggcaagggcctcactgaccttggaagaagactctgaagtcgaagatgggggtgtcacagttccgaggcagcaggcaggctggggtggaggggctggcggagcctgggggtccgcccacctcccagtacaccttgcacttgcccatgcgccgggcccacagctgtggcccccgaagctccaggtgcaacccaggggccacgtgccgcagcagttcctccgtgtagcgcagctgcttctggtccgggagctcggcagggctggggaatgctacctgctgggggtctgtggcccggacagctgggtctggggggccgtataggaacgtgcagctcgggtgtcccaccaccttctgcagcaccgtgcggcccttgtacatgatggtcacgtccagcgcccctgggctgggctctgtgtggagaccaagctgtgagtgacgggggtgggcggggacaggctgtgagtgacgggggtgggcggggacaggatgtgagtgacgggggtgggcggggacaggatgtgagtgatgggtgggcggggacaagccgtgagtgacgggggtgggcggggacaggctgccccttcctgggatgcactcaccttgcaccgcggtgcaggcgcttggggagggtgacaggtacggctctgcctggtgcggggactctggggccgcggcctcgcctgcatccggaagggaatcctgtgctggcacctcatccctagcctctccctgtgccccaggcctcccaacccctacccctctcacctgtcgttagtgccgcgggctggggcccggggctgggggtcgtctctactgcccacc

SEQ ID NO: 63735 - DNA, 1061 bp, Homo sapiens
gcaggggcggggacaggttgtaaatctgaatttgtctgatgcttcctcagagatctgtatcatggtcatttcatagaaacggcaaactctgtcccagctcaaaaagatgctattagactaatcctttgatctctttacgtgtgcggctcagctttcagataaacctgcttgatgttttgagggttttctcttatttccgttgcttcctcgagggagagtaatccagtctaatttgcatttctcttacttttaagctgagctgctgcgccctcacgggacacagtcatggggagccctctgccccatggtgggcattggtgaagccacagtggtcccgggggcagacctcaagggtgcacagcagcagccccttgggccctgcctgcccaagccccacctggccccacctgccctgtgttggggactttgtatttcagcctccatgcagggtgacgctgggactccccagcttccggttcacggcttcagggtccagcaggttctcctgaagccccatctaccgctggcttcctgctcactctcccctctcccgctctgtctctccagaggaggccgggcctgtggaattaggcggctgcttcacctgaactcactgcagtgccgggaaaggagcctctggaactagacccaggagcggatctgcaaaggctactcagggttctcccagcggctctgaaccccgaggccaactcgccctccaatcacctggcccctgaagcaggcggaggcccctgtgcacagtgggcctgtggccccatttggttcaggagtgatggtgacacggagttggctccatcgaggctcctggcagcattacatcctctaagaataagtcataaagaaagcactccttgtaagatacacgatccaccaggctgcctccaaccacagcctcatctccatccggggtgtgtctaggttttcttttttattattattttttatcatttgagacatgttctccctctgtcacccaggctggagtgcactggtgtgacctcagctcactgcaacctccacctcccaggctcaagcaatcc

SEQ ID NO: 63736 - DNA, 1093 bp, Homo sapiens
agaactggcaaagctgaaaatactctctgtctgccggctcctgcttttgactgcagttgtgcaacagaaatgcagcctagctggttgtgtgctggagaatattctagaagccacactgaggaaaatagagttagaactgatttttttttttttttgaggtggagtctcgctccatcccccaggctggagggcagtggcatgatctcggctcattgcaagctccgcctcccgggttcacaccgttctcctgcctcagcctcccaagtagctgggactacagcgcctgccaccatgcccggctaatttttttttggtatttttagtagagacagcgtttcaccatgttagccaggatggtctctatctcctgacctcgtgatgcgcccatcttggcctcccaaagtgctgggattacaggcgtgagccaccgcgcccggcctgatttttataatctattttatttcacctgatatagccccaatcctattatgtcaacgattcaggatcaccacatttcaggggctcagtagccacgtgtggccataagctactatgtgtactgaatggcgcagccatacagcgtgatatttagagtctgctgtgcggacaaccatcccgagcctccctgtcctttttctccccaacagtccaagaggccagcgtgcagcccccatgcagggccagccaccctgagcctcactaccccggctatcaggacagctgccagatcgcaccgtttccagaagctgcgttgccaacgtcacatcccaaaataggtaggtttgaaagaattcacacatgtacaggttattgtcctcagaattgcttccaatgaaagaattcctaagtgaaatgggattcattttggtttggtttgttgtttttgttgatgcattagatcagtggctggtaaagtgtggcccactgcctatgtttgtaaataaagttttactgacacacagccacgtccattcatgtgtgtgctgtggaagttgcttttggtacagcagcagggcacgcccctagaaaccagttggcctgtgaagcctgaagttctttctggtgagtttgctgttgtcctcttgagggtaga

SEQ ID NO: 63737 - DNA, 2019 bp, Homo sapiens
aggtagatcatttgcaggggctccaacactgaagtacttagatgtcagtctaggaaatcatgtacagggtttgtacgtggaagatactaaagaaaatgctgaagagagagaccagggaagattgaaatacgtcaaaagacgtcctgcgcccgtggattagaagactcagtaaagatgcgactttttcccaagttgattcgtaggtttaacacaatgactatcaaaatcccagcaggattctttttagatgcagacaagctgattctaaaatttgcatagaaaggtaaaggaaataaaaaagccaaaacagttttgaaacaaaaaagccaaaacagttttgaaataaaagtttaaaatgggtggaatcacattgcggggtcttaagacttacgggctcgtgacagtaatcaagatagtgtggcactggcagagggagagaccccacgatctgggtcagactagagtgtcatagtagactccagcaaatggccttggagtgacaggacgttcatcagcagagacaaaggatgacctaaacttcacacttggtacaaaaatgaattcaaaatgggtcatcgatctaaagtgaaaggtgaaactataacatttttaggagaaaacacattggaaaatcttcctgacctggagttagaactaggatttcttggattggacttcatcaaattttagaacttttggcttccgcttggggagtggtggtgtgatgagctcagtggaccaactctccagagaaataactagtgaaaattgtgaaaaaataaccccttaaggtctccagaaattgtcctaggggagtacagcaaataaacatccaagaaaatgtagtaagtcttggaaagggcagtgaggattgtgacgtttgagctacgaccagctccttccctccctttctgcccccagctccctatggtggaggctccattgtgggtggttgtgaccaagaaaacggttcccactccttgcagttcccggtcaagggatatggtatctcactgggaggggcaggccaccagcatttctcaaccccttcagctctaagttgcagtaaattcctgggaagtgtgactgaaaatctcttcagtcatccccactcagagggcagaggctttacccaggcatgggaggccaagcatacggagccccaatttccatcaacccacattgcccatagggtggggtgtccatgcagtgagaggctgctgccccccacacagaacccggctaatgcaacagaattccctctgatagactcaggcactgttcctgcctctaggtctatagtaggggctcagacattcagcccaaaagagagagaggccgtaagaacagagagctccaaagcccctcccaaaggaactgacttgatttgaaacagtatggggatgttcaagcctaaaagtgccctggaaaagaatggacattttgatggtaagcagttaagaggaggccagcagttccattagagcaagaaactaaactgtaggtcagcaggtttaccagagaggcgaggaaagccacagcgaagaacccatctgggaaaccgaccttcaagatcgaacctctcagtaaagaagccctaatttaattggctcagacagtggagcagtgtgtgccccagggcattgttgaaagtaatggagcaggcagctggcagttagttgattctgacacttgactacaccaacagcttaacagagatcaggaagagcgacagccaaaactcccaccaccaaaggtgattgcaccccacccagggccgagccctcagaggagcagcagccgaggccgccccaggagaacaggctcagtaagatagtccagctccgtacctgagtaataaacaagctgacagcagcaaggatcccagagaaaggagaactgctttccactgttgctacaatgtatcacctgcggtgtctgattcttaacaaaagatgataagacatgcaaggagccttggaccatacacaggaagaaagcaggcaacagaaattgcct

SEQ ID NO: 63738 - DNA, 1076 bp, Homo sapiens
aagcaggagggaggcagggctgggacgtgttcctcaagttgccaggttagcttgggacttgtagatgaaggctctggaagtgggtaccagaggtgctcagtgtgggacctggttgagcttgcactgcctgtggacagcgggtggagagatcacgtagggggtcagaggcacaggctgcaaaggcagacccgtggtggacctgtcagggccaagtatgtgggtgggtgagatcacatgagccgctggggcgctggtgctggtggaggggttgaggaggcgccaggaggtaggcaatggcagaggtgacgttcccacctgccatcatcatgactgctgcccttccttgcaggcggccggggacggtgcatcaagcagggggagaactggtacagtcccaccgagtttgaggccatggcaggaagagccagcagtaaggactggaaaagaagcattcgctacgcgggccgacccttgcagtgcctcatccaggtatcgtccgtgacctcacctgtgctcagcacacagttcagacgtggggccctctgaggcggcccagccagagggagggcacagaccacggggtcagacaaatggggtttgcagcctccacctgctgtctgtgtggccttgggcgagtgatttaccctctcatgtttcagtttccgggtctttcacgtggggatgacgatgatcgtgaccctgtgaggattgttgggagaagtgcatgaggtcacagcgcctggcacagaatagctgcagaaagggggcgtgtcaaatacacaaaaaatgaaaacagtagaagttaagataatcgcttctgtttgaatgcgtgtgaccctttcaaagtcacctaacttctcgtcagtctactaagaaaagaggacttctaattcctattccagtttagctccttgggtgttgttaaggaagcaattcctgtagagacttttgcaaatcttgaaaggaaagaggtaggtcctgccaccaataatggcattgtgaaaaggagaaggctctggaaattactgtttttgtggttttttttttttttttttgagacagagtctcaccctgtt

SEQ ID NO: 63739 - DNA, 1894 bp, Homo sapiens
catgcctttttttttttttgagacggagtttcgctcttgttgcccaggctggagtgcaatggtgtgatctcagctcaccgcaacctcccgcctcccgggttcaagtgattctcctgcctcagcctcccgagtagctgggattacaggcatgtgccaccacgcccggctaattttgtatttttagtagagatggggtttctctatgttggtcaggctggtctcgaactcctgacctcaggtgatccgcccgccttggcatcccacagtgctgggattacaggcgtgagccaccgcgcccggctgcaaacaggcatttttagggcagtttggtgagtgctgggttaatggtatggtcaggactcattcaaccagtatcttttaagcatctgctgtgtgccagagattgccctggacacaggacattctagaactctgggtgacagaagagccacttgcttggcctaggagcatcacaggaagactttgcagaggcagagaggagggtgtgggggtgttggcggcagaaagtgtttctctagaaacactccagcatgtagaggctggagctgcaggacctatctgggatgacaggggcaggaggtggggtgcagctgacctctgtggtaactgccctgtgtgcagatgctgctgaagggcctgtctgcatgccagggggctgagttccatgttgtagggggtgcggtggggtggcaccaagggacataggcaggttagatgtactttttaggaggaaggggtcagagaccaagggcaatggctgtgagcatggggccgaggtcacctgacgatggtggcctgacccctgcggtggaggagaggcaggaatggagctacaagagtgggtccaggaggtgtcctcacctgcggggaggccgagagctcctcgtaggcatagggcacacctgaccagcagaacccacagctgtgccgcagaaggagatagaagccccgtggtggtttgatagagctggggctggctggggtggcgggtttgttgtatgcattttttactgcacgtaaaaggctttactggggaagaatagatttcctctctttttcctggaagagccgaatgacttagacaatggaatagaaatgtaggtcgagcgtgttcatggaagtgttaagatcttcctggttacaagggcacacacctgagggggagtcactttgtttgaagcacctgagcgaggctgttcgctttgtccattctggcttttgttgcttgttaaatgaggctccttctgttgcagaggtgaccacagtgacagtggccaacgtgggggctgctgcagacaatgtcttcaccacgtctgtggcgaacgcggcatccatctcaggacatgttctggtaagctgctccgaggggcacagcccagggcgggtggtgccacgctgggggcctccggcttccccgaggctctcccggggttcagcccgctgtgtgaacgtctgctctgtgagctggggagggacgcactggctcgctctgctctcagaggccttcgggctgtgctggaggtgggagaaattacagctgaggtagaagctgcctcggaaggccaggtgaagagccacacctgtcagatgggcttgtggcctgcgttgggcagggactcccagcaggctgctgtccggccacagttcagcctctgcccgaggcccggccctgcctgtgctccttatcctatagctgcagggccagctgaaagaagcaaggcgtttccctcccccatatcctgttctcgtagcatttatggtgcagtctcccacgcctgactgctgtctacttagaaaactgctgaaagccagttgcatttcaaatagtgtctgtgccaccttcagagcccttttgtgatcatgttttatcagc

SEQ ID NO: 63740 - DNA, 1548 bp, Homo sapiens
cggccccgacgaggccgccgctgccgcagccttcgcaggcaagtgcgcccgccggcctctcgcctcgtccggttcccgcgcgcctaccccgcgcgcctgccccgcacaactgtcccaggtgaccagcccgccacacctgtccctcacacctgctccacgtgaccagcccgctccacccgccctgcacacctgcccctcacacctgctccacgtgacccgcccgccccacccgccctgcacacctgccccacgtgactagctcacccctcacatctgcctctcacacctgccccacccgcccctcacactttccccacgtacctgctccaggtgaccagcctgccccacctgccacaaatacctgcctcgcacacctgctcgacgtttccagccttccccacctgccccacgtgatcggcctgccctacctgccccgcacacctgccccacatacctgccccaggtgaccagcctgccccacctaccccaaacacctgccccgcacacctgcccctggtgacctgcctagcctcacctgacctggccctgccctgcacacacctgccccctgccccccttttctttgtggcagccccgcctcctactggtcccccctgtgcagctctgcccctgccctgccttcgtccatcctggctccccccacctgtcctggagaagccctggggtgggtgggcacctgtggtcaccaggaaccccccacttcctgagggccagttcaggcatgacctgagcgctggggagccaggggtgggcagcctgctggaggccatgatgccagaggtcagcgtggctgtgtggtggcccaggggggctgcggagccacctgtgcaggctcccctcccagtcctccctcttcctcttgcctttttccctaaggacctgctcctcctgccccgcttcctgtcgggcttcctttggggaggctgctgtggctttccagtccacatttttatataagctgcttatagtttcttgccacacaggtcagtctccttctcaggctccaaaacactgggagcccgtggcagagctcacagatgccctacggggctggtgccgtccacccacctcctgtgtcccgcccttgtgtccgtggggcatagacttccccacccactggcttcctaacgcactgtattcttccccattggagttcccgagtgtcccccagggactcacagctcagtgttgagacccttgggaggagcttcttgttgcgttgtgaggcacttttcccctacggagctttgcgggttgaggaactggatcccagtcctggtgtgctgggtatgtcagggcattgcgtgtgctctgggtgcttgttcggcctgggggctgggtgggggccagcagcgtctgggctgcccttggtcagctgagtggccctcgaaggcaaaggggtcactgctgcttgtttggttggttaagaaaaaaaagtgagggaaggctttgtgactctcaggggttggcgtccgtcgctaaactctggtttgacgttgggatttggagccatgaggttgatttcag

SEQ ID NO: 63741 - DNA, 1050 bp, Homo sapiens
cctggaagaggatgggacaagggtgggcagagggccgcatagagctgagagtccagggaagtttggaagccggggtcagccttgcggtacagctgcggggtgtgtcccgggcctagtcctcatctttgggagcccattccccagcggcgccagaggggcctgtgctccaggcttgtccacagctccggccactccctgccagagtgcccagaccccgggtgcgagtcgtgtccgcgcgatgtacccgcaggaggagctggaagacttcccgctgcccacggtgcagcgcagccagacggtcctcaaccagctgcgctacccgtctgtgctgctgctcgtgtgccaggactcggagcagagcaagccggatgtccacttcttccactgcgatgaggtggaggtgaggcggtgccgggcggggcagggtggggccccgccgcgccgcgccccgccctcctggccgcctgacgcccgctttcccaggcagagctggtgcacgaggacatcgagagcgcgttggccgactgccggctgggcaagaagatgcggccgcagaccctgaagtagggcagcgggcggagcggggtcgcagggggcggggaggggaggagcccggcaggggaggggaggagccggcaggggaggggaggagcccggcagggagggagggtcaggtgcgttcccggcggggctgagcaggaccccctcgccctccaggggacaccaggagaagattcggcagcggcagtccatcctgcctcctccccagggcccggcgcccatccccttccagcaccgcggcggggattccccggaggccaagaatcgcgtgggcccgcaggtgccactcagcgagccaggtgggccgaggggctggagggggctccacagggctcgttgtggggggctcggtgagcagccgccgtgtcccccatcaggtttccgccgtcgggagtcgcaggaggagccgcgggccgtgctggctcagaagatagagaaggagacggtgggtgcccgggcccggcaggtggcccctctcttccccgcccc

SEQ ID NO: 63742 - DNA, 1030 bp, Homo sapiens
gggcttccagaaattacctcccgtttcttccaaggggcttcctgccacctcctgagacccccctcaagagcagatgggaccaccgacctcaccggcctggtgatgggcacagggtcacctggcatcgggtgggctggctctctgtgtcctctctggccacccgccccaggggtgaggattgccccccttcctgccctgagggcatcactcttgggggcctgtggtgttttgagtgctgcccgcggcctccggaggccccagtggcagccccgtgaggcaggcgtggataagaatgacccgtagaggggccaggtcacctgctcgaggcccgagtttggggcaggggctggggttaacatgcaatctctcttagttccaacgtgtccttaaccactcactccctccccggcctccctacccacttccccatcaggcaggtccacagaaagaaggagggtctgctggtgctggccctggtggggccagggttgccgagggtctggccgtgagtgtgggagagtccacactgggcgaggagggagggcggggctttgaacatcagacctcagggtgggtggcctgagctgccagtggggccaccagtagccacaagcaaatatctccaccaacaaggcccgtctgtctcgggacaagcatgtctttgtggcgcttgctccccttctgtcctcccccacagctggccctgtccgcccgtgcccagtcaggccccgcagaacccaagaggggcttcccatgccatttaggaagggctgtctctttaaaaaaaaaaaaaattacaaaacggttgatttcccaagaggttgacacagcagcacgtacagtaagatgttcctcacacctgcggggatgccatggtcccagcccggggcacccgttacccaggaaggtggtgagagtggtgctgggaaaatgtgtggagaaacacaacagggacccccactaaccccacaaagctgaaccagccccagcagtactagacgtcatgagaggcaaaacgaccaagttcaca

SEQ ID NO: 63743 - DNA, 1042 bp, Homo sapiens
cctgctctgcctcctgcacccgcagggcgtcccccgccgctccctcccctgcttcctgcagcggcccccgaccccagtcctggccccaccatggatcctgcatcgccgggttcggccctggcgggttcagccccgcagagtcggcacccgggccaggtccatctcctccagccctcccggtgcgtcccgcggggcaggaaggaggcgaggcccagccgccccgtgtcgtgcaggtgttttcccgggcccgtccgcggcggctgctgaggacctggggagacccagcctgtaggatccgcagctgcggtgcgcggccggcagtggcgctcgggcttcgtccccgggggcggggcttcgtccaggcgcgcagggaccagcgggcctcgccctcccgcgccgctttccgattggcagccgcccgcggggcattgtgggccgtccgcgcgcccgtcccgtcgccgccgccgccgccgcagacccctcggtcttgctatgtcgagctcacccgtgaagcgtcagaggatggagtccgcgctggaccagctcaagcagttcaccaccgtggtggccgacacgggcgacttccacggtgaggacggcgcggagcccgggcgcggcgcaagcgccctccagaggccccggcgccccgatttccccgggtctcccgttccgggacgcggaccgggtggcggtgccccgggcggctcgttccgggaggaatgagcgcaggtgccggatgttggggccagggacagccgtgaggggagcggggcccgggtcggccgtgagaggcgcagggccagcggcgaccgtgaggggaacggggcccgggtcggccgtgagggagcagggccgggggcagccgtgaggagctggggtcagccgtgaggggctcggtgctggggtcagcggtgcgggcggtactgacgggtccttgcgagccgtggggcacgaagccggagccccagcctcgccctccgcccagggtggggtcggctgcgccctcagaccccgcacccgggacgggctgtgggcagcccgc

SEQ ID NO: 63744 - DNA, 1099 bp, Homo sapiens
tgccgctgatgcagtgaagctggagcggatgctgacagtgagtgttgtgtgtgggtacctacatatgccaagccctatgagagcccgggcctgggcgtcggggttcaagctgggcagagttaaaactttggtgagaccccaggtctcattcacgtgctgtccagcaagtggggcctgttgaggccatcccagggtggagggtgcatggcacccaggggtgcccccaggatgcttggtgggtcctggctcctctctggcctgtgtggtgactgtggtattggccaccctgtggccgtggcccccacacagagtgcagaccccacaagggcctccctccttccacatggtgccttgtgaggcttcaaggtgcagaaggtagggtggggagacacagctcgtgctctgtttgtttctaggaacgaatgttcaatgcagagaatggaaagtagcgcatccctgaggctggactccagatctgcaccgccggccagctgggatctgactgcacgtggcttctgatgaatcttgcgttttttacaaattggagcagggacagatcatagatttctgattttatgtaaaattttgcctaatacattaaagcagtcacttttcctgtgctgtttcattcactgtctccgtcccctttgtcccctaagcatcacctgccccagctgtgatgggctgtaacctaggttaggactcagagatggggtcggggtcagggtaccccagacacaacccaccgcctgggccaccacctgggaacccaggtcagggttgttgctgggaggccattggtggagttaggcaaagggcaggcttctgatgccaggggctcccaaggtgctgtcccaggtgggtcacagatgaacagtctcaagcctccaagcgtgggcagatgtggatgcctctcagaggagcagtcccagccggaccctccctcctgctcttgagggcctgggcctcctgttccctgtcaaggctgccctgcccatgccccccgcccccctcctgtcctgttgtggctgagaccttacatgggatgccaggttcctgcatggggtcatggtgccaccttgtgggggcagcacgacat

SEQ ID NO: 63745 - DNA, 1505 bp, Homo sapiens
ggcgaggggagtgggtgaggggagaggccccccaggccgcttgggcagaggaccgaactccgaaccccattcgatgccccttcaggtgtccttctaccgtggcgcggtgcctgtgcgggtgcccgaggaggctgaggctgcccggcagaggaagggcgcagacgccctgtggatggccactctgcccatcaagctgccggtgggactgagggacagcagaggggcggggcaggaccgaggcccaggggtgaccagggtgacatggtggagttgggggtggagcccagggcttaatgcactttttccttccaacagagacttcgagggtccgaggggccacggcggggggctggcctctccttggcacccttgaatctgggagatgccgagaccggctttctgacgcagagcaacctgctgagtgtggctgggcgtctgggtctggactggccagccgtggccctgcacctgggggtgtcctaccgggaggtgcagcgcatccggcacgagttccggtgaggctcccactgcccgctggctgccagccccagggctgagccctggctgcctggagggcccacctgattctgacagaagtttcttccaggggaggtgggggaagggcaaacaccaggctggaaaggaaaggtctggccgcacctggccccaggagccgggaactcccccacactccgaggcagagtgtggtggggggtcctgggcaggtggacaggacccctctgtcgcccatcctctgcctgcagggatgatctggatgagcagatccgtcacatgctcttctcctgggctgagcgccaggctgggcagccaggggctgtggggctcctggtgcaggccctggagcagagtgaccggcaggacgtggctgaagaggtgcgcgcagtcttggagctcggccgccgcaagtaccaggacagcatccgacgcatgggcttggcccccaaggaccccgctctgcctggctcctcggctccacagcccccagagcctgcccaggcctaggccccacagacttttaggctggcccagatattccccagtggatgggcagagcccccaccttcaagtctctccagtgtgtggggacgggtccctgtgagcaacaaaactgcactgtttctttcacctcagagcttgatttatttgttggatggagaagccgttggagggcggagggtggtggggtagaggcctggcccctgcggggagggaggcctgtgtgcacaggtgccccacatcctggtcctgtcctctcccactgtgcctggggcctcctgtgggtcctcatcttcctgggagggaggagctgtgctacaaagtaacccacatgggctactttttttttttttttaaatggagtttctgtcacccaggctggagtgcagtggcatgatctcagctcactgcaacctctgcctcccaggttcaagcgattctgcgtcaccctctcaagtagctgggactagggcacttgccaccacgct

SEQ ID NO: 63746 - DNA, 1301 bp, Homo sapiens
tcgacctgagggacaaccagctccgggacctgccccctgagctgctagacgccccctttgtgcgcctgcaggggaaccccctgggtgaggcctcgccagacgccccgagttcaccaggtaggcttggtgctagaaggggcagacctgggataggacatgagtctcctcactgtcctgagcacatgtctgtcccctgcacagtggcagccctcattccagaaatgcccagactgttcctgacctcagatttggacaggtatggggtgggttgagggggctggaggggagtctgtctgcctgtcactctggcccctccgacaccttctccagagttcctgggtccaggctccaacacgtaggcccttctgggtctaacctgttgctcgctccttcctcactcagctttcctgtgacccctcaaggctgctcagtgaccctggcctgtggcgtccgcctgcagttcccagcgggagccaccgccacccccatcaccatccgctatcggctgctgctgccggagccaggcctcgtccccctgggtcctcatgacgccctgctcagccatgtgctggagctgcagccccatggggtggccttccagcaggcatggacagggcgtggcgggggcagtgtgtgggccagggcatggcaggggcagtgtgcgggcccgggcatggctccagtgctcacaccatccttgtctggcaggatgtggggctgtggctgctcttcaccccaccgcaggcccggcgctgccgtgaagtggtggtcaggacccggaatgacaacagctggggtgacctggagacctacctggaggaagaggcaccccaggtgagggccacccaggcctgccggtggcgagtggagagctgctgccctgagccgtgcacctctgcccagagcctcaccctggcaccttccaccctgccccgtccctcctggatcctgcttccctatgtccctggcaccttccaccccaccccgtccctcctggatcctgcttccctgtgtccctggcaacttccaccccaccccgtccctcctggatcctgctccctgtgtccctggcaccttccaccccgccccgtctctcctggatcctgctccctgtgtccctgactggctgtgccctgacccaggctcctgtgacctcctctctcccccatcccagcggctctgggctcactgccaggtgccccacttctcctggttccttgtggtttcccgccctgtgtccaatgcctgcctggtgccaccggaggggacactgctgtgctcctcgggtcatcctggggtca

SEQ ID NO: 63747 - DNA, 1289 bp, Homo sapiens
tgggcggcaaccggctgagcttggacctgtaccccgggggctgccagcagctgctgcacctgtgtgtccagcagcctctgcagctgctgcaggtggaattcttgcgtctgagcactcacgaggaccctcagctgctggaggccaccctggcccagctgcctcagagcctgtcctgcctccgctccctggtcctcaaaggtgagttccacctgttctgggccctgtctccatctctcgctctgccctgcctctgctgcatgttctcaaaggcaaaccccagtcccagccccagctccaggccgcccctcccggctccccaggtgtgaactgttctgctcttggtcctgtccagccccatcgccatcctcggtgatcaccacccccagtgtggggctggctgggccctggctcctggaccctgacgctgcccagtgggggtctctccagaccacagtgcagatgttgttcctggggaaggttgtgggtgatggttgtcagctgagatgagccggtggtctccacccctgcctccttccatttgcgggcacctctccagtgtttctgtctgtctgtccctgtctggctggggtgggggtggggtgggaggtctgtgcctctcgagcagctgtttctctggctggcagggtcgatctgggacctcggaccctggctctgagggccacatccgcctccccccttcccaggagggcaacgccgggacacactgggtgcctgtctccggggtgccctgaccaacctgcccgctggtctgagtggcctggcccatctggcccacctggacctgagcttcaacagcctggagacactgccggcctgtgtcctgcagatgcgaggtctgggtgcgctcttgctgtctcacaactgcctctctgagctgcctgaggctctgggggccctccccgccctcaccttcctcacagtgacacacaaccgcctgcagacgctgcccccagcactgggggccctatccaccctgcagcgcctcgatctctctcagaatctgctggacacgctacctcctgagattggaggcctgggcagcctcctggagctcaacctggcctccaaccggctgcagagcctcccagcctctctgggtgagtagcccctgcgccccgacacactggccccacgggagggtccctgaagcctgcctgtcttctgcaggggcctctgcacccacaggcttggtccacagctgcctcttggttgtccctccacctccctggcctttgagactccctcagtggctttgtcagagttctctg

SEQ ID NO: 63748 - DNA, 1134 bp, Homo sapiens
aaaagtgcctgacgggggctgggaagggggagggggaaggagtcaacgactccctccccgtcgtcattggctgagcgcctcgtgacgtcactctgaggcgcctcatgcggcgccgcgcacgggtcccagagccttctgggtagcggtttaaccccgcctcttgcgtcggcgccttccttttcctccctgtcgccaccgaggtcgcacgcgtgagacttctccgccgcctccgccgcagacgccgccgcgtgagtgtggtgaccgggcccggggtgccggctggggacgcggagtccgtggggatgcggggtgggcggcggggtatttttgggacggaggcctacgggccgagccacgcgcggcctcgcccggcggccccgggatgggccggcaggaggccgccggggtaactccgccgtcgcgtcctctccgcccgcctcaggatgcgctacgtcgcctcctacctgctggctgccctagggggcaactcctcccccagcgccaaggacatcaagaagatcttggacagcgtgggtatcgaggcggacgacgaccggctcaacaaggtagcggccgcccttgccccgcagccgccgtggggccccagtgtcccatacaggcgattcttctgcctgatccggccacatgctggagggttcggggagaggctcgtttcagtctagttggcgatttcttggatagagaagtaagccgggcggaggtcgggcgcggtggctcacgcctgtagtcccagtactttgggaggacgaggcaggcggatcacctgaggtcaggggttcgagaccagcctggtaaacatgtcgaaaccccatccctactaaaaatacaaaaattagccgggcgtggtggtgggtgcctgtagtccccctacttgggaggctgaggcaggaaaatcgctcgaacccgggagatggaggttgcacggatcgtgccactgtactccagtctgggtggcagaaggagaccctgtctcaaaaggaaaaaaaaaaaaaaaagcagggtgggtacgaggcaaaatcgtgattaacaagctttggaagtttaataccagtgagctgcgtaagattgcgttaaaaaaaaaaaaaagcagtcctggcgcatggctcacccggc

SEQ ID NO: 63749 - DNA, 1125 bp, Homo sapiens
caggcttggttgctcatgcctgtagtcccagactgaggtgggatagtcacttgagcccgggaggtcaaggctgcagtgagatcctaccactgcactccagcctgaagtcaaagtcaatttcattgccagtttattttgccagtgttgaagatacctatgagtagtcaacataagtagtgagatgccctgtgtccttttgtcagtcctaagtctaagaaagctagtgtccatttatttttatatcacttcccaagtgaggctggtggctccctttgggcagtgcagttctggaaacttcagggcctattcccatgtggggaacccagtcctgctgtgactctgggagggagagggccggggatacaatcgtacattcctggtaacagccctgtgattgtctgcttcaggttatcagtgagctgaatggaaaaaacattgaagacgtcattgcccagggtgagttgatgtggacgggctttcgtttgttttcatggtccatcctaatccctgccggtccatctgtggcctgccaggtttcgcttgtggaccagagcaccctagaagcctcacccgaggagtgagcagggctccagtgggctcacgtcatgggcacttctagacactctcaggagcagggcagcagggggcaccctgtgttctcagcagacgtttaggtggccctgcctcttaagcctgactgctcctagccctgaggccattccccaggatttgtctgaagcttggtgtctggagaactgagttcacgtcagcagtccttaccacatgctttctgtgagggggttgggggcagggactgagggtgccagggatgtccataggctccttgcctctttgttgggcagatggttttttgttggcttcagctgagctggtggaacttgtttggaagttgagctgttggggcagctgttcttgtcttccatgcatgtgaccacgacagggccagctcagcaaacgggccaagccatgaacacagcgttgtggccagagatgtggatactggggcagcacactcattccctacctagttatgaacatgtctgtccagtggacctctgagggtggaggtggggaaattgggcaggcaggcagtgtgggcctaat

SEQ ID NO: 63750 - DNA, 1031 bp, Homo sapiens
tcttgatctcctgaccttgtgatctgcctgccttggccccccaaagtgctgggattacaggcgtgagccaccgcgcctggccctgtgtcccctcctatccgtctcccagtcaggggcccggtgctgtggccccgctgacccctcccctgcctcctcagccccaggatgggtgagttcaacgagaagaagacaacatgtggcaccgtttgcctcaagtacctgctgtttacctacaattgctgcttctgggtgaggaggggtcgccttgcccccacccccacccccacccctcccgggccaccatcagacctgggcagatgcgatgacctttgtgtactgcttgtagctggctggcctggctgtcatggcagtgggcatctggacgctggccctcaagagtgactacatcagcctgctggcctcaggcacctacctggccacagcctacatcctggtggtggcgggcactgtcgtcatggtgactggggtcttgggctgctgcgccaccttcaaggagcgtcggaacctgctgcgcctggtcaggagggcgcagggccacggggtgggggtggtgcagatgggcccaaggaggttgtcgctgcaggctttgaacctgtgccttgctgtgctcacctggggggggggtcacggtccttccacacctgcctagtcctgtgggtccccacgttcctgctggaccagctgagggaagacaccagctccgcaagaaagcttcagggagggtggccgcccctcagcccccacctggagcctggggagccggggtggggactctgctctgaggtgcactaggtctaggcactaggcctcagaacaagggtgcccttgtgctgccccccccagtacttcatcctgctcctcatcatctttctgctggagatcatcgctggtatcctcgcctacgcctactaccagcaggtgaggggcctgggcaggccattcagagacacagacatgcacaggcggggcggacacacacacatgcacacgcgtggctagccccaaccccc

SEQ ID NO: 63751 - DNA, 1817 bp, Homo sapiens
ccttgttcttgatgcagttccactgctgtggcagcaacaactcacaggactggcgagacagtgagtggatccgctcacaggaggccggtggccgtgtggtcccagacagctgctgcaagacggtggtggctctttgtgggcagcgagaccatgcctccaacatctacaaggtggaggtgggtgtgcagcgggatcatgcctccagtgtctacgaggtggtgggggggcaccccagtgactggctgtgggcagtgggacacgcctccaatatctaccaggaggtggggggtcaccccagtggccggatgtgggcagtgagaccacacctccaatatctacgaggaagtgggtgggcagcccagtggctggctgagctgttggtggcctggctgcctaggtgctaggggtgggtttggccacaccctggaggctggaggcagtaggggccagtgggaggtgccccctgggcccgccttcaacacccatccgcgccccgcagggcggctgcatcaccaagttggagaccttcatccaggagcacctgagggtcattggggctgtggggatcggcattgcctgtgtgcaggtgagggcacatgggggtggcggtcatcttgttggggacacggggcagggcggtggctggtggccccatgacgtctgcttacgcccacccggctctgcacacaggtctttggcatgatcttcacgtgctgcctgtacaggagtctcaagctggagcactactgaccctgccttgggccttgctgctgctgcacccaactactgagctgagaccactgagtaccaggggctgggctccctgatgacacccaccctgtgccatcaccataacctctggggaccccaacctcagaggcagcttcaagtgccttttgctgcgcaccaatgcccagcaggggaggtgaggggggctggcggggcgaagtttggggggtgttttgtggggctccccagacacactctctgcctggtggtcagatgcaggttggaaggggccttgctgagtggcgcaaggccgagcgttcccagcagggggagaaacccttcacaccccaggcccttcaggaactggggccttgccttgcagccacatggccccatcccagttggggaagccaggtgagctctgacccttgggcctgggcctctgcccctcccaacccagccctcgtctccctcgacagcgcccctgctgtcttccccaccgcagtcaccaccacccgaaatgccacgtggtcactgtgcactgccctgttcatgtgcctctgcggggcagggccttcctggttttgttcactgctgtacccagatgcctacaaccatccctgccacatacaggtgctcaataaacacttgtagagcagatggacgagctcgctgtgctggtaacagatggtggtctgttctcagggccctcgcatccagcagggcagacagacccacccccgccccgcccagtgtcaggacaaagaagggcagagccaggaggacacaccccccatggggctccagggaagggaggtctgatgccagggacagctgagcacaggcctcagcagaaagaactgaacatgttcctaaatggtgagatggtgtgttcagagcccctgggggagaggaaaaatggtttccaaaacccttctggccatggtggggagcagacgtgggaagggtgcagactgggggccgtgcccaggtaagaggtgtcaggcaggtggggtgggggcagtagggtgagggggtttacatggaggagcctataggccctgctgggggccagagggtaggaggta

SEQ ID NO: 63752 - DNA, 1151 bp, Homo sapiens
ggaaagaccccacagcggcagagcagggcttgctctggctggggtgggggtgaaccagctaagggcaggcccctggagagctaccctgccgtggccagtgctggatgaggtggctgcacatcagcaccttggtggtcttggttttctaagctccccgcaattacttcgttttcatttcatttacatttcttacatacgttatacacacacacgtacagccagagtaggtgggagaggaggctcctcacgctccacccagggttctgggcatttccaggttactccagccaggatcatactgctagatctcagcttctgagccgggtgaatctgttcgccttgccggtggcggggggggtgaggccagcaggcagtgagaggcaggttggatgtgggctccaggcctttgcagaccgtagagaactcagttggcctctgctcctcccctcgacacagggatgcgctggatgccctgggcctgaagcgctactgctgccgccggatgctgctggcccacgtggacctgatcgagaagctgctcaattatgcacccctggagaagtgaccacgctggaacccacccacccgctgtgctgaccatgggccctgagcgtcctgccccgaattcacgaggctgaggcatccgggagctggcgtaatgcctggccgcagtgtgtgtgtatccgataccccactctggaaggaaccatccagtaaaggtctttcagaaccactaaggtcccagccctcactaggatgtcaggagccaggtctaggcccagctttcacactgtggcagcccagtgaagcagactgggccatgaactctcctagccctggggccagcctgttccacaggcacccctgcaggaggcgctgccaggagagccttccatctcggggctctttgaggttccctccttctgggtgttcttcaggctgagcagagaggctcctgtaccctctctctcggaatctgaagagccagatttaggccgggcaaaggggctcacccctataatcccaggactttgggaggccaaggcaggaggatcacttgagtccagaaattcaagacccgcctgggcatcataatgagaccccatctctacaacaaaatttaataaattagctgggcacagtgttcacac

SEQ ID NO: 63753 - DNA, 1045 bp, Homo sapiens
tccccggcggctccgcccccgcgcggacccctcccctcctcgccgcaccgcccggcaaaccccagcgctccgcctgggcggaccaatcgcagcccccggcaacgcaccagccgcgaccccggccccttcgcccgcgccggcgccccagcccccccaccttcgcgcgcgggaggaagatgctcgcgaagggcgcctgaggggactggaggccggggccggggcctggggatgaaacctgggcagctcttagcccgcgaccgacacccccagcccttccccccacggtacctcgcccggactctggccccgggccgggcttggagacctccaaccacgagaacgatactcaaagcactacgcaaatggagggtgaccccgttgctgtctggtggcaacttgaagcggctccgccccgggcgcccttggggaagccctgagtgccggcggcgggtggggggctgggtcagcctgcactgcatggagcaggtgtcgttgagtctttgactatatgggaggttccagaacacagaaaagcgcaggtgtgattcctgagatacccaccccccctccaccaggcagccccgcaggaggctggcagccccaggacagacccagagcgctccaggtgggcccggctcggcctccgccccgtgctgtccccaatgcgggagcggggccggcttcaagggcagtcgcgcgcacccaccccagctggcttgatgctctgctgttcccgtcttgaaattcttggtaatttttaaacaaggggcccagaatttcattttgctccagcccaggctggaagtcagcctgtaaaagaccccaccccaccccttgacaggtacagacataccggccccgtgcgcagatgtgcctgcactcctgggtgtcatcacgccggatgcgcacacacctcccacagccggagatggggacagaggcccccagctgtgccctgcagcctaccccacgcctctgaagccccagccccaccacagggcacaagggccctgcggtgttgggaagatatcagcacgtggcccag

SEQ ID NO: 63754 - DNA, 1143 bp, Homo sapiens
cttcattccctgccctggcccaggaatcagccccttctccagggtgctctgggtcctcactgaatattggggaccgaggccagggtgctgggtgggctcagcgctcatagcccctggctttcagctcacagagcatggctgcacgtgtcccgatacgtggaggcacctgtgtccctgtcctctgtccccccaggacccatggtcctcccccagcctggggaggaagcccagaggtgggggccctgggcctcagggctgctgggaggacatggggccggtgtgtctgcagcttggtgggctaggaggcgcgggggacacaagaccaggcgcaggaggggcccagcttaggggccggcgagggggtctggatgagggaggcggggtacagtgggaggggccctgctgaccccccccgcacccccagattgacaggtatgcccagcaagacctgaagaaaggcttgcacctgtacggcacgcagggcaacgtgggcctcaccaacgcctggagcatcatccagaccgacgtgaggcgtgggcaggtgggcggggtcggcgggtgccccctcccctcctgcctcagcccgacctgagcttgccccccagttccgctgctgtggcgtctccaactacactgactggttcgaggtgtacaacgccacgcgggtacctgactcctgctgcttggagttcagtgagagctgtgggctgcacgcccccggcacctggtggaaggcggtgagtgagacccccaccctgggggctggtaggggcctagagggcgggaccagcaggccctgccgtgacacgcatgacatccctccctgcagccgtgctacgagacggtgaaggtgtggcttcaggagaacctgctggctgtgggcatctttgggctgtgcacggcgctggtgcaggtatggcctgggggcctgcgggctccctgcccccactttgttaggaccttctgagcccagggaacaaagtagcaaagaccttgcccccaggaacccacgatcgggggaggccggggcaaaagcaggagggcgagttcagggggatgggcagggacggcctgtggggacagtgggctccctcttagtggacagaggcagaggctggtgtggggtggaggccggtggtcgtc

SEQ ID NO: 63755 - DNA, 1048 bp, Homo sapiens
tgatctctgtgggttccccctgaatccagaggtgggctcgcaggtcgtctggggtcaggaagtggatgtgcagagccaaccctgggccagggaggggtgggttctcacacccagcctcctcttctcttgctgttcccagctgccagcctgcagcagtggtgtgcactagctccaggtggggcttaagacaagcaccagtcacttttggtgaaagggatgtcgtggcctgggtcccaggctgtgagtggcagtccagagtaggagaaggataccccaggccaggagctgatgtcagtccgggctggtatctgtctacgctggccagccctgggcacgtccagaggcgccagaatgacagcaccatggtgagacaggtgctcactcacctgtcctccgtctgatgtctccatcttttgccagtggaacagccatggctacgatgtcaccaaggtctttgggagcaagttcacacagatctcacccgtctggctgcagctgaagagacgtggccgtgagatgtttgaggtcacgggcctccacgacgtggaccaaggttctcatccttcctgcttgactgtgcttgccccacaggctgaaaagagtgtgagtgcgagagcaggggtgtgtgtgtgtgagtaggtatgtctctgtgggtgtctctgtatgggagtgtgtgtgtgtctctgcgtgatttaagtgtgaatgtgagtgtgtaagtgtgagactgatgatgtgggagagaagagattgtgagtgtgttgaatgtgactgtcggtgtggacatgtctaagtgtgagacagtgggtgtgagtgttgagtgtggtgactgtgagaaccacgccctcaccccttggggcccagccggcagagcaggcccatggtgtgggctggtgtgctaagtgggaaggtgagtgtggagcagggcaggcctggtagagggggtttctgaggtggtcgccacggtgggaccctctgcaaggccaagttggtgcctcagagtgttccgcccaggtctgcgtgtggtccaggtggctgtgagggtggcctt

SEQ ID NO: 63756 - DNA, 1059 bp, Homo sapiens
gactgcagttgatcgaggaagaaactgtggaggtgaatttataaaagaaaattgaaagcctatagtagtaaaactgtgtgcttttggcagtggaagttgattttaggagtaaacctccgtgttattagcggatgacgatttatcatggcaaacatccagcaagatatttgagttctgagcttggtaaagaggtagagttagaaatggtgctgtggagcaccccctgggtgcgcagcggctggcccgggcggttcaggactcgctcctttgctgtcctgacccaggcactccctttcccctaggctcagtcccggccccggccctgctgcagccccttcctgccggctctgggttggaggcaggtgtctgcttcggcttttctcctgccttgaaacggggcctcatcccattcgtgagttctgagtgtcagtcttatcagggaaatggtgtttctttagaaatcaattaaaataaaaatggctttttgttcttttttttaggtaaaagtaaagaagcagaaataaaaaggataaacaaggaactggcaaatatcagatcaaaatttaaaggtaagtatgtttaaccttttccatgaaatgtcctgttgtaaattttctgtagtaagaacccagtcttttaatactgtcttcttttctcccacactaaagtgaagttctcagtttgtacagtttctatcagggccctgtcagaattaggaaatggcatgtgtggagctggttaggtggggcagcccctcctggtgtctggtcttttcctggagctggaacagcactggtctagtgcccagctgcatgtcgcagtattagccaccaggccagcgtgctgggggttcagaggacagacaccaagtacgggaagtgctctgtgtaaggcgccaccgaacgcctcctgctgacggtcaacagggacctgacctgcgctcggtggactgcctctctgtgagccagtgtgtgggctgagtgccttccctgaacatccttactttgaagaattgtgaagtacggatttagttttcagcccttgggacatttttgaaac

SEQ ID NO: 63757 - DNA, 1084 bp, Homo sapiens
ccaggtgagaggccctttgcgagtcggggctgtgtgcgctccggcgggcctctcggtggtcggtggcaagaggcgaggcaccagctggccctgccgtgaggcctcgcagagccgcttctgctccccatcggcgtctttttgttttccttcagttgatagaaaaagcagggattctagtagaaaatggagacgtggggttgatggctgacttagtgaaaggggcgtctttgcggtgggatctggagctggaagagggtcccgaccagcggcctctggtgcaggccagggggtctcgccgccgtcccccccccgcgggggcgtgctgcagcctgcgaggggacgacggtgtccctgtgttgtgcctccccgtccccagcccgctgatccagttccacctgctgcactccaagttccacctgtgcagcgtccccacccgcgcgctgctcctgtccacctacatcaagttcgtgaacctcttcccggaggtgaagcccaccatccaggacgtgctgcgcagcgacagccagctcaggaacgcagacgtggagctgcagcagcgtgctgtggagtacctgcggctcagcaccgtggccagcaccgacattctggtaggaggcccccgcccttcgggctggcttggctgagggttggaggccaggagctctgaccagtcccaccctgtgttctttccaaggcgaccgtgctggaggagatgcccccattcccggagcgggagtcctccatcttggcaaagctcaagaagaagaagggccccagcacggtgacagacctggaggacaccaagcgggacaggagtgtggacgtgaacgggggtcctgagcctgccccagccagtaccagcgccgtggtgggtccctcacctactgtgcacccagacctgtcagggcctcacccccaagacttgggaccagcagagcatttgcctgtcagggaggagcatgtactgagaacccaggctctggctgtggctctggacaccccgctgtcctgtcctgggggccactgtccctgctggacacgctgctgtcctgtcctgggggccactgtccctgctggacgccac

SEQ ID NO: 63758 - DNA, 1050 bp, Homo sapiens
ggaagcagttgagcaagtgagaaacctgtttcctgtaggggtcaggggtggggacggggctcatttgaaaaggtgggttttggtctctggcctggctgagaacactcgcctttgctgtttctcacagtccacagcaggaagtgcagaacatcttcaaagcaaagcacccaatggacacagaagtcaccaaagccaaggtaacacgtctggagggacggccccgggggacacgcagcccgtgaccccgcgccagggtctggagggacggccccggggaacacgcagcccatgaccccgcgccagggtctggagggacggccccgggggacacgcagcccgcgacccagcgccagggtctggaggggcggccccgggggacacgcagcccacgacccagcgccagggtctggaggggcggccccgggggacacgctgcccgcgaccccgcgccagggtcctcattctcctgtttctttggacagatcattggatttggttctgcacttcttgaagaagttgatcctaatcctgcgaatttcgtgggagctggaatcatccacacgaaaaccacccagattggatgcctgctgcgcttggagccgaacctgcaagcccaggtcaggccctcaggaaatggtggaacacacttgagttgctttttattctggcacaatgtacgtggtgagatgtgtagctctttagtgcagttcagtcagttttgacagatgttgtttaaccaccaccctgtcaatacatggttgcctcccagcctccccgcagctggccaccgtggagcatcatccctagtgcagttcagtcagttgtgacagatgttgtgtgcctgtttaaccaccaccctgtcaatacatggttgcatcccagcctccccacagctggccaccgtggagcatcgtcccaccatggagcagcctggccctgggcggtggctctcccagctgttcctctctgtcaccgcgttgttccttctcaccacgtcccgttctggcgacggacacctgtctccgtttcacttgggtggcacccaggagt

SEQ ID NO: 63759 - DNA, 2158 bp, Homo sapiens
gcccttgggaggagcacagctgaccctggttttgctgcagtcccagctggactgttttcccaggcaggattttaatctagaatttagaaacatttgtatttgtaatgacttctggcaaaagcacgtgtcctggccggatgtaactgttctcctttcccagctcctgtttgtgaagggcgtctgttatgctcctgcagtcgccgaggccttggatgtgcagccaggggaggagcgtcctgccggccccgcagggcccccaggactccagggtaaagtgtgggccggtggcgcaagactcagaggtgtgctcgtctctttcctgtcagagtgggcgtccccaggccacggtgcaggcctgagtccttccaccggccccgtccagtcgtccctggaggggctgtggaggagggacgcctctgtgtggtcaggaagtgaaggggccattggccgcatgccatgtgccacctgcggcttgtgtctcacctgtcatctggactcagcacccaggctgcacgtctgacacctgagaggcgagagagtggggccggcctaggagccaaggctggggccttgcgctctgtccccaggatggtggccttgtttgtcctaaacacacccagcacaggttctggcttcctgacatgctgtggaggcagggagggtgggtggccacatgtgcttgagggttttcaccctggccctcagttgcctgctgtgcgggtccctggggcagctgcaggggctcatggacccatcagggtctccacagctcccctgcagtgtgtgcaccccacaatgtctgcggctcttcttccggcgtgtcgggctttgatcacagcatagccacgtcagtggcgtgcgcctctcgcacaggccattctgggtctggtggtgccaggtgccgtgacacgccgtgctgggcttgtgctgcagctgggtggtgtggccctcattctcatgttccagctgctgggcagtgctctgcctgtgtgctgcgcctgcaggctgcgtgtgctgccgtggatctcctgcatcccttgacccctcccgccatcagaggaaaggctgctccccgaggcaccgcttccctgtgcggcgctgcagaggggccctcagtgtggcactcctcgtcaaagaaaaataaaggctagaactgcaccccggatcacgcgctttctttggggggaaagcatcccatgtaaccctcatagctccccgggggtcgcgtgaggcacagaccccaaggtccccgacctgtccttcagcagtgggctcacgggcagcgggcatcagaaagtgacctgccctttgctccgccggtttgattctgggtgtgtggtggagctttttgggactcaggtcatgcgggaacccctccagcctggccgcagggctccccactgtacagtgtgttgaggtgcagcccagggctccttcctggggaacgggaggccccgtggggatcctccagttgatcctaccacagatggtgcagaaggggctctcgggcagatgggggtggcccccggaggacggtgggcttcgccagagacggaacagtcctaatggagggagggcaggggcccaaagccagaggcagcttctcttaccagcccagaccctgctgggggcagccctgcccaactgcagatcccaggggcccacagggtgcagatgtgggtcgggtgcctactaagggactggggagaggcaaaagcagtgctcagggaccagcctctgtgccttgacaagaaccggtttatttggagtctctgaccgggtgacgccctctcccaaggacaggctgctggggatgggtgtggtgctggtgggggccttctgcctggctgggagcgggggcggctgccctgccctcgctgccaccctctgccctccctgactctggggatctcctcttctctgtgctggtggctgcctgggcctcttgcccccatctcggcacaggtttccgtgccctcctcgcccctgatgggtctggtcgagcgcctgctctgtggcttcatctgcagggttctgggcccagcagggctggggccaagttcaggggctgggaggtgttggacggtgggcaggggtggtcgggagtgccctgtgtgcctgggaggtccgtgaccactgtccgcctcagtccctctct

SEQ ID NO: 63760 - DNA, 2145 bp, Homo sapiens
tgagtacttggagtcaccaaggaggtggagaaaggtggaacgtgagtgggaagtgtggtctgagggtgtgatggggttggataggtagtggtggtctggaaggatgttgcagtcataggacctgtggaagagaagggactgctccctgtaggtggggagtgtgtggtgaagggtgtgggtagcctgctgctgctggccgaggtggtgtgggccacaggggttctggtgcctgtactggtgtgtttgggggtgatgttggtggtagaagttggggtgacttcaggatggtgtgttgaggaagtgtggtaaggtagggatgtagaagttttggccgtgctaaatgagcttggggattggctggtcccactggtggtcggtgtcattggtggggctgtgtgggtggaccctgtggccttgatcgtggtcggtggaggaatggtgcctgttggcattgagtggatggaggcagaagtggccatctgtgtgtgggtagggatgatgaccgtgtgagtacttggagtcaccaaggaggtggagaaagatggaacgtgagtgggaagtgtggtgtgagggtgtgatggggttggataggtagtggtggtctggaaggatgttgcagtgacaggacctgtggaagagatgggagtggtccctgtaggtggggagtgtgtggtgaagggtgtgggtagcctgctgctggtggccgacgtggtgtgggccacaggggttctggtgcctgtactggtgtggttgggggtgatgctggtggtagaagttgaggtgacttcaggatggtgtgtggaggaagtgtgtgaatgtagggatgtagaggttttggccgtgctaaatgagcttcgggattggctggtcccactggtggtcactgtcattggtggggttcctgtactggtggggttgggggtgatgttggtggtagaagttgaggtggcttcagcatggtgtgtggaggaagtgtgtgaatgtagggatgtagaggttttggctgtgtttaatgagctcagggcttggctggtcccgctggtggtcagcgtcattgttggcgctgtgtgggtggaccctgtggccttgagcgttgtcggtggaggaatcgtgcctgttggcattgagtggatggaggcagaagtggccatctgtgcatgggtaggggtgatgactgtgtgagtacttggagtcaccaaagaggtggagaaaggtggaacgtgagtgggaagtgtggtctgagggtgtgatggggttggataggtagtggtggtcttgaaggatgttgccgtcatgggacctgtggaagagaagggactgctccctgtaggtggggagtgtgtggtgaagggtggtggtggcctgctgctggtggctgagttggtgtgggccacaggggttctggtgcgtgtactagtggggttgggagtaatcgtggtagtagaagttggggtgacttcaggatggtgtgtggaggaagtgtgtgaatgtagcgaggtaggtgttttgtttgtgctgaatgagctgtgggcttggctggtcccactggtggtcggcgttattggtggggctgtgtgggtggaccctgtggccttgagcgttgttggtggaggaatggtacctgttggcgctgagtggttggaggcagatgtggccatctgtgcgtgggtaggggtgatgactgtgtgagtacttggagtcaccaaggaggtggagaaaggtggaacgtgagtgggaagtgtggtctcagggtgtgatggggttggataggtagtggtggcatggaaagatgttgcagtgacaggacctgtggaagggacgggactccccgccgtaggcggggagtgtgtggtgtgtggggtttggggcgttgtgtattcagtagtcgttcttgtttgagtggtctctgtggctgtgggcctcgtgggttgtcctggctgtggggtggttgggcctgtggtgcttgctggggttggacgtgggcctgtcgtctgggtggccgttgttcctggcagttcctgattggtcgattttgctgtgggaattggtgaagttgtcatcgttattgtttttgtttctctaccctgacctccgctggcccgtccttttgtctatgtgacctttttcttgcctgtctgtgcctct

SEQ ID NO: 63761 - DNA, 1034 bp, Homo sapiens
gtgcatgaatgaataagcaaacatgaatgaatgaatgaatatgtgtgaatgaatgtgcatgggtgaatgtgcgtgagtgaatgttgaatgaatgtgcgtgaatgtgcatgagtgaatgtgcgtgagtgaacaaatgtgcgtaaatgaatgcatgagtgcgtgaatgtgcatgaatgtgggtgagtaaatgtgtgaatgagcatgaatgaatgtgaatgtgttgagtgaatgtgcgtgaatgaatgtgaatgagcgtgaatatgttgaatgagtgtgtgtgggtgaatgaatggatgaatggagtgaatgtgcatgagtgtgcgtgaatgtgcgtgagtgaatgtgcgtgaatgaatgtgcatgaatctgcgggaatgtgactgcgtgaatgagcatgaatgaatgtgtgtgtagtgactgcgtgaatgaatgtgtgaatgaatgtgcatgagtgtgtgtgagtggatgaacaaatgtgcgtgaatgaatgaatatgcgtgaatgaatgcatgaatctgcatgaatgaatgtgaatgtgcgtgagtgtgtgtgaatgaatgtgtgcaaattaatgaatgtgtgaattaatgagcatgaatgaatgtgtgaatgaatgaatgcgtgtgaatgaatgaatgtgcatgaatgagtgaatgggtccccctgtgtatctgcgttgcctcccggtcacctggcaccttcgatgttgctgcctgggacgctctgtggctggctggggcagaggcagggctggtagtgccacgtgcagttggcctcctgtgtgtactggtactcgccatggccgtcctgcgtgtgcgtgttgtagaagccgcagtagatggctgggaggaagggagctgtcagctggtggggttcctggccctggccctggccctgacccggtggttcccctgggcatgcatggaacctgagtgtgggcggggaaggtctgggccctcttggtgaagcctcccctgggcagctgggggctgcgggagggccagggtggccccgcagggcacagcccggcgcct

SEQ ID NO: 63762 - DNA, 1045 bp, Homo sapiens
ctgtctggtcttcgttcttgcaggtcagccccgtctccaggctgcaggtcagcacctgcccgacctggtcgatgcttacctcggggtagttctccgcccggcactctatgctctttggtgcccagcacatcttgcccccagcagccctgatgttttcaaaagtttccatgtccccgcctgcaacccctgaggttgggaagtccacgtcaaaccactctgtccactcacacttcggttgacagcgggtcgtgccctggctggtggtggtgttagtcaaggggctcattgtcgtctctgtcctgggcgtgctggtctcggcctgagaggtggacagctcgctcgtgagtgttggcgccaggctcgtggtcagcggctctttggaagcggtgctggctgtgcctgtcgggcgagctctggaggttgccattgttgttggggccagcgtgggtggctgtgaggggcgccatgtgcccaagctccccgtcgtccctggaagggctgagcgtgttggaagggtggatgtggccacccctgggacagtgggttctgtggagcctgcaggcgtcgtggggcctcccgtggtggctgtaccaagggtgcttgtgtatctgggggatgtcagtccttctgagagggtggggactgctgtggtgctggccgggggagccctggtcagccccgggctactcgtaggctgcggcgttgagaacagggcctgggtggtggtggtggtggccgtctccagctctgtggtcggtggcggggttgtggcacgtcccctgcagtggtcgtcactgcagcagaggacccggatcctgtagttgtagcacatcttgaagacgccctcctgctcccagttcctgcacaccaggccgaagtggacgtcacagtgcaccttctgccccacctgtgccagggtccagttggggaagctctcggcctggcactctatgtccttaggctgctggcataagtgccctccagcggccctgatcttatcgtaggactcaacgtcccctccaagttgttcagacttggggtagtc

SEQ ID NO: 63763 - DNA, 1140 bp, Homo sapiens
acgctggtagctgtggatttggtggctgtgcttgtcagcactggaagggtggttgcagtccttggactggaggaggaagtggctttggaactggtggctgtgggtgtggtggccgggctggtcagcactttgggagggggagctgttcccggggtggaggacggggtggccgtggatccagtggatgcagtcgtagtggctgttgtggtcagctctgtgaggatccaggtcgtccccggagtggaggagggcatggccgtagagctggtggccggggtgctggggcagtggccgtagttgcagcagaacacacggatttcatagttgaagcacatcttgaacttccccacctgctcacggttcctgcagaccaggccaaagtccaggctgcattccacgacctggcccaactcccccagggggacaccaggctgggcctgggcacggcactcgaggcccaggggctgctcacagacggcccctccggccgcacggatgttggagtaggtgtcaaagtccccgccagagggccccggcatggggtagctgtagtccagccactctgaccaggcacactggggctcacagcccgtggtcaccaccgtggttatgggggccgatgtggggctgctgggcagcagggtcgaggtgcgggtcttgctgggtgtggccgtggccgtggtcctggaggtggccgtggtgtggcccggggtggtcgtccctggggaagggggtgactcggtggtcctgctgctagggtgagggctggacagggctggagtcgagtgctgggtggtaccggtggttgctgctggggtgtgggaagtccccgtggaaggctctgtgatgtgggtggtgcccaaggtgcctgaggtggccgaagtccaggctgtgcgcaccgtgtggggactgctgggggacagggatcgcccgtgtgtggtggccgtggtgttcggcactgggggtgtgtgggtggtccctagggcagaggagggagtcactgtgctgctggtggctgcaggtgtggtggcggtggtggtcagcactggggggataggtgttgtccctggagttgaggaggggttggtggtggagccggtggccgtgatcgtagtggccgtggtgatcagtgatggggga

SEQ ID NO: 63764 - DNA, 1032 bp, Homo sapiens
cccactggcttccccagctcccacttctctactccctgcttctgcagggcatttggacagtttttctcgcccggtgagtgcatgtggataacactgctgtaccctttccccacatgctatgccaacctgggtctgcctgtcctgggagccagtggctttctccctgctggtcatgtttgttccccactggcctcacttggcccctcccggccacactgggtccccactggccacactgggtctcctctggccacaatccgtccgcactggccacaatcagtccccactggccacacttggtccccactggccacaatgcgtcccccttggccacattcggtctcccctggacacaatccatccccactggccacactgggtctcctctggccacaatccgtccgcactggccacaatcagtccccactggccacactcggtccccactggccacaatccatccccactggccacactcggtccccactggtcacaatccgtccccagtggccacacttggtccccactggccacactcagcctctgccctctccactcccttccctggaaccgctgctccctcctgcgctgacctctgcctttgctctcccagaactctggcttacccatctctgggagtggcttatctttctatggtgttgttcttcacaggggaagtcatctacaataagaccgaccgagccggctgccatttctacgcagtgtgcaatcagcactgtgacattgaccgcttccagggcgcctgtcccacctccccaccgccagtgtcctccgccccgctgtcctcgccctcccctgcccctggctgtgacaatgccatccctctccggcaggtgggccccgcctgccctccacctcccgtgctgcgtgcacacggtctgggttggctggaggcacagccacagtccagctcccgaggcccgtctcagtgaccccgccgccagtatctccagttggaggaggcacacagggcctaggggccaggctagcatgggggccgccctcctcagg

SEQ ID NO: 63765 - DNA, 1013 bp, Homo sapiens
gacaggaggcgggacaggaggcgggacaggaagccagcaagctcacgtgtcgcttgcgtagcaagtgccccaaggaaagcattcccggagaggtgcgcgtggaacagggtgaaaggcggccccgcagggcccagcaccagcctgggagcattgcacctggctccgtgcacctgccctggggggcagctgcctccccgctgaccgggcctggtcgcctgcttgccccactgactgcctccatcttcctacatgagctggtttcctcacacaatcccctacactggaaataacagccggggtgacctctgagtcctggcggccccctgccccctgtcccctgggcagtgctcccacagcccaagactgactctcggggtgcccacaggggcatgtggatgaccaagcggctccttgtcccccaccctgcctggccttcccagaggcttcctggtccttcagtggctgctgggggtcctggactgccccccggatgtgtcctccagcctgcaggccccaggcaagcagcccacagaggacctggacagcctgggaaagacggtaggcaagaaaagacgtcaggacaggaaacgtactcaatgctcagggtttatttgcaaaactgggctgggttgagcagagggggctttgggatgctgacccctctctgacctggccgttgcgacctcagccctgagttaccctgcagcaggcatggacaggcggccgccttgcctgtcgcagcttcctggcagcagctggccttgcctggaccagcctgtctgccccagcggccggacgtggccagctggaatccgtgctgcgcgggcgctccggccgtggcagggacacataggcccgcacatgcttagtttgttccagggcgtcccagtgacatcagggaggggcaaggccaaggtgggccacaggctctcccagggtaggactcctgagtggcgccctcccgaaaggggtcctgctggcccctcacccttctggggccggtttcacccacg

SEQ ID NO: 63766 - DNA, 2883 bp, Homo sapiens
ctcgctggtcgccgagccccgcgcacgctgcctgtgctctgtgcctcactggtcgctgagccccgcgcacgctgcctgtgctcagggctgctcgtggttttagggagcggccaccaggctgggaggcgagtcttaagtccggccacacggtgccttcaggggtgtgtgtgctgcagtggctgaaccgccgtgcgtctcctgctcgatagattgcatctcagtgtgtcctcccgcatcagacatggggcgaggggcctgcgtagctgtggggtggagatgccaggaaccctggacggtggccccagtgcactgagggtccactgtacaccgcacctgctgccccacttgtttgagttttgtgagcattttcttggtgtagtttgtatgtgtgtgtggggttgtcattctgggcatcggctgcagctttgctgaggtcttcagtgcctgtggtgattgttccccaccggcacacagtttagtgacacacttgccaagctgcaaaagcatcttctagaatgcctgataaaggaagaggctcagaccgtgcagtgtttggatcagcgggcgtgacattccgtgtagtccgtccccagatgcagaggactctgtgagcccactggtcagtgaagacgagcgtgtgcagtgcaaattcacgagttctgaagggatcaaaacaccacccccagcctgctagttataaaacagactcgggtgagatttgaaagatcaaactttgatttttatatggaaggaagatgagttagtgaaggaggcgtcacagagggccctgcccaccttccccgtggctgtgcctggggttgctgtttgggggtttgcctttccagggtgtcttgcgggactggtgtttgctgagacccgaggtggccccttcctcagggaggccggtgggatgcgttgttttcttccttcagcaggagctagtgtggcacttctggaactttccgacgtttttaccaaacttgatctttgcttccagggatgcccgctgtctgtagccccggcatggtgcccgtggccctgcccccggccgccgtgaacgcccagccccgctgtagcgaggaggacctgaaagccatccaggacatgttccccaacatggaccaggaggtgatccgctccgtgctggaagcccagcgagggaacaaggatgccgccatcaactccctgctgcagatgggggaggagccatagagcctctgcctcgatgccgttttgcccccgctctttggacacgccgacccggcgctccccaaggaatgctgtcccaacaagattcccgtgaaagagcacccgtgtcgccccctcccgtggacttctgtgccgccccgtccacacctgttcttgggtgcatgtgggttttcggttcctggcggtccaggacggggcgggggctcccctcccatctcgtgctgggaggtctcagcgcgctctcctgtccctgggacgtgcgtctctccttctcatgccgttctggaaaatgctcttgctgtagagagcagctgcttctgccagggtgttggaggtggtggagcgccttccgattccattcatggcattttgtgatgtgatgtaattggaatagagctgttgatttaaggcacacacaatccctcacactgtgggttttttttagaacttcccagacgaaaactcacgcccttgccctaacgcgctttgctgtgagcctggcccctgcccagggcttgggtctggtgagctgagcagcttcctgtggatggtgtggggccggcctctggcctggctcacctggccactgtccagccagccttgtgacagactccggcctgaaggcagaatgaacccacacctggagtgaggaagggggcctggcacggttggccaggctctgcctgattgccagccagcgggcatctgaagccgggtccttcgcccgccggaggctgccgtccgtctctcctgctgcgctcgtgccagctccgtgggtgtcctcccagggagcttctcttctcaacaggccttgcgaggctggggtgagaggtgatagaggcagcactgtgcatgattccgagagggtgtggtggcactgccagccgactgctgacagcttgggagctgctgtgcccaggacgtgggttcagcgtgggcgaggaaagcctggcgagcgtggccctgtaaaagctttctgaggcgggaggcgctcacttacctctgactgcctgggcgctgcgtgtagcatcttggcctacaggacagattttaggtgacacctggttatgacagtcagaaatttgagaagcttctcacaagtgatgcactttaaataatctgcatgccattgagacacctgcatgtctggtgtttgtggttcaagtgtcttgccgccggccttcggatgtaaacccactgataacggacagaaagagaatgcccacaagtgggtcttctgtggaagatgcagaaggaggaagttagtgcttacattttagtctttttctccctcaaaaaaataggttaagtttcagtgccagctagaaaatactgctttctgccatcgattgggggtggtttttgtcaaatatactgttgataaatatttatttttgtaaacttgaagtgtgtggtggccgtgggggagggacatgctggcagcaggcgccttcttcagctgtgggtcctaaaggcctttgatcctttgaagaagaaagacatggtatttgttcagcagacgccgaccactcagacggaggggcccctgggattccctgtctcagatggcctggtcttacgcctgtgtagatttcttctccattgggaatgaaggtgtcaggcgggactggaacgttctagatggtatgttccgtgatattaacaactctaacc

SEQ ID NO: 63767 - DNA, 1003 bp, Homo sapiens
gtggacagttttgaactaaactcagagacgacagcggtgcagtgacttatccgcagttgacagttttgaactcagaggtgacagtggtgcagtgacttatccacagtggacagttttgaactcagagttgacagcagtgcagtgacttatgtgaagttgacactttcaaactcagacaccacagcagtgcagtgtggttccccccaggccgactcgacacctacactgggatgtccctcctgtcaccatcctctctcagtcacatcccagttagaagggggtctgtaagcccgagccatgtcacctcctggatttgaggaggtggtgcaggggtgggagcagggcccagcgtcccctgtgcactcagggctcgtgtagcgagggtgattctgggctggcatggggagggcgattctgggctggcgtggggagggcaattgtggggagggcgattcccgaggttctgatgggtggatgttcctccttgaccccgggaccatctccgctgtgtttcagctgcttccagctgccatggtgatgccaccccagcccgtggtcctgatgccaacagtgtaccagcagggcgttggctatgtgcccatcacaggtgcgtgtgctccctccctgggtgcctctcccctggtagaaaccccagggcctagggcaggtgcgggaggagggaacggggcttagagcgccggggtggggacgtcatccattctagaatcctgtagacgtgctgaccgcacacagatcctttcaggccaggaagccaaggcttacgtttgaattttgtttgcatatctagaaaatagaattgttttttttttttttttctaattgttggcagaaatgaggtgagttgaaattttcagagatgtggaaatgtggctttgaaaccccgttgtgcccagctctgtgcaggagaacctcacgcccctgtcaggtgacacgtgctctgcactgtgccgtcgtgtccgaacctcacgcccattgggtgacg

SEQ ID NO: 63768 - DNA, 1003 bp, Homo sapiens
gtgctttgtctcagaactgcacgatccatctgtggctcactcttcttgctcctggcctcctgggaagcaggtcacagccgtgttcaggcgactctgagtggctgtagtctatgtgttaggaaaaggcctcgtggaagggttcagggaggcagacggcctagagaacccaccctctcctgatggttggcacctccttttcctgacattggcttcattccaggcaaagttggccaagaattacggcatgacccgcatggacccctactgccgactgcgcctgggctacgcggtgtacgagacgcccacggcacacaatggcgccaagaatccccgctggaataaggtcatccactgcacggtgcccccaggcgtggactctttctatctcgagatcttcgatgaggtgagagggacgtgccagctattatggaggctgcacgtggctgagcgtggctgccgtggggacacacctgccaacacagccacgttcctggctggcttcgaggcgtggctccccacctggtgtttcattgggtgcatgacagggtcctgctctccccaaggaatgtgaaaaagggattgtttccagctccttgaacatacttacatttggaaacatccccagtgacaagcatgacccagggatacagcgtgcacgtgtcccctccgctgggcgcacagggtctggccgctcaccagcaggtgggatttccagggacagagcgtgcacgtgtcccctccgctgggcactgatctggccgctcaccagcaggtgggatttccagggacagagcatgcatgtgtcccccgccactgggcactcgtctggccgctcaccagcaggtgggatttccagggacagagcatgcatgtgtccgccccgctgggcgcacagggtcttgccgcacaccagcaggtgggatttccagggacagagtgtgcacgtgtccactgggcactcgtctggccgctcaccagcaggtgggatttccagggacagagc

SEQ ID NO: 63769 - DNA, 1034 bp, Homo sapiens
ggatacttttgaatttcagctgtttcatgtggaaacatttgaagtatatcagcagagggttttccaaatcactttagacctgaggctcagcttttgtctcattcgtttgaccaagtgacctgcagttcagtggccctgcctttagctgtggacaaggagaaagaagccgtgggcacacatggtgcaagggagaccctttaaaatgacctgaaaacccacctgagcaggctttgaggacaggaacccatttttagcggcagaaacctgcatttggggatctcctgagtgagggctgcacctgtaccgctgggggccaggccccaggctggacacccttgacccctccgtttagagatgaggaaactgaggctgagcacagtccaggacttgataaggacatgggtgggggcggggccgcgggaatgccgggggcagctgctgtcgggctgctttgtgcccccaccctgactcactggcctctctggtccccggccccgcaggtgtacatcggtgagctcccgcaggacttcctccgcatcacgcccacacagcagcagcggcaggtccagctggacgcccaggcggcccagcagctgcagtacggaggcgcagtgggcaccgtgggccgactgaacatcacggtggtacaggtgggccttggggcaccctcctgcctgcctggggctggtgcgctcggtgggggtgggatttcggatttcggcgtttatactgcatttcctaagcgggcaaacagaacttctgattcccgcttttcctgaaacctgtgtgatgttgaaaacgatctgtgtgaaagatattggcattgaccccgggttctaccaaacataactcaagtgatgagtagtgggtgtaggtgggcgtctgctctgtgtagggcctggctcttccaccaggcttgagtacgcccaaggacacctcccggacccccgccggcagctggaggaggcgcggccggcacccccgccacctggtgtgtgctgcgtgagtggcttcctgttggcctcagtgccggt

SEQ ID NO: 63770 - DNA, 2635 bp, Homo sapiens
cgagcaggtatttcaggggcacccccgttgaccggtaaacgcatagtaacatgaggtctggctcggagctgccagggtctcttaagaaggtgttgtcagcgacgggggtctcaggtgttgcttggagtacatgtgacttaatcaaccagcgctaccaactgtggcgttcaggatggccatgatgcaggggacaaccaggtggttcctgccactggggtcttccagggcagcacggtagacatggcagcacataaggacagctgagctgtgtggtgacggcccggtgggtctgtgatcttaagcgtcaggtgctgggagagtttgtaaatgggcctcaccagggctgggtgttggggtgaggacgtgacatctctcggaggaggaatgggagtaggggttgggctgggagggcagggcacggaaagagaggtgtggggtctggaggtggagaggagggagccccaggggccgaggatggagggaggcaggagctggaggccgccggagggtcctgggcacaggaggactggacttgccctggagtttaccggctcagcgcagcactctgtaaagtgttgcctggcacacgcaaggcagggcccgccttggcaccagcctgcttcgctgagcatgacccaccccagcccctctgaattaacccatagtgggcctttacccagttactagcacctagaggagccctgcttttgcaggatgtcttgacacagtatttatcatgtcctctttctgttacacctgtggtgccagagaggcaggaggttaagcagggcgctcgctcagctttccagcagaaagagatgctccccagggtccgggggcaggactctggctcgggagaccctgactgtggtctagccgttgcctccccctagtgataaggggagacggcaagatcccatgggccgtgaaggagcagaggggccgctaatggggtcctgggagggttcttttgtccttgggtagagggagcttcaggggcccgggtgggtaggtgtggagaggacgtgtgaagctagccagcccgacatcgttctgagagaatcataccgtgtttagatcttcaggataatggttccctgaatagccactaagggatgcttcagccctgtgcagtgcttccctcacgtttcaaaaaggccagtattttggaaagataaccttttttcaatatagtctgcatattatcagaaagcatgggtgagtacctgcaaggagtaccatgtggacccctgcgaggggtaccgtgggggcccctgcgaggggtactgtgtggacccctgtgaggagtatcatgggggcccctgcgaggggtaccgtgcgggcccccgcgaggagtatcgaggagtaccgtgtggacccctgccttctgcagtgagatctcgggacgtttgcgggagactccgctgcagccaccgcggtgccgtcagagaggcctccttggtagaggtgggtgcgctgtgccgtgtccaggctgctctgactccttgtcctgcttctggaggtgctggttggccatggagtccagctggaggcggcctggcccctcccttcctccctgagaggcctgttcctgtccaggtcccctcactcttcacatcgttgataattcctgccgaatcggtgacttcattagggatggcagagggtagtttctgaactttatcacttcttcggtgtttattaactgggattgtttgtaaagattagctttccccatcaaccggtgtcggctggctgtcctgaaacacaattcgtgaaagaaaggcaagtgagatgcttttccctcatcttcccgtacctcaaggagagagttgcttttctttgtagatgtgtgtgggctttctctcccctgagtgttgtgaagagcccgtggattttcctgcatcctgtgtgtctgagccagtggcacttacccgtctccgctggctctggtgggctgctcctgggagggcgtccgttcctgctgactgcacctgagccagcggggaacgcactcaccgcctcctcacgagtcctttctctctgggttcctgtgaacctttgcgctggattttttaggccgggttgtgagtctgtacaggtgtggaattgctgtgcttgcctggaaatcacatcttttcactgtgtggggacccacgggcctcttggaagataaaggcctcttgcctttgattattttgtctgatactggcatggccaccccagctgtcttttagagagtattcacctagtactttttccttctatgattttacatttttctgaaaacttttgtttaagacacgtgcaccatcgatagcacgtagctggatttttaaaaagtcaaatctaagaagactaagtcttttgatgggaatgcgctagtttcatctttctagttaagagatgcctagatggatacacagatttacagattttttacatgttttctttggtgcttttatttgtcctacattttcttattttttttctctcattgccttttgaatttattaaatggagttttaaaaaattcagttgttttatctcaagtacatacacactgtgctgggaaagtacaggggctcccctggaaatggtaacatgcacttatcagcttctgccatgagggagt

SEQ ID NO: 63771 - DNA, 2447 bp, Homo sapiens
cacagttccctcccttctccgagcgggtcgcacgtccgaaggtcacccccgccaggtggctaggccctgtcgccactcgacagaggaccgaggaggaaccaacccactgcccagactgcagcgccgccacgctagggcccgcgccgacaaccgtcatgactgggcatgcgcaaacggccccgccgggagccatttcgccgggctgcagggctcgaggagagagcaggtgcgcaggcgccgggcgagaggctgcgcctgccctaccctggagcgcgcgtgcgcgcgagagccggaaggggcggtgcctggcgcggcgcctgcgcagtggggcggtgccgggggcggggcgcggcggctgtcagctgactgtggcggcggcggcctcgaggtgacaactgtctccgtcgcaggctccggcgggggcgcaggaggtcgcccggcgcgtcactgtcgggtcggcgagccacgggggccgccgcagcaccatggcgaccaccgtcagcactcagcgcgggccggtgaggcagccgggcgagggtcgggcgggggcggtgacctgcggttgcgggcggggccttgggtcagggctactgctcagctgcggctggcgggccgactccgcggctctcccggggcacgcggggcgcctggccggccggaggggagcggcggcgtccacacctcggggcggggcgggccggacggacgcgcccacgctgcaggaggcttgagctcaccgccgtgccggggcagagctttggggaggcagccccgggggagggggcctgcgcccgttgtgagccccagatggaggcgggccccgtgccccatggtgccccagagggaggcaggccccgctccccaatggtctccagatggaggagggcccggtgcccagatggaggcggccccgagctctgactcccgaatggaggagggccccgcaccctaatggtcccccaggtggaggcgggccctgaaccctaatggtcccctagatggatgcgggccctgctccctgatggccccccaggtggaggcgggtcccgcaccctgatggcaccctagatggaggcgggccccgcaccctgatggcccccccaggtggaggcgggtcccgcaccctgatggccccccaggtggaggcgggcctgcactctagttggtcccatagatgatggctgtttcctctttctcatttacacagagtgagggcagtggtgaccacttcttgggcccaattgtgtccccggttagtggccaccgtgcaaaacctcagtttcttcatttgcaaatgagaggataggcgccaggaacttcagagaacctttcctgctctgaattctctcctgagagttgcctggcagtttcttctatagcattaatattgcaggagagctggtgtagactgactcagagatgatgggctcctggcgtgagtggcctcctggctcactgttagggccttcttgcattgctgtaaaggaataccgagactgggtaatttgtaagaaaagagatttaattggctcccggttctgcaggctgtacaggtagcatggtgccggcatctgctcctggggaggcctctggaagctcccagtcatggcggaaggccaagtgggagcttacacgtcacatggcgaaagcagcaagagagttgggggtggggaggtgccacacactgtaatgaccagatcttgtgagaactcactatcaccgggacagcaccaagccacgagggatctgtccctgtgacccacacacccaccctgccaggccccacctccaacattggggatcataattcagcgtgagatttggcggggacacagattcaaaccgtgtcactcactgaggctgggctggggcaggctgtcgtgagcggtacagtttttatcaacagtggctctgaacatgccgtgggtggaaaaagtcctttttcacgatgctccaaggtccctgccctcgcgcagcccagtactggacgtggtggaggggtcaccagggctccccacccttaacactgtatccacaagtcctggtgtttctcccgaggagataattcttcaggtagaacattttttctgagtttagaatgaagccccaggttttgggcatagctgctttttctgaggactttgaaggaaacctcctgacacttatgagactcaggtgtggagcctacgggtcggcagaggtcctggacggcctctgatggcagcgtctctacctcttcatctttactccaccacagtgagtccccgcaagttgccgtggcagccaagtgctcctttctgcctaacaggagactcagagcaacaagggaaccagcaccctgctgttgtgtcctcctggagagcaggggggcatggtggccaggcaggatggccccttccttgctgtgtggtctgggagacatcctctgcctcctgggaacttgttcc

SEQ ID NO: 63772 - DNA, 2073 bp, Homo sapiens
gtggcaaaggtgcagggcactcggttgtgctgtcctcgtccctcagggcggatgaggagtgggcggctcccagcccactccccagctccccctgcctgtgaagcagtgtgcacctgctgtgggcagggtgagaccccctgtgtgttgactgtgtggttgtctaagttttccacgggagcccagcagctctgatgcctccctgtgccccttcccttgcccaccaaatttgtgtctagcagggattgcctcacttcccagtagggatcagttacgtgctgggtgccaaggaggccgactggcacgtcatgggtaccactggcgagaatggggagggtggcatttgacaggctcttaaaggaccaggagaagtttgctaggcctggtgtaagatgggcaagttggcagagcagcagctggtgcccacaaacagggtgcagacccctgtggcaggcaggacaggtcatctagagcagggaggagggaggtgaggctggtgagtgtgtgggaggcaggaaggaggtggttccatctggcccggccctcctaagtgcatggtgcctgccaggcaggacccaggctcagagcccacctgttggaatagtgtgagggactttgttttgggggctgtgcacacagcatctgcccttctgcttcttccaagtggtcacggaagccctgtgggtgggctgaggtccagggtccactccccagtcccttcagcgccatctctgtcctgcctgcggccggggcctgctcccacagtcctccctccacatcgaaggacttggtctttctgtgccccggggctcctagccagcagcacagggggagctgggagcagggcgcagggcctcggcacttccctgggtgaggggcagctgggccactgaggcagtgactgggcagacctctgggcctggacggcacagagcctgtttcagagcctgtgagcctgcggggggcgccgcagaggtgttttctccactgggcaaagccaagaatgactaaggacgagaagagtgccatggaggtgtcgtgtgctctgaggcctcctcggtagctgccgctggcttggaccgagcaatgggctgcctcagagtgactgcttcctgcccaggcctgggccttcgctgagagcctgcccttctgggaaggagggcacttgaggtcagggagacgtgggtgctgccaggcgttcggggctttcccatggaagtccctctgttggtgcccgcacagccgttcctggagcagaggccatgtcctgcgcgtccccttggtcctactacctttgggccagtgcccgtccacctgccccatgggaatgagtgacccggtccaaagaaggtaggcttgcaggaggcttgtctcacagtgcactaagctccggggcccggccagccctgggtgctggggacagggtgagactgggggagcagctcggggaggcccagcctggagggcctcgtgcgtacttttcttctgtgttctaggagagcaggtgtggacgggaagaggcagggaggctgaggtgccagtgccggagtggcggctgctcactacctcctgaccacagccagagcctgggagagggaagccaggtctccaggttctgcccctgcccagccctctctgaggaccggaggtggaaggtagccccagcctggaaggctggcaagggggcaggaactgccagtagggcagcctccctgagtgggccctggggcacaccctgagagtgagcgcgctgacagctgctcctgctggcagccctgcgtgaccgaccaccaggtaactgccacctggagcttgccagttgacacagctcctaagacacagagcagggagacggcttgtagcccgcttggcagcctgggccactgcaacccacccctccaaatgggaaggccgagcccaggctgtagctgcccgggtggggtgtggtgtgctgtgctgtgagagcacagggcagggaggtgcaggcccacctgccggtggtcagggccaggcccagcgtcatggggagagccttccctgtggtggacacgctgggcatggcctggcacaggctgg

SEQ ID NO: 63773 - DNA, 1059 bp, Homo sapiens
ctgtccgtccctggcccgagcactgactgggctaggctgggccggacaagggagaggggagtgccatcgacctggagctcgtcagcagagttgctgcctgtgttcagaaggcctttcctgggggcttggcagcagaggaccttgaggtggagcccaggacctttctgatggatccttcttgcaggccaaggacggccctgtcccctcccttctggtcccacccccaccgcctcttctggcagcctgaggtggagcccaggacctttctgatggatccttcttgcaggccaaggacggccctgtcccctcccttctggtcccacccccaccgcctcttctggcagcctgaggtggagcccaggacctttctgatggacccttcttgcaggccaaggacggccctgtcccctcccttctggtcccacccccaccgcctcttctggcagccatgccacttggaaaaggccaattcagacgctccctcgtttcaccagccttggccagcccttgcctctggaaagggggcagctgtttgtctctgccaggcgtcccattggccagggagtgaggctggagggcccggcagcaggcatttgcgagtgctggccagccggcaccccgccccgcttctcctccccaccttcccgtcgcccactcatgctgggagaccactgcagtctccctgaagaccaagcccggcccggccagtccctgcaaagtggactctgctgcaaaatggtgcttcaggctgtcagcaaagtgctcaggtaacacctgccagcctggctgggggaggggtgtgtagcacatctgtctgccctgttcttgcccccaggaaggaggtcagggtggggaggcggcggactgtgtccgtggctgccctcccagtgtggccggcggctgtgcagcgagctgtgctgggccacacgcaagctgtccagggcagaggcggctgtgcagtcccgggccagcctggcgggtttgctctggagccctgcccagtggggctttccttagccgcctgcacttcctgttgctctgtgggagaggagcgggtct

SEQ ID NO: 63774 - DNA, 1481 bp, Homo sapiens
ggcagtggtcttaccagccctgggtgggttccttggctactcagcaagacagaccccacagggcttcccaagtgccattctctgactcagcaaacgggacctcagcatgggcccagtggtctccaacagggaaggaaaggtgcatgggaggtgaggtttactgagccgggtttctggccccacagggtgggtagagggaaccgcgggcagggacagcgggacccttccctgtcaccgcagctccctctgggttgatgcttttgtaacagtgggtagcgctggctggtggagtccaggagtggtgctgagggtggggctgacccgcacctgcctctggctccgcagggcctggcctcaggttgttgtgctcagcagccattcatcttcccagcacccattggaccctgctggtgtcctatgtgccttgtcctgcgggggtggggggaccttaggaggaaggacacatccctgctcacctgggacttggtgttacatgtccattgtagagacacaaaatacaggaaaaaaaacccagaaaatcaaaagcaaatcctcctaccacccagcgatagtctgtacttaacattaaaaccagcctcactctgtagtgggactcttgctacccaggggagttgtccactgctcccctgccggtgggaatggggacgttcccaggttgtgtgatgcttcccaagtccctgggaagggagcgtggtgccagtgctggtgtttccacaggtcggtgcccgccacttgtgttggtcttttctgaagaagatctttgccacgttgacaggcagagagcggtgccaaggtttagtccgtgtttactgcaggagggctgatatggccgatgcttctatgcacggtgggccatgccattatctgcttggtctttgcctactttgtcttgaactggtccagttttcttatgactggcatgggttctctttaagggtattaatcttgagtgttaagattttagagcttgttcttaaagagaaaagtaaaagcccaggcggaaacgatgggaagtgctggagcccgaggcagtgtctccacgactcccctggcctgcagaggggcagaggacaggtacactgcgagccagcccagagggccagggagagccgggggccgggggagctgggggccagggggcagcctgggagggcgagtgccaggaagccttgggcacctgctggccctgggcccgctcctgcccttggctggcgcctgagggatgctcttcttttcaccatcccttactttttattttttattttattttatttttttttttgagacggagtctcactctgttgcccaggctggagtgcagtggtgcgatctcagctcactgcaacctctgcctcctggctcctgcctcagcctccccagtagctgggattacaggcgcccgccaccacaactggctttttttttttttttctttttgtatttttagtagagacgggatt

SEQ ID NO: 63775 - DNA, 1145 bp, Homo sapiens
cccttttgcccgtgacctttgcgggttgggagacttttcttccaagcaccctttcagcagcgccttttcccctccagacatggtggctgtgcaggctgtgggctggcagaccctatccccacagcaatgcaatctcaggagcccaggtggggctgttgtctcggggtttggcctgcaccgtctacggaagctcctaactcctgctttgctgggacttgtcctcagcccatggaaaggcctgatggtgccaggtggccctgaggagccagatgcctgagcctggggccaggcctgggcgtgagcccaggagcataaaattagctccggcgtgggttgaaagctgctggcgtgagcatggcttgtctgtgttgagtttgtcttgcacagccctggcctctccccacagcctgcggccagccctctacatgggcggccgctctgggttcctcctcccggcacatctgcccttctgctgcgtgccctgttctttgtgccacatgtgacaggaccatttgtcatagcagtggtgtcatgaaatacaagagtgtgggcctgagaatctgggttgagtcaggttcctgttggaggcctgcatgcgcgcagcctgctctgagtgctccggacacgcgtgaacagaggcaacaggagccacccctgggcagcttccccactgccgagggggacgggagtaaggaggtgtgggatggggtgcctggagggggtgcgtgggagagctgtttgaataggagctctagaaggcctctttgagaaggtgctgttgagctgagacctgcggaggtgagggaggggactcgccatgcaggcctatggagggagccctggctccctggtgctttgtctcagaagggctgcctttgcctcctccccctcatggttccagggacacgtgggtttttatttaatatttttcagtcgattgtcgtctttaataatattttgatgaatgggctgtgtcaaatttagccagcaggagcgcatgtgactcagctcccgtatcagttgaatagacgaaggggcagggagggaagcctctgtgagcaggaactggtgagcctggctgtgtatcacctggataacctctgagctgaagagctgtgccagcaaagcccttgagctcatgtggg

SEQ ID NO: 63776 - DNA, 1086 bp, Homo sapiens
gagtggggagggcctctttggggctgctagcttgtgcttactaacttggctctcccagctgccttcaggggtcctcctctctgaccgagataaaatctcgtgagtgtgtgtctctgcaggaatgtgaatggagtgatgatgaccttgtttttcttctttcttttctttgccgcatgggaggatgttactggtggttgacaattgattctgattatgaggacacccaggctgaacttgcttgaatctctagagttcttttaacagcctcattgaggtataatttacataccataaagttaacttaagtttgcaattaaataatttttggtaaaattacagggctgagtaaccatcaccacagtttaatttgagaactttgctatcatgccccagagaagcctcatgtccactggcactgctccccatccccacctccagcctcgaggcggccaccagtctcccgccatctgtgtgggtgagctgaatcatgcaaatggaatcccagtacacgggctgtgtgcctgtcctatgcggcgcagtgttgcgaacgtccatccatggcgttgcgtgtgtctgcagctccgtcctcttcatcaccaagtgcaattccgtcctggggagatgtgcatctgccactctccttccaccactgatccgcggtttgtgactgtgacttttaggacagtgagctgggcctgttcctcagccgggggccccagattcctgagttcatgggctgccgtgtaccaggctctgtgctggggcggaggtccagagatggagacacagccattcccgctttcctagagctgtcaggctggtagagaagggccccaggcagcaggagaattgaggagtgggtgagtgcggccaaaagcagggggctcggttagagcaggtatgaagggcttttccaagagggaaggaggaaggaggtggcccaggaagaagcagcagcacatgcggaggtgtgagcagagaagccggctggcccaggtctgctgtatctccagcgggcagccctggaaggtctggtttcaggaatagcctctttccatcagggctccaccagggcactcttaggcc

SEQ ID NO: 63777 - DNA, 1032 bp, Homo sapiens
ctctcaacccacttgacggccctcctcctacagggggcttcgccaccttctcctcctgcttccccggcctctgcgagggcaagcctgctgccctgctacccatgagcctctcccagccctgcctgcctgtgcccagcgtgggcctgacccgcatcctgcctcacctctacctgggctcgcagaaggacgtcctaaacaaggtgtgtgtgcagtggagttcggggggtggtcaatgggaaaggggcaggagctccagaagcagcttggcagcggagcgggggatgagggaggaaaggagctgaaggcagtggatgagctgggtgtgggagaagcatgggtgggggcccaggaggaccccaggctccccacccatgcccctggaaggaccacagcagggcttgcgggagggcccggcagggctcgggggaggagcggggagctggcatgccaagctgcggatgtcactgggcctctggccagctctgaaagaatcccatgttttaaaaatggtgacgagggaaaagggtaaaagccaccacccaggcaatcataaaattcctaggagcccaccaccagccgtgggtggggcctgcagtcggaggccagccgtgccccaccccccgcacgggcccagggtgccagggtggaccagagaggcctcctgggccctcccctggatacactgggatctgggacaaattccaaggctcccaggattctaaaggccctcctgacggcagggcaggaaaagcctccaccttcactcccgccccgagcttctcccacccctttccaacccgccctcccgcccctccaggatctgatgacgcaaaatggaataagctacgtcctcaacgccagcaactcctgccccaagcctgacttcatctgcgagagccgcttcatgcgggtccccatcaacgacaactactgtgaaaaactgctgccctggctggacaagtccatcgagttcatcggtgagtctgcggtgggcggagggcagggacctggctagaggaaggctagagctgt

SEQ ID NO: 63778 - DNA, 1050 bp, Homo sapiens
aggtccagggagaccctgtgggtgaggatgctctcccagaggccagcatggcacagaggcttcctgcaggagggggcactcggccagcccttcgcagtacagagaaggcctctgagggggcggggagccggcgagctgcagggagcatgctgggcacagcaggtacctggagtgggaaggaaggttaggaccaggtagggcagaggagcggaggggctgaggactgggctctgcactgccgggcacctgctggggtgggtaggagagagcagggaggggcgcgtgcccactctgcagaggagcctgctccatggtggtggctgccgcaggagcagcggttgcctggcacctctgctgttgccatggtgacgatggaggtgctaacttgctaatgaatccccttcggctgcaaataacaatactattgtgggtgataggcccagctccagctcagcgttgcttaggaggcagagcagggccaggtaaaggccaggacccgtcctcccgcccctccagcccctgcccaccaccctgcagctggacttgccctcctccctcccctccctctgggtctcagatctggctggctgcaccgaggtctctcatggcagtgtcaggactcagggctgcatgaaggctaggccctggctgcagagagggcgagggcctctcctcacacctgccctcctccctgcactggggggtatttgcttctgttgttttcagtgagagagaatccacccccacttaacggatgaggacattgaggccggggcagctcctcaaaagacccccagcccaagtgtccctgccactgcagccttctcggggttctgggtctctgagctggacccttgggtatcctacggggcacctggagccgctgtctcaccagaaccacacatctgggccctcgcctctcaccacctgtgcaaggctcaggtagaactcgggaaggacaaacagctcatcaaggaccccctgtgggtagtcagggacccccttggcaggcagagaccctccacagcaggcaggcagcaggcccttttg

SEQ ID NO: 63779 - DNA, 1058 bp, Homo sapiens
ctcctctccaggcccagggccccggccagtgcccagccccgctgggagacccggccagcaccacggacggcgcccaggaagcccgagtccccctggacggggccttctggattccgaggcccccggcaggttcgcccaagggctgcttcgcttgcgtgtccaagccccctgccctgcaggctccggcggcccctgcccctgagccctcggcctctcccccgatggcgcccacactgttccccatggagtccaagagcagcaagaccgacagcgtgcgggctgccggcgcgccccctgcctgcaagcacctagccgagaagaagacgatgaccaaccccacgaccgtcatcgaggtctacccggacaccaccgaggtgaacgactattacctgtggtccatcttcaacttcgtctacctcaacttctgctgcctgggcttcatcgccttggcctactccctcaaagtgagcccgggcggtggcagggggcaagggcgggctagagaggtggtgccggcaggacagtccctggctgtgggcgctcggcccctctccctctcaggggagcacacgggtagaacaggtgcagttgaggggccaagggatcaaaggacagtgaggggtcctgatggtgggtcccagagaggtcggggtactggctaggtctgggcgggcaggggtctgcccttccctctcctgagccatcagggcctggctttctgctcagccagctcagcggaacctgcaggaggggctgggagcgggggttgaggggggcggggttgctcaggctcaggggacatgggacgtagacctgggcagcagccacttctccgtgtgcagggatggggccagcgtggggctgaagagggcttggaatcctacccctatggaaaggaagaggggccaccttcttatccagctcctcacccggagcccaagggcaggtgcttacacagctctgccaagccctgcgtggagaccagacctgggtggccagggcagcccagggaagaggggtgtaaacaggtcctgcacctccccagctcagggctgcga

SEQ ID NO: 63780 - DNA, 3015 bp, Homo sapiens
tgcagaggccctgcggccagaaccagccatcccaacttcccagattgtgccatcactccctcctggaagccttctttggttttttcttccagacagacagacagggtcctccccagtggagctcctggcactcacttccttgtctgccgctagccttgaccctgatgtctggctgaaccttggctcctgagcagaccaggagaacctgagggttgaggaaaacctcttctgggccaggctgggcccacgcagagcagccctaccccgggaagaagggagtctgtccctcctcctgccttctgggcctttccatccctgcagtttcagaaaggcccctccttcaggaagctctccctgattgccacattcaccctcttactcctgacctggcactcttgtgcttggggggtggcgtggcagctgactcctcccttttcctcctagggacccagatgcgcagcctgggggtgagctgatgctgggtggcacagactccaagtattacaagggttctctgtcctacctgaatgtcacccgcaaggcctactggcaggtccacctggaccagtgagtagtggctgcagtcggctcccctgggttctgtgggcgggggcggtgtgcggagaccctggaggaccccggttctgcaggtgggggttgcatgtggggagtagtgggagctgggcaagaaagagatggggtcagaccagccctccatgcccctccttgcccctccatgctccccatcacctccatcccctctattccctctatccctccatccctccatttcctccatgcctctgtgactctccatgacccaccatcccttctgtccatccctccatgccctccatcccctccatcccctcatccctctgtgactcttcatgaccctccatctcctccatccctccatcccctccatccctccatccctccatcccctccatccctccatccctccatccccacatccctctgtgactctccatgaccctccatcccctccatctgtctatccctccatccctccatccctccatgcccctccatcccttcatcccctccatcccctccatccctctatgcccctccatcccctccatccctccatgcccctcaccaccacctgagggtctcccaccccctctaccactctgtgtctcctctcccaccctcttccctggagggcttacagccggctgtgcttccaggagccctgaggggaggagagtgcagcccagccaggggaggggctcccagggaggggcactgggcccccagggcacactccagtcccggcaggggcttcacgccctgactccccgcagggtggaggtggccagcgggctgaccctgtgcaaggagggctgtgaggccattgtggacacaggcacttccctcatggtgggcccggtggatgaggtgcgcgagctgcagaaggccatcggggccgtgccgctgattcagggcgaggtgagcgccgggggctggggctggggctggggctggcagggggagccccaaggccaccactaccaccctgacactgctgtgacccctcttagtacatgatcccctgtgagaaggtgtccaccctgcccgcgatcacactgaagctgggaggcaaaggctacaagctgtccccagaggactacacgctcaaggtgagcgggcaatggggtgccgcacgccccaggtgagcgggcggtgagggggcgcacgctccaggtgagcgggcaacaggtgggggggcgggtggtgctaggcctgggtactgaccaccagggccgtcccaggtgtcgcaggccgggaagaccctctgcctgagcggcttcatgggcatggacatcccgccacccagcgggccactctggatcctgggcgacgtcttcatcggccgctactacactgtgtttgaccgtgacaacaacagggtgggcttcgccgaggctgcccgcctctagttcccaaggcgtccgcgcgccagcacagaaacagaggagagtcccagagcaggaggcccctggcccagcggcccctcccacacacacccacacactcgcccgcccactgtcctgggcgccctggaagccggcggcccaagcccgacttgctgttttgttctgtggttttcccctccctgggttcagaaatgctgcctgcctgtctgtctctccatctgtttggtgggggtagagctgatccagagcacagatctgtttcgtgcattggaagaccccacccaagcttggcagccgagctcgtgtatcctggggctcccttcatctccagggagtcccctccccggccctaccagcgcccgctgggctgagcccctaccccacaccaggccgtcctcccgggccctcccttggaaacctgccctgcctgagggcccctctgcccagcttgggcccagctgggctctgccaccctacctgttcagtgtcccgggcccgttgaggatgaggccgctagaggcctgaggatgagctggaaggagtgagaggggacaaaacccaccttgttggagcctgcagggtggtgctgggactgagccagtcccaggggcatgtattggcctggaggtggggttgggattgggggctggtgccagccttcctctgcagctgacctctgttgtcctccccttgggcggctgagagccccagctgacatggaaatacagttgttggcctccggcctcccctctgtgctggtgtgctcttgtgcctggtcaggggtggctccaacttgggatggggaaggagggtgggtagtgcgaagccagcacggcagctgactcggcagcaccgggacaagcatttggggtgccccgggcctatggccccctgccctgccctgcccagcccatgggctccagcctggtcggccagcggggactgacttgttcccaggtctggagcagtagccggcaggatgtggccttggctggggtttcagggtgtctagtgtgagtgccagccttgaggagtgatttcagggagg

SEQ ID NO: 63781 - DNA, 1170 bp, Homo sapiens
gcagagaaggggaagggggcagtatggctgtgagcttgggatggggtcggcaggttccccatctctcgggctcctggcccaggctgtgtcttgttcccagcgctgagggcaggagcaggacctgcctgtcattggtggtgggagtaagaggtcggagcagggagcggagcaaggggcctgcccgtctgtgctcctgcctggttcccatctcgtgtaaaccgagccctgatgacttccacgaagagggccccgccataccccgtgtccccatccccagcggtgttcagctcagggtttccagccctttcttctgggccctctgggccccatcgtgtgtgggatgggcatccattgaactgggttttgtagcctcatgctcagggagtggtgtagggctcagcctgtctgctgcccactgactctgccctggcctgcaggtgccctgccagtcagcgtcgtcagcctctgccctgggcggtgtcaaagtggagaggcaggtctttggggaggccaccaagcagccaggcatcaccttcatcgcagccaagttcgatggcatcctgggcatggcctacccccgcatctccgtcaacaacgtgctgcccgtcttcgacaacctgatgcagcagaagctggtggaccagaacatcttctccttctacctgagcaggtgggcgtgtgggttccctctcgctccgcgttgctgggaggcagggcggggctggacggggagccttctaggcaccccctctcagtgctgccccctccctgctgctgtgccagagctcctgacctctgacctcagggcatccgggaggcgggggttggccgcccttctgcagaggagtaagcggcagcacagagaaagctgtttggccggggtctcccagtgggaggggctcgggccaggctgtgggtcctgggaccttggcagctgggcctccctcctatgagaatggacccaggtcaggggtcgtggcagttcctcttggttcagtcggcccgtcggtccccagacctggtgatgggcacatgtggtcctggtcccggggttgctgatggtggagagggtcatggtgcccaggggaccggggatccccggggaggtgaccttgggtgcgtatgggtccccggcaccacgctgcgagcagctctgtgggcgtccccagc

SEQ ID NO: 63782 - DNA, 1038 bp, Homo sapiens
ttgacatggccccaacctggggaggaagtcacttcctttctcagaccttggactgcgggccaccaggggagtcttccaggccgggctttcctgcacccggggctcaggctgagggccacgtctgtccccaccctggcttgacctctggccttgtcttttccgtggggaagtcctcagcctcaccatgtattgagcaggggtaggtgacagaagccaggggtctagagaccccaagtacccgtgggcattaggaccgagggctggggacctggcccatcttccctgcaggctgagcaggtgggagtgggtggctgttggcagctgtgggccccgtgatgcccctccctccagtatgggccttggctctggggacagccgggccttctgaggcccagtggggagatggggccccctctcccatccctgacggaccctgtcccctgccaggcccagtactacggggagattggcatcgggacgcccccccagtgcttcacagtcgtcttcgacacgggctcctccaacctgtgggtcccctccatccactgcaaactgctggacatcgcttgctgtgagtcacgaaccctggccccgtcgcccaggtcctgcccttccgggatgtcgctgcagggctgcctcaggaatcacttgggcaacgcaattctcctgcctcttggccccgtgagccaggccagccctccaccctgctccagccactgactttctgggtgaaccaccagctgtggtcttgctctcagcagggctggggctggggtggccacagagggagccggctgtggctgggagggaggcccggggtcacagcccacagtcccggggctctggcatgatggtgggcctcagatcccctccaaatcccaccctggggaggcagcttggggggtgcgggctccatggtagattgtagggggatgggagggctaaggccgtggcgtgggctgcgggatgaccggcgggcccccttgtcgcccggggcagggatccaccacaagtacaacagcgacaagtccagcacct

SEQ ID NO: 63783 - DNA, 1069 bp, Homo sapiens
ggggctgggtacagtgggctgcctcagagcactttgggcaggagtgacaggtacccgccagcaccctgagcagccatgctggccaccatcctggaagagaccagcgcaggtgcagagggaggacgggagacccttgggggctttggagcctccagaatggctgaggagaggagggttgggcacactggcccccaggttgggtgtgtggggctgaggtgggtggcgggtgaccacttcttaggactgtggcctgtgcaacctggcggggggcaatgggttgccattcactgacttgggggagctgggccagcagtttccaggtgacaggcaggagtttggttttggctgtggcgactctgagattccccaggggcctccaggtggatgtgcagcattggcagcgtcggccggcaggcgggagggcctccctgatatgccccgacccgtggttgacaggatcccgctgcacaagttcacgtccatccgccggaccatgtcggaggttgggggctctgtggaggacctgattgccaaaggccccgtctcaaagtactcccaggcggtgccagccgtgaccgaggggcccattcccgaggtgctcaagaactacatggacgtgagtatgaggtcttagccctgctgcaagcggagccactgtcaggagagctccgtggcagtatggggaacattcccacctcctgttctcagcagcgcagtttgagtggctcacctggccacggtggcgtcccggctcagccacactcctttcttccccattctggaacctcctgccactggcccctgtcattgcagggtcttggtcctgctagggcctgggagggtgattgggagtggcctcgggccttggtgccagctcgcctgagggggcggtccttgggcctgcctgagtgtggccggctgacctggagcctttcactgctgtcctgctgggaggcctgtggtgactcgtggcctccccagcccctccccatcttcttcctctcgcaacagcccctcctgtgcccactactccttcagggggaagcaggatccaaggtggagcactctg

SEQ ID NO: 63784 - DNA, 1035 bp, Homo sapiens
aaccttggtttgcaagaggcttccagagaggatgtctgggagcgtctcggagggggacgagggggcgccgggaggagcaggtgcaggagcccacggcgcagcgccccgcgcaggcctggacgcggggacggccgcggcggccgggacaggggtcaccccgcggggccctccagggtgggccgccccacgaccccaggccaggccgaaacgggaatcctccagaccccagaagctgggccgggctgaccccgcgggcgcgagcggcgggaactgtaggcgcggcaggcgcaccaccaccccgccccccgcccgggcgctgtgcgcgtgcgccgaggttgccccgcccaggccaggccccgctccgccccgccccgcgcacgccggccgcgcccacgtgaccggtccgggtgcaaacacgcgggtcagctgatccggcccaactgcggcgtcatcccggctataagcgcacggcctcggcgaccctctccgacccggccgccgccgccatgcagccctccagccttctgccgctcgccctctgcctgctggctgcacccgcctccgcgctcgtcaggtgaagcctcaggggccggggctcagggacgggcaggggtcgcggcgccgaggtcccggggcctgtggtgactttcgcgctcccctgtggcccccacgagccccttgcgccccccgcgctggaatgcacctgtgccgccctgcgcggcctcctgcacggaccacccgcctacggggcgccgggctccggaggtgcaggggacccggggcagaggcgccagatgcctctcccccatatgccaccctgggttgtaccttgaggactgcagactgaccgcagcctccctggagacggggcggggcggggggaggtagtgctcattcggggcaggtggaattggggtctgtactgagcgcccttgttgctggagacctaggtcaggcctcagagcccccgagtctgggcgagtccatttccttagggacccctttaccacctgtgaactgggggctttaaaagtt

SEQ ID NO: 63785 - DNA, 1646 bp, Homo sapiens
gccgtctttggagaattccaggatgggtgctgggtgagagagacgtgtgctggaactgtccagggcggaggtgggccctgcgggggccctcgggagggccctgctctgattggccggcagggcaggggcgggaattctgggcggggccaccccagttagaaaaagcccgggctaggaccgaggagcagggtgagggagggggtgggatgggtggggggtaacgggggaaactggggaagtggggaaccgaggggcaaccaggggaagatggggtgctggaggagagcttgtgggagccaaggagcaccttggacatctggagtctggcaggagtgatgacgggtggaggggctagctcgaggcagggctggtggggcctgaggccagtgaggagtgtggagtaggcgcccaggcatcgtgcagacagggcgacatcagctggggacgatgggcctgagctagggctggaaagaagggggagccaggcattcatcccggtcacttttggttacaggacgtggcagctggttggacgaggggagctggtgggcagggtttgatcccagggcctgggcaacggaggtgtagctggcagcagcgggcaggtgaggaccccatctgccgggcaggtgagtcccttccctccccaggcctcgcttccccagccttctgaaagaaggaggtttaggggatcgagggctggcggggagaagcagacaccctcccagcagaggggcaggatgggggcaggagagttagcaaaggtgacatcttctcggggggagccgagactgcgcaaggctggggggttatgggcccgttccaggcagaaagagcaagagggcagggagggagcacaggggtggccagcgtagggtccagcacgtggggtggtaccccaggcctgggtcagacagggacatggcaggggacacaggacagaggggtccccagctgccacctcacccaccgcaattcatttagtagcaggcacaggggcagctccggcacggctttctcaggcctatgccggagcctcgagggctggagagcgggaagacaggcagtgctcggggagttgcagcaggacgtcaccaggagggcgaagcggccacgggaggggggccccgggacattgcgcagcaaggaggctgcaggggctcggcctgcgggcgccggtcccacgaggcactgcggcccagggtctggtgcggagagggcccacagtggacttggtgacgctgtatgccctcaccgctcagcccctggggctggcttggcagacagtacagcatccaggggagtcaagggcatggggcgagaccagactaggcgaggcgggcggggcggagtgaatgagctctcaggagggaggatggtgcaggcaggggtgaggagcgcagcgggcggcgagcgggaggcactggcctccagagcccgtggccaaggcgggcctcgcgggcggcgacggagccgggatcggtgcctcagcgttcgggctggagacgagggtgagtttttccccctctgccaccctcagcccccacccgcccctccccacacaaccaacacgttctccccacacgactctctcgttctccccacagccaggtctccagctggggtggacgtgcccaccagctgcc

SEQ ID NO: 63786 - DNA, 1088 bp, Homo sapiens
ggctccactctcaggaagtgggaggagggggcagatccatgcacactgtgtccttgaccaccagcctcagaagcaggccatgcccagccagcagccagcctgcctgtcctcttcagccatgcatcaaatatttagtgggtgcctgctgtgtgtcaggcactgttccaggccctggctgtgggagccaggcagcagacccctcccctggaggatctgcaactctggcggagatgacacgtgtcacagcacgatggtcatatcagtgctggggagggacggaattcctaggatgcttgctagagggtcacagggttggggcactcctcaaccacggggctgaggcactccaagtgcagaggcttggaagagccacagtggatccaggccctgatgcctgagaaggagccagctaggcagagccggggaggagcactccagacagacaggtgaggttggaggaacacaagggaagcaggagacagagccaggggaaaggggctggacacaggttaggggcaggtgtgagcctgggaggcaggggggctggccttgggacctggaggccagagggaggctgcattttattctgactgcagtgggatgatggagggcttcatgggcctgacatctgattgcgggggcagcagcccgtcttagctccagagtggaactcacattcacagtcacttgcaggctcacagggaagactggctatgagggggtaggaggaccacttcgcagggcctggcccatgggagctccacatctgaagtgcccttcccagtggcccactggtgtgacctcatggggaccttggggatcccatggctgacaaggacatggcttgtgtctgtgtgatactggcacagtacgcacccagaagtgcgtctgaaagggttcctgttgttagctgggcctggtggagcttccatcctggctccaggacaaatattcaggtggactctgtcagaggatgaggggagaaaggggaggggcttgctcagcagcccggcctgggatgggagcgccgctccctgggcctcccctgccctgagaaggcttatgcctgaggaaggcagagctgctgg

SEQ ID NO: 63787 - DNA, 1244 bp, Homo sapiens
aaccactgtggcatcaactccttcaggaagccctcccggattgtccaaggtgctcacctcctttggggagccctcccagattgtccaaggtgcttgagggagggaggaatgggttgttctcccggcaccggggctgcactcctgggcagacgctgcatgcctgtcctcaggcgcggccctgctgccacccccttgggggctcggagcgcgacagcagcttggggacgcctcccgcgcccagcacggtgcacctgggccctgaggtcctggccgaaacgcgccaagttgggggtaggtgcagcgaccccatacccctcggctgcgcgccctggcggcaggaggcggggccgggggcggggcgtgagctggccggggcggggcctatggaggggcgggaccgcggcgccctataagtactgcggagcgaggcgcgcgcccggccagagagcgagcgcgcaacggcggcgacggcggcgaccccaccgcgcatcctgccaggcctccggcgcccagcgccccacgcgcccccgcgcccccgcgcccccgcgcccctttcttcgcgcccccgcccctcggcccgccaggcccccttgccggccacccgccaggccccgcgccggcccgcccgccgcccaggaccggcccgcgccccgcaggccgcccgccgcccgcgccgccatgggagtggagggctgcaccaagtgcatcaagtacctgctcttcgtcttcaatttcgtcttctgggtaagggctgcgccgggggccggggcgggagggggcaggcacacactccacgttgggcaggtcccgcggcagcgtgctaggccccgcgggcgcagcgcgggccgcgaagttgtggggccacctgtgggctccaggagcggggtggggggtcgcccggggccaccgcgccccccgacattggggctgagggctgcgagccgagtttcggggcctctgtgctcgggggcccacctctgcggccgggccggggcttctgggggccgccgggcagttcccgctgtggtggtgatgggtgcggtggtcgcgggtcgggacccgagtacccggccgcccctcagctaaggaggggcctgcgcgggtccctggccgcggattccggactgctgcttcgcggggacgaggggggggctcgcgggcgggactcctggcgccccgcccccatgagctcatcaagagccgccgcccctggatggtggggcgggggcgcacactttgccgga

SEQ ID NO: 63788 - DNA, 1183 bp, Homo sapiens
gcagccccctgggagtgtcgccagggcgggcctggaagtttcccaggcagctggggtggagacctgacacatcccaagggtgcttgttattaaggctcaaggaaatgtctctgaggcctcaccgctcctctccccagggcctgctccctgcaaagcattgagaactgagtccgtccacagtcactgtggacccacccatccactggggctcagtggtagccagcaatgccaggctgggtgaggtggggttggtgggcaccaccctggtggacccccctccaccctggtgtcgcagggtgtgtggctgagagcacagtgccatgggcttgggcctccttggtggagtccccaacacactgctctggtcctgggcctcggccttccccgtctgcagtgggggcccacagtgagcctacctcctggtggtgttggtggatttgctgacatgcctgagtgttgacagggggcttggtgcaggaagggctcagggcgtgggtgttggccaggggtccaaagggacctctgcctcagagagcccagcccagacaggcaggatgtgcagtggggaaggggctgcgggaaccctgcagggtccagaaggacacagtgcagtcctgtgggctctggggaggctggtggggaggaggttgacaatggatatctgggtggggcacttgttagaagttccattttagagaggaaagaggccttgcctgtgggagaaggcagctggggtagcctgacctctttcccaggaaggagcccacacacacacgcacaggcactcacacacacgaatgtgcacacacacacactcccaccttcacacacactcacactcttgctgtctcccttcccaagccaaggtgcgagggggaaggtctgggcagcatgcacctgcgccctgaccgctttgggggccagtgagaactgggctccctgggtgcgcggcgggcccaagcagggaggacattgcagatgccctggccaagcagcgtggaaatcctgtcccttgggtgggtctcggagcctccatcagaggcggctggcacctgagacccacctgctgccaggagcagggcaggagagtttgtgtcccgggacagggaactggcctgtgggagccttgccttcctcatctgtgtaatggatataagagtcttctcctcgggggctggccagg

SEQ ID NO: 63789 - DNA, 2171 bp, Homo sapiens
ctcttggggcgctgccacacccttgcaggagggggcagtgttcctgggatgctcaggtcctggtatcacctctggccagatacggaaggtgaaactacagggcatccaattcaccttgaacttcagataaacaccagattatttttttgtatgtcccgtgcaatatttgggacacacttaccctaaagaagtattctgttttcatctgagaggcagatttaaccggcgtcccgtgtcttcctggcagtcctgccctggagtcacactccacaggtgcagggcagggccaggctccaagtagatggcggccaaagcacccgccccatgctcctgactcccggggctcttcagggcattgcgaaaaccagcagcagagctgacacctggtccctgctcgggagccagcaaggcaggaggctgcttaggccttgcgtgtggggtgggcgcactccctgctgcagtgctcttcgtacatgtgacactgttcccgctctttcccagctggctggaggcgtgatcctgggtgtggccctgtggctccgccatgacccgcagaccaccaacctcctgtatctggagctgggagacaagcccgcgcccaacaccttctatgtaggtgagtgcacatgtggccgcagacgcattcagggagggcttctaggaggaggcaggtcctagccttttggatggggacatggagggtgaaagacagtcgggcatggcgtgtccgggcagggaggcggccctggaaagggctctgggcacaagggttgagatggaggtgggcctgtggcctgctggcccttctggtctgagccagggcagggggtggcagctaggcctgggcagggactgtgtggagaccttgcttattttaagtgtggggttatttcgggggaggctccctgagaagggtggggctggatgcctgggccacacagagcagccgaggcagctggcgctgtggagcccgggagggagggagggatggagctcaagggatggaacccagtgaggggtggagacggggcaggggaggggtggagaggggtggagacgccccagaggcggtgtgactcagctgcccctgcaggcagctgcaccttgctgccttattaggctgcgtgtgggggactgggctgccctccctgcccccaggagcaggagcaggagtgatggaggaggaggaggggaggggcaaggccaggaggaggaggagggccatctcactgtgcagagagcagcacccttcctcctggtgcccctggcagggctggtgctggtggggctctgggagcatttgttgagatgcttctggccttgaaaggaggcccctgggatggctctgttgccctcacaggctgaggggtgggtgaggtgggcagcctgtgtgtccccagtcctcagggcttccctcagccggcaggtgcccccaggcctggagctgcagggccaggccccctgccagttacggaggctgcttggcttggttgctgaaccagggccccaggaggccgaaatagccccacacctgcgccgtcccacctctttgtccagtcaccccagggccaggtgagggccctggccacacagcgtgcccgttccttcttccccatgccccgctcatgggtcagagggccggtgctggggtccagatggtgtcaacagggatggtccctgtcctccccagagacagaagcctgtggcccacggagggtttctgggcccagccgatcctagggagggtcccatggccctgcccataggttcctggcctctctcggggccgtggtgccctcacaggtggtgtcaggaaggacgggaaaggctgcttgtcccaggggctcatgtggagaccaccccctgcacgcagctggggcgctcctgcctgtgtcctcagaagcactcggcttagctttgcccatgtgcctgggctgtgggtggcagagcccggccagcatcctccgatctccaagggtgcatctctactggaggcccctcctgggcctcttgctccccgcttcccagatcattaggatatttggggtccagaagggcctcccagccatcctgggccttgtcctccggggccaccagtccagccagtgacaaccacagcatccccggcctggaacgaggctgcccccagcacgttcctcgtactcctgtcc

SEQ ID NO: 63790 - DNA, 1026 bp, Homo sapiens
agcctgccgttgtgttggccacacgaccacaggacctgccacccccgacgtgggctctgcctgggcccccactggacagggaccccttggagctcctctggccaccaagtcctcgcccattccagaatcggccttctggagcctcttgctgtccctgatgcgggctgggccttgccaagggctttttttcctgcgccgggaacagggtggatttgctgggctcactcccctcagagacgctgcgggtgcggtgggttaggcccaagggcgttaagagaggaggctggggtggggctggggcctggcagggggtctggcagccctgggcctcccacctcctgtcaggaccaaaaaaggcaacgcgcctctcctgacctgtaccccggagtgaacccaaccttgcaacccaggagtgtcagggcctgaggggagggagacctggctcctgggtgccgtgcccgtaaggaggtggccacctgcagggcattcctggcagaggcttcatctggccaggtaggaggctgggtggccgagccccaaatctgggtgtgttctctgcctggcggtgggtcctgccccaggcaccttctcctctgggctggctgggcagggacaatgggcctggctgcgaggagggggcctgggctgccttctgcattgcctcggtgacgggagatggcccctgcctgctgagggataggggagtgggcaggcagtgagagacactgacagctgtcccgcgggtacagggccctgtctgggtggccaggcccatgtctcgggcccacagtgcgccccccacccttggacggcgccttctccctccccaggtgcatgctgcccagccagggagcgtgggggagttcgggagggctggcctacacgccctggtccagctgtcccaggtggggtgctgggcttcagccctcagcccagggcctaggaatccaacttgatcctccccacacagcagccaggttcaaatgcaggtcccgtaacggaagtgctgctgtgcagcccagattg

SEQ ID NO: 63791 - DNA, 2947 bp, Homo sapiens
gcctacagcctgccctctttcctccctctggccactgcccggctccagttcttcacctgcctggtcatcctgtttgcctgtgaggtggccgccggcatctggggctttgtcaacaaggaccaggtgagcctgggtgtgcagggacagggtggggtgggtgacgggggcaccctcctctcctgtcgcgggtgggggttgggctgactcatggcttgtgggagctctttgggctcttcctgggtcccacttgccaggaggatctccaggggctttatggaggaggcagcattggggctgagcaccaggccagcctcccgtgtcccagcactcccggggcagctgagagtgcagagtccttgtcctctggggtctagcctcgaagccaccctgcccagggagagcctgggaaaagtgcgtccgcctggggcggggcggggtgggggcaaggagggggaggttccccctgtgcatgtgaccgcacccctcccccagatcgccaaggatgtgaagcagttctatgaccaggccctacagcaggccgtggtggatgatgacgccaacaacgccaaggctgtggtgaagaccttccacgagacggtgcggccccggggggcgagggcggggagcagggccccgggaacccggcggggtgtgtctcgtcctggatgaatcctgcctacgcccagacctcaggagcaggaggtgcccttgggacctccaggacccctggtctcaactggtcctcgggtgggaacctagtgggccagggtggcccagggtgcggaaagctctgagcagcgcagctgaggaggaagaaggctggcccctggatgcattctgcagtggggagcgctgcgtacccctggccacctccccatgggttccctagagccaccgtccccctgggcacatccagggctgaccttgcacccctgctctctgcagcttgactgctgtggctccagcacactgactgctttgaccacctcagtgctcaagaacaatttgtgtccctcgggcagcaacatcatcagcaacctcttcaaggtgcgcgaggccggtggggccgcgcctgaccccccgcatgtcccgcccctgggtggggtcctaggggtgggcaggtcacacggcagccccacagggagcgaccacactgggtggcatggcccctgtcagggctgctctgctgggagggttggggtgggaccgcatctggcccacgaggaaggcaggcgccctgtgctgcgcattccgggtgaagaaggtggaggctctggggggtgggaactcacctgcacccccagctccacgtgtgcactcgtgggtgtggacgcccctgacagcctgtagctggcagggcctgcaggccatatagtgccctgtggaagtttcctgctgaggcctcagtggaagtcgtcatcagtgatgctttaggggtctagtgacaccaatgaccgtgatctcagtggaaaagggcacagtgtgtcccaggcatttcgcgtttatgttaaaacgggtggaagatagcaagccggcagaggccgggccgctgcacccgcctgttccgaggtgggtagggggtggggggctgttcccaggattcccctctacgctttctgtggtgaccacggattactgcgtgacaacgggaagccgggagccgaggcccggtccctgaccacgcgtgcctggccacccctgcaggaggactgccaccagaagatcgatgacctcttctccgggaagctgtacctcatcggcattgctgccatcgtggtcgctgtgatcatggtgagcgggcgggggcggagggcctgctctctgggctgccccttccgcggggccttgtgctgactgcgccccccaccaccctcctgcagatcttcgagatgatcctgagcatggtgctgtgctgtggcatccggaacagctccgtgtactgaggccccgcagctctggccacagggacctctgcagtgccccctaagtgacccggacacttccgagggggccatcaccgcctgtgtatataacgtttccggtattactctgctacacgtagcctttttacttttggggttttgtttttgttctgaactttcctgttaccttttcagggctgacgtcacatgtaggtggcgtgtatgagtggagacgggcctgggtcttggggactggagggcaggggtccttctgccctggggtcccagggtgctctgcctgctcagccaggcctctcctgggagccactcgcccagagactcagcttggccaacttggggggctgtgtccacccagcccgcccgtcctgtgggctgcacagctcaccttgttccctcctgccccggttcgagagccgagtctgtgggcactctctgccttcatgcacctgtcctttctaacacgtcgccttcaactgtaatcacaacatcctgactccgtcatttaataaagaaggaacatcaggcatgctaccaggcctgtgcagtccctcagtgccagtggtgtctgagacctaggggttggccggagggcaggggaatctgacatcggtggggcttggctctgtggactctgtggggtccagggtgagggtgggtgggtcgggatccctggtgttcaccaaaggagtcactctgtaaaatttggggagttatttattctgagccaaatatgagcaccggtggcctgtgacacagccccaggtcctgagaacttgtgcccaaggcggtctggctacttaattgtatacattttagggacataggacattgatcattacatctaagatgtacgttggtttagtcggaaaggtgggacgatttgaaggggagggactttcaggtcataggcggattaaaagatgttctgattaataattggttgattttatctaaagacctgaaatcaatagaatggactatctgggttaagaggagttgtggag

SEQ ID NO: 63792 - DNA, 1035 bp, Homo sapiens
aaacccaggctcaggtcggtcctgcccggcacctgtttcacacatgtacactccggtctgaggttggtcctctcccccaccccacccacctgcagttgagcagctgaacagaggccatgccggggcactccgaggcctgagacgaccacgcctgtgccgctgaggaccttcatcagggctccgtccacttggcccgcttggctgtccaatcacactccagtgtcaaccactggcacccagcagccaagagaggtgagaggagggcttggagggggaggcgggactccaccctgtgtgggacagttctgtcagttgaccctccacttgtccaggggcagtggatctgcagggggaactcattctcaatactgttcctcctgagaaacaaattttctgggctgttttggtttaggtgtggcgtggccctggggacgcatggctgaggcaggaacaggtgagccgtcccccagcgtggagggcgaacacgggacggagtatgacacgctgccttccgacacagtctccctcagtgactcggactctgacctcagcttgcccggtggtgctgaagtggaagcactgtccccgatggggctgcctggggaggaggattcaggtcctgatgagccgccctcacccccgtcaggcctcctcccagccacggtgcagccattccatctgagaggcatgagctccaccttctcccagcgcagccgtgacatctttgactgcctggagggggcggccagacgggctccatcctctgtggcccacaccagcatgagtgacaacggaggcttcaagcggcccctagcgccctcaggccggtctccagtggaaggcctgggcagggcccatcggagccctgcctcaccaagggtgcctccggtccccgactacgtggcacaccccgagcgctggaccaagtacagcctggaagatgtgaccgaggtcagcgagcagagcaatcaggccaccgccctggccttcctgggctcccagagcctggctgcccccactgactgcgtgtcctcc

SEQ ID NO: 63793 - DNA, 1051 bp, Homo sapiens
tgacccagcttggtatgtgctcccggcttcagctgcccctgcgtgatggagacaccctcccactcgccttgccacacttcccagcagtctctcgaagcactggccgcgtggaaacaaatccttcaaggggatttgagggtccagctgtcactcagtcatggccatggtgggggcacgttggggacacagcagagagtgaggcagccgtgggcctggccttgacaggcggatgtacagacacatcagggccgagactgaggcgtgggctctgggtggggagacagtgaccacttgcttggaggagggggcgctcaggtgggaggggcacagtgagaaggaggtaagctggtgctggcggggcaggcagggacccctcccagggctcacagcttccagcggacagcaggcacagggctgtggggatcagagcacaggcagaagtcacctgacagcaggttcccgaggcttcaggcctggaggagtgaggacggctgttgggttcttgattccagcagagggaggctgtgcagggttgcaggaaggacggttgggggcgcttcggggaggtacgagaagcaaaggtgtttgcagcccttggggccaggcggcgggaaggcctgtagacgccagagggcgctcgtgctacatgcaactcaggagctgctggcacccgccaaggagtgctgagcgcggggagcccaaaccacagccttggggaacccaggaggggccgggcgggtgcaggacccgcatgagggattccgagagcacgatgtttaaatgttgggggaaaaaatggatcaaagcgatgtgttcccagggagcccctgttttctcgtttcttttcgtacgcccagctttgcagtgccagaaagctgttatctcagcactgctaaggaaaccccagcgcggcctcggagggattaggcattctgctgaaccagggatatgcggtgggcctgaaaaagccatttcgggaggaatctggtctcggctggggtccggccggcaccgtgaacaccacgtgaacaccacgtcggaaatctgctgg

SEQ ID NO: 63794 - DNA, 4724 bp, Homo sapiens
gccacctgacccctgaggaaggttctgtcctggtgttttaggaaattaaaatgtgcacatcagttggctgcccagagtgggtgggacctgcacctgccagagaggaatgtgtgctttttggtttaatcctgggaacggcatatggggcccctataacaaggggcagagaaggcctccacagatttgtttttccaattcaagaggagaggttattgtctgctggcttgtgtgttggagactgtggggcgtgctttctccaccacagggaggcagtgaccagagctgccacctcttccctgttttcacctgtggtcgtagccaggtcaggcatctaggagagcatggaggggagctgggggtgggtgggtggggattcagctctttccagacacactggtgctgcctctttcaggccagggcttgagggcaagtgctgtgccctaacaggtcttgcttgtcacccccacctctgaagtgggtatttcacagcctgaactcacagctgcagagaaggttgagcccatggtgtacttgaaagggcagttcatctggatatccaggctctgcaggaggtaccggagcaatgccaggtgccctttgctgaactgcctagagtggctggccctggggacaaagagcacagcatcctggtgacaatgaagtcacactttcctaagacagtcctggtttttgatgctttaattctttggctgcctttgctttgtcaaggccaggatctgggcctaaattttcagggcagaacaaaacaattttgttttctaggaaagtgggaggtctgggatggcaaaggcagcctcgggcgtggcgactaccccagctggggacgctggctgccaagtctcaccctctcaagagaacaggaatcaaactcagcacagcatcctcctttctagtcagtggtcctgctcgatagggggatttgaattttatttttttaaaaatacaggcacagaaaaaagactagaaggaaacagatccaaatgttaactttgtctttgggtgattttcatttccttccttattgtgtctgtgttttctattttgcatgatacttttccaagtcaagaaacaataatttgtggaagtctcctgtatctgtgccttgctctctggcccacgaccttgcacatcttatcctagagttgccagaatatgtccctccacctggcctggagctgcccatgaggctacatagagctctcctatcatgaaagtctttgaggctttctgttcccaagaaattctggtctcacttcctctgccttctcatcgagccccagacccctccctgcccagattaggtcagcattcaagccccaagtccagcctatgacaaagctcaaagctccagcccatctctgctgccctctgccctcaagagactctcgccagtgtctgggcccttcctagtaacttcacccaaccactcaccccctgcccttcccctcctgattgattaaaatccggcctaatctcccaggtgtaacccaagccctcttccacaagctttccagggctccggagattgccccctcccctgtacggctgcagggcttatgtgtgcctggcgctcagcacgggaaccttgccttctgcctcacccatgtctccccagggtttggcacaggcgagttccctgagccagcctacttcacaaggatgaacagaagctctccctatcctttgcaagtagaagccccctccctggccccctcaagaaatctccccctctcagtggattcaccaaagccctgcggatcctgcactgtgaaggagaagccctccccaggggcatccggacagctgcagccaggccctgcgtgacattgctgagccgcagccccacagcctgtgccagctgcccatgcccggctcatagaccctgagccagagtggccccgccaccacctgtgtctccactcagaggcgagaagtaagggacatggatggaaagtgtaaaagccattcccacaacagctgccaggaacaaggcgaggaatggagtgaaaatgtatattcacagctggcacccagttccgcttaggaaaataccttgcttgagtggacacctgttgtttttgcctgccagcagccaggcctggcttctgggaacagcttctcaaatcttccttagggggctcttcctttcccactcctagtgtgcagtgtttaggtaccctctggccatccccaaaggggtccctgtggaccttgcctcagccatcggaggtacagctgcaggtccaaggatggcttgtaccccagctgaggccaataagaacctggccttagattctggcaggaatcctggaagagatgacctcgttctgctgggcttcctgagctgttgaatgcaagctggtggccattttgccccttttagaaagtagctgcctaaggatacagccatcccatggggccaatggatagagagcaagggaaagggagaacaaaagagggaacgggaagggagaaggggagtgcaagaggggagagtgagagcaagtgagcaagatcatctcagctctggggtccagctgtgtctgaaacagctgggtccagctgtgtgagccaaaaaatgtcccttttgtgcttaagcttgtttgagttggggttccatcatttgttaccaagagagtcttcaggaatgtgcatgacaaagttgggggtgaggtgtgagcctacggacatgggcctgggggcagtcaaggttacaaaatagctaaactggtctgcactgcccccactagttttcagggcagagggcagggagaaggcttgtgggaaagaagctggcctgaggccaaggccctggccctagccctgcaacagcacagggaactcttggaaagggatttcctaaggtgggacattggctttctactgctgtgatgcaagtcctcatctccccaaaccttcagtgagcctctctccacaccctgctgtatgaggatgtttgatgcaaattatggaacatgttggatctcacattggatcaaaggtgtgcagaatagatttgcctcaagcatgacagtgatgtgacacagtcaaagatgacttccggaatcctgagaagtcccagggaggatgctgggctttccaaaacctaagtttaggatactgaggaccacaccccacaccccaaacacttctccttagaataagtatagcaagcctcagcatacacaaatctcagagtgaacggaaatgtctctgcaggcccaagggtggggtctgagtagcgggggcgctgaggaagacaggcagtgacagagccaggacagggtcaaccctgagcgtgagtgagcccaggaaacggaaagagagcaacacagccacccacacaactaaaatcgacccacccgggtctccatgctgcaggaagtcactgtctaggtctcccaagacacattttcaggggaaggttccaggcagcaagagcagccctaggaaactttaatatacaatggaatctgggttaagcactatcttctccaagagttgagctcacaggacattccccagaaacctctggagaggtggggaggaaagtttctggaggtctttggatggagaaaacaaaaaagtggccttgattttcaagacaaaattacacaggaagaaaaaaatgtttttaatctaattaagagcgatcttttcaccttcatcacaacatcgcggaaatgtgccagttcttaacttcacacaataatcaaagcaattagtgagggagaagccttggaaaccggtgcagatgttctcagaatgtttaatggggaaatgagttgcaggcctcattctcagcatccggctccaggccctggctaccaaatccagacatctgctggggccccacccccaggccccgagggcgcgggcttgagaaacacaggtcccttcccaggccacctcccagccaggccagaactggggccgagaggctccccatagcttctcaaattggagcctggacacagtcagagccaccccagaactggggggaggctcaacatcaaaattatgttaacaactgatgtcaaaagtaatcaactcagcttggctcccccactgctgctggctgcaggagggctgtgagtaggaggagagcaagcggccccagagggaccctcggctatgaccccctcagcctgaacactacttcaagaaaagatgtggtggcatctgtctggtatggtcctgtgggctccattccaatgctaatggactcttaaggggcccaggaatcaaaatggtcaacacttgaggaatttccagtaatcagagaaaacgtatagaaatgaggatgatgcttacttaggaaatggcctattacaggaaacagagggccacgtggctaatgtcagtgagctgtgggagagacagagaccccaggtggggcaggcagatcagcaaatcttggaggacctgctatgtggcaggcactggagacatggaggtaaagaacacaatatccatgttctcagggacacactcatatgcccttagcattcacgttcttcacactgacagcttcttaatgcaagcccaccagatactttcataagcactacctctgacttcaggcacttgctgagctgcacacagggcaggccaaaaggaatggaaagtgagccaccaccggggcagcactcactagtgaaagataaataccccagctctctcagccgcttgtagaactctga

SEQ ID NO: 63795 - DNA, 3186 bp, Homo sapiens
aataccacccagcaataaaaagaaattaactaatgatttatgcaacaacatggatgaatctcaaatgcattttgctaagcagtgaaagaagccagatgcaaaagaatacatattataggatcccatttataggacattctagaaaaacaaaactacagggacataaaacagatcaatagctgccagtggttaggggagaagtacttgacttcaaaagactcaccccagggtatttttaggggtatggaacttctgtgaatgatactggattgtggacacatgactccagacatctgtcaaaacccacagaactgaatctcaaagagtggattttactgtatgcaaatttaaaaaattaacccggatgttggaggaccctacgatgaaaagcagactatgatgagcgtgttacaaacaaatgacatagcagtgaaaggaaaggaggaggaggagctggcatatgttgctttcaaaaacactgttttgactggacactctatggttaaagcaaaagtctgtcctaaacactctaatctagtaggtaaatttgcttcacatagggtactacgtgtacaatagggttacacaaataagtaaatgaactgtaggtaatgggagccaggtttctagctgtcagagaaaaagctataaataagttgtgggggagggggcaaggatgaactctggtcagaaatgtcagtatgaactcatggttagctttatatagatacagatatgtaaagatgtatgtgtactcaggttacatacatacatatatttcctagctctgtccactgagaggagactgaagcaatgataccctagtagccacgagcataccccgtgcctagatccaggttttctattcattctccagggagccagggctctctggatgaatggatgattctagggctagggtagggaaaataaaagatgagcctgaagtattgtcaagtgctagaaaagaaatgcttaaaaataaatgaaaaggatggcggggggcacatcaaaaggacacatgaacccaccagtggccacagcttgaacaatttgagcaacaaaataaataatattggactataactcaaaaaataaatactcccaaatccacactgataaaattaaataaacaattggaggagagggacaaatcttccttataaaggaattccaaataaaaaatgtagaaggaatgaggaaaatagaagtacatcacggtaatatttgctgcaggaaaacgatccatgaatgaatgctgaaattagttagtgaaactcagaaacttcacagtttcttccttgaaatgtattttaattgctgtggtagttttaacatatttgcagattttttttgatactctcctgcaggaggtagagttgaacccctcccttccccaccttgagtgtgggctatacttagtgactcgcttctaaagactaagctatggaaagggaaaaacagctattcacttacagtggaggagcctggccgacaccactttaaacgagtggctcaaggttaatattaccagtgataaaccatgttgatgtcatgttccacaatgaggaaagcatctcacctcactggcctccttcccctaaacctataaccctggtctagtcctgagaaaacaccagacaaatccaaactgagggacaatgacacctgactggtattcttcaaaagtgtcaagttaatgaagaacaagactgagaagcccgtcaccgatcagagatgacaataaatgtaatgatcgatcctagatgggatcttggaacagaaaaaggacattagtagttaaactggggaaatccaaataaatttataactctagcttaatagtgtaccaatgttaattttttagttttggtcaatgtaccatggttatataagatgctaacattaggggaagctggtgaaagggatgtgggtactcggtactatttttgtttctcttctgtaaataaaaaatgtgaggtaacaagagaaaacagaacctgtatacaatagcacaaaagaatattaattatctaactaagtatatgcaagaactctggagaaaattgtaaaactttagtaagagacaatgaagaagatataaatggagaaatatgccttcattccaatgactagaagactcaatactgaaaagattatctcaaaatctgaataaatctctccaaatcttaataaaaatctcaaggcttctgtgtgagaactttggcaagctgattctaactgcgacttggaagtgcaaaaagccaagaattggcaatattcttgaagaagaacaaggtgggagaacttgctgtaccaaacatcagtacttcttccaaggcagtggtcattagggcaatgtggtattgacacagggagagacaaataggccaatgggacaggattgagcattgggaaacagcccacacaaatatggaagcttgctgtgtatcagaggtggcctgcacatcctgggaagagcatggacttttcaatcaaatgttcaggagcagttggatacccacactggaaaaacattaagttggacccttaattacctcacatcatataccaaaaattcattcttgtcattctaggggattgaagacctaactatgaaaagcataactataaaggtcacatgactgaatatagaagaatatcttaatgacatcagcattaggatggttttttttaaaagaagcaataaccatgagagagaagactgagtaatttgacattagagttaagacccaatcatcaaaatacaccttaaagagtgaaaagacagtgcccacaaaatgcaaaggactcctacaaatcaataggaaaaatataaatgacttaatagaaaatgggcaatagacaaagtagcacatcacaaaagaggaatccaaaaggctgatgagcatgtggaaaggtgttgcgcctgactagcaatcagggaaatgtaaataaactcaggagctcatggcccgtgggggcgagtggcagacttccagcaggaaaccacacagacattacttagtcacagccaggagaagggctcagagtgaaagggctctgtgcccatgacatccttagagagaccagggaaggacctgtaaggcttgaagaatgtgcagatttggagacccacaggtctgggacctggcagaagcatgttactgcccccattttagagat

SEQ ID NO: 63796 - DNA, 1048 bp, Homo sapiens
ccccactctctgttgacactatcagtatttgctcttggcttatatttgtcttcatttaaatattttattgcaaaaggattaagtactcatctgtgagaagtggaataattcaaagattcacaatggctttcctcccccaaggtcatcagtgttaactgccaactagatccctagcccaccctctctgctcatccgagcagcagatgccaggtgggagttgcttttatgcacatgggatgtcactgtgactctgttcctgtcactctgtaacataagctcatttcatttttctctaggtatataggcatggatttaattattttagtcattacataatagtccacagtttagattggccacagctaaccattctgtatatcatggacattcaggctcttatagttttaagctgcttaattattcagactatgatgccatattcatctttattcttaaaagctgacatactggagcagggtgagagggtgtgtccttagtaattttaataaatgttgctagattgctttcccaagaagttgtagcaattcaggctcccccagctttcccacatccatgcctgaatgaagtgttgaatgaagcccgaatgaaggttgtcagcaccttttgcagggactatcaagcatggatgaaaactgaggcattgctgttatttccatctgtgttgaataccttttatgggcttggcatctgtttgggtttcctcttgcagaattgcctgttcatgtcctttgctcacttttgcttatcactttgtaggaattttctatacattacagacattaactccttgttatatgaggcatagatagcttccccagtctgttttttcacctgaattatgttgcttttatcctagaaaatgttttatgtttttaaagtgatacatcttttgctttataaaaaaggaaggttttcccacatcagcgtaatacaattctctcttaaatttattcctaatttcactatttgaatgtgttgtatgtatacatatgtatgtgtgtaaaagttttaatgcatttagtatcta

SEQ ID NO: 63797 - DNA, 5023 bp, Homo sapiens
gggtccaggagaaagttgaagacatggaaattctaattaacgcacacggggctgtttttgctcaaggatttgcgaagctgtcatgtcacaagaggccaggcaagcacatgcttgccagggaggtgctcacagtcacctggtgggggtctctgcagctttccctctgccttctttccaccccctctgcccagcctcgggggtcctggtcctcccccatgcccatctcaatgggccgggtgctccctgagtgtccctctggagagtgggactgagggcggtatctgttaacctcgagctggggcttgcccatctaagatgccaaaacagaagagacaggggcccttcagagaaaccacatgactgggctgggcagagccataggctgcagggcttatgggcctgtcctcttgggccgtctatctcaggtatccatgtgcaaccaatggggcagacgtgtgaattccaggccagtcctggctggcttggcagttggggatgcagtgtgagggaggatttcacaaaaatgatttcagcctcccagggttgcttggagaagctcacccaggccacacctgcacacagcccccaagttcagagccgcagatcctcaggcccctagccctgtgcctcagcactggcacaatgtgtctgcagtccttgcttcatcttaggcagggttgagtgagcagcaatcctagggcttctccatgcctggggctttgggggttctggggaggaagagaccaagagggctatacatgcccttctccctcctggcaccattcgaaaggcttagggaactggtactgagggctttgagagccaaaggaggacacagccgtacagcctaagtgtgtcctggggggtttactgagcagacgttggaaagatgaatggaaatctggtggctgcagatgggtgacaagggcattctagatggcaggttaccacacgcaaggcacagggatgcacacaggcatggcaccgtccccacccactgtcgtgccagtgacccttggtgagcagaggatagtgagtgggtcagaatcccaggaactcatcctggctcttggggtacagggctcctcttgtcatgggggtgctccccaactgcccatgcaggcctacagtctctacttcccacctttctctcagaagccctgtcatatggttctgggtgggagacacaggctcagggagtttgaggctggcagggactctcttgtgccccattcaacctaggaagacagcttctgcctgaaaggtgtgttcgaggctgagtcctggccgcccagagctggttgagggtcctgaggctgagcagtagggcccacctataggctggggtgcagcgacgccactctttatctcctgggtaccccgtgcctcagcttgtcatgactccctagcttgcatcaggcctgctcaccccccaccccacctctggctaacaggccccggaaagaggagcttcgcccagccccagggaccttcccgtaatcaaggctatagtgacctcacctctctggggccctgcgggcggggagagctcgagatggaaacaaaatgtgtctttatttatgtttttaatttgaattctggaactggcccagcatggtaatacatttaacatcagtagaatgctgaagaaaaatggaaatgttttttggtaactgcctcccacccactctgccccctgtgagaccccagcacacatccctgtccctcacacacaccagggcgtgtgcctctcttcccagttcagggtccatggggccaggctgcccacaggagcttcgctgcatccctgagcagctggagccgaatttaattatgggcatcactgggcgggctgtgcaggaggtggaggaatgcagccccaatgcgggcagaagacctgcacggcccccacacccctgccgccaggcggtttgggccctgaggaaacagggtgcccactgctgccagccttctcccccagatggagtggggcctctacccagcctgtatcccagaggagcctgggttcctaggccctgacactgtacgtgcccactctccccttcaggcctctctggagggaccgtaccctgacttctgaggatgcaggaacccagctcccctgaagcctcagccctgagtcttccctgaccagaacacaatgcctcaaggtggcccctttgcagcaacctccttgtttttccctctcccagtcccctcttcagatccctcaccccaagccccatgcctgggctccttcctgccttcccaggctggctcatatctagcagccacttttggaacagcctgctctgagagaggccttggtaagttacagggcagggacctggttgggtaatgactggagtctctgacctgcctgggcccacttatcactggaggccatgggagtgccaacctgaaaaggctgcaggatcttgcagaatggtaatgtgccagacccaaagtgggcagagagcttggggatggatgttcaggtctctcaggccctgtcatcctggagtggaacaagaaacagcccagtgtcctagatgacacagccacactggcttggggtcacccttgggcaggtgggtaacctctggctccagggagcttggcatgtgctgataccagcactggcagccctcacccccatagtggtgatttactgggcagctgcaagtttggctgtgatccacataagtgcctggtctctcaccaccttcacctgcaggggccttgcaagacccaagagttggtaaggcctggctgcccagctagatggactgtgggtgatggccctctcctcccagtaggactttttgcatgtctggatgctggtccgtgaccaagagaaccaaggtgagcgagagctccaacaggagaagcaagcagccagaaggatgagaagggacagtcccctctctgaggggacagccaagaggcaatacaggcactgccacctgtattgcacacaacatgagccactaaactaacactgatcactttggaggtccatcatatccaggacttggtacaggccttggccacagtgtaagccatcattctgccttctggtgctgacctgtacctgggcagcccatctggctaccagcctgctcacacctctgctcctgcctttttacccagccaggaggggcccagaagctcagagccctattctcagggtgtccatgactagtcacccctgctttccagtgatctgctggctcccttggagcctcttcacaccctacccaccatgaggtactgccaacctctctgtgaactgggggggcctggaaagacagtgggcaggtcctgtctgatcataattaccccttaagatagccactccttccctggaggtggcctcattctggctacccaaccctgccagttctctggttacacctgcagcccccagcaccatgggtcccgatttcctcagtgatttgcaaggccaggccttgcacctggctggctgcaaaggcaggaggcccagggcctcactacgacaaagacacacatggctcaggacaacctcctgacccccagagagtccaaagaacaaaacaccctttagaaaaatgttggtagagagaaggagagtttccacaagtgaccctcagaagggccgcgagtgtcactcacagatcttgacacaaagacatttatcaaggggaatccccaacgggttagcagccagaatgggactgtggccagaatggacttgggtgccccactgaccccgctgcacggctgtcaccgctgggcaccccagcggggagtcacatgtcgcaggggaatcacaccgtggccgggcaccggggattggcctggccatgccgtgacggcgggggaggacgggcatgcatcccaggccagctgtgcctcaggggaaggccaactggaaggcgtggaaaatcagccatttcctccacctgaaggagcccctgaggacagcagcagcaactggcagactgcacccggcatctgccccatggctttggccagggttccatggggaaatgctaaaaaacaaagtcgtctcttttttggggggcaggggagggggctgggggagagaaaaacaatctcagactctcaaagcatgaaaacaagtggaaaatgatcagtctggttttccataagtcaaaacaagaggatcatgttcccaggctcagtgggaagtgcccttgctctcctctcttgcctggtgcctccgtgttggggccaggcagacggcaagtggtgggcactaggcgagtagatagcactctggccagagagcaaggcttccccagcaccaagtctgactccttgagctccagtcccctccagcccagcccttcacgcacatgtaggcactcactgtgagatgtgggtgatgggtgtcagcagagtctccccttccaggtccaggtcctcggcgaagctgttggttctcatgaaatggggcatgctcacttccagcagtgttgggctcttccttactgaggagaaagtgtggggacagcacgttaggcctcccacccaacctgccagtgctgtggagccaggcctgtgagctcccagggccaggtgaggagtggagcttgtgcctggaagctccagccctgacaatcagttttatagttgggtgttggggtgggtgggtgtttaagatggccccaaagtgcctgacacctcagtgtctgaggagaataaaggccagtgaatcatcttcggagtggtaactgtgcctggggctgtgctcaggtgtccaagactctccccacctcaggttctgggcctcttcccatgttcacaactgacacttgggtcaagaataaaacagaggtgacaggcacaggcctggtaagggacaacagctcccaccaccatacattgtcacactcatacattgacagagtagtgggtcaggaaagatggggtgataggacctctgacccatgaggaatggcaagcctgggaggtgggggcagccacagaactccttcctcaaaacacgatgcta

SEQ ID NO: 63798 - DNA, 4822 bp, Homo sapiens
cccagcagggcaccacaggacactgctgtggcaaggtttatacttagggtgcagtgcagtctgatcttgtataaatgctcagtgccaaagacttaggagataagtcaggcagagtcaaaattaacctttgaaaaatcccttgaattggccctaaaaataatccctttctcagatctttgtgtatatcccctgctgggttgctcttctgcctgctaaagtgggagaatctctgggtgcacatccagagtaccctgggagaggcatgccaggtgttcctgtacctttttcaggatattcccagtgtcatcttcagagggagcctctgaggctgcagccacacatgggaaaagattacttatggagaagatcagaggctaaggggctggggatggtggggacatcggattttgaggtcagacctggactcctgtctacctctgtctctctaccttttatttttctttccttttctcctaacaaggccctatttctaagatggcacctcaggcctcccatgggaccaaccaggcctgacagactaactgctcagactaactgccagacttcctcctgctagccagtcactaccaaggatgtgtgcctcagatacagcccctgcccaggacacctacgttgtccctaacagggcccacatatctaaagcatgaatgcctagccaggggctctggggcaccataagaaggcatgaagctgggcctgccaatttgcatcctgggagggcaggtcagccttgtccaggcaatccaggaggcttcccagtggcccactggccagtgaggacctttgacctccttggctggtggcaccaggtttatgatgcacatagaggctgaacttgaagaattcttattgcagagggcagccacaagagccactggccagtgcccagataatatctgcagactgttccctcctgctccatgggccacagaatccctttgtcttgttactgctacactgccttcctaccaatcttcagggttcatcctggcctctgccatgcatatccaggctcccccagagattgtgtgtctgggaatgagccctggcttctgctcctatctcccagtgatactggcaagtccctatccttcttgaggcttcaatttccccttctgtgagctgggaggacaggcccactagatgctctctgagggacctaccaaggatgtgggctgtgtgtctcagccaacagcagtatctcctaaccccaacacaagaaatacacatagtaggtgtctggttaatgctcttggaatttcagcctatactaaccatctgaaagccactgagtctgaactctgctaccatatttgagattatctctccattgggcacctatgggttgcctagagacaagctaccatggtcctcttccctcgcccgtcatgtgcagggtcaaaggcaggtgagctacacagctcgccctgctcttcactctgctttaatgtgggtgcttgccttggcagatgggcccgacagtgataagaacaaatgacagatgcatactggggcacctgtgactgccatgagacacagtccactgattctgcctccaaccccctccccagagcagaatagtgagtgctaggtttccgcctgtacctccacgggaccccaacagctcctgaaccccattccgagatttgaggttgtgacttggggacctctagacttcccttccctccacctgactccagactgtcctggagcttgggactctcaggcctctaggcacatcttattaaggacagcagctgacagccatatgttgtgaccccatttgtatcccatggtaactcatgacctggcagtctcaaaagctctcaggccaaataaggaatgtccccacaggatctcccatcacaaagagacattctatgctggctaatattttcaggcatttccccgagtcaggtatgtggctggatgcctaacaccatctcctcaaggccttacactaatactgtgagatatactcccaatgtatacaagaggaaactgaggctgatagagattaggtgactgccccagtgtcctgtgggcaggatgaaatgacccaagctggccagggctccctgacagaccttgtccctggattcagcgaacatacatcaaaccattagctgacaaggaatgaatctgacaagctgttcatgaccaccacactgaaaactacagggcaaggtaaaagatatgaaagtcaacctaaataaacaagggacacatgatgccatgtttcaggagccccaaaactataaggatacccattctcccatgcccatctagaggctgctgcgcctagaggaggctttccatggcaactggcatatgtatggtgaggagaaaccctgcaaagacagcaaagccagtgatggggaaggagaagcagccagagccagcaggaccagctgtcaaaacctgttagcaaactacagtgagaaggaagcaaggtcctggccacaaagaacaacttgaatctgaccagtggcacccaatagggtccagaaacagagccacacgtagccagtgagctgattgtaaagacactgatacggcagggtagttgggagaggacgggccttcccatgccgggtgctgagctagactggatatccaagtaggggaagagtggaccttgacctcggcctcacattggacacaaaaatcaatcccagatggagtgcagatctacatgggaaaggtgagctaataaagctttagaataaaccagaatatctttatgaccttggagtagtcaaagtttcttaaataggacacaaacagccctatccagagaggaaatgtttgattaactggaccacatgaaaattaagaccttctgttcatcaaaagacaccatcaagagaggaagaaggcagcctgcagagggggaggcgatatttgcaatgtgtgtgtctgtgagagagtgtgagtgtgtgtatctctctctctgacaaatgactccagaatatctaaagatatataggaccataaataaacataaaacaggcagaagatgtaggcaatttatacagaatgatgtatctgactaaatgataacatggaaagggactcaacttcattagtcaacaggttactgcaaattaaaatcaccatttgatgctgctagacattcaccatcatggctgaaaaggaaacgacggaaaatgccaagtgttaggatgtggagcagccagaatgctgcctgtgggaatgaaaattggaatgactcctttggtagactgctgggtagtattcactaagagtaaacatatgcccacccaggaccctgcagctccacacataggcatatattccccagaaacgcaacctgatgctcaccaaaagcatgtacagaatattcttaaacagcaacctacaccagaaactgcctgctggccacaggtggtagaatggatgaatgatgtaggccatgcacacaatggagcaccagtcagcaaggagcatgagggagcactctcccttcagccccatagagaggctgccagacatcaaattgagtgagggacattggacacaaaggtgtatgagttgcatcattcccaccgcataaagttcaaatgtgggcaaagctggtccttgctgctagcagttaggcctgtggttaatctcaaggtcagtgacaggaaatgggagcctgagaggctttctgggggttctgttgcttcctccgggtgctgcacacatgggtcccagggactgaagatgcctcaagctgcgcacttgagacctgtgtactaatctgtgtgcatgcacattaccctttaactaaaagtttaacaccaccaccctataccagggtagcccaggtgagcctaattaggtggatagccctggccttcagggccgctaggcccagccccatcccactccctcacttaaggggacacggcttccagacttcctgactaggtcacctccgtgcttcagcctccagaggctctgcagttcaatctcccctttcaggtatcagcagagcacacaagagatctatatgggatgtgccccccgcccaaccccgccccgaccccctgccccaactgccagaagtgtctccatgacaatatcagtgcagttgtgaagtcctttgccctccagccacctctgtggcgtgaatgttctctctgtcacatcctccaacaccatctgcttggctgaggacctgagcagcatcatggctgggagttcacaagtggagagggctgagcctggccagagtgcactggggcagggtgatttggatggcctttcccttgcagaggaaatgagaagcctcactgctttcttctgggccatccacctagacagtgcggccctctccccatagcagcagccctaggccagccgcttcttcctcacgtgctcagacggaggaagtgaagtttggaaaggttagggggccacggggggccgccacagctgggctgatggcaggctggaagccagattgagggcatctgattcccaatcccatctctttcccactgagccattacgcctcggttttaatttaattagaagaacatttaatccccccgtgcatttcagagacgggtttgagcctggctggggctatgtggggctctgacggggatcctatgactcatgcagccctgtacagccctcccgggcgggcccccagagggcttccttggcatctcgtgcagacagaggtggtctggagctttgcagaagacaggacactggtctagaaagacaaaatggtctcatctgttcttgacaagcccctcactcatccttctggacactggttccc

SEQ ID NO: 63799 - DNA, 3476 bp, Homo sapiens
tctctggttcatgtcactctgtggagcaggggctgctccagcacaaagaggtttttgacagggaaaggcagagccagagtcagggcaggccctgggcgggctcctagagagcccaaccaccctctaataaggggtgctctccaccctatctgaggagcaattgggatctcctaggaagtgaaactgttacgtatgtcttattacagaatttccagtggagtgattctggaagaaatgtgtatggcatgttgtgactgctatgtctcatgaaatatttacgtttttatgtaacttttttccattttcagatcatcttttattttaacgcaaaatgacaatatatttttcaattaatttgcccaatatctgtgtttaaatgttttctaatgcacacacgtgttttaaactcattaaaaaaatatgacttagatcccatcccactttcatgttttatattgccaaaactctgcttttgggagaggtgagttatcttcacttctgaaacagtactgcttgggagctggtttggccctggctattctggggaaatgacacaatattgacctagaggggccctaatctttccccgctagagcactacctctaatagggtgaaggatgggagaaagaggctagtgaacccaccttcaggtctgtccactcaggacatgcccacactagcctctccaggggctctgcccttggcatccccgtcccccacctgggctctggcagagaagtcaggcgggaagaagccggctgagtgcccgccactgtaagaggaaacgaagagaaacagctccagtcagccccagaagcgaggcctggaaaaactctgcagctggagctaacacaaaggacttttcagaccctgcagccaaggtgcccagtgagcttttttttttttttttttttttttttttaaaaaacagctattagggtgacaagcctttccaaaggccagcagttggcgagagtttccaggaagctggtctggcactgggctgggattggagcaactttaacgagttaagttcagaaggaaggagtcatcaggaaaggtttaaggttcaacaaacttttcaaattattttgcaaaaagttctggctttccaattcaaaggcatgtttcgctgtgactgttttaagccagagcctatttaaaaggcaacacaactagcatgcttcagattcactcactcgaggtatttgtctaaatcctccgaatgggctttgcaagtgccatctagtgcctagtaacactggggccatcttacacatctcgacaggcagccctcctccccacgtgcctccccccagcctctgtggtcgtgtgcgcgcgggcgcgcacacacacacgcacgcatgcaccttccctaagcaggaagctgctctttgccaagagcgaatggaattcagatttccagagggtgtccttggcctccagctctacggctgcatgatgaagaaaggtcctagtgtgtgtgccgggggctgggagagaggggcctccagctctgctcacatctatctgggccccaagaaaaacccacaactggctgtgctctccccagccacacccagccttggtcacattccttcccttcctgagcccacactgggtggccccggcaaaccagcttccacacctccctccccaccggcagggagacctagcccaagcccccatggggcagccagcaagtacaaatgaggggctgcaccccaggcccaaagagccagaaagcacggagggccctccccccaccccacccccaatgctgggcatccccttgtggctgctgtcactcatggggaaagagacacactcccttgtctagcacccggtgagctgagctcccatcccttcctgtgcctgctttcaggaagtccctcttcatatccaaccttgactctcctggctgtggtgcttgtgggcctgggattgaagggccatcactgccctttgcaccagagcttcccaacataccagcaagaagggactgtaccccttcccctgtccagtctgggccttccaagccctgagattcagcaacctcaggaattaaacatttataggaaaacacctatgcagacaagggacatgagtcagggtggtcatcagcagtagcaaggtgggtaggctggtcacgtttagcttctctttagcccaagtaatagggtcttccacctgcatggccagggaggggataggctgagagcaatctttctacaggctgtcagcatcaacaagtggttgtgatgagcaggagtctgtatggcttttcaggtgttccggctcaaggaggcccaacaccaagttggaacctccaggcctggtgcctaggcagaaggtgggctaaacaaaggccaaggggagctctgctctgtcacttccctttgtttgctaatgagactgtttccaaaagctggcctggtagcctgtgggattgtttctctcaagatttcttctaggggagaaggtggctgaggctttgcagtctgcatcacccagtccccagaatctacaggggactcagcttgcctagtcacagttcggcttttggccttggctccagggcccattctgatcctcgtgcttgggtcagggatggtcagcacccctgccctgatgctgcctgctggggtctcctgctgagtaccgtgaaggcctactgtggcctgagaagccaacttcactgtcccttttggccagccctagaccctatatttgttcaagtaacacattgattcactggcttctcctttaggcaaggcctgcaggggactcagctggggttcatgattccttgccacctgtggtgggcctgcatggccagcccaaggcctcaagtgccacatactgctcccctgacagtcaggtggctagggtatgacactcaagaaaatgcccaggcagaacccagagttggggtcacttggtccagcccttctgaaggggactggttggatctgttgcggggaggagacaggccatgctggaccagcaaaaaagcatagaacttggagtctggaacctgacatctggccttggctctgccatcagctggctgtgtccactgggcaaggtcctatcatatctggtctcagtgcttccatttacccagagtccttccatcacctgacacctacagggatgctttcccaatcaaaattcaggccatgtggtttgataaggccaccttccaatgtggaagacaggctggtaatggagaggcctgggagcacagagctcctaggcactgccatggaatgtggggaccttagggaaggatatctcaattgaagctcttcagagcccctggggtggactgttctgtactctcatcccctaacccataccagcctgagctcaatcatatcagcctgtgaaggctgccccaccacactgcttctgcacccaccacaccaggcccccttgagctcccacctggagcccacacacccagctggtg

SEQ ID NO: 63800 - DNA, 4855 bp, Homo sapiens
gagcccacatttcactaatgtccacatctgaggaggctttcataataaaagaacacatacctatttcacctatgatggtcagtgcaatcttgaaaacactagtaaatagtgtccatcagctttaaaaatacaaacccaaattgggtcataccaaaatgcaaggatacacacaataacctgggtgaatcttcagggaattgtgctgagtgaaaagagccgatcccaaaaaggtgatttgctatgtggttccatttatataattttcttggaatgataaagaaatgaagaataggttagtagttgtcaggggctaaggacagggtagggtgggagggaattgggggtagctataaaagggggacatgagggattcttgaagagttagaaatgtcctgtagtgagactatcaatgcaatatcctggtcagaatattgtactacagttttgcaagatgttactatcgggggagactaggtaaaggagtatgtaagatttctctgtgttgtttcttagaactgcatgagaaatgtacaattatctcaaaataaaaatttattttaaaaaatgcccaaattaaaaaaaaatcagtagtcctcctaaaaatacccagaaatgaattttagaatgtccaaaatccatacaaagatctaaaaaaatatggaaggatgttgcaatggatttgaacatgtgggtaaactgcttctatttgtggctggaaagactttttttttgaggtggggaaggcaattcttcatcagttaatctaaattgaatgaagtttcaataacaaatgccaatgggatatgaatatacacacagatagacaactttttttttttttttttttttaattaggcaagctgaggccaggtgcattggctcacgcccgtaatcccagcactttaggaggctgaggcgggcagatcacttgaggtcaggagtttgagaccagcctggccaacatggtgaaaccctgtctctaataaaaaaaaaaattagccagtcatggtggcagatgtctgtagtcccagctactagggaggctaaggcaggagaattgcttgaacccaggaggtagaggttgcagtaagccgagactgtgccactgcattcccgcctaggtgacaaagtgagactctgcctcaaaaaaaataaaaataaaaaaaaaattaggcgtgctagttctaagtttatatgaaaaaaatgcatgtcctataaaattcagaagtagcagcagtctggccccttgtgctcctctagccctcaactggcctaacaggccctagtgtgcagcagggactattttcccatcatcactgtccacagcatctggacaagaatacagagaacggctgatttaaaaaaaatctaatctgggatcctatgcatcctaaataatcttatgaggatgcacttgtattttttctgatgctgatactattcattccaactcgcctccccatcagctttgtcaggcactgtgaattgcatggtacacatgattacaatggatggaatggccatcatgaggtatagcaatacatttaagtaacactgtgtcactactataggacaggcacttttctgcatactttatattattaatttgtgtaatcctcctaacaaccctctgaggaaggtactcttatgattcccattttacaaataaagaaactgagactaagtgactcactcaaggtgtagcaggtagaaagtagtggaattaggatatgagttcagactccagaccctgttattagcccctgtctttggctatggattagtaaaggagagcacagccaagggtgggacaggcagctgtagtcctctggaccagcttcacatggatggggctgcattgttacaggtggcctaactcagacatggaaactgagtcgctgctgcccaactcatgccatgaaaccattttggcctgcacagcttataacagcactctagctctagctatgacactttatggtgttagtgggtttttttggtggttggtatggaggaggggctgggctacaagttttagattatgtttcttattgcgggtttttaaaaattcttgaattaggcctatttgctcttttgttctctattgagttagcaaattcagtttttccaagatgccctgaaagtatgatcatacatgtatacgaaatggtccttgggtccagctggcaactcctgtgcacccccgacctggattctgccttccttgaagtgagccttggaagaaacaagtgctcatgctccctgacattattagctgccacgatgaagcctcagtcccaaacaccccagcttcctgtctaactcaagagctaatcctgtgtttaaatcttaagagtgtttagatcttaggccatgccatgaattcccctggttgactgcatttgtgaaaatgagcttcccattattggctcttaagtaatggagatgagggggagtcctgctacacagataagtgcatcataaagttacataattaaaataactgagctctggcctatcaacaggcccatcagcagtccagaatagagtctagaaatggacacaaattaaatgagagtttgaaatatgataaaggtagcagttgaaattagtagagagatgatgatgtactcaaataaatagtgttggacaactggacaaatatatgggaaaccaaattggatttaattactctgtcaaaatcccgataaagcaaggatttaaatgtaaaaaatgaaataaaaaatgatagaagaaaacatggaagaatttattaaaacaatttcaggatgagaggttatttcagaatttaagataaggacctcaaaccataaaagactgacacagctgactatgtgaaattaaaaaaattctgccaccagaaaaatattatagaaaaagccaaaacacctaaggaaaatgaggataaaatattttcaatgaatatgacaaagcaagtttctacaaatcagtaagacaaggtattttacaaagtccaaagggtatgaagaaatagttcacaagaaagaaaaacaaatgattttaagcatttggaaagataaaaacctcatttccaacaaaagaaatgtaaattaaagctccagtgtaccatttctcatctatgaaatgaatgaagataaaaacctgagtatacacttggtaagggtgggggaagaaagtgcatttgtgcagtcaaagtgatgtaaatggtacagcccttatttggcagtatctatcacaacataaatgaacattttaatcctgctggaaatggggggaaagggaggatctcttaaagtaaatccactgaaaacggagaccaaaattttacaatagagatatttgattgggaagttaatttgaaaaataacagtagttaaaatattattttatctcatatgcaataacagttgttagagttacaattatgtacacgttttagaaaaaaacaaatccagaggggattttggtttgtcttttgtaaagcattatatggtaacatctgagggcatcttttatacttggcagaggatgttggcagcacttccacagagaggatcattttttgtagaagtatggcatggtttcactgcttgaccaagaggccacctgcatcaattatcatctcccctgctgtcctctgaaatgcttatctaggcatcgatcttggtttcctcttcaactgattaactaactggtctactctgcccagtctctatttgagaaatcatttgacatcattttctttaacttgatgaaatctcctattttgacaagatttacagttcctctttataagttcctctttactttgtgtgtgctttatattgtctttggttgacaagagacagccaaagaggtcagtcagcagagatacaagtagggataagatggatagggagaaacaacagtgttcaatagggagggatgtttcagggaaactaatttcataagtggtcatttcagtagtgaatatatttgaatggttaatggctgctgttttttagctgccctacatatccatcaacagaggatctgttccataaatcatggcacaatgaaactctgcagctgttaatgaaaaggagatttgctagatgtcttaatacagatccatctccagaacataccagtgtcttccttttaagtggtgcacactggggctgaacacttactaagaaatgaaagggctccccagtcaaagctgacaggtgtcattacaacatgacccctgtggtagatcccagcacaatacactggccatcactccattctcttcaaatgtcctagggttgcttcatacagcagaccatcgtacccaaagccactatgcatatgacttggttatctcctgccaggctgtagtccagttagtgctcccttggaaatactcaagaccttaatgaactatctatctgtgaatctgtgaagctacccatttcttagaggcctctttggagagctggctgttgaatacccagtatgatggtccttagccttcttagacctttcctgtaccactacctctatgccttttgccaagtccaagtgttcaccagaaatggaactgatgccagaaagactacagctaacaatctgagcagaacagtgagcatgtcctatctgggaaaagcccagcccattgggctaaatctctagctgaacacagagactatgctccttccaattatactggaagcccaaccatgagaaaacagcacttcaactacactgttcagagccatcacctgttcacacgtgtgtctgtatacatgtaaacacacattttgcaataaaaatgcttctcagatgtactgcaccataataaatcagcattgtatgtacagctcaaaaa

SEQ ID NO: 63801 - DNA, 3856 bp, Homo sapiens
ggaatctgtaattctcacaggctgtcccatacattttaaatccaggaaatgtgctcacccatgagacagggatggcaagaagatatgaatgaaaagcaaccagtccgtaaaattggaagccatttcactccttaccaggtacaaagataacatgctgcatggatcagggacacaaacttacctaccttatgatgtagtgaaagaatctaaaacttttgtctcagcagactccctggaggaagccaataacaggaggccttgactaggagacctcaagccttggaatgtgcccagaccagtggggagggaaggctgggaggcagtcctcccttaccccttttctcccaggcagacctaccctgggttctctccaggcccctccgcctgagcaagtgctcagttggccactagctccctgcacatccaacaagcctttctttcctgttccttcttcaaggaaggcttagcctcaaatccagggccacagacaaaggacagtcactctcctctgccagaaagtcatttatgggacatggagaaagcatcaaatatattgcttttccaacacctaacagtggaataggaggaatagaaggagaactcagccagaaagttctggagcatagtctttttgccaaaagaacacgttttcaaatgaaagaggtggtgctggggcactgaggaatcagggggatggaccccactggagcttgtctcatgctggcagcaagtcccaggcctcaaacacatacctgggccacctcaggagagagactgcagggaagaaatgagttgcaatgctccagcctaaccaactccccttttgttaatccaatcccagaaggtactgggtagggtcagttaacagacagctgcctgtctcctggcagagtctgaccaagccccagtgggcgcttctcttcctaagtcctctggtgtaccccattcttcaagggaaacggtccccttaagaatctatgtgaaagggttctgaaattgctgtaccagttaatgaattatttactctaaacaatgtcttgataaagggggaggatgaagttagctgatgttgactaaggagagacggagttgccaaggaaattcttctaaatgaaaaaaaaaaaaaagtaaaagcagtcagctggttttgtctgactatgaaacgtgtcacagagcatgcacctttggccatcttttgcatttatgatttggaagagagatgtagcagtgagtgtggggccagggaggggaatccaacaaagccattctgcaagctagtggctgggattttggggtatagagtaagagcagccagccttagaggcccatgtcatctgggctgcctcagagctaaagctaggtaaccagagggagtaaggaaaggcctgagtcccaggctaggcttttcacagttgtattgagatgggaaagtaagggatgttccttgcagcagatgcagggcccagttgtctagagcagtatttgaaatgagttggcatttcagggcagtgtttgtgatgccagtcagtaggtaggggcttctacctcttttttagaaatgtttactctgaactaagctctatgctttaacaagttatgttttaataggaaaactgtcattgatggaatcatatgtaattcctacatttttccagttacccattcctggggaaagcttagccattggacaaaccacccagagccccaggaacctgcatttgcagacagcagtggcaggcacagtggcctagtgttgagcgggggaaacctggcctctatgtgtctggttttgcaaactaaaacgccattgcccatactcaggctgacaggttctggaggtgccatggactcctgctctgtatctcacctctagttccatcacaatgcatgagctgtcagtgggagccttttaatgcagatgctaatacccattcctaatgctagcccatccccacaccctcctgagttggtgcgatatatcctgggaacaagaaaatctgaaggctcctggtcctcaggctagcaagagccttgcctgtaagaagtgggagaaggtcacctctctcaggaggcagaactaaggctgcacagcacaagggagatgtctgaatgcacagtctgggtggcagaaggactcctgtcctttcttccacacagacctgagcacctctccaggtgccaccattttctgtctgggaacatctgctatccccaagcctcagtttcctggtctacaaaactgagatggtctcttctatacaaggccccaggaggatcactgcaagtcactgcatttcatggtgcccagatttccctgcatttctagaatgtcaacagagatgagtgggctcaaggggaagagattctttatgactagagatattctggtcaactttggaccccagcttctatggacaatagcatgtggacatgagccctggggaagcagggatgactgagcctgaagaagagctctcaagccttacactctccagaccagccttgggttgcctgaaccccagcatagccttatggaacccctgccagggtcctagcacctggtttgacctgggcacaagtactcactcactcactcactcactcactcactcgtcaaacattcactgagggtccgtgacaggctccatatggattaagcactgaagataaaacactgaatagaaacagccagcctataccctcatgctccttgaatgtgatagaaggagccagccagtaaaccctttaccacaaataaacacacagttacacattaagaatgggaggggaggtatgtgattttttacagcccagtcttaagctttagaaattggctcctctgaggaagggacatttcagctaagaaccacaggataagacagtcctggcctggggaaggggagagaaggtcaggagagagcttgatatgtttaatactgaaagaatatttgatgagctgggacatctcctgcagatccacggctccctagctttgtgaccctgggccctagactcaatccctcaacccttaggagattatctataaaacaggagtgataatattcttgtgttaaaagctgctgtgaggattagtgaaatgatgtctatatttgcctggcaaacaggaagtgtaagtagtagtatcatttgaagattattcttcagcctaaacgtgtgttcattatggccggtgtgttttctccccacctagatggtagtgctgggcctcctttggagtaccttgatgtttggggagcatggatgatatgaccataacctgagaaggcagggactgtacccattctggtcctcccaggtcccagggcccccacagtgccctggtgtgtgatcagtgcccacaatactgaatagaggaacagacacatgggaagcaacggcagcctggtctttaagggtgagggagcaccttctcctgagagagggagagataggttgggggaggttgggtgggggtggggagagcgagtgagcaagcaagctagaaacttcctgaaaagggaagttactctagaaaagggtaagttccttccaggcatcatgggctggcttaacctggaccagtttgactttactaagtcccatttctcatctagggagcctgaggccattaaggttatctggtcccaaaatcccctagagctgtcacagggatccccattctttgcctttagtcaccccagccccaagagccatcctccacatggagtgagcagggagctacaaggaaaagacggtcacagttggagagagacagagaaccaggtgggctggtaggacaggaaggtatagggagaaagtgaagctctctcctggggaggcaggaatactctcctgc

SEQ ID NO: 63802 - DNA, 1022 bp, Homo sapiens
gccgagtaggacttcccagccttgaacatgggtttgtcatccaactgggacccacacttgatccagcggccatgctctgtgcagcctgggcctgagggcagccacgctcatgtgaaaagtgctagtagccaagctgccattctagtcaccacagctgtccttgcaggagcacattgcccagggctgggagctgtcatttccgtgacgggagtgagactcaacactgggtgagggtgggggtatctgttgggaattatttcaaaacaattgtggaaacttggcagtggaggggctctgggcataggtatccacaatatcctagtcaggggttggggtaccctggctctgctgataagcccaagtgagcatactcctcccccagcttggaacaggtgggacgggccaggtgacactagtgtggtctgtggtctggcctcccaagccagtggcagtactggggtggcagacatttgctgtgtgctatcccaaggcctaaaggtcacacagctaggttggagcagggttttgggcaggatgagtaggcattgctgtgctctcagaaaggcgaagcaaaccccagaagcaagggggcgagacagggcaaaggcctacactttgccatcaactcaggcctactcaatgctggccctgtccttcccctgcccctgccccatcagatggtgcgagctggcggggcttagagtgagcccccctgactcttcttggtgtggagtctgaggcccagagtgtacaggcctcatccgtgtgacccagcaggaggatgggagagtgggcccagaacttggtcaggctcatccgtggagaacaagttcttccctagtctagttgtggtctgagtcctgggtgaagcaggaggcagcctgggaaacagcctcgttctagtaggaatcgcattctcaggaacgctgactgtgcagggccctttctcactgccacctgggaggatgcctgcctgctggccatttcggcggactgtcagagcaccctccctggggtcccag

SEQ ID NO: 63803 - DNA, 1056 bp, Homo sapiens
ggggtctctccacctcagcctgtatccccacccccaccaggtcccctgcctgactccagcatacccaggccctagaagcaccaactccatggctgcagctgagtggagtgtgtgcctgcccaagcctagaggggtgctgacccctccctcgcacgaggagacatcaaagggaagcaggaagcagcggcctggctgacccacagcgggtgggagaagtgcagcctcacaactgctggggattttccatcccaccaggatttccgcgggacaccccaagtccagcctttgaggctcctcaggaaccagagtttggcctggagccagttggggcagaggaggggggccaggctgggtggcttaggggtgtggttaggcctgctaaggggctcctcttctcagtctccccatgatttgctggttactggcttgaaatctgggcccagacccattccaacactgaaccctgagctccctgagacctggctggcaaggacaggtcccaatttttacaggggcctgagaggaatggagaagggatctctgccccttcctttctcagtcacacctccttgacagggggtcatcagagtgggctgtggtaggtgcaccagggaagggaccatacagaggaggctggtctcaagtcctagggtgcctgggatggccctattgaaatgctgcagcagctcttgtgcaggcagggatctgtatggacagctgggtggacacaggtgcctactgacctcccagatccttcagcagagctcagccctgagtgacagcccaaggcagacctggctacctcagcctctggctcacagccctcagccagagccctgagaggcctgggatctcaaagctgcaaggtgggaggccagaggagagaagcccggagctggtagtgatgctggctgagtgaaaattgcacatttcccaacagtgtgatgctccctatccagcctgggcttttggcagacttctgtgctttgtggaggaagctggctcagattcctcccctccctgtgcagtttgtgtgtcaaggtgtacttgtcacac

SEQ ID NO: 63804 - DNA, 2801 bp, Homo sapiens
agttcacccagagcttttgcccacttcattgatggtctggtgggcttttgttgacacatacccgtgactcccaaatgaacctttcaggttggcttaaagccgctgggacctacacatgacaaaacccagacggaaacagtggcttacactcctgtgtccctaaaggtacctgttcctaacagtgggagtgccagagcctggaagctggaagccaaggagacagggacctccctcctgctgaccccctgccaggccacatccacctaagggatttgggatcatactccatcttcaaccactgggatcaaatggaaagccctcaggaattctgagagacagcccctatacctatgtgcactgacacacatacactgacaaatacgcattctgacacatatatgaacatgcacatatgtgtgccccactccctgccaggaggtgggttctgtcccatctttgacatgttacttcttgtccttccctaggcccagtggcactttctttgtgataggtgctgagacccccccgactgggcccagtggctgttcccaggacccagtctctgctcttatcttaacccagctctagctcccaggaccccagcctttcgcagggagagagatagctcttttggtctggcacatgttccatgccaagtagtggaaacagcagctgcagggcagcctcagacttgacatcatttaatccttgtgacaatcctacagggaggaagacactacacatatgtgcagatgcagcaaggagcagctcagccacatggaatgacttgcttgaggtcaccaggcacttgacacagcagagtttagcccagtctctggagagaccagccttccacatcctgtcatgctggggagggctgcccgctttttgtccctgctcccccagttctaaccccggaagagcgattgtccctgctgtgccttcagcccagacagaagcaggctaggagaggggaggagaggcagggctggccctcggaaggctcaccttcctcaacagttctctgcttgggcaaaggtcttccaagcagccaggctctgaggctagtcactgtcatcgttgggtgaggcagcctgggagtaccagaagttggagcaggtgggaaccttccccagggatggggctggataggcaggggtgggtgctaagtggcaggccacaaccaggcacctgggagggccaagcaccacactgagaacgcagtgcttcccctcccctcctaggctgctcaggaacccatcagtctcctgtaaacaaatgagactaagtctctggcactctaggcccaggtgcaaaggacagctgcccctgcagctactcactctgccctggccctctcaggaggcttgtgacctctgcacctgctggcttgttttgttcctaaaatacccggatccttgagaatctagaagacaccactgctaacagatttccacatcattcattctgttcttcctgtgcaagcttcatgctgggacagggaccataaaacaaggtgacccaaaaccttcagcagaatgcaggtaggcagagcagaggtctctgggagtgtcattccaaggcagtgtcttcctcctcccctatgctccccatttcccaagagtgggcttcttccaccccactcaagcacctcttcccaaggctgacctaaaggcctcaagctctgcggataggggcagtcctgaggtggcattgagtcttagggttggagtgggagatatctgtgcaaaggctgataggaacgtcctccaagggctgacttcaaagcttggcctaaaccactgcatcaaagtcagcaagctgagctgtttgcacagaaaaggaggaggagcaggcccttgagccacctgtagctctccttagggtctcaggctttcacaccagggcaggccttgggccagactacccaacttccaggccggatgtgccaccggggaggaggaggtaactgcccctcaaaaccctgcagcccagggctccaggattccaacccagggacctgcaggctcccctgctctccagatcagacccctactctcagagccctaggcccagtgggtgacagcctgtgagacaggcctgtgtggggtggccctagccccacctcagcttccaacctgaccttgctgcatgacctctggcccagccctctccacctggagtgccatctctctttgtgggatgggccaggtgggctgtgtgtgggggagggcaagtatataggtgtggtataggtggaaactgccacagtaaccagcagcagctcagagccgggccacccaatttgtatgccagccccagctgggcctaggcacgtggtgtgtggaaatgaacgaagcaggcagccctatgtttaggaggcaggtccagagctcacccaggcacagcacaagatgagtgcctggcctcagtgagcgagcactggctgctatgaggctgtggtgtggaaccttgacactagggccactggcctggctgtgtgacctctacctcatcacccagagcagggcaaccagaggcagagcctcagtgtggtgttctcctgtgaaatagtgatggcacaggcaggggctggggcccagtgcctacacagaggatcagcaaaggatggcagttattgaaacctctacggggaagttccccagacacgagaggaagacccccatggaagctgtgtgtgtgacgtgcttagattttccagagtcttcattttccttgtctaaacagaggtcatggcgcctccctctcagatcaaacagccctgtatgagtggctacaac

SEQ ID NO: 63805 - DNA, 3145 bp, Homo sapiens
tttatattgtaagatgtttagcaccctgcctggtctctacctagttgatattagtaattctcccatagtcatgatagccaaaaatatctccagacattgccatatgtcccctggggggcaccgcagatgacaaccacttccttagaacagctcttgggactgggatggtgtctctgctgtggctctttaaaggcagcaggccctggcttgcatcctgccacatctaacacctatagcctcaccacctcggtgagaaagaccctggcccaggcctggccaatcagagtaccctcttccctggtcagcagtataatttgtttggcaagcacttccagtcccacaacctatgggctgccacccagaggtttagttggaactacgtgtcagctgccgtccctcagccatctatggcatgggcacctgtggcttgaccaagttggaggtggcctagagaggccgggctgggcctgctcaccttctccagttagtgcagactgatgaatgagtggttctcagcggataccggatccaggtttgcagtacactccaggaggaggacgagtagggtttccctcagagcaggcctggatgggagggcaaggggtggcctctaatactgcctttccttccggtgcctttatcagcctgtgccatgctcctctgaactggccggccccagcatgtccaggttactggcaggagcctgtataacccagggttccagtcacaccagccaggaaggcccatgaggctggagcgcacccagtctctggctgctctgtctgcggaactaaaagcctttctcccagagcctttcctacggctgggcgaagctcttgtttgcaatttaaatgtggcctcatttatggaagaatccctgctcctccgaaaagccttgggctcaacctccctagcagcccgggcctcagccaggagaagaaatggatctaaaaggcctttctcctgctaattgtagcaattagcattagagaatggggactcgatggggggccagcgcctggcaaaacaagcttattcccagcttaggcccaggcccagctccacacactgctgcttggccagactcggcccccacccagggtctggttggcttcagggcagggagagagggcccaggcctgtgggtgctaagagcagttgtggagggtgtgcatctgagttgttaagcctggtagctgtacaggtagccctgggctatgacttgtggtcctctcagaaaagggtctgactggaacgcagagccagaccagatattcatgagtggatcacagagtgtagactgagggctatctggtgattgacagaaagtagtcttggggcaaatgactcttaaagagtaaggagccattcccctctatggctaactggatgcctttctctccccctgctccagaaaggacttcctgttccttcactgagcgtgcttgcttatgaggcttctggaaaccaggagagttcagtgggcctcattattgagcgtatgggcaggacaacctgcttgggacataggccatgctacagttgattttagccagcttgctgcatctacacagcacagtgccttcccaggcagtgaattatgtctaacaggcaggggaatgatcattgcctcatgttagggatgcagtcattcaagaaatatttgtcaaacactcagcaggtactagaccctggcccagagggagggatttgataggagcagggacctgcctaccctcccagggttagtggacaaaggggagaaagactaactaatgttgaaggaccgtttgcaccctgaggggagtgctgaggcctgggagcacagcaggtgtatagcaggaacccactggaactagcctggggtctgaaaaactcccttggggaaagtggcaggggcaggccaagggccctctggtggtagggagcctgtgagcacctgggatggaaagaagccaagcatctgaactaccagaaaggcagctgcaggattaagcaagacccacaggtctctaaactttgaaaggatgtctgtccactgagtagataattgattggaatggggcaggggatgtgagaatgccagttaggagatgcctgcagtacagagaaatggtggcctatcaggacagtggcaatagggatggagggaagcagggaacctctagaactatggatgggtgaagtaagcctggcttggtgatgggcttgaggtgatgggcaggtggtgaggaagcgggtgtatcggaaatgaccccagaacttctgacttgtgccactgaaaggatgggtgacactgaaaggacaggggccttcagtagagtgggctataaaatgatggaggctgtggagaggaggtgggggcaggtgactggaatgtgggtctggctgggttggagagacatttggggggtcagggcctcacaggtggtctggaagcccttggtgctgagggaacagcttagggaaatggtttgcatagagaaaggcactggcatttagtggccatgccagaagggaaaacctgccaaggagactgaggatagagccagaaagatggcaagaaagccaggagaactggagggatggaaaagaggacctaggggtcatggtcctggcagaggtcacattggatccagtgcttgtgattctctgattgctggcagtggatggccactggcctgcaaatggccctagtggaatgtcccctgcctgtgtggctccctgtgggctgcctctcccctggacagatggggagagaccccttccccacctggttctctgtttcacccttggaactgtggcggtaaagaggacctccccacagtacgtgcagggaacaagctaggttgactccctcagggaggcctcgtccttgctgaggtatttcataacctcaggatagagaaatccccccaactttaatgcaaagccaagcaagctgaaaaatggccttgaataggctgagatgaaaaaacaaagaggctgtcaacatcagagactcagtgggggcagggagcttcagtggactccccacagacagcagttcctgggcttctatgcccagacccagaggcctgagcccaagatgtcaggatgggtggtcactgtaagtgcagtggattgtagctcaggggtgagacat

SEQ ID NO: 63806 - DNA, 4678 bp, Homo sapiens
tggccagggtcgaggtccgagttcctggccgcgtcccaaggatcggattccgggtctatagttctcatggtggttcagagtgggctgaattgggattggagtctggaatccgcatcgtggttctgagtccgcgctattgggatggaagttgggaatccatgttgtggttttgagtcaaagcccgaattgggaccggagtcggaaatccacttagtggttctgagtcagggcccgaattaggatcggaggtgggaatccccgttgtggttctgagttaggtatcctagttgggatcagaattcgggtctagggtccacatcctggctgggagtttgcctgagttgggatctgagtagttggggtcccagtcagtccgggtctggagtccgcatggtggttttaggtagggcctcattagggacagaggatcgggagtctgagttggggacctgaatcccggtctggagtctgcatcatggctctgagttgagatccaagggaggtccgagttggcgactggagtcagggtctggagtctgtctttgggtagaggttctgaatggggggctctgagttaagagattgggattggggttagaggtctcagtggggtatgggagtcaggaattgaagtcgaagttctgcctctaggtggggattctgagtcaggaattagggggcgaagtaaaggttgcagtctgagttgggggtggtgatcacctgccaggtgagaggtagtggtagaagtctcttggtcatattggagatgagagttgatcagatgcaggtctcagtctgggtagtaggcttgaagggccaccactatgttcagatcccagtaccccactgtggtccctgagcaggtcaaatagccttttatataaaattgagagtaagagtgccttcccacagcactgttctggttatgaaagagaataattcatccaggtagaatagttctgtcttagattatcacaaagtataaaaactttcctgataatatccacatttgatgtgcatttaccagttctttctttactgtggtgccccttttgctagaccaaaagctcccaacgaggaactctgttttgttttctgctgcctgctctgtacccagccaagagcctgatacacagccttactcagtcagtacttgaaggaaagcaggcaggcaggattaaccagatttctatggtgtctcaaatgatccatttctgcacctgttttccagatactcagtaggagaaaaatttaaggattgagttgcttgattatgggtgtattttaatgtgtttcctaacatgctgaggagaaaagtgggtctgtttcaggatttatgctccagctagagggattttttaaaattgcgaatcagagcatgtccaaattcagatagaaagcacaagaaaactataaagaatttcccttatgaatgtagatgcagaagttccttgtacaatgctagctaactgaatccaataatatgtattaaacaacaattcttaaacaagtgggattgctcttaggaatgcaaagatgatccaatatcagaaactttatccatgtaattcacattaagaggctacaggagaaaaaccatatggttccctcaatagaggcagaaaaaaatgatgtgataaagtttaacgcctatgtgtgattttggggtagtggagtacaccacttagcaagccaggactagagaggaacttcttcaacttgatacaagttataaaccaaaacttaacttttcagtaaacttgatagagaaattaaaagtgtatcattctctttaagataaggagtaggccaaggatgtcatcctggccataccctaatacaagaaaaagaaatggggatgtgaggatcaggtaggaagtgataaaacttagtgtagctcatagggttgatggtctccataaagattctcaaacattttggtgttacgacttgttgtattcttaaaagttattgaaacccccaaagggcttttcttgatagagattctatctgttgatagttaccatcttagaagttaaaactaagaaatgtttaaagcagaactatacaagcacatattccactggggtcatggtgtgctgcctctggaaaactctttatctttgtgagaatgaaagaaaaggcaaataatgtcgagtattattatgaaaatgtttttgacctttcctgaaagggtctggggggctctctggaatccccagactacactttgaaaattactgggctacatggaaaaaaaaaattaaggaacttaacaactaaagagagatttcagatttcagagaggttttggatataagatcagtgtactcaaaacaaaaaacaaaaacaaaccacatttctttatgccaatagcaactgactaaaaaaaagcataatagagattaggacagcaatcagaatagcagcaaaatttataccagtctaggaattaacaaagacgacgacttttatggaaaaaattttaaaactctattggaggatatagagggagatctttccatatgcagagacattttattttcttgaacagggcaacttggcattagaatgacgtcaggattttccaaatctgttaagttcaacaggactccactcaaacttccagttggagggcttgagtaatttaacaaacatattctaaaatgtatgtggaagaaaaatatttgtaaatgccaactgaacttttgaaaaggagagcagaggacttctgctggcagataccagggcacacgccaacttcagcaatcagagcggtgtggtgacagaggcccagaagagagctcagaggtaactccaagtctagaggaaggggacatgtgataaaggtggcaccacatatcagtggggactgttcagaagatgatgttggaaagccagccctaaaatggaggaataggaatatggattcctaactgagcccctaggaaaagtagactccaaatggactaaatatttgaaagcaaaaggtagttgccatttgtttaataggagaaaaaatgaataatctccagggccagggtggccgtggggttcttaaacaggatccagaaagcacaaacctcaagactaaaatgtatgaacttgaatgcattaatgattatggattaaggatttctgttaaataaatccatcatggcaagggtcaagactgttttcataataatactaaggaaacaatttgcgtttttcacttttacactcatgaatgtaactttgccatgactcattacaagatatttgaaacaattaaagctgaggagggaacaacagctaaaatataccagaaagcaccacaaatcattaagaaaaaggtaggaagattgccagtttgcaggagggttaacaaacagatgaaaatttgcccaagctaatcagttatcagagaaatgtaaatgaaagcaacagctattcttcataggagaagcattagaaagtaggataaggccaagtgttggcagaaggcaaggaacaagcctccctgtgtgctgcaggtggggacggagacaggcacagacgttctgaagagctggccaacacttcttcctcaaataaaatattttatacctgtggcccagcagtttccctcctaagtaaacatgctggagcagttctcacccagaacaacgagaggctgtgtgtgtgcatgctcagggcagcatggcccataggggtgggcagttggagctggtcactgtggttaggagcaggggactagatgtacacttcacaagatagagacgcgtggaaacacagtgctgagtgacacaaatgccaaacagaaagagggcctcagtacatgactgtgtatttaaattaaaattacacaccacccagacacgcagtactagggagtgctcgtgagtgcacacacacacacacaatgatataaataaattaccctggagaagctgtttgtgtagggaggagagcaaggatagaggctagagatgaagtggaaaagcatggagaggaagagagcggtgactttatgcagacccttacagggtgacagtgtttcataggctgagggctgtgatcaactctgtgcagagtcccaaaagccaagaaccaacgaatgaatgtgcctccatgactctcctgccagataccctctagtggcttctatttctaggaaataaaattcaaattccatcaggtttttacaagatctgccctgcttacctctctgaccactgtcctccctcactgagctttggctctgccagccttcttcttctttgttaaatctgccaagtatccctcctgccccaaggccttcaccacctctgcctggcttgtcttttctggtgatcttcccttgacaattccttcttcttatttaaatctcacaggaaattttgctctgacctgccatatctgtcatccccttcagtcactcactagctgacgactacctttcgagtctctgcaaagcacaggctacgcttttctagttccttagacatctacttatttgttggctgcctatctcttccaccggaagagaggccccaagagagcatatctgtcttccgtatagggtccgcacatggtgggtgtgtcacagatttctgttgaatggtttcattcatttattgaacgaaggaagaggccaggccaggaaagtgtgcctccattttcacaactcagtgag

SEQ ID NO: 63807 - DNA, 2555 bp, Homo sapiens
gctcagtgttcttggccactacactgggccaccttcagtctacccttgaatgtcagattgacatggcgagggtttttggtcagcctcgttttgtcttggccaggctctttgggcagcctctggggtggctgagattgggagcttagacaccagggttcaaggttattgattttgttttttgcatattttacacatattttttcggccatcccttaaatgtgatttccaaaagaatgaactgtagcctcagcttatactgtggaagatatcatttatggtaacccagggatctttttgccccatacagtacaagttcttaggttccataggcacgctggattaagggcaatttgtaatcttagccagaaatcataggttacaggttcgtaaagttactagcgcagaagcattagcaagatcgtgatgtatttcttaggctattgttggcctccacacaaattcatggagttgctggatgtggtttaaagggtacaagatctctgtgttagataatattggagttaatccattcctctgggaggggaattttgtgtcccggatgccgttactggaaggatagcattgccccttggtgagactgttaggagagtgaaggagagtgagtgacagatggagctcttgggagtggcagctcatcatttgttggtgcagtacaggccaccagaagaggatggatctgccggggcgctccctggtagtacaaagagcaggaacccgctagaggagagatgtgctttccatgagcgccaagggcccagcctacccccagacagatgtgcccttgagaagtggggactgttggcaccaagaggggttgcctccgcggtggccttcctggatggagctgcccgtgttgagcgcactgtgctctgtgtgggcaggggttccagctgcttcccagccctttcatgggcaggcccctggagctccaccaccccaaggagccccaaaaccctcctgctgaacatgccatgaatttgaatgcttgaaggcatagctttaaaaacaaaaaaaaaccctgctttgactgcagggtggtagggggagttagctttgtttttgtcactatttttaaaagtatatttgcagtaaccatttttttcaatgagaatgaactcattcagtcttggctttcattgttgattggagctaattggtgaatggagctggctttgctctctacaagccttgtctttttcattgacagaaggaacccagccagccggcggaatgcaagcagcagtaggaagcggaggcgggtgcctggcagaccggctgtcgggactccaggcctgtgggcggggcctcggtccttgccgcagcacaatcccgtggacagagcttactccatctaactcgttttcaagtgcatgattttcactttcacttttcctttttccttattattttgcttaacttgtacagtggcaactgaaatgcatttcagaaataggaggtttcgtccagcaccctctgcagccttggtgcctgtagctctggacttccctgggcctttccctgtgggagggccctgtagaccacatcagggtggggtgggggtcacttggcaaaaagggccgaggtctggtgatgtggttcccaggatctggaacctctcccacccctcctgcagttggactgaattcttccctttcatccgaagaaacccacttgctgtttccagccgctgaatctgctgagtgtgcagcctgcatcacctgctgtatgccgatcatctcagaaagggctgtgtagagtagggccctgttctccttaggatgttgcttcttgatttttttttttttttaggggtgggtcagggttgtgacacaccagcccaggtgagagctgctgcgggtcacctcatatttatttatcccttcttgcctgtgaggactgcggcttttcgctgtggctcgtccttaacgtttctgaaccaccttggtgccctgagcaggaagatgtgccacttcctagcaggcgcaaggcctgtgcggaagaaacgccgctccctgccaccagggctgaagatgcgagcccgtcctcatgacgcaggcgccaccctgctgccggagccgggcttcggcagtcttctccactgagggactgggctgggaagtcctgcgtttcagtggagcgtatgagcgtcaagtcctgctttctcagtagccccattgcggggccccaccattcatcctgtctgaaggtcctgggtttggtgtgaccgcttggcggctggtgggtggggttttcaagtgggtgacggcgctctccggcagccggggatggccgtgtccgcactgaccaggcctgtggagagtgctcggcctaaccttagaacacatttgtaactgaatacagtgttttcaatttgtacagaatagttagaatattctattaaagtggtgaaacattgagtcagcactgtgccatgtgggtctttgcaggggaatgtggtggggaaggctcagatgtgctgcacacctgttgggctctgttgagccctgggtattggtggctccaagaccggttgt

SEQ ID NO: 63808 - DNA, 2830 bp, Homo sapiens
acatactcagtagaagcttttccagctgtctcaagctgtgtcttatttacatagactcctcagtagagcaacttgactttccaagtgtttcattcttttaaggtaaggtaatgatttaactgacaacataaataaacttttctttgtgcgtgtttggaaaaggtgcaaagaagggactttggggctctttttgttaaggaacagaataatgggattgtgggcatcatttgacccagttgcacttgagctgagcatgcccagatgatgtgtctagatatctcatatgtctcagataatttaaaataaattggaaaggtttactaaagaaaactgagttgaaaatgagtgggcaaccccattaattttacctgcaaatttagatttttatttgtggtctcagagtaacttaaatcaaggtactttgaccatttggcacattttaaaatcagaagtgcttaaatgtcatcctacagcatcataagagtttcttcttgtaaaacatgaaatgtgtagttcacttgcctcttaaaattaagtatattatgggctgtcagaatactaacgttacctggtgtttttgtaatgtgtctctgtccgactagacgttttttgcttgtttttacccttgttttttggagtgtgcactaaaagctgtcagtgtgatattctggctctgtcatcagttggtttaaactggctgtttccatgaatgcatgttcacagttgtggttccttcaaggaagggatgggagaagagcttttaaaacttttttgagaatgtgtcttataaagactactctgggaataatctgctcatggaaatgttcatcttctaaagtttggcctgttgatgtgggaggactctgctgaaagcgtacctgtgcgcagcaccgtggtggtgggcggtgagggctgtaggagaccaaggcctgggtctgccttgcgtgcatcacagtgtgcggacagggaaggtgagggctgtcagtcagccagtgaacaacgttgggtgaataaatgctgcccatcactgctgtgcggggtgtctgatggacccaagggccacgtgtgtttattgggctgtgtttccgccttgtgggcgctgaatggacacttttaaggttgcagttgtaaagcaaggactggggtcaattggcagggccacctcctcagactccgcgcacagctgcctctgtccttgttgcacttgtatctccccctccctgtattctgtgcctcagcttctcttttcctcccctctgttgtttgttctgctttctctgtcaccttggagaaccttgagtctcctttcacgtcccaggtttctaaaagagcattctcaccagccattacagagaacatgatgtggtggattacacatgctaacaccccatgaaacctttgataaacggttatgttggttgggggagaagggactaaaaacatgttccggctaatggtgtgaatgaagttcagagacggcccggcatgtgtggccaggataaggccaagcctgctgtccctgtcacatgcaccttccagagagatgggcagtgttagagtctgtgcaagcaaaagaaaacaaggaaggaagggaggttttagtattgggagcagtctgatagaagtgaaaatcatgcttctgcccattttgaaagtatgatctagtgttgaagttgttcaccccgagttcagtatcttgcagcccttttgtatcatgagaaattgtggccgtttcctcctgtataattttgtgcatttcattttctttcatgctgacagttcctttcaatttttttccccatttaggtgtaatttttgtctgttaatcattcatacgtttctaggtaaggtggaattccattcatacctaacttccaaacttctgatctatactttatacaatgcattgttttgactttgaataaagagggagttgctgtccaggtacactcactgtgtcacaggtttgacataggtgtctgttacatgtacttttaaaatcaacgaaccaaacctagatttggtccctgctttctgagcccagtgtttcttgctaaccaagtagcaaagatgtaacttgggtgtaattttcattgctgatggtactgctttccagtaagagggccctggatggtcagcagtctgcacggtggcacacacgggccaccataagcaagcagtccttgcagagagcataacacactgggctgtcccagctgtgctcagaacacacactggcagttgaaattggcccactgtcattaccaacacgtgtctgttgaatatctatactttttgaattcatgttttgtgcagaccaataggtacacagaggggtaacagcttttactgtgccagcattttttatctgaaacatgaactggcatctgttttggtgtcagcagtaaaaagtactgttgtgaggttggtgctagttgaatgaagcaagaaccagttgtagatgaaagtgagtgtcagtaagcctggaagctgtttcccactccactttcttcagtccctgtagctctgccctgtcctggaatgctgacaggaggccgtaagtagacagaggctcttgcccgtgacgagacctgttcactcgtggcactcgggatgtagtgggagaaagcagagaggtggggacaagaggtgccatgaggaaccccacaaccatagcagggcctctgcatgccaggataagtaggcactccgtttttaagggtctcgtcacagaacatcagcatgatcctggcagcccatagaccagacgtccttgaggtcttagcgccaccgcctccctgtcttcctcatgtaggctgctttcatggga

SEQ ID NO: 63809 - DNA, 1008 bp, Homo sapiens
ctctaagcaaatacatggtgtgagctcaacaaaatgggaaatgttgataaatgaagctgcattttcatgcactacccttgttatgcaaccagtagtgataaggtggttttgcttttggtgtaagtctcatgtttgaaacttgatttttagtctgaccaatgatgtatttggatgtaggagaaactgattcaagacaattgactaatggtggaggttcacctttgagcaccttattgatcactttaaagattaaacaccaaagttttaatatatttctactaaggtttcttttccctttgtatgagatgtaaaatgatacccagattcctgtatccaataacattatgctgctggttcgatcagccttgtagaaaatttaaggaaaacaaattcatcggtttacaaaaatcttttcctgtgtgcctgctcctcggtgtgagaacagccagggcagagctgtggtgccaggttcccagctgtgtccagggtacaccctggctgaccagcttcctatcctattccttgttttgcgtgactttcaatttcctggcatgcttttaaaatgcgctgcacacaagcaaatggctcctcaggcaagcgaggcccagcaggcagcgtggctggactttctgctcctcttaggcttggtcagtgagtcacttgatgggactggtgtcttgggcaggctgctgtcatgttttgtaaacctaaaaatgtttttctgtgtttctccagtttgaagaaggtgaagaaggagaagaggaggtaagagacaggtttatgcagtgccacttacctccctgaagttgtttctttggctttctctgcttgaaggttatggactcacagggctgtgttaaacccattttttgtgacgctgtctttgattctaagaatgttcttaaaacactaagcagaaatgcatagcaaatgctgtgacagtttccatcgtttttgaccctgcagttggttcatgaaaatgtatcttagaaaataatcatttaacaa

SEQ ID NO: 63810 - DNA, 2043 bp, Homo sapiens
acagcttataaggcttaaggactttctctttcctgcaccatcatgtatagttctgcgggacatgagttaagtttccccataaagcacaaatgcactgaatggccacagcctgggggctgtttgccattcctcctgttaatatattaactctctcaaaatgatcttctcaagcttgagtgccagcccatggcacatgatggaggaggagaagggaggggggcatagaggcactcaggccagcttcagaagtggtggatggagcttgcaaagatgtctgtgaggagatgcaaggctttggggatttctgttaaacctcgaggtgagaaatgttacattttatctaccagcacagcttcctcctgtgtgggctttaaaattctgggagttgtcactgtaatttaaatatgttttgtcttttctttttctagcatccggggatggagaatcactggtaagatttgttgttaatagtcttattttcctgttgaagtctctcctgagtgaatgtctacttgtctacttgttaaaaaaagtccagtcctggctgtgtgtggactgggtatgccagtgatcttaatgctttgggaggctgaggtgggaggactgcacgagtccaggagtttgagaccagcctgggcaacatagcacaaccccatctccacaaaaaattaaaaccaaataaattagccagccgaacatggtggttcacgcccgtaataccagcactgtgggaggccaaggtgggtggatcaccagaggtcaggagttcaagaccagtctggtcaacatggtgaaaccccgtttctgcttaaaataccaaaaaaaaaaaaaattagttggacacggtggcagcgcctgtaatctcagctactcaggaggctcaagcaggagaatcacttgaacccgagaggaggaggttgcagtgagctgagattgcaccaccgtattccattgggcgacagagcaagactccgtctcaaaagataaaataataaattagctggacatggtggtgcactgtgtagttccagggtcgctggggcccaggagcttgaggctggagtgagctgtgattgcaccactgccctccaacctgggtgatagaataagaccctgtctcttaaaaaaaaaaaatccatttctgtttcctaaaactctgggattaatttgaaatcattacacatctaagtaaaagtatgtgtttcatatgttgatttcagtagcaaatgtgcagtgctttaatactgcctgtttcccatatgtgagactgataccgcctactctgggtgagacctttggacaagttgtggagctgtagggccctcacttcccactttctctgccattttgcttcagtagctctttaaagctacttaaagttgttttaaaggggctttgagtgtctagtggctgtcccccagcagtgcaggagtttggtgttttaagttaagtaaatcaaaagtgaggggctgaggtttggctgagggtggtgaagtgaatgtttttatcccattaaaatgagttaacacgtaggtttttcctcctcaggatgaagattctgaattcacattagcctctgattttgaaattggacactttttccgtgagcggatagtcccgcgggctgtgctgtacttcactggggaggccatagaagatgatgacaatgtatgaggctcggggaaggggggcttccacctgggtgcttatctctgttggtgcagagtggccctgaattgtggcttaggaaacccccatgcctaatctttttattacatcatcagccagatatgtagtccaagctgctgtccttgttgtggggggaatacgcttgaagaggagaagtctgaggaacagagcaggaaaagcaggtgtctgtgaagcagtttcagaggtgattgccagtttcctatgtgagccctgcctagtgactcaacaatattctctcaaaacctaagcttcagggaacttgtgaacacagggaatatctcttttatggaggtctggccacaacaaacatttattgacagtggacttatgcta

SEQ ID NO: 63811 - DNA, 1030 bp, Homo sapiens
ctttgaacagcagcaactcctccttccttgggaaaccgcggacaagttcttgtgcatcatgcagacttgacggggctttgccacagaatatacatttcagagtcctgatgaaatgtcttgggaaaataataccattgttccagaagtctgaagttccagtggtcacacccaagttgaaagaggaccaggctgtttctctttttgccaacctccagatgaacttcatgggccattgtatttggtttgcagattggttttatttcgttttccaggtttggcatagagctgtggtttgcttcctgcatgcatttgtaatggatttttctcatggattgtgtgttcctgacagctgtcttgtcctggtaggtgtactattgactggaagaaaggaaagaatgttactgtcaaaaccatcaagaaaaagcagaagcataagggtcgaggcactgttagaacaattacgaaacaagtacccaatgagtcctttttcaacttcttcaatccattgaaaggcaagtctgttggttgttaatattcattatgttcttatataaaataattttggtcacctgatagattcctaacacccagagactttagtcctcttttttcaggcaagtgtggtcagtaggggcacattgctgtgtcccaggctgttctgttggtgcgctggcaagtttatcgcggggggcagaggtagctaggacagtaagagtaggattgtcatcttctgcaggaaagggaagagctttactctgcttggctgtagcccaggcaaaaacttgcagttctgttttaagaaaactgaatcgagtatttgcacctgggctgcttcctcacttggacacctggagcacccttctccaccagctggcatttctgccccgctgttgtgtctggttcgcaccccccggggaccactcccagcctcggagagctgctgggtttgctctgcaggtacccgttactgctgtacgctggttctagttgtgctgcttttggatcatctgcttagtcccccttttcttgt

SEQ ID NO: 63812 - DNA, 1033 bp, Homo sapiens
tggtgctgtccactgtgccaggccttggtcttgtagtttgtttgtttactctgttgggtggagatgataccattcttttcccaagtgtctctgaagtttgcatgcatctaatgtatatgtttaacgtttaaaaagatgggagctatgtacacataatgatcagcacttattcagaaatctgaacctactaggttttaccctaaaaaaaaaagcgcaaataagactgaaaaatgttttcctgctctttgatttgtcctgaaacacgtctttacaatatgcttgccatggcatatcattgcattagtaatgttagtggcatggatcagcctaccagttggtaagataagcttgactaggtcagcccttacttttatctgaggaaccatatgctcatcttcaaatggccttgccagactgtctcatcccagcctggttctcccagggagcactgttcgtaacccgttagcctggctgtagctaatgggttccattccggtgcaatagcatttccagcgacacatgactgactgactggtggctttcagtttcaggtcttggagacaaatgctgcatgacgggctgtgggttagggatcttgggtgtgggtgatggtggtaggggcctggggccagtcaccagtatcttccttcctccccatctcagcactggggcctgggctaatggatgagggccactaggagtgggatttcttcactgcaagtgctgcaagtaatgcctggggcagcagcaggggtgggcagtggatgtacctgtatctgtctcttctactttttcctgtctgttttccactatggaaggtgacattcaggtgtccctctctaggtggggccctgggagctgggagtgatgcctgctcaccagctgggggctgccctccagaggggataccccatcttccttgccccatgtgggttatagcaggtccttcttcctgggcttgcatcacttctgtttagactttatcacagggcccccaggagccgcctgggcacgtctgcctagtttgccctcg

SEQ ID NO: 63813 - DNA, 1074 bp, Homo sapiens
tattagtccaagtgaacttctttatccttgcactggactttttttgcccagtgctagatgttctgcatatttgcattgcatctccttaaggttgatgtacagtctttgcatctgcatttgtgatgatgattgtctcaggatggcacctcacagagctagcactggatggcctttcccagcgtcggtggcactttgtcatctctttagtttcttcgcctttgatgtgaaatggtacggaattccgtgtggatgtaatgacttgaatgctttttcctcagaagcatctgaaaagtgtcgcgtggcccagtgagtggtttggaggtgcagacttagaaagcaaggtgtttgatgggagatagtagaggattcggcaacgatattctacgtgaagccgctgcattgtttgtaaacttttattttcgttacctatgttgcatcttttttttagggagacatgaaaagtaaagtagtcgtcacagaaaaagcagcggcaacggctgaagagccagatcccaaaggaattccagagttctggtttaccatcttcagaaatgtggacatgctgagtgaattagtccaggtaagcacacttctgtcttgtagagagattatgtgctagtcttctaacattacttatctatggcattttttaagcactacactgggcattgaaagattgttcatagtgggcggaagggcactttctctgaccaggacctcagatgagcagtcctgatctcacagtgaatggtttattcacagtggggcttccatgctgtcttttgcagttcttggtggaaagctgggcgcttcagcctgatccaaaactttcaaatcagttccttttacctcttgtaaagctctgttgtcttgcctgtgggaaagcctatgaatagattccagagcccatctctgtcttcctgtggtgtgagtgtgcaggaaagggtgagggcaggagaccagagcagaatgaattttgaagggatgagctgtgtgtttgtttgtgtgtgtgtgtgtacacacacatctcagtgaatttttgaacaagttgctaatattttctgatcatttctc

SEQ ID NO: 63814 - DNA, 1078 bp, Homo sapiens
ttgacaacatctagggtaagaacgcatctaacctgccaaacatagcttagtctagactaccttaaacaagctcagaacgctaacattagcctgcagtcaggcaaaatcatcttccacaaagcctattttataataaagtgctgagtatctcgcgtaatgtattgaaccctacacagagagaggaacacagtgtggctgtattggtgcccaaagtgtgatggcttctgcaccatcaggaagttgaaaatctttagctgaaccattggaaatcggggactgtctttattttacatctttaggtgaaacatccaggtttacccagggaatcatttaatatttttctttgaaccctaaaatttagaatcttaaaataagttataaaaatatccagttttcaaagtcttttagtagacattatttataaatttaactcttgagttcctaagtaagctaataacataattctaataaggtctcatttttatgtagagaagagaatttatcaccggcgatgttgaaccaacagatgcggaatcggaatggcacagtgaaaatgaagaggaagagaaattggctgtaagtctttagaaacatgtgactcatgttctgttttaatactgttaaaaataagcattttttaatgatttttaatgactagtaaacttatgtgcttctaacagtaggtgctgctgcatcattaggttgggtttagattcctttctgatatggatctagcatctgacacagtactgtcagttaataggagtaagatgtagtgccacctcagttatctgtggacaggagcatattgaaataagggatcagaccaacaaagattaaaacatcagagaaagcaaagatgaagaagagatgcccctgtgttctcagtcactggaagattgggggagttgtgaggggagtgccttcctgctcagtggcatggactagcttgccccctgagaggtgctccgccagtggattggttgcagatggtggttgtggtgtggccatcagtcacctgctcacagcctttttctagtgactggtcccattccagtgctgtgaaaactcccagtgt

SEQ ID NO: 63815 - DNA, 1051 bp, Homo sapiens
tgcaaagaaaacttagggaacagtgctggcagagagctagtgagccttgggctctcctggactgtgaagtctatggcaccacagtgagcaagggagctagtggatgctcttttactttgaggaactgatctcatctctgttcgtggcttctggacaccaccatgggacttgggggtagaccatgtgaacttacattaatgatgtcctcagttgtttaagtctggtgcttaaacagccacagtcctggtgagagccaggactctctaggtgtttattcagtaaatttgtaactacccatcaggtgattaacccagagtgttaaatgctcttaaaataaattttaattattttcaaaacatgtttaagaagtcactggtgtatgtatttagaaattagtagatgtaaatctaggcaaagctaagtagatatgttactaatttttgactcttggctattgtgtgtggtgggcatattttaaatatgtttggtcttaactcttcatagaaaagctcacagatcaggtgatgcagaatcctcgagttctggcagctttacaggagcgacttgacaatgtccctcacaccccttccagctacatcgaaacgtaagtgtgctgtgaatagggtctcatgcaatttggagaaacaaaaggaaaataaaggaaaaaccacttttcagttccccagaacaggattaaatgtttttttcgttccaagacattgtctatgagagacaggcactgggatatgagaggagtgaccctacccggtgcctaggctgagagtttgcctggtggatggagtagcgtgacctgtcagttctgataggaagtgcacagtgccatcctgtggagggctagaggacttcacagatcatctgagttggagaggacagctggtggctcctaagttaaactaagagaaccactccttcctgacttacccacatgagcctgtgacaccaacaccttaaaaaaaaaaaactgggcatagtgccgcatgcctatgagttttcactaccctccagcctgggtgacagtgagactgtcttt

SEQ ID NO: 63816 - DNA, 1079 bp, Homo sapiens
atagggattgataaacaaaaataatttgtggtgctgaaacttgactgaactctagcttgtttataataccacctctctacattgtctttccttattcaggttgagcactcctgatcccaaaatcaaaaatccaaatgctccaaattctgaaactccgttagtgttgacattaatgttacaagtggaaaatttcacacctgacttcacgtgatggatcacagttaaaactttgtttcatgcacaaaattatttaaaatattgtataaaattaccttcagtctatgtgaataagatgtgtgggaaacgtgaatgaatttcatgtttagatttgggtcccatccccaagatacctgatcatgtttatacaaatattctaaaatctgaaacacttctggtcccaagcatttcagataagagatactcaacctgtataaagggtgcagtgtttaaagtaacttgatttgttggtttcatatcaaggaatagatgtagtctatatgcatggcagttacaaaagtgaaaagagacctggcctgctgttatgtactaggaaatttgtctccattaacagtttctcaggtagccactgtcttctagtttgtggatgatgaaactgaggtccagaggaaggttatgcagaagagcatgagtgggaatgagtatggggaagtagacagggcctgaattggtaggaatgtgtattctgcagaaggtgacgggggaccattgaagtgtgtttgttagttttttgtttgtttgttttttgagacagagtttcgctcttgttgcccaggctggagtgcaatggcgagatctcggctcactgcaacttccgcctcctgggttcaagagattctcctgcctcagcctcctgagtagctgagattacaggcatgcgccaccatgcccggctaattttgtattcttagtagagacgggtttctccgtgttggtcaggctggtctcgaactcctgacctcagatgatccgctcgcctcggcctcccaaagtactgggattacaggtgggagccaccacacctggcctttgttaaagggtttttaaatcttcactgacta

SEQ ID NO: 63817 - DNA, 1013 bp, Homo sapiens
ccatattggtcaggctggtctcgaactcctgacctcaggtggtctgcccacctgggcctctcaaagtgctgggattacaggcgtgagccaccgtgcccagcctattcattgcttttaaacattatcatgggcctggcatggtggctcacgcctgtaatcacagcactttgggggaagctgaggtgggcagatcacctgagggtcaggagtttgagaccctctcccgccttgggtgacagagcgagactccacctcaaaaaacaacaacaacaacaaaaaacccagaacattatcatggaaagtttaacaacatgattaacttctgatcctggagagtggtaatgatagactggatcaggagtctactggcctgggcaatagaaatgaaatctggactgtctcagggcttcgtataatcaccagcttttgtgggtggggatgttggggtgtcctacaggggtatcttgattccttctgagaacagatcatttctttgtcctttctgatgtcctaatctaaaacatccagtactcctggaggatttgaacttgtgcccaatggctggtcagactctcttggattgagaatgttggattgccattcctcagactgaatgtgggccaagcaattgtgctttagaaatttatcttagagtgcggtggctcatacctgtaatcccagcactttgggaggttgaggcaggtggatcacctgaggttgggagttcgagaccaagtctggccaacatggtgaaaccctgtctctactaaaaatacaaaaaaaaaaaaaaattagctgggcatggtggtgggcacctgtaactccagctacttgggaggctgaggcaggagaaactgggaggtggaggttgcagtgagccgagatcgcgccactgcacgccagcctgggcaacaagtgcgaaactctatctcaaaaaaaaaaaaaaaaatttactaccatccctaattttgtaggatatataggatttgtaaggaaattataaggagtcttgt

SEQ ID NO: 63818 - DNA, 1205 bp, Homo sapiens
atacaaatatgtagattaggttgttggaccttaaaggtaagtctttctaagttactaccttcctgtaatagtaactatacctctaaatgactaatacctgcactgcgcaccagggactctttcagcctgtttgcgtgtgttaactcatttcataatctaataacctgagatagatgctattgtttttccatttaactactctggaagctgaggccctgggaggttaggtataatgacttgtccgaggtgacaaagcttaaagacccaggcagttttaactgtacccagggttactgcttctgtagagggaatgaaagaagttttaatgagaaattgttttcatcattgtgctaagcttaactgaactctagcttacgaggttttgagctggttgatcatttccatctcaaaattctcttattccacagaatgccaaatgcctcctatagtagaattttgagattcagactgggatgagcaattgctaatggaataaataatatgcaaatgtaaaatgaagttcagagaaagcaacgtggtgatagaatgggaaagtaatccaaagataaaatgagtgactacagagagagagaaaattagttatttagtagtagttcacaagtttacttagagatatttttactagaatttcagggccttatgatgtgatttttatgaaccattttaacacgttactgccgtcttaaatagctgttattacatatccaattgcagtcttttttttttcctggttgagcagtgttagcttcagaatgtctgcagttatttgtgcctatatgtcatataggcacatataacacttttgtgaattttgttgtgtaagctttaaatccggtactgtttttcaaaatgaatatggagtagtcattggagaaattggttgaattctttgcagtagcaaataaattttaatcatttttaagtttgataactttggtaaactgaattctgaaaagtttacacatgttttaggatgtcctcaaaatgtacagggcattgtgttttgcaaattagccatttagccatcagattcttctgtagaattttgatctttttgcccatatgagaggtagttcttatttgtatggaggttaagtacctgcggatgggatgtgttcatcaccactttacagtatgaatttgaatttgaaactgaaatgaaaacttcctaacctgtcagagtt

SEQ ID NO: 63819 - DNA, 1040 bp, Homo sapiens
ctcccattcttagctgctggagccagcactgccagatgagtgtgctggctccagagcagtgtggtgactgaatgtccaagcaagaggacatggctgcatcagggagatagacactttgagacgggagggcaaagaaaggggagttggggttacccaggtgcagaggagaccaatagccgctgtgctctgggttttcagggtctgcccacacatgacatggagggcaaagagctcagcaaagggcaagccaagaagctgaagaagctcttcgaggctcaggagaagctctacaaggaatatctgcagatggcccagaatggaagcttccagtgagggggcacaggactgactttttaaaccattgtggactagtggctgctgtctgcctcagtgacaatgtcccagcgctcctatcatgtttacagtcacccttgggtcctaaattaagagttgtgttcatgtaggttcgtgtcgtcgttggctctgagacattgataataaatttttctcaacagtgagaccctctctgtcttgttctgcatgttcagcacttggcaggaggcctggtggccagccagggccgcttggtcagcaggtcacaacttaggtgcttgggtcagttgagctgcttcagctggccgaggaatttctcccccatgctgatggctatcggctaatctctggtgtgtgggcacattgggaggtatttgagtaggaaaaagacaggctcagactggcagagcctgctgagccctagacaaaggccgctcagtctgccctcgggttctgatgaataaacacactgcaggttttcctagagccgttccatactgggcagcagcacagcgagtggctcagcaggcaggcccctggcgagctgcccagaactgccgctggagacagcaagtccaggatctgcatggctaatgagtgagttgtgggggtggtctcaacacagcaggggccttcttgtccccagtgcccagtgttgtccttgccaccctgcctccacacctggttcacctggactaagaatcacc

SEQ ID NO: 63820 - DNA, 1050 bp, Homo sapiens
agggctctactgggcaggagtgcaccctgaccccatgccctgtggctctctgtgcctccgtggaccttagccaggcccctgcagaccctcacagaaggagctccgctttctgcctccaccacccaaggcctgccaggcccttctcacatggggtgcagggaaggcctggccaaggggaaggctgtgccatgtggtcacaagctccaagacagcgtttatagacttactactattaggttttctagtaagctttccactattcctgtagaaataacatctggtttaattttaaattccttgtatgttccctccaccttggctttccccttcccatctttcatagcactctgaatctgagggcttggaagcaagttgagggctggaggtatgagcagatgtcgttcacagtgcggagccccaggtgctgctcgggggcagtgactgtgccgtgttgcgtgttctaggcagcaaagctggccaagatgaagattccccccagtgagatgttcttgtcagaaaccgacaaatactccaagtttgatgaaaatgtaagcatgtaagcatccttctcttctattcagaacttgatcagaccacattaaagtgggaggacaggaattttcaaccttggacaagcagattttctgtctgtagaaaatttggaatcaaatctgacacccgctttaggtccagggcctcctggcccaactactgagctccttccacagcccaggcagctaggcaagcccgtgccagggccccctccactggtgtggtgagctctggtccctagccctgggagttgtggccccgggccaagatccacccaggccctcacaagctggctgaagtgccgtggcgcagataggcctcctacccccagtttcttcctttgtcatagcgattcacagccactgcctccaaacctctaggcccctccctgctggcatttggatgtgtttgctatgtacctttgggccagctgtgtcagaactcagccatgggtaggctctgaggggcacagtgcccctcaccttaggcaggaagcac

SEQ ID NO: 63821 - DNA, 1620 bp, Homo sapiens
ctgaaccctgatcatttagtgtggtttccgcattgacagcctggcctttggcaacagactagcctggatttgaaccagttgtgttacctgctggcttattaacctgggctgtccttccaagccctgcctgcaccacctggaaaacgcagctcctgcctgtggacagcaccaacaaggcagcagacagtgcaggtggcaggaggcggccccagtaacacatgactgttgacatcctttgtctctttccacgcaggcctactttgaaaacgactgctgggtcaggtacttcctgcacacaggccacctgaccattgcaggctgcaaaatgtcaaagtcactaaaaaacttcatcaccattaaagatgccttgaaaaagcactcaggtatacactggcttctcccacagaccccccaaccaccttctcatacatgtgtaatggctgtagcactcgggagaataagggcgttggctgtcttgtgtccccccacagcacggcagttgcggctggccttcctcatgcactcgtggaaggacaccctggactactccagcaacaccatggagtcagcgcttcaatatgagaagttcttgaatgtgagtccccagccccttcctggaggttggtggagcagcctcccctgcacagtgggcaccttgtgcagtggtgataggtgcaccagcctcccgatgtctctaatggagaccagcacatgggtggaagcacctccatgctagtgggtataacaggctcggggccactcctgaaatggctgacggctcagcagagtggacagaggcctcgtcctcctagtcactgcagtgcacgtccttctgacttgtactttccaccaaatgagcatctgtaaacctaaagcaagagcatgtttctgtcaaagaaatatcttttcctttctttctgaccacttgtgtaattctggtctttcagatttttaccaaaaataaaatcacagcagtagaaagttgtaacagatatttcaggatggaaaagttgcctaaatgctgttaaactgatttttctaacttcaggagtttttcttaaatgtgaaagatatccttcgcgctcctgttgacatcactggtcagtttgagaagtggggagaagaagaagcagaactgaataagaagtaaggtggtgccatttctttggggtttttgagcatgcccatgttctatgcctagcctcgcatcttggccaccatgtgtcctggactgtcgaggaagggctggggacactgtcgtacgttgtgcagaattaattcaggataggcggctctgctaatgggagctgctctgggtgttgaagtgcatggagaatttcttttttgttttttctttttgagacggagtttcgcccttgttgcccaggctggagtgcagtggcgtgatctcggctcaccacaacctccacctcccgggttcgagcgattctcctgcctcagcctcccgagtagctggggttacaggcatgcgccaccatacctggctaatttcagatttttagtagaggtgggggtctctccatgtttgtcaggctggtctcgaactcccgacctcaggtgatccgcccacctcagcctcccaaagtgctgggattatag

SEQ ID NO: 63822 - DNA, 1022 bp, Homo sapiens
agcaggtggtcagcgtgctatgtgactctcagttagagctgcagggaagcggatggacgtgcactgcacctggccagtgaccggcctcatcattctgcctatagcctgccttggaattctcattaaccctatgagggcagttgcagtgtgatgtttgctgaaggatagggtgtttgtggggagggtcctgtgttctctgttatcaattttttcaaagcgtatttttaaaaaatcagatataaactttcatgagtaagttcataataatgaaaagttgaaaacgtgaatgtatattttctatcaaagagcatctaaaagcgaatgtcatgggccatatcacattgtgcttttgcggaattgtcagtggcagaacagtgcggaggtagaaggaagccaggacagcggccttccgtgttggtggatagatctggattttgcttgcagaggttttttgtgtttttgtgtgtttgttttttaatctgggaatcagtataccaaaatggtaacagtagtaattcctaggttaaaagataatggcaatttttttcctagttttctttttttatctttcaaatattctacatttagtacatattttataatcatgaacttggtgtttagaaaaatatatttagcggtgcttttcctctggactctgtttctcagggcagcttaggtctgttgcctgattaggctcctgaaaagtggatttgtcacctggaaagatctcactgcagcttcttcagggtcacctgagttagaaccctagatggagtctgttcttcctccacaagggggtgacagcacctaaggcagcccttagaccagggaccaggaaaggctgcagcagccgggcaagacctggcgtgggtcctggtaaccttatgcctagagtgaagacctctgctctgcccattcatcgaacaaagggtgattctctgcgtgacctttggactggctcacaggtttctttattcacagcagctaatcttttccattggtcctgcatgtattgttgagag

SEQ ID NO: 63823 - DNA, 1003 bp, Homo sapiens
taggctctattctaaagaaatatcagaacctaaaataaaggtgcggtggctcacgcctataatcccagcacttttggaggccgaggtgggtggatcacctgaggttgggagttcgagaccagcctggccaacatggcgaaaccccatctctactaaaaatacacaaattagccaggtgtggtggtgcttgcctgtaatcccagctactcaggaggctgaggcatgagaatcacttgaacccaggaggcagaggttatagtgagccaagattgtgccactgcactccagcctgggtgacagaatgagactctgtctcaaaaaaatatataataaaataaaaccagacaacacagactgaagaaagatagagatagccaggttgacacataaatatcagacccatggcatttcaggctccgggtttgtgggagtagaggggcgggtttgtgatgatgaagcgcctcagctctgagaggatgcagcctgggcctctggaccagaaggcttcactaccctagaaccagagtggacatgcccacgtttcatgcacttcccaggagttgacagatcaagtaggccaagaattaatacggatatgaaaggtttgaaatacagttaacaggcttggtttgagagctgggaactttgcactcaggaattaaagaacatcctttccttccaagaacacagaaacatatgccaggccacagaaagatttccacaaatctcaaagaaccgttttcaaggaaccctcattctgtcaaggagccctcattctgtcaccatggagcgattgtattagataacaacacttggccagacatggcgacccacacctgtaatcccagcactttgggaggccgaggcaggaggatcgcttgagcccaggagttccagaccaacctgggcaacatagggagaccccctttctacaaaaaatttaaaaatgagctgggtgtggtggcacgtgcctatagtcccagctacttaagaggctgatgca

SEQ ID NO: 63824 - DNA, 3632 bp, Homo sapiens
ctgcctatctctcctaacctctggctgtgtccgtcatgaatcttttcctgaatgcaccaaggggttgtgctgtaggtgacacactgtgtgctcctgcccagcctctgcccataaccctgccctgcacggcccaggtaggctgcacatgctcaccaggcccacctcggccctcccacctctttttgcctctgcacccacagtccccttggctttgctcctctgagttcatgtgagacctgcccatttgtagagtcttgtatttgtccctgccgagccagttgtgtaagcatcacagtctccctaggagacggtggctcttcacaggtcaaggtcagcacctttgaattcagggcactgatgggctcacaccagctgcacgagatgttctcatgtgaagtgtgtggcccgctgctggatttttgtttctttctcttcaggtgttgctggaagaagccaaggatttgctctctgactggctggattctacacttggctgtgatgtcactgacaattccatcttctccaagctgcccaagttctgggagggggacttccacagagacatggaagctctgaatgtaagtgtcacgattgtcttgtgctggctctcttgcgctaagggccctgatttctaaattcctgttttggcaaggccagctcaattaagcggccaagtcaacattgaacttgagttgaggggcataatgggcttttcgttttatgaattgggaacgtttttatggagcgcgtggttttcagaagggaaaatcccaggacattctcatgtcttgcacaggttctccctccagatgtcttaacccgggttagtgagtatgtgccagaaattgtgaactttgtccagaagattgtggacaacggttacgggtaagcacaagggccttccctagggagggaagggctgcagaacatcgcacagggaggagctccccagctctgagcctgagtttgggaagcagaggagcaggtgttctggggctgcgtagctagaagtcccagcagacttcctcctacaactctgggcccacccaggggctgaggagcatgggtctgcactgtcctgggggccatggtgagaacctaacccagaatctgctgggaagctcggcagccaagaccatcagtcatggggccccagagctgcataatggtgagtgcgaatactgctgggccttcacagacatcagtgccattgcgtagacattttgagagtgctagtcctggtgtcatatcccgaaggaggatgcatttcatcagcatctatcgcttggctatgattttagtgactttttgttggcaaatccatcatacacttccctggcccgtattgtctcaatctccaaagtaagcattttcagaaatggccaacaaatggaaatgcagacaggaacccggttatctgtctgtagtgtgtagggaccagccccacagggtcggtgggtttttctccccatgtgtggagatgagagattgtagaaataaagacacaagacaaagagataaaagagaagacagctgggcccgggggaccactaccaccaagacgcggagaccggtagtggccccgaatgccaggctgcactgatatttattggatacaagacaaaggggtaggttaaggagagtgagccatcttcaatgataggtaaggccacgtgggtcacgtgtccactggacagggggcccttccctgcctggcagccaaggcagagagagagaggagacagagagaggcagcttacgccattatttctgcatatcagagacttttagtactttcactaatttgctactgctatctagaaggtagagccaggtgtacaggatggaacatgaaggaggactaggagcgtgaccgctgaagcacagcatcacagggagacggttaggcctccggataactgcgggcgagcctgactcatgtcaggccctccacaagaggtggaggagcagagtcttctccagactcccgcggggcaagggagactccctttcccggtctgctaagtagcgggtgtttttccttgacacttacgctaccgctagaccacagtccgcttggcaacgggcatcctcccagacgctggcgttaccactagaccaaggaacccttctggtggccgtgtccgggcataacaggaggttcacactcttgtcttctggtcactcctcactatgtcccctcagctgctatctctgtatggcctggtttttcctagattatgattatagagcgaggattattataatattggaataaagagtaattgctacaaactaatgattaatgatattcatatataatcatatctaagatctatatctggtataactattcttattttatattttattatactggaacagctcgtgccctcggtctcttgcctcggcacctgggtggcttgccgcccacagtagtgctcagcactgtaccgtgcgcctgctcccagagacccactgtgtccagcctcagattgcttccctcccacaggaaccacacaggctggatgaaagagaaacaagaggttgtgacagtgccaggaacggggcagactcttaagcagtagcgctgcttctctccccacttcacacaaactactgtggggcagcataagagcctgtgccaagccgagaggcatgggcaagccgaagctcagagaggacaggtcattccagactggagtaatctagagtgcttcttggaggccaagagcctcagctaagctaatgggtagagtgtggacattcagggaaaggtgaggccacacaagaatgaggacggcagcagccctgagcaaggcagggtgggagctgcatgggtcacaggacgccaggcagagggacgagctgcccagggcaggcaggctgcctccgcagcgggatgggccctggtgtcccactcagtccaaacagctgatacggttttcagtggccaccacagagagtagataggccacagatttcgcacttttatagccctgctttattttgttactgtcatcctgctgacacactttcgggtctgttagatgcacccacccaattccttttctgttttccagctatgtctccaatgggtctgtctactttgatacagcgaagtttgcttctagcgagaagcactcctatgggaagctggtgcctgaggccgttggagatcagaaagcccttcaagaaggggaaggtgaggagggcatgcctgagagcatgtgggctctccctcctggcccagcctgggttgtgttgactttgcaggccacgggggctgcgctgagcccacccctcagactcttgggaacagtgctttttcacctgaaggaattttaggagttttctgcactcaacattgtgcagctctaagaccatgacatgtgtttttttaatggatatataataattatgcaatttatggggaacatgtgatgtcttaatacatgcacaccgtgtgtgatgatcggggtagttaggatgctcgtcaccttagacgtttaccttttctttgcattgggaatgttccagatcttctggctatgttgaaatatacaacaaatgttttggtaactatagtcaccctactgtgctagtgaccacaagaacctattctttctgtc

SEQ ID NO: 63825 - DNA, 1049 bp, Homo sapiens
cacattttgctcatcctttcacctgcccgtggacacgtgggttgtttccaccttttggagatgcaagtaatgctgctataaacctgggtgtacaaatatctgtttgggttcctgctttcacttcttttggggatatacacggaagtggaattgctgggtcatgtgatgattctatttttgatattctgcgtaaccaccgtattgtttctgcagtggctgcactattacacattcccacccatagtgcatggggttctgttttctccacatccttgccaaagcttgttattcttcatttttttcatcccagtaggtgtgaggtggtatactgtggttttggtttgcatttccttaatggctagtgatgtggagtgtcttttgctgaactgtgagttgttttgtgttgtctctaggtggacatttgcaagtttctttaggccatatacctgcaagtggaatcgctgggttgtgtaggatatatgtgagtgactgtcgggggttcccaacactgcccacacattctggggccctagaaggactcatgagactcggcatcgagttatcatcttgtctaaggtttgtagcagtgacacagcgaggagcagaagctcaggcggagtcttcaatcatccatgggcaggctgctgaagcttcctccctgcctcccatgaggggacacagcacactctcccccaccaggaaaaaaatgcagccacatgtgtgaaatgtccctccctagggaagcccatcacataggcaccctctgcctggcacgtgccgcaattcctgactccccaggaggaaagctggtgttccacctgcataagccacagtgtttgttcaacagcccactgggggctgctgccacagagctgggtttcccggcctcttagcacaggggacatttcagctcctggatgccagctaatggccagctctgtaggcaggcctttctcaggtggcagacacagaccttctaggctcacttttatcttcatagtagccatatcagaaatgtctatatggccaggcacagtggctcacacttg

SEQ ID NO: 63826 - DNA, 1048 bp, Homo sapiens
gatgtgtctgcagcacacctcagaacacactgggtggcctacttttcctcatccccagaacagccctagaaatactgctctcacacccaatttgcattggagaaactgaggcacagagaggttaggtgccctgtccagggtcacacgtgagagggcagaaccaggagctcctgagccgggagcttcagtctctcttagttccttactgcctggccacttgggttgcacacttctctatctctatggggccatgggaaaaaccgttctgttttctacctggaatcacctttatgaatttaggttttgctgagcagtatctaatagatttgacgtctctttatggttgcagccattttcagtaaaattaaatgagaccacggatcccgataaaaagcagatgctcgaacggattcagcacgcagtgcagcttgccacagagccacttgagaaagctgtgcagtccagactcacgggagaggaagtcaacagctgtgtggaggtgaggcttcacacatctcccagacagcccgttcgggtcaaatgtcgggccgtgcatagactgatctgtgtgcacggattgattccacagattgtcttagtggaagacactctgtgtctccagtagctccactgtggcaggcggccctgttctgcggtggctgagtcagtgcccctcccctcccacacccctttgccccatttcctgggtgcagagcctgtgccactggaaggagactcgggatccacaccctcccaccacttccatcagataggcaggaggtgcacttggaacgtggggaggcagccttctgtcgaagtgttccaagattctccagcggactctccccacaccagctggagaaggaggagcagggattaacattgaattgagcattgaggcctgtgggtacctactgagcttggggccttcacgttgaccagctctcctgcccctgccaatatctccttcagacacagggcagagacctgggtgcagaggggaccctgccctcttcctcaggcctttccctgtggctggcgccctgga

SEQ ID NO: 63827 - DNA, 1024 bp, Homo sapiens
gtgtaaaagaagatagaactttcgcataagtaaataatgtaggcttgagctagcttgtgttttcacctgataaacatcattttaatcccctcagtgagttaatattaccacttctgctactgatatgatcatttctatgatgttcagacacggttagaaacctgcatgttgctcaggggtcggtagccctgggtgttttgcagaaggaaggcctcccacagcacgcacttcgacatgtggcttgcaggggaagctggggcccccagggctcatttcattaagcgtcagaaagatcatgttaggccttgggcactacttggcaggtgggagatggagggtggtgtttctatttgatgatggtgtgcacgtccggggcccacagttgtctcccaccaccctcaccctcacttagagttggccaagggagagagtggcctgctgcagagggatgcatgtgggatccaagcatcactccccaatgtctgccttccctccccagatcatcaagagggcccggcagaaccacctgttcgagcagtatcgggagaagaggcctgaagcggcacagctcttggaggatgttcaggccgccctgaaggtgggcctcttgctgtctgctctagaaaccgagccctttgctttctgttctcggtcctttgtaggctactgtccctagggtagtgtcagtctcacaggctttcacaaagtgtatgttactcaagccagttccgtcaggggcgctgaagtctccataggtaaggtcccctggcctgtgacaaagtcaccagcaaagatgtactggagtggagtggagagtaggtgacattcctgccacttacaggaaaacaactgaattcatcacagtgccactaattacacttataaaaatgcttaccaatattgctgtctaattttcaatgccaaggttacaactaaatcagaaacttctgcccaagatacaaaagctatactaagctttttaatttggtaatactgtaaattttcagaatcttttgaagaaatt

SEQ ID NO: 63828 - DNA, 1065 bp, Homo sapiens
ccagagcagcaccacgattcaggggtcctggcctccaagccgcgctcccccaacagggactgaccctggccaagtgttgtctgcctcagtttcttcatccgtaaaaagaaaatgacataacctacgtcctagagtgtactgcatattgaatatttagctcagggcctggcacatggtaggtactcagtaaatattagctgtgttattgttaaataagcagcatttcaacaatcaataaaatcattgattccctttatcgcctccctccatagatgagtagaaccccagggaggaagaggccccacccacccagggctcagttggtgggaggtgccgtacatctcactgggctcccactgagactgtgacttttcacagtaaaacaaaatggtctctgttgaattgtttacactaaacacaaaccacactgtgatgtttgttgctgtttttggtaatcctgtgcagtgtttcttgcatttcttgtgatcgtcattccttcattcctaacaaaggaagtgttcatacctcaagatgggaaaaaggtgacgtggtattgctgtgggccaaccgtctatgacgcatctcacatggggcacgccaggtaggtccaccgcggggtgtccctgcagcttctgcagttgcacgcagaagtcagagccattgggatccacagcagcgatcttaggtccacaaagatcttagatctgctacagagacctgagatttgaggaatcaagactgaatttcttctcttatttttaagatgaaaattttaatgccataagtaatctatattcactgcagaaagactacagatcaccaaaaagaaaatgtccatagccccactgctaacatgctggactcgacctgggcactttttctcacataccttaaagttttctctcatccctcaagctctcgtggggtccccagatgctgagttcccgtgacactcagacctgacaggcctgacgctgggttggctgtgaccgccccccgaccactggatggtcatggctgtagctcctgacgagtagctggctgttggggtaaatgccacagagt

SEQ ID NO: 63829 - DNA, 3286 bp, Homo sapiens
gtggggttctcctacccctcatcccccagcacccagagggagagggtgccgctgcggcaaagaggcttgaagttggtttggtttgggggatttctgttgtgagtttttaaaaattgaggttaaattctcgtaacatacttagctgacaggagggataccatgatcatgtaggtagctttcccaaggcgaggcttatccgttatactccagatgtgctgacccctatgatttccccaaatgtcagaaactgaactgtgtaatttgtgatggtgtggaactgtgttcctgctttccctgatagaaaacataaattaaaaatgtaaaaactaagtaatttatatgacataaagtgaaaagtacacaattctgtggtatttggcgcatgatgttgtcatgcagccttcatttctgtctagttccaaagcattttcatcacccaagagggaacccatccatacctgtcaggcagtcactccctcgcccccagtcgaagcgctgcccctgtgcctttgcctgttctggatgtttggcgtccagggaagggcttgaacacctttttccttggttctgtgccatcccctagtccctgtctttctggcggcctctgggctgcccgcctgcctgcctgacaccatgtgccctctgtctttgcagctcctgactacaggtccattctgagcattagtgacgaggcagccagggcacaagccctgaacgagcacctcagcacgcgtagctatgtccaggggtactcactgtcccaggcagacgtggacgcgttcaggcagctctcggccccgcccgctgacccccagctcttccacgtggctcggtggttcaggcacatagaagcgctcctgggtagcccctgtggcaaaggccagccctgcaggctccaagcaagtgagtaacagagtgggttccctggccattagaacctctctcccaaggtcaagggctttctccatcaccctggtgcttacctggcgtctgcggataccccagagggagcctcgcccaagtgtgtctcgagcaagtggcctggatgggcagatgcagcgcttgctggatggaggttgggataaaatcacgccctatggagttggttattcaggagcagtatgttcacatcactggtgtggcaggattgcctgaggtggtggggtgcagagccgctgcggctctggggttccacgtagcatgcccaggccacgggccctagccttgtgatttttagctaaggctgtgcctggctctggttgactcagttctttctctttatttcttccataagattgtagcgtgtctatcctccagctttagaattgttgaatcctaaagtattaattggcattgaacttttttttttttttttttttgagatggagtctcgctctatcgcccaggctggagtgcagtggtgcgatctccactcactgcaagctccacctcccgggttcatgccattctcctgcctcagcctcccgagtagctgggactgtaggcgcccaccaccatgcctggctaattttttgtatttttagtagagacggggtttcaccgtgttagccaggatggtctcgatctcccgacctcgtgatccacccgcctcggcctcccaaagtgctgggattacaagtgtgaaccaccgcgcccggccggcattgaactttttaaaaatcagaaataagtcattttttctctttgagatgatgtctgtcccgtagctccagcctgttggtgctggttgtgtctgtggaacgtgcctgtggttatttgcgggagatactcctgggatgcctgcatggctttgtcactctgtggcaaatctgagggggctccatgccatcatcactgaagtatgcctttgggtggcccagctcctcctgtggctgtgggcactcctccaccttcatgtgggggcaggtttagtgctgttttctggtggtcctggctgtagctggcagccttctgggggcttctccagactccgttggggcctgggattgggaacatgcccccccgcctctgccgtgggtcaggcctctgctagatcactgttttaaccaggctggaggtggggatgtcacatctcctgtgggtcgtgttttctggataactctgcagcagacactccttccccagcgtagggcagaggccgttgctgtgcaggtcacgtccttccccatgtagccgttcctgcctgagcctccagcgcggtcacccaagtgacacctgtgctgtgaggtgccttctctccaagggctcgggtgtcaggttgttccccctgccatgtgccattccaagacacagccagaggggggcaggattagggagggtgaagcgggcctggtacgtccagctcagcagtggcctgtccaggcttccctcatagggacttgttgaaagagcggcacagacgcaagcctccatccacactgtgagaggaaggaagggttttgctcttgcaaacactttttaacctacagagaggaagcagagccacgttgctgtgtaacagaatggaccatggatagcactaatggagttgctgtgccctccccaggttccaaatcccctcatcacccaggctgcgcaagaggctgccagggtctgcttgtgccaggaatgatgggcattatgtcaggcgaccctcactcaagcttgctgtacactgagcaggggctgaagggggaggtgggagctggagtctgggactgctagagcatccagtgacctcgagtgggtccaaggcgccatggagtccagtgtagtgtcctcgcccatgtccctgggatgacagtagctgtggatctccctccatgtagctgtgacaatcagagctgcttcccccactgagtgggaacgccctctctttccatggctcatactccccaagcatgcaccttccttgctggcacagtgggccatgtgcccctcctcctgctcgcccttccacctctgttggacatcccagcagcatcagatgtgcctgtgtctggccctcagtgtgcccgcctgttaccagctcctcccatgtgccttctgtgtcctgtctccaagatcctctcagacatggaaagactctgcttggcccggcgcggtggctcactcctgtaatcccagcactttgggaggccaaggcgggcggatcacgaggtcaggagattgagaccatgctcgctaagtcggtgacaacctgtctctactaaaaatacaaaaaattagccgggcgtgatggcgggtgcctatagtcccagctactcgggaggctgaggcaggagaa

SEQ ID NO: 63830 - DNA, 1778 bp, Homo sapiens
gggtggcaatattgctgtctgatcaccccacaggctcattgtgagggatgttggatgcccctaataatgaataacctccctcccagtaaggaggaagatggagatgctgttcttgggggtgagagaggatgcctgggggccacctttgtgaacgagttgcagctggacctccggggctggtgatcaggacggggagtgggaggggaagccctcacctgtgggaggaggcgctggtctctgggagtgggcagtgttggctcctagttggtgagagcaggggtgcatgcccctctctcctccccacgattcatgtctgggggctttttccggtcccctttctgaacacttcttgggcagggagtggatcactgggaaggacccaagaggagcagctgtagagggtgggaccaggggaacatttgcagaaagggagtaacctgcagggtgagatgttgcctggacacccacaagatgaggaccctggtgggacctttgaagtagcagggtcagagggcaaagggtcagggtgagtgaggggtgcagacccccaccaaaccggggcacttattaggagctcagacctgctgtaaaggggtctgcattttagcaagctttccacccatggggaagctggtttaaacctcacttgctgggcccaccccagagattctgatttggcaggtctctggtgagcccaagaatgtgacttctctggatcccccaggttctgctgctgaaggcacaccagggccatgcctggagtggacctgggagagcctcaagggaacgcaggaagagaaacagggcagccgggagaggtttaaatgcttacaggaggccaggcatggtggctcacgtctgtaatcccagcactttgggaggccgaggtgggtggatcacctgaggtcaggagttctagaccagcctggccaatatgtagaaaccccgtctctactaaaaatacaaaaattagctgggcatggtggcgggcacctgtaatcccagctactcgggaggctgaggcaggagaatcgcttgaacccgggaggcagagtttgcagtgagccgagatcatgccactgcactccagcctgggtgacgagcgagactccgtctcaaaaaataaaataaaataaaataaaataaaaataaataaaaaataaatgctgataggaaagagccagagagagggagaggtcgcactgccacagttgtttgacgtgtcagggttgttgttcatttggtgtggctttgttttggtatctgtgctgagcaattgcttggtacttgcatgtgatttcaataaatgttctgtagagactccacctttgtagccggtgacaaccaccatccacctttgggacattcccatgtccctcaatgtgttgatgaactgaactgcaaggtcatccggtggtggacattccttctcatgggggcagagcaggagtttcggcacggagcgtgcaggctctacgatgagggccagtgtcgaggaacaggtccctgggaggttttcagtctgctcagaagtgttctcatctgatctcagcatcagactgatccacagcctggctcaaacccatgaccacttgaaagctgacctatttttatttgtttcctcgagacacacttaaatgcagctaccacgattacccaaatgactgtctgcgtccatctcatggaagcctgtcattctcctgtgcttccctgggcaccagcacctttctgctctgagaagatccttcccaagcatggtcttggttcccttttgatga

SEQ ID NO: 63831 - DNA, 1147 bp, Homo sapiens
gcaggggcaggtgggagcctggacggaagctcagcctccagtttggaggccagcccacatggtcctaatgtcctgagggctcaaggaccacagaactggaggccaagctggcacatctggggccaaggggataccccaccagcatcctgggccatcaggccatatacctgctgccacagcagctactagagtggggacgagctgggcccagtttccatggagacctcagatgaggccacatttcccggactcctcgagaaggggctaataaggaggaatctagagccactccaatcccctggatgctgagagcaggctctctgggaagaagtgagcattctaagggtccgcaatctctctgaacccttatgcagcaaaggggtctgcgtggggatggggccagggttgggggagccagtgtggggctgaggacacctgagccagccctggtccagtgaggcggagcgtgtggcgtgggagggtggtgctgggagtcaccttctggctttgcagctttcctgtggtcctgaacggccacatagcccctcggagccttggtggctcatctgcagagtgggagcaccttcctacattattacgaggattccccgggaacacgtccacggtgaggtcatgtccgtgagatgaatctgtgcttttcctcctggttcttccttgttctgggggaagtttatgtcctggggctgaaagtggaatttgtggacaggccacttccctttctgttcttgtttctccagctgaggaactgaagttgctaatcacgtcctggaggtggggagagagggccctgtgcagatcctgggctggagataatttgggaggaggtaagtccccaagtgggggctggaggtgctctaggagaggtgggtccagcccctggggctcccagtctcaagggatacctggacccaggcctgctgggcacgtgcgggagcctgaggtgaacgcactgtgtgggctgggaggggcccggtgcagccggattccagggtgctgaccagggatctgcgactcacacccagactcaagaggggctggttcagtcatggtccagagggaatgtccttccatcaccagccatggaggccggagtcagaaatcaaagaaaacactctcagatgccttg

SEQ ID NO: 63832 - DNA, 1057 bp, Homo sapiens
tggacaactcaaaaaaaggccctcacctttgccctcacagattctgcctattggtttgggtggaagcaccagtgctgtttaagtcacatgcatcatgggattctaaggtgtggccagaatcagtgatggggggtttcagatgcatttgtacgagttgagctcagccttggttccaaagggaggtcacagggccttctttgcctaggtttcagaggccagctcagtgcagcttatactccaattgctgaagcagaattgctgttgtttagcaggagagggaacctgagagcaggaagagagaaagtcacattttgatctccatgtagaagtttactgttcctgaatctcttttataaagaacagaaaagcgtggactttttctgtatttcttggtctttctgttgatggttgtggtggtagcaggtgaaggggttgtgctaacacctttaaaggcatattctcacgatgcaggtgtgatttgtccagagaatctttcctaagaggaaatcccagagaagcaggagaaagagaaagaaatggctggtgctcaggtaaatgcatctcaggtcaggggttgtgtccacttttgctcctgaaatgtcatgtgtttagaatttggaaacctttacttctctacttgtggtgtttctccatagtaagtttgtttcaactacttttttttcttataataatgaagggtctctgaaaatatttgttttctatataccaaagccgtctctctgttatcttcaccttgacttcttatatgccatgaagaattcttaccatgactttatgacctgcagtattaaaaagttcacttcgtggcactgaacttgtggatacccaggattcctcttgaggatggggtgggtttttggatatcagcaaagaagggaaatgtgcactctttaggtttcatctggatgctccataagctgcatgcagaacaggactaagaaaataaacatttaaaccagatgacatttatctctcagaataactcaaagcattctggaaaagagaaaaatgaaaagacacttgctttttagaatgc

SEQ ID NO: 63833 - DNA, 1052 bp, Homo sapiens
taggttccttcaggattgagattcttccccagcatgctgccacttgtggagagacctccccacctcacccagcttctccctcctcatcatcatcttcgtcccagtctgtactgtgggtgtcctccccagaaagttcaccccctgtctcctgggttccgtgccctatctgccagttgcggttctcagcaagagaagtagaagagcatgccagcatatgtggggacttccctcaggcgtgagccatgaggtcctgtggttttgccccaccctctgtgacagactgggactgaatcgcttgacagctgagaagagccgctgaggccaaagctccctctctcctcctctccactcattccctcaggactctgcctgagggcacctctgtgcctagcctgatccccattcccagttgtcaaggcttctgtgaccatggcacctgattctcctaaggccagctctgttcttttcccccttggaagtctccttggaacttttgggccttgggacaccatccagaatgtctttccctctgtgagtggtgcacattctcatgcccattttcctgaaaggaaaaccgaggcccagtgaagagcaaacgctgcctgacagataaaatcctgtggtgtgctgggaatgtgcgtgtggattttgagcacgaggctgacatccagcaacccatgaaccgagctctcagtctcctttgtgggctcctgtcctgggcataatcaggtaatggtgatgtgtgtgacactaagcaagttatttattttagcatccagaattaactgagagaaaaaaatctcccatcctcccgctcacagagctatgatagggaccagatgggttaatgactaaggagtagttactaggcttgactgtggaaccttgggcatatcccattccttatctacacaaggaggtgattggaccagaaggtgtcaaagattccctcaagctgtgatattccaaattctgttcccaccttctttgagcaaatatgtcttctcttccctttcccagaagatttcactgtgtggcactaacaccggttc

SEQ ID NO: 63834 - DNA, 1026 bp, Homo sapiens
tatgttgcccaggttgcctaaaattttttaagccagtcaaatttagcagtggggggactgtacatcaactttagtgacactggtgttaataagttctgataacccattaccattggaccagctcctccctaaacttgatcttcatctctgttgcccgtggcagttttgtgtatcagtctgtccagctcactctgccaatctctccaccttgtatctgcatgtccccacttttgctcctgtgctcctaaatacctctttttttctctctctctcccccaacctctctgcctgttttccctgcagccatgggtcagagccccctctctgcagtctggtctttgctgctgctgctctggttcctcgtggtgagggcctttccagatggtccaggcctcctttgatgcatgagacacgggacagcctcgcctgctgcctctgcccatcctgaggatgttggccatgtgtgctttcagtgtaaccaagattcctgtcaatcccatctgcagggaactctgggaccttctctggtagctgccagaccggctggtggagaaacaggagacaatctggggactgaaccttacccagggctgtaggagtgagactctgaataaagggttgggccggcggtgtggcaggtacttcaagacaggcagcaactaacctggcgatagaagggcttcagctgatttgggggatgactggagaggaaagcgcttggccgtcatacctgctagtgttactcagatgcctcacgtgtccatctggaaagcttctgttcactcctccaggaagccttctgtgacctctcccacctggctggggtagtgaccctgtctctacgctcccacagagacctggatgcttccctataccaccacatgtccatgtctgtctgccacatcagaccatgagcttcctgagggaagggactgggtcggaggcacagagatggtgccaggaaacgtgtgaaactcagaaaggaacaaatacctgtgaatggctggtccctgcactgcccctgcc

SEQ ID NO: 63835 - DNA, 1174 bp, Homo sapiens
cggcttcccatgcctgaggactatgccatggacgaactgcgcagccttacccagtcctatctgcgagaactggctgttgggagcctgtgagccccaggcactttgcatcacagtcacatgcccattcacaccacacagaggttccctgccttgtttggattggcactgtttgccattctctgggttggctgtggcatctaccctccctccctgctgccagaagcagcatcctccacttgttcagggcttttcttaatactgaacgtagcataagggcttctggaacccagaagaggagacagtttaccatcctcaagatcattcagtgtttttcctttaaaaaaatggtcaataaagctcctttggcagaatcccccaaagaaccagggtattctttttccatccctagccattctggatcttgtgaccctccatgccaaccagcttccctactcctaccctggcccttttatactaggactccttaggaggagtgagacaggtgataatggatccttaacagatgaactatccacagaaggaagagggatccgtctcttaagtaattggttagttaacactgaattttggaggcaaaggagggttggcctgagttaggaaacaaaatgggatctttctgacacacttagggcagaagtgaatgcctgtcacggagggattgatcttcagggctgtttttgttcctgcctttagagttccatgaacaccatacctttgctactactatgtgcaggaacccttggtcacatgtgacatgtctgtgggaagctcccagagtttggtttggtccctggttttcagtcttgctgagactctgtctggatttgcctgcagagtttggataaaaaatggcaggttgggtaaccctccctgttcatcccatgttagctccaaagcatttcccaccctccatctaccccttccagaagcaaaaacaaaccatgactgaggcaggcatggagttgggcgttaggggcaggcagagggcctttgctacactgctgacagctatagggagccccaggtaatggcatgagatagctggtgttagggctatctcaggcaatatggccacacctgggtctttatgcatgaagataatgtaaaggtttttattaaaaaatatatatatgtataaataaatgatctagat

SEQ ID NO: 63836 - DNA, 1024 bp, Homo sapiens
accagtgcatacttgtaagtggcttaaatgataaacagtacttttgtagattgatttttatagacagaatttgatcaaagtagatatcatctgagatgacactagccataattaggcttggggaacctgtttaacggttacatttgttatgtaagtaccacagaaacatgatatgagcaagcatttatttatactatgtacttctggaaattgtaagacgaagttgagtgaggtagagacagattcagggtaatcagcttgagtggttgtttgagatgtctattaatttatgtatttttaacatcacagttagaaggatgccctctgtgaagttgttgtaagactttgtctcgtaacattgtttttctcttcctgccttagttgtgaagcactggagcctgacatggacactatgtgaagccctatggggccacctgaaggagcttgacagccagctaaatgaaccccgtgaatacattcaaattctggagcgaagaagagctttctcccgctggctatcctgtactgccacacctcagattgaagaggaagtctccttaacccaaaaaaacagccctgtggaggctgtattcagctacctcacaggcaaaaggatcagtgaggcctgctctctggcccagcagtcaggtggggaaggcatatggtccttctctgcgcctctgtcgccttcctactcactgcctcctaccgctccccgctaattgtgcatttccctttggcttctagcctatgagtattaattgcggacttcccagaaagattgctggttcccgtggaatatgtaatataacataaaatttaacttttaatcaagtaaacaatgtttaaggtcctaaacagagaattagaagacatagtgcggctgggctcagtggctcatgcctgtaattccagcactgtgggaggccaaggtgggtagatcacacccacctattcctatagaataggaaccatgacttttttttttttttttttttttttttgagacagtttcactcttgtt

SEQ ID NO: 63837 - DNA, 1050 bp, Homo sapiens
tactcgggaggctgaggcagagaattgcttgaacccaggaggcagaggttgcagtgagccaagatcatgccactgcactctagcctgggctacagggcgagactctgtctccaaaaaaaaaaaaaaaaagtttttgaagagtgaaatgaaataacatatacaaatgacttatacagagcctgctgcatatttttaaataatattaatagtgttgttgcttttattattgttgtagatatcatcatcatcattagaatcttgtcctgatttcctagttcaaagagtaatttctgcaaaatctgacttagcctgcttctggtcatccacatctgatataagtagtttgattaaacattgaatgatttcagccttactgatttttgttattgttcaagaaacaatagcttgtgttttgtaatagtctttctccccttcattcccgcttcatttcagttggtgggttactacaatcaaaatttacaagtggagcttttctttcaccaagtgtctctgtgcaagaatgtcgtactcccagagcagcatctttaatgaatatcccatccacatcctcttggtctgtccctccacccctgacttctgtgttcacaatgcccagcccagcccctgaggttccgttgaaaacagtgggtacacgtaggcaactaggcctagtccctcgtgaaaagtctgtcacctatggcaagggaaaactcttgatggacatggccctattcatgggacgctcatttcgtgttggttggggccccaactggactcttgctaatagtggagaacagctgaatggctctcatgaactagaaaatcatcagattgccgattccatggagtttggattcctgcccaatccagtagctgttaaaccgtgagtcacatttcttgatgctttttgagaaaggcaacatgataggtgaaaaaaactaatcaggaggatagggccctgctttgtcatctttctagagagagagagagagagagagagagagagagagagagagagagagagagagagagtgtgtgtgtgtgtgtgtg

SEQ ID NO: 63838 - DNA, 1724 bp, Homo sapiens
cctgggtgtcattaccagggctttttcctccttcaggattttttttttttttttgagacagagtctcattctgttgcccatgctggaatgcagtggcccagtcttggctcactacaacctccattgcctcccgagtagctgggattataggcatgtgcctgtaatcccaggcacatgccactacatcggctaatttttatatttttagtagagacagtttcaccaccatgttggccagactagtcttgaactcctgacctcaagtgatctgcccacctcggcctcccaaagtgctgagattacaagcttgagccatcaaacccagtctagaattttttttggtttgaaaatatttcaaatattggcttagtcatttgctaacattttaggatataggtaattgaatttgtactgtaccaattaatttacagtgtgtttcagctttgagtgtttacccttttaaatcatagactgttagtcatagttgtctttaaaactgcttaataaatgtaaatataactcttgacatttttaaacataaagggattcttcccagattaaaattgttcctaatattattactttgttttttggaagagtagatagtgctcgtatcttacgtggtactgcacaagtagagaccagctaaccttaggattcagtaacccaaaagttaaattccagacccaagattgtgttgactagaaatttatttctaaatgtttttaagaaaaagcaaagttactggagactttgatatttgtaccttttgttctttttttccaatgtcttctggcagtgttaggaaaaggtgaccctgtgtaaatcagaaaattgtagttgctagctagatcaagtaaagcataatctttgtctctgaagaccaccatttgtttcaccatgggtgctggtttaggtcccagacaccaggtcgtaatattagaatgggatgactacatgaatccttatttggatcaaagtactggtttatcttggggtaattgattttaaatcactctagcaaatctgctaccttacctcaccatagaatgggctgaatctaataattgttgtatcatattctgaataaagtaaatctgatttagaatctatttctgtttggtataatttaatgctgctttcctgatctttctgctgtctacagagccagagcccagaggtggagcagttagggagggttgtggaactggacagtgacatggtagatatcacccaggagccagttttggataccatgttagaagagagcatgcctgaggatcaggaacctgtgtctgcctcaacacatattgcatcttcactgggaattaatccacatgtcttacaggtgaagttctaacccaccttttttgtaacagaaagccaaactaatattttatctccattgcataggatcaggtctcttccttggttattaagatcattgagtgctcactgtaatggggaaaaaaaatacaagaatatggccaatgtctgggcctcattctcttattcaaggagataaggctatattgagaactagtagatagggtttctggttttaactgcattagaatccagagtcctagttccaatcccaattttgttgtgttttgtttttgaggcagagtttctttgctctgtcgcccaggctggagtggagtggtgtgatcttggttcactgcaacctccacctcctgggttcaagtgattcccctgcccca

SEQ ID NO: 63839 - DNA, 1051 bp, Homo sapiens
taacttaagatttgctcatgtgggttcatgcacagtaaattctgcctttattgactacctgatgtgcagtttaatctttttctttacctccatggttttttaaaagttaaattagctttctgaaagggtttttaatctccatttttttaaagttgtttgcttatacttcgggtaaccttgatatttgtattttaatagtacataatctttatgaaaaatagtttgggaatgtaaatgaattattatttggcttggggagattagggcctacattgtttatcgcaattacttgtatcattgatacgggatttctttgtaaagcatcctctacctctcagctgctgaaagctagacctttggtattttccatgctataattcttatggctgctgaaatgtgtggtttttatgatttattaaataatctcttaggaggcatttctggagaatgtgtgtatatacatgtttgcgcgtacaggggaggggagggtatgataaatgtgggaaactggaaatatattgacttttatgtttataatcttggtagcatttagaatgcccctaagaaatctccattgacaaatgaaatgctatagacttggttttccagttatccatattcattttgtctgtcatatgctttgtatcatctccttctttcctaattttttataaccttatatatatatttattataaatatatgtatttctgagggaaagagtcagatggccttattttctgtaacaaaagtaatatgtaggatcttaaagataacctctttccagttggcccagctgaaaaagaaaagcttcatttatggacagacaggaaaatgtttgtaatgttgacagtagtttctaggttctttaattgccagaatagaaatagtagaaaaataactataaactcctatattgacacttgtgtttgtgagagctctttgaaaaattgagcacccaaaaatttcagatcaaggttctagcaaaaagaggtagtaaggatttaaaatgggcaagtagctttttttttccttgagaaagagttgtcgcc

SEQ ID NO: 63840 - DNA, 1055 bp, Homo sapiens
gtatatatacaaaattgaaagcaggatctcaagcatttgtatacccatgttcatagcaacactattcacaacagccagtaggtaaaagtcacccaaatgttcattgataagtgaatgggtacacaaaatgtggtatatacatgcaataaaacactattcagcctacagagaagattagcatggtccctcacaaggataacacacaaatacatgaagcattccatattttttattttaaaaattaaaaaatatatgttattcagcctcaggaagaaaattctgatatatgctataacatggatgaaccttgaggacatgctaagtgaagtaagccagtcacaaaaagacaagtactatattgtgatgtatctgggataagtcaactttatagaaacaaagtagagtagtatttgccaggggctccgggaagcaggaaatggagagcagcatctacctattacatcctagtagtcactgtgtttagatgtaaggcatacaaaatgaataggatacaacacttgaactctggtattaatattagaagtggtacaccaccactcttgtagtcatcttcataccgatattcctgatacttcattttctaagcatttgtttttagtaaatgggtagtagctgttttttattattatttagtacggtagccctttaagacctgcataagacttggttcgtaccactggactgtaacttaaataagttagtgattcctagcttaagtgtgaaaatgagattggaaataattgatgtaccatggtaatttaaataaatgcagtctgactctagaaccagatattgagttgtcaatgtaggagtgactccttgctcttaagcttatggggcaaaactcaagtttatgacacatgcagaataattccaaggcagcatagttaccattattcactatttatgtgttaggtggctttctggtcttatatatgaagcgcttttactttaattggttactttaattggttatgttttacaggaaggctgaagttacattggatggagtttggccaacagataaaacatct

SEQ ID NO: 63841 - DNA, 1045 bp, Homo sapiens
ctagcgctttgggaggctgaggtgagaggatcacttgagctcaggagttctagaccagcctgggcaacatagtgagacctcacctttaccaaaagtaaagaaaatgagccaggcctgatgatatgtgcttgtagtctcagctacttgggagggtgaggtgggaggattgtttcagtttaggaggttcaggctgcagtgagacaggaccactgcacttcagtctggtcaacagaacaagaccttgccaaaaaaaaaaagaaaagaaaagaaaagaaaaatgcagattttaaatcagataacagtgtaattgaagttactctccctaagtccccattcttaccagtctaggaattgctgaattatttaaaatactaatacttaaaactgctttctccttgtgattgtttaatcactatagttgtaaagtaggtatttgccttcatacagaatgaatttttaactatttgctctgatttataggttatggttcaatctattttgaaggagatgtgaatttgacaaatctaaatttggatgatattgtgcatatccggaggaaagaagtagttgtctacttagatgataaccaaaaaccacctgtgggtgaagggctaaataggtaagagtttatgtacatacagaaaattatcagctaaatcacaatttttttttctgtaaacataaatgtgtttagatgtatgcttctgtagcttgctttccttactatagagtacatttattgtctctactttgatttaaaagtataaatggcaaagaaatgctatactgtgattttgaactccttttccctgattttattttttaattcatttttttacattccttggattcgattctattctattttatttcatttcatttcattttactattattattttttttttttgagatggagttttgctcttgttgcccaggctggagcgcagtggaatgatgtcagttcactgcaacctccgactcccgggttcaagcgattctcctgcctcagcctcccaagtagctgggattgtaggcgcccgcc

SEQ ID NO: 63842 - DNA, 1051 bp, Homo sapiens
tatttgataacaggattttttacttcaatactttcttgtcatgtttttaaaaaattctctctctttgggcaaaccaaagaaagtaaaaagaaaaaactttttagtcagcaaatgtctgtttacctttttcattcaagacagcactatgagttctatggtgagacagccatacgtttgtactgccaaaagagagagaaagcatttggagagtatacagatgattgaaatacaaacatagtgtgatgagtgaacgaagtgtctggataaagtgctcagagctgggaggaggacagttttcaaggggattttccactttgacttgaaggtgttcagctttattcttccaaacaccatagtacaatgtatttgacaccttgtgttttggctatacaatcctaggaagcgtttataaatgaaacttgttaggttattcttaggtgtacaagagttgagcagaagtgcaccattggactccagtttttaagataatgtctgggacatatctgtatgcctgagtaatttttttcttcttcttttggtttcttgtttataggaagagcattaagaagttggttttgaagaaccttaataatagcaatctcttttctcctgttaatcgtgattcagaaaatctagcttcaccatctgaatatccagaaaatggagagaggtacactgaattctgttttgagttcttcttagtagagagttatagtctcatttttaagacattcttaggaatttatgaaaatttatgaagtttgatgaatattacatagaagtattacaagcttatgagcgcctagaaatcaaatcatatttttgtcttttgaattcattaaaccttaaaattattggagttctgatttagtgcttcagaactattttggtatttgtgtatcttgttttggacagggttagcatgtatttgacaccctttagccctttaagggatattttgtctgtgatgattttctttcttttttttttttgagacagagtctcactctgtcgcccaggctggagtgcagtggcatgagccaagatcgcc

SEQ ID NO: 63843 - DNA, 1031 bp, Homo sapiens
aaatgctccaaaatccaaaactttgcactgacatgacattcaaaagaaatgctcattgggacattttggattttggattttcacatttgggatactcaactggtaagtataatgcaaatatttcaaaatacaaaaaaatccaaaatacttctggacccaagcattttggatgagggatactcaacatgtacaaagttgggtgttaacatccttgttttatgggaacagagacttcaacaggtatctagcaggtgaatgacaaagatgaggattgaaatctggtcttgtgatttttaaggccagtgcagtacatttaaagtaaaccaaaaatttccttgatgcttttgtttttcagagattgaaaccaacaaatccagcagcccagaaggctcttactacacctactcattataaactgacaccccgccctgccactagagtccggccaaaggctttacaaacaacaggcacagccaagtcacatctctttgatgggctggatgacgatgaaccatccctagccaatggagcattcatgcccaagtgagtttatttttgttaacagaaattaagtgtaaaatactgatataaactaaatatgaaataatatacaattatttaaatatattatagatgtgatacagtccactttgtttttgtttttgtttttgagacagagtcttactctgtcacccaggctggagtgcaatggcatgatctttgctcactgcaacctttgcctcccaggttcaaacgattctcttgcttcagcctcctgagtagctgggattacaggcgtgtgccatcacgcccagctaattttgtatttttagtagaaatggggtttcacaatgttggccaggctggtcttgaacccctgactgcatatgatctgccgcctggcctcccaaagtgctgggattacaggtgtgagccgctgtgcccagccagtccacttttttataatttgaaaaatacagaacatcacaaagaagaataaaagtcacccgatcactcccagggataactca

SEQ ID NO: 63844 - DNA, 1058 bp, Homo sapiens
atattatttcctttggacaattacatacacgcacgcacacacacacacacagtatttgccctgtatactgtcatattatttcctttagacaattacacacacacacacacacacacacacacacacacacacacactacttgccctgtatactgtcgtattatttcctttagacaaaccagtctataatgtttctagaagtcaaagactatggctttttatgcagctatttcagtgataggtatgcataaaatatttcatcagggttgtttaaattttcctttctttgattagtagtgacagtgaacactgtgtaagtgaatttatatgagtattgtatcttatgaaatgtctcttcctaaatttgacctattagcttatttgattcttgattttctttacagtttgctctacacacattctgccccaatgataccattgatctgagcattttgaagaccacttcttcaaaaagaataccgagctctgtgttacaaatgcattgtatccttgcatttatatatatatatatattttgttttctttttttttttttaaaagctttgacagatccaaatgcttctgctgcccagcaggctgttctccagcagcacatcaatagtctaacatactcaccttttggagactctcctctcttccggaatccgatgtcagaccctaagaagaaggaagaggtaaatttaaggatacttctgtaaaatatcatatcaaagaaagagaaactgaatgtgcagaatgtaattttttgcctgtatatattaagggattaagcaaagctaggtgtaattaattttttaagatattatttcactcagccgggagtaaattatttttgctgtatctggaaggtgttgggacagtgaaatgaccactacactgaagatcaatgctgagggttttcaacagtcctgaaataaggcagatattaatgttctcatttttaattaaaacaactttttttaagtttttttcttttctttttgagatgatgtcttgctagtatcgaactcctggaaggaatcctcccgcctcggtctc

SEQ ID NO: 63845 - DNA, 1029 bp, Homo sapiens
attgaggaaactgaagcacagagagatttaagtattttacctatgatgtgtataatgtactgagcgcagtacttgacctgcagtaacacttaccgtattcacccctttgttgaaatgagtggtcactatgaagtttccaaatgtattatatttttaagtaactgacctctggcacaacattgaaaggatcttctgtggtgcttttttctttcctcttgtctccgtagctcttggtgctggacaggcatctttgtttgggaacaaccaacctaagattggagggcctcttggtacaggagcctttggggcccctggatttaatactacgacagccactttgggctttggagccccccaggccccagtaggtaagtgtcagtcactttagaaggcttttcttaattttttgctaatacttgctgacctgattttccatcctacacctgtcccattcctaccaaggcattgcatacatgcatgtcattaaacaattgggtagtaaagaagggcttattaatagatcctggcctactctgctttcccagctcctaggcctcctctgtcaaagaaaccacttttgttactatttttaattcatctgatatataatttagttcatatcgctaaatgtgcttatattactgtgttttggtttattaaatctaagtaaatgtaacctgttatggtagatgagaatttagctcatgtatcacctctactttatttacttcttccaatataattatgtttactaaatttactgtatttcctaaatttagttttatctattgaagtgtttttctttattttatttttttgaaaaggagtctcgcgctgttgcccaagctggagtgcagtgatgtgatctcagctcactgcaacctccacctcctgggttcaagtgattcttctgcctcagcttcctgagtagctgggattacaggtgcatgccaccacacccagctaatttttttttttggtatcttgagcagagacagggtttcaccatgttcgccaggctgatctcga

SEQ ID NO: 63846 - DNA, 1303 bp, Homo sapiens
gtaggaaaaaatagctttggtacgggcaaattaaggaaggcttttcttttcttttttttcttttgctcaaattcaaattaaggaaggcttttctttttttgttgttaataatttttgtaattttaatagagatggggtttcaccatgttggccaggctggtcttggacgactgacctcaggtgatctgcctgcctcagcctcccggcataagccactgtgctgggccacaagttttatttttttccaagatggactcttgctctgttgcccaggctggagtgtagtggtgtgatctcggctcactgcaacctctgcctcccaggctcaagcaattcttgtgcctcaacctaatttttgtatttttagtagaaatggggtttcaccattttggccaggctagtctggaactcctgacctcgtgatcctcctgcctcggccttccaaagtactgggattacaggcatgagccactgcgcccagccacaagttttatttttatgtgatcagaattactttggctcctggatcttgtaggttatgattagcaatgtcttcccccatattccaagactctataattctttttctgatgcttttgtctctcattccacaataatgtaatatcctaacattttattttaatatattctgtttttcttcaacagttctctctcacaataaacaaactgcattgtgttgctgttgtatattccttatacatgcctctcctataaactaaaagatgaatacaatcaattaagaattttacacccccaaccttagcagcagcatatcatgtagggaaatgagaattgtgagtcagcaagcacacacactgttgcaattccctgatgatcacatctgctgaagcaggcccttgggtttgggaggaacatttcctgagacttgcatataaacacccacgttcctgaactctgcatttcatggtttaacaggtagactagcactatagcttcaggctgtatttttgggaggcaatagctaagtgggtgtttctctgcagcttcttattttcagtgatggtgattcaaactcaagcctcctgtaatgtgggcgtttgggtacttaatgagtagttgttacacaaatattaaatgtacagatacataagatatttttgtatgcttcgatgtaagaaaccaatcttagtataaaaggttttatactgacccttggcatgtgattttctcccgccccatgtgttgagactaagaaacattcattaactcatggacataacaatttcttgttttatagtgatattaacatcattagcactat

SEQ ID NO: 63847 - DNA, 1096 bp, Homo sapiens
tggagtgcagtggcgcaatctaggctcactgcaacctttgcctcctgggttgaaacgattttcccaccttagcctcccgagtagctgggattacaggcacgcaccgtcatacctggccttttttttttttttttttttttttttttttttttttgtatttttatagagacggggtttcaccatcttggccaggcttgttttgaactcctgacttcaggtgatctgtcagcctcggcctcccaaagtgctgggattacaggcgtgagccaccgcgcatggcctttgaattgatatttcaaggctgaaatgtaattaagtaaatatgaagacttgtttgcatatgtgaaattttttttttaagttatcctacaagttaggagtcctaaatattaactgaaaggttcacaacttaaagtcagactgctttgtgttaaactcccttatagaggaaattgagagttatattaaaagtacaatccactcattcttttgtcttcctaggttttggcacaaataccagtgggaatagtatttttggaagtaaaccagcacctgggactcttggaactgggcttggtgcaggatttggaacaggtaagaaactgctaccatgagatctaggaagtgacacagcttgactttctagtttctggaacttgagagatctgtttgattatgttactggaattaagaagtctaccttttcgtttttccagttgcgtttataagacattcccagcagttatgctttaccaggctttaaaatattggcatgtttgtgttagaagctgtatgctcccttttctacaaaatgtcctctgatagtcctggtctttttgggatttttagtatttaatgtgagaattgtcatgaggacattaactttcagtttccccatgttacttttgtaacagggatttgagaccttaaactgttcatcaaagtaagccctaatagaaaggcagagcaataagagcacatgctgatgtaattctcctttgcaaggagaatttcatttagttccattgtcatatagaccagtgtcaccccttttccctgattcctactgttaacaactatttttcagtgcctttga

SEQ ID NO: 63848 - DNA, 1342 bp, Homo sapiens
tataggcatgagccaccacacccagtcaatattttcaatatatcttataactacctaattatgttttcaaaattcagcatctgtcagatcagatatgggaagtttattctgtttgtcgagggaaatagtggttcaagtatttcttgaggattttgtgtgccagatacatcactaggcactgatagattctttttaggagttgagtacaaagacatggttatttggtgtaggtcagcagttaacagttttttaatgagcttttgaacgatcctgtactggagaaagagatcatattaaacatctattggaagattaatatgtttatcaactacaggaagaaggtagatagttcattgataggtaccaattcctaaattgatgtgtttggtttgatttttataatcccttttagtcattttgctcattcactgccagaaatgattatagttcctataaactctgtttgaaacaaccgttttgaggcagtggacttggttaccatgggtaagatacttggtgtctgtctctctctgtctctgtctctgtctctctgtctctctctgtctctctcccctccctcccaggctggagtgcaatggcacaatcttggctcactgcaacctccacctccctggttggagtgattttcctgtctcggcctcctgagtaggtgggattacaggcgcctgccaccatgcccagctaatttttgtatttaaagtagagatggggtttcaccgtgttggcgaggctggttttgaactcctgacctcaggcgatctgccctcctcggcctcccaaagtgctgggattacaggcgtgagccactgcacccatccctacttatttctttcctataaaattaaaatggaaagatagttaagggtcagttagcgtttctcaaccttttctattatcacttacccttccccatggaccgtttgtagactattttttcatttttaagttgtacctgctgtaatgggactgttttttcttttttctttctttttttttttttgagacggagtctcgctctgtctcccaggcgggagtgcagtggccagatatgggctcactgcaagccctgcctcctgggttcacgccattctcctgcctcagcctcccgagtagctgggactacgggcacccaccaccacccccggctaattttttctttgtatttttagtagagacggggtttctccatgttagccaggatggtctcgatgttgtgacctcatggtctgccggcattggcctcccaaagtgctgggattacaggcgtgagccaccacgcctggcctgttttttcttaatcatcatctcccttcccctgaga

SEQ ID NO: 63849 - DNA, 1045 bp, Homo sapiens
ctatggatttgaccattttgaacacttcatgtaaatggaatcataatatgtggtcttttgtgattgatgtctttcacttagcatagcattttcaaggaacatccatgtagcatgttcaaagtttttcttgtagtgatttcttctggcaaagcaagtatttgctacatttctcttaacaggtaaaaagatatttgatggccttgttatttttttctttgcctcactgaaatctggtttcattggattcattgtgtttcagtcgtaatccttaggggttaccattaacttttcaggccagaagcattccgtgtttataaagttaatcttgcccagattattttttgatagcctttattcatcttttttctaccttttttatgaatgttaggacatctttctcccaccccatacccaacccagtatacctgaggtaacctgtatttagtttggtgtgtgtcttaatattattttaaattttcctgtattctattctttttagaccctgtttggcaataacaagcttactacatttggaagcagcacaaccagtgcaccttcatttggtacaaccagtggcgggctctttggtaacaaaccaaccctgactttaggaaccaatacaaacacttctaattttggtacatataaaaagcaggtttggctctcttaaagttacactgactataccacacgttattctcctgattcgtatgattggaaatatttaaaagttctcaggtaagcggtagcttgatgtgaagtaccagagggaaaggtttaaagtcctggatatggcttgagataattagtaggcatgtaaattgcctttcatttactttggattacttcagcaatagctgagaaaccataaaggaaacacatttggttaagtaacacattgtatgaggccaggtttcaaacctgtggtagcatacagaagataattggttattcttatttttgtcgttgttggtttgttgtgttgttttgtttttgtttttttttttttttttggtggagaacagggtctttatatcgccttagc

SEQ ID NO: 63850 - DNA, 1856 bp, Homo sapiens
agaagtagtgtctctcatactttcagcaatatattccttagcaacaattaaattcatttatgtgtaatttttttttaaactcagctttttggaaaagtaaagtaatccaaggatttgctatttctttattagtttctgtaaagtaattgacagtggctgctaatttttctgaaattttggggggtgaaattttacattaacctatatttgatttctctaataggaccacttgtatattctaaagtttttggttatgtgtaggtatatgttataatgtatgtaaataaaatgtactgtgaccactcttgaagtctgtgacaagatgttttcagaaagacaagttcattcagcatgtagttaaatgagaaagggagaaatgagataaaatttatgatgaaacaaagtatttcttttaagttgtcttccaagtgtgaccttagggctttatggacacttagctgaccaaaggattcagactttgtttcacttgaaagttgtgagcctggaagtacgtatctttctgtatgaatttctatttgggccgggcactgtggctcacacctgtaatcccagcactttgggaggcataggtggatggatcatgaggtcaagagatcgagaccatcctggctaacacagtgaaaccccatctctacttaaaaaaaaaaaatacaaaaaattagccgggtttggtggcgggcacctgtagtcccagctactcaggaggctgaggcaggagaaatggcgtcaacctgggaggtggaggttgcagtgagctgagatcacgccactgcactccagcctgggctacacagcgagactccgtctcaaaaaaaaaaaaaaagaaatttctatttgaatatatttgcttgggagacttgaaaggtgaaaaatttcaggatatgagatcaggtgcagtggctcacacctgtaatcccaacactttaggatttcgaggtaggaggattgcttgagcccaggagtttgagactagcccgagcaacatggcaaaaggcagtctctacaaaaattaaaaaaaaaattagctgggtgtggtggcgcatgcctgtggtcccagctacttgggaggctgaggcaggagtattgcttgagcctgtgaggtcaaggctgcagtgagctgtgattgcaccactgcactccatcctaggagacagagcaagaccctgtctcaaaaaaaaaaaaaaaaaatgaagtactgtgatgctagtgccatagcccaattccaatgcatcttatacattcttaaatttcttactgttatcgtctcatttttctttcttatttttagattttggaaccagtactagcagtggaggactctttggaaccacaaataccacctctaatccttttggcagcacatctggctccctctttgggccaagtagttttacagctgctcctactgggactactattaaatttaacgtatgtattttcttccaatctttgtggaatgttttttcccgcatgtatatttctttgcaggatgaattgtaaaattgcttctctttccagcttagcttgacactgcctgaacgatgtgttaaaaacaaaatctataaatagttgtatagtagacaggaacacttgtgaaatgtaaatctagattacgatgtatatttgaattaggctcatcccaataaaatttgtattcataaaactttattataatctggtgtaaggtagaatttgaatttactgtgttaagaatttgcttctgaatggtcaactgttcaattttcttttttttttttgttattttgtttttttaagatggagtttcgctcttgttgcccaggctggagtgtggtggtgcaatctcagctcactgc

SEQ ID NO: 63851 - DNA, 1050 bp, Homo sapiens
agtagaaacggggtttctccatgttggtcaggctggtcttgaactcccgacctcaggtgatccgcccgcctcggcctcccaaagtgctgggattacaggcgtgagccaccatgcacagcctcaaatgcagaattttaagaaatattaaaatgccttttcatttggtcatcttacgtagattttattctaaattctaatttactctggattttgctttttcagatactggctttggcactactagtggaggggcatttggaacatctgcatttggttctagcaacaatactggaggcctctttggaaattcacagactaaaccaggtaggggctttatttgtgatataactggtttgtttgtagctagtataggaattgacttagtggctctgatgtacttaactttttccctccttctccatctcctcaggaggattgtttggaaccagttcatttagccagccagctacctccacaagcactggctttgggtttggtacgtcaacaggaacagcaaataccttgtttggaactgcaagcacagggaccagtctcttctcatcccaaaacaatgcctttgcacaaaataaaccaactggctttggcagtaagtgggacatcactggagttctgcatctaataatttggtttgcttattgaatgtgttgtcttttctccgtttttctgtgttcatctaccttcttttcctactaaatggcaaaaacaagggaagaggaaaacttcaatatgtactgaaaaggttaataggctggaaaggaagagagtatgtacatttctataaggatagaaatttgaagcactgttatttaagggatatgcagaggaagagcttcctgatgcaaaatggctagagaaaggatgaaaagccaggtcagagtagtgtagttcatgttaagatgggagaatttcaaggaggagtgtgttacagtcagccatattgtgctgcagaggcaccttcttcttgtctctgttttatatttggtatgaagagactagagcaggaatgacataatggacgtgacatggtta

SEQ ID NO: 63852 - DNA, 1051 bp, Homo sapiens
ccttctgtctcaaaaaaaaaaaaaaaaaaaaaatgttagctttttaggtggttgggttagcagactgtgttttaatttttgatggatatgattcataacctcctatgaggatcatataaacatcttgccttgtagacctgaaatatttattgattaaaaaggggacttaggttaaaaaaaaaaaaagattgaaaacattgttttaaatggatggttaatgttgggatctgaagtttaacctcacattatgaagtttaaccttactgttcagctcaggaacattgtagattataaagatcattttacaaggtttattttatcatacagtttgaggattttgaatgagagtatatactatagttcgaataggcctaagtttgtggaatgatagattttctaaaacaattatattccattttgtggtctttaagagagtgataatgttttctttttcccagctttctgaaacaaagactcattttgaagatgtttaacaaatcatttggaacaccctttgggggtggcacaggtggctttggcacaacttcaacatttggacagagtaagtttttaaaaaggacaaaagagggagaaaccttaatctcccttactaagaacaaatccactctgataagctttaggtgggaattttatttttactttcatatttataacaaagtcgtcttgaaaaaataattaggataagatctctttaacagtttttaagaaagtagaaataaattctaagttttcatggccttcttctgattgtcagtagaagatacttaaaatatttatattattttggttgacagaaagttataatttgttactaattttcagaccagaaaataattctcttaatgttgaagtctaaaatgcagttatgaaataactgccctggaatttaccctgtgaacatgatgtgacattcatgtcacagaaatgttaaaatgtggaagtgtctaattcccatcaaccctccggagatctacctcccttcctacccagtatcgtgtatgactaattgcctgaagcaatccttatttac

SEQ ID NO: 63853 - DNA, 1076 bp, Homo sapiens
aggctgacgcaggagaatgtcgtgaacctgggaggcagagcttgcagtcagccgagattgcgtcacttcactccagcctgggcaacagagccagactctgtctcaaaaaaaaaaaaaaattaaaatggtgttccatgagaaaaacaactacatttagctttcaaaagtaattacaggtggtttgccccttgatatcctttgtatttcagtaagcagaagtttttgagtatttcccaatactgaattaaaaagaattgtgctgtagtgttgagaaataatacaactaataatttttgctgcttcattaaggacccttttaagtgaaagtggaattttttatattgtaaatgggtgacagtgaagaattcagtgagtgttagttcagcaccatttggggttgttgctttgattcatgctgagttcccagcatttttgcacaccattgattttgcacatcagcacagaggtcagaacagtaaagaaaaagggcaaagtgtcttagttttattgtgaaaatggttttgatttcattgaacccctggaagaagtgttggggacttttaggggtctttgggtcacactttgagaaccactaatctagaacaatatttcacattggttcatagagccctaagctgcttcatagggcagagctggtggggttctactgtacctactccctcttcacttcagccagagcagcttctgcttatgtctgttttatatgtcgggtttcatggctaaaaaatatttgaaaatcattagtcaaggggaaaagaattgagcacctgaattagggctggtctgttcgtgaagggaacagttcatcctcagtaaatgttacagtcactcatcacttcacatctttaattttacttcgtttgacacagagcttactagtatttgcacactcaaccttcttgataggtaaatggggctgtgtgccgtggctcacgcctgtaatgctagcactttgggaggctgaggtgggcggatcacgaggtcggaagatcgagaccatcctggccaacttggtgaaaccccatgtctactaaaatacaaaaaattaacccggt

SEQ ID NO: 63854 - DNA, 1756 bp, Homo sapiens
gtacagaattcaaagtgaagtattatagtagaataaggtgaggaaataaaactccgttttggaggaagaagctaactggaataaagagcaaaaagagagcagtgatcattccctgtgacggtcttacaaattcgaaaagaaactcgagttaactgggttacagtatgtttacctggtggaggaagttagggtatttaaaaaccaaaactagaggttggacaggataaaggtactgggaaatacttgggtaaaattattctttttgactcttcagatttgatgaaattgaattagttgacacttggttctgtacacatcagtaagattgttactttgttcttgtatagatgacaaagcataaactcagaactagtagtgcagaagagaaccgtagtctaaatagtaaagcgtgaacagggtatgttttccgtgacattttctcagttcaggcatcaccctcttctgggaagcttttcttggcattctcttctctgcaagcttccataacacttatttgatatttctatttatagcacatatcatttttattttagctgtttttttaattaggctggtaaaatattttcatcttatctttgttgtccagttgcttgccacatagtaggccctcagtaagtgtgtttacttgaatgaatagacaaatatggaggagttatacctaacagtagtcaatagagaggctcctgaaatatggggcccagataagatagttcctgctgtttatatgttatgtgatactttggtccctgacatttatttgtttatttatttatgagatagggtctcactccatcacccaggctagagtgcagtggcgcaatctcggttcacagtagcctctacctcctgggctcaagcaatcttcccacctcagcctcccaagtagctgagaccacaggtgtgcaccaccatacccagctaatatttttttgtatattttgggtagagacagggtttcgctatgttgcccaggctggtatcgaattcctgggctcaagccatcccccacctcggcctcccaaagtgctgggattacaggtatgagccactgtgcccagccagtacctgactttatgtctactaggtcctagataactaagagcaagtagaatttttaaggaactaaatttacggctttgaaaaaattatattattttcttgtaatatgatttatgtggtggtagttaacctggaaagtaaagaatgatggtactaatgtttaatttccaataatgagactatgcagttatgtaatttgttgaaaggttagggaactaagaaactcagagatttaaggataagtattggctgagcatggtgactgactactgtaatcccagcacttcaaaggtcaaggcaggtggatttcctgagcccagaagttcaagactagcctgggcaacatggggaaaccctgtctctacgaaaaatacaaaaattaggcaggtatggtggcatgcacctgtactccagctacttaggaggctgaaatcaaagaaacatcagagcctggaagattgagactgcagtgctgtgattgcaccactgctttccagcctgggaaactgcgtgaggccctgtcttaaaacaaaggcgtggtgtggtggttcacgcctgtaatcctagcactttgggaggccgaggcgggtggattgcctgagctcaggagtttgagaccagcctgggcaacatggtgaaaccccatctgtacttaaaaaaaaatatgaaaaattag

SEQ ID NO: 63855 - DNA, 1015 bp, Homo sapiens
ttctccccccttccgggcgggcggacgcgcggggcgtctcagggcctctccgcttcgaagtctagcgccgctgcgcgcaccttctggcctgagagaggggcggtgctgaggacccgggggcccggagcccgggaggcccggctttggaggccctgggagagaatggacatcagtggggtctaggcctggaggtctccagttgctgcccacgcgagtgggtgtctgtctggttgtactcattcattcagtggtgtaaggaccccacggtgggctggcctttccggggtcagcgccttgaaaccctgaatacggtctgccccgcacttccttgaccgtcatgtgggactgggctttatttgccttggcttctccataagggaagtgggcaccccgaggattagggtgagtccgaagtttgggagatttttaagataatatctgagaataggagtcggttcggtggagcaaaaggttcttttctattttcccacgtgttcagtgtaaagccagatgaggagacagattgagtttctggattactatagccataaggactttagaaattgtttaagtcaatccccctaccttacatcagttttgtagatggggaaaccgaggcccggagtaacaggcaggattagccaatgccagatttttgacagtctaaacagttttctactacctcaccctccctggatatttcagtctcccattattaagaattccctttaggaggtcggtgcggcatggacattaggtagctaaacgtagatgtagtcttcacagcgttttccgtttagttgctaccagctctgttcacgggtaaggtggaagcttcgttagtggtaccctaacctagagcttgagaactaaacttagaagatggttaaagaacgtcagcgttgttatgtatcggaaacaaatcggtaaaactacaagccattgtttccctttctaaatctgaattttttgacttgtgtcagctgatgaggactcggagtcagttagggattta

SEQ ID NO: 63856 - DNA, 1060 bp, Homo sapiens
ggaatgttgtcttgggattctgagtcagtcttcctcatccagggcaagagctatccaagtttaggtgccttcctcctcagactccccaccccacagcacacagctaattttaggactgagcacaagggctgactttatcactgagtgccagcctggctgcctggggccctgacagcatgccactccatccccaggtctgacaagatgtaccaggtcccactaccactggatcgggatgggaccctggtacggctccgcttcaccatggtggccctggtcacggtctgctgtccacttgtcgccttcctcttctgcatcctctggtccctgctcttccacttcaaggagacaacggccacacactgtggggtagggcatggggacactgatacctcatattcaggccgatctggatcttctttagatcttgaatatcttttaacaagattagccagctctccactggggcccatcaaacatacggggctgctggggggatgcctgcaaattgaaatctcaagggttagtctccctctgccttctgtgaggttctggaggctggagtcactgaagtgtaatatagagtcagtaaatgaattacaagtataacagagtttgacacatgtcccaccccatttactttgatatcctagagaaagtggtcttacatctttcttcctggccccgcgccccatatccctgtccagagggcagacctagagccaaatccttacttcatagaagagcagattctggaaccccagggtttctgggaagtggagagagaacaggattgggctagagggtattttgggcctcttaatgtagcactatgggcttgtgcctgtctctgtaggaatgtgactcagtatatgtgtgtgtgattgtgagggtcatgactgtatataatgggtttgagtgggtcgtgtgtgagagagactatatctgtgcctgtctgtatggagatctgattatgtacgtgtgtatgtgtcctggggtgagtcccgtggcctctaagattccatagatgtctgtgtaccctctggacagggatatgggg

SEQ ID NO: 63857 - DNA, 1036 bp, Homo sapiens
cctgatcttggctcattgcagccttgacctcctgggctcaggtgattcctcgcctcagcctcagccttgggtagctgggactacaggtgcatgccaccatgcctggctaattcttatattttttttgtagagatggggttttgccatgttgtgtaggctggagatttgtgcttcagaagaccactctagcttctgagtggagaacagctttaaggtcaggggcaagagtagggtataaggaggctggtgcagtagctcatgctcctgggggaaccagagccaagatgcggactgtgagcgtagagaggagggatggagtctagagaggtgtagaaagtgggattgacagcaaatggagtttttgtgcagttggcatggggcgggggacagtacggtagctagagaaggcatctataatgtggggggacttttacctgaggccaaaggaatgaatcttatggtgaaatctgaggtgccgtgcaaggggattttggggaaccctgctttataccatatgagtttctgatctactgtcctatcagaaagggcttatcctcccgtctctcagtactcttagctctgggcacatggggaagtttggggtgagctgtgtacccagtttctcatagctcctgatgttgcttgttgctggtgcagtcgatgagtggggaacttgtgtgctggaatggggctggcggtaggagtacatgtacctgattgtgtgtatgtgtctgtgtgtatatgtgcgtgtgtgtgtacatgatggaagagacagtccctgctcttagaatcccacccccatccctaatctgagagaagctcatgaagacaggaccagcagccacaatgccctaactctctcttcctcctgaggccttccccaaactctgtatcatttctccccagtacctgttcccaacagtggtcagggttcagggcccttgaatcctttaggctctcccagtcaagctttagatggtggtcctgttttccttaaagtagctgagactggggagtagttttcagattgaatatt

SEQ ID NO: 63858 - DNA, 1109 bp, Homo sapiens
cacctccagcctcacaatacatgttgtgccgaaagtagacagccagcgccgagaagaaggagatgaagttgatgatgaagagccgctgtttccagctgtaggacttgcgatcctagggaatgggctgtctgatcactctgcagcttgctgggtatgagagcgtgggctcccctctcagccctaactcctaagggctgggccttatctcccttggctcccactagcggtcatggaagggagcacaggcaggggcagcaagaatgacgactatgtgttcacgtccctgcctctgggggagtgatgggccgaggagcagtggtattcctgccgcttccacttcagggggatggagtatgaaagttacatggagtcacccaccaaccccacctccaaatactgtgggggaaaagaaacccatgtacatgggtggggcgctggaattatgacagaccagtcctctgacactgttcctaactcactgccgcctagatgcgactcctcattctatccccatttgcagcctccatctcttctattctccagtctcccacactacccaaacacagtgctatagtcctagattctgaccaaccaccctcagtttgttcccaagccccagccccaaccccagcacccctctgccagggttcccattagaactcagttcccacctcaccattacccgaatcctgaggacagatgtccttgattttcttctgggctgccttggagcccccgctagggatagaccgtacctcctgacttactgtgtgcttcttggtcaaccgccagagaatgcaggtgaggagcatgtgcccgagggatgaggcaatgaacacaatgaaagcattttcgtggatggctggagggaaagaggattgggagccacattgcagggagtgcccacaccacgaagtaggaaggtccgaatgtggtaggggcaggcccgtcccctcagggaacacttccccactcctccctcatccaggcacccactgaagtcctcggaggaggagacataagtgagcactagcaacgcgaggttctccacgacattgaggccgaagttgaggcggcagagcgggcgatagcaggaacacggggaggtg

SEQ ID NO: 63859 - DNA, 1029 bp, Homo sapiens
aagggtgtaggccaaggctcaccccagtgctgctggcttctcctctccacccctcatatgggcgtggggtcctcaaacatcacctttacctgagaggccccaagaagctgagctggcagagagctccaccatttggtgctaaaaaaaaaaacgtcctgaggttcatgaccaccatccagtttctggcctttacacagtcacctttcactgaggtcaggagcccctgagcagtggctgctccctgacaaccacagccatttctctgcacgggggtcattcataggactaatgtatttcatgatctactgtgcacatccaggcctgtggccacagtcccctgctaaagttgctcaggtgttctagtcctgacttcacctttttgatttggtgtgtgccctagggtatgtacccttccccatctgagcctcggtgtgtccatgtgtctggcgggggatgggtggactgtatgatttccaaggactctaccagtcagtggttctgatgtcatcgggtggaggtggtgttctatacctaaaggatgacctgctccagaaacagcaccagcacagcatgtattttcttctcttctgaaagttctggcttgtagacccctcccctcctttgcaaaggtatgggatagaggggtcagatgcagatctctactgtaaaatgggctccctggtatctcctgtcttccctactgctccaaaccctaaattttggttgtacattttatttgaaaggaaaataaattttttttttgggccaacagttgcctaggcttgctagtcttggggctcatcttgtttgataggaactgggagagaaacaggctcaagaatggggagggagtaagtccacggcagggtatgattcctagcagaaccccccagtcccccttaggtctggagtctcctaaagctggtctaagcctttattttggtgagcaggagtgagtgagctatctgtaatgattctaggactgcaagctagggtacctggaagtcttcagttgagacagagacctgg

SEQ ID NO: 63860 - DNA, 1019 bp, Homo sapiens
tgaattcttctttggatatccattgcatggctacctgtcgcccaggttagagtgcagtgtcgcgatctcagctcactgcaatctccacctcccgggttcaagtgattctcctgcctcagcctcctgagttattgggattacatgcatgtgccatcatgcccagctaatttttgtatttttagtagagacaggatttcatcatgttggccaggctggtcttgaacacctggcctcaagtgatccacctgccttggcctctgaaagtgctgggattacaggagtaagccactgcacccatggccaccccttttaaccctgctttggctctgtgtgattctccttttccaacagtcatacgtaagtttcccagctgtacatgcccttcagtactgaagccttggcttctctggactaaatgacaaaaaaaaacctctaagtatagggctaggcacacaggactgtacaaccattgccttttgatctgcttgtaccagccctcatcactgagatatggagagacttctctgaagcccagtatcggacactccctgcccaccccccaacagacaagactgcaatgctgaatctcatcggacagcaatgacaggcaaaagctatgcctgaaataggcaaaaatctctcttcccagtaccaggctgacctggctccggcaggaagtatagcccatgggggtctaaccctatctgaatgtggtccctggagcccggcttgtacccagtggggcctggccttggggtgtggcccaggcaggcccagaatgggggagggaaaggaagcagcctgattgccagatctctgtggctgttacagcaggggaagtgtcccaactgggagtgggggaggggaggaacggactcttaaaagataggcgagtatggaggtgatgggaacttacctcagccttctataacctgcctccctaacatggggctccctttctgcagccctccctgaacctcattataactacaatccatctctggccattccaatcctga

SEQ ID NO: 63861 - DNA, 1240 bp, Homo sapiens
attatccaagtcagaagtgacttatcctatccaaagtctggtccctgtctctctcacaggcttggagaggctgatgtgaatcttatctcttgttattagaatgggagtgtctagagggcaaggtcctggttgactggaccttgctgagcaccctaagctgagcacaccatgtagtagctgtcagtaaatgactgaatgaagtcgatgcaatcatgtctttgcatatgggagttcctcttcctggaatgcgactcaccccccttcagatccttcctgtccttcaggcccagtactgttccccagcttctccaggacatcacagcaaccccctcttctgccttacctttcccagcattgaccgtacttttcattgtgctgaactaactggatgcttcagggggagggtagtctgaccttctgtttatttccagaagcccagggaagggctgagcaaaagctgtagaatgacatacccctcctcccccatcaatccacagactctgatgctgggaacaaggaagaacctctaggaccagaagacacaagacataagtaaccaacttctttctcattcaccctgaagagcccaaagttggggtaataaacacataagctatactgtcttgtcttcaactggaagggtgagaggtgaagctggcagatctagctcagagatgatgaggaagatgggaaggaaaagtggtcccgacaggctacagactgggaatatccgaggacccttggtcaaagacatggcaagggacaggggcactgttggaaacacttccaaagctctacaagtttgtttgtttgtttgttttgaagggaggaatagaggagaggtgatataaagaggctcaaaggggctgcagctggctgcagctgggctgggaggaggaagctgggggagacatgaggtcagtgtgggactgggaccaggccaagggctgagtctctttcttccctttctccccatcagcagggaagaacccaagagagcccagttcctagccttaaaaaaaaaaaaaaaatcccccgggtgccgtggctcacgtctgtaatcccagcactttgggaggccaaggcaggcagaccacttgagatcaggagttcgaaaccagcctggccaacatggtgaaaccccgtctctactaaaaatacaaaaattagctgggcgtagtggtgggattacgcctgtaatcccagctactcaggaggctgagggaggacaatcacttga

SEQ ID NO: 63862 - DNA, 1007 bp, Homo sapiens
aggagtgctaggcagggctggagaatgttgctttccttctgacaattaggcaggccttggtgactctgtagctgagagccaagaaaagggctgtactttttttctgctctggagagtcttttgcaggggcccagagaatttgattttttctcttttggatgtatatacccatctgtctctttttagttagttaaaatatttgatcctaagattgatttagttaaaatgcttatggctttagcatgcatacaataaacactatgaaagcctgatcctgcagtgaaggcaggtgctctacaaggaggatctctcactgggccgtggagaggccattcctgtcaccctttggctctttaatacctgtacacccagccatgctaggtcactttctcagtaaagatctgtgcctgcctgtgctactctggggcttgcgtttctgaagctggcctgatacggatgcttggaaccgtccttagactctagaaaacaacaatggtttctgtagaatgtgcatgagggacctcaggtggagtctggagttatggctgccagtgttggaggtattgagggcctctaatcaggaactgtggtttagttcagtgtagctaggacagggccttggaggataggcatctaggcagtgtgcagagtgcaggctggcttctcaatcaacctctgatggagtggcaggccagaaccctgcctccctcccccagctagttgctgctgcctccaaggctataaatggcctggccatcttggtagctatgctaattttagctgagggtggctcccggaactgggctggggccaagagcaggtaggtggggcttggctgaagctaatactggggcctggggagagggacacactaagcctggggtagccaggatataatctgctcccaggcctcagctttgacaatcacccttagctaggttaattgattcagcaaacattgaacaatgccagctcatgtggtatttattaaacaagtattaatattt

SEQ ID NO: 63863 - DNA, 1030 bp, Homo sapiens
gtaaatatctggtttcactgtttggtagctggatgatcattaggcagagttgcttcattgttggctagctacctcacatgagcacccataggtaggaagattgcagtcatgtgtgatctagtagtggttctattttttttttttttttgagatggagtcttgctctgttgcccaggctggagtgcagtggcccgatctcagctcactgcaagctccacctcccaggttcatgccattctcctgcctcagcctcccaagtggctgggactacaggcatccgccaccacgcctggctaattgttttgtatttttagtagagacagggtttcaccttgttagccaggatggtcttgatctcctgacttcgtgatctgcctgcctcggcctcccaaagtgtgggattacaggcgtgagccaccgcgcctggcctctattttttaccgtaatttagaagtaatgatgagtgtaaataatactttgagatatctgtagcaatgtaatgtgatatgaaaacatctgttgatttctattgatgacaaaatcacagttattgctaatattattgtggttggttgctccatatgtaattgaaggaaatgctaactttcagtaagagaatattgaaaacaaagatgtaatttcattcccatccaaattcacaggcctcctgaattctatctatgggccccttagggatatggggccttcgtgttaagaacagctctttggcaaggaagtgatgagatcttgtggaggggagtagtttcctaggtctctacaggacttgagtttcagacccaaggggcccctctggtttcctgctgggtaacctttgatatacattgctgagtggctttgtgggcatgctgtggtacatttccctttgtggaaaatgattctttgggaaactcagcaggtttggttgttgtcaggcttttagggagaaaaaaagagaccaaactgggcctccagagctttgttgttgctgttgttgttactgttgattaaaaaaatcatgaaatattaagat

SEQ ID NO: 63864 - DNA, 1053 bp, Homo sapiens
tgggactcacaatgacagatgaaaaacttcattctgactttttaggccattggtgttaggtgctaggactgaaatcctagtatgtgaaagctggaaggggttttagagaccatctctcccaaacttcttatttacatatcagaagaacaaacttacccaaggttttggtaagccagggctagaatataattttctctgattctcattcatatgttgttctcactctgttgtggagcctgtctaccctaatggagcctgtttgggttgttaggaggtctgggacctacacagaggagaaccaggaagcagttcacaatattatattatgttcaccgaaattggtctgggtacaattagggatatacaaagtcaaatgtcaagtgctgcttctttggacctatccagctagaaagcttttttattaggcacagaaaaagaagcccagcaatatctgtttcctatggtgcctaatatatgcaccctataccactctcttgacaatatctgttcagagcaatgaggaatctgtttgctgggatgtacagtataggcatctgaaggagacaggtcagagccttatgttgtatgtctcaccactgagctgttcagctggctccattatggatttggggcctccacaggcagggtaaatgtattaaaaactttgtggggttactcgtggccacctggaaagtgccaaggggaggttctctgggcattgagaatttgacaactttgcctgtgttgatacaacttgctagagcaggcaagacttgaagagggatggctgtggtcctgtcatgtttatcagagtggagcagatttcttttgtgtgagaagtcatgcaagaaaaatccggaaatgagccaacagcacttaaacttttgttttctgctggggagcatggaatagagaaggtgcaggttctaaaatttctgtatgggtggtggttgctttcctgacacagagttccagccccagaccactttactcacttcatctccctctgttccccttgctgcattcttggcaagccaagcatttttctttgtt

SEQ ID NO: 63865 - DNA, 1403 bp, Homo sapiens
tgtcgcccaggctggagtgcagtggcgccatcttggctcattgcaagccctgcctcccgggttcatgccattctcctgcctcagcctcccgagtagcggggactacaggcgccagccaccatgctcggttaatttttttgtatttttagtagagatgggttttcaccgtgttagccagaatggtcttgatctcctgacctcgtgatccgcccgcctccacttcccaaagtgctaggtttataggcgtgagccaccgcacctggcctgagtactattctttatcaggactgggctaggtactttcacatgcattattttagttaatcctcacatcgggtctctcactttatagctttttgtacaaggcaatcttggttcagtgccctgtgattgatactgatagtcttgttggcagttgtgatcttctctgctgagggagatcagagaagctttgtagaggaggtagcagcttagtgggtcttcagatacttcaggtagaaatataagggaatttgtgggaagtattccagtcataggaaatgttatgagtaaaggtctggagtgggaaaaagtaaagagtctttggggggcagtagtttagattggctggagagtggtagctgtgccagagagtaccataaaaagatcaaggagggcctaaattgtcaggctacttgattccatagggaataaatagtccttgcacgttttgacaaggggagagacctgacctgagttttgctttagcaaggttaatctcacagaatatgcacagtacattggtaaaggtgagattggaggcaatgagcctagataggagactttgcaactgttcatgagcagaagacatcagggtctgcattgtggaggtaaaatcagtaggactcagagtttaaatgtaggaagggaaggaaagaaagaaaagagtcaaagatacaccagtgttttgagtgtgggtcatgaagagactggtggtgccattagcagaaaatatatggcagtcagaaggagggtcagtgctaggggatgattagtggtggggtagctgaacttatttgaagtgctgggcaaggggctacactccacaggacttcaggaaccaaataattctttctatgcttatttcacattgctacattttacaaatgagttttctggggtccaaagaaatgaaatgatttgcctaaagtcatacagtaactccatggtggaatctaagtctgagaacccaagtctctttgctttttagctattaaacttcctaacaaagctgagccttgactctaggaaaatcagagacagtcttggagacagacaaacctgacttcaattccagatcttgccagttttctgtttgtaagatcgtaacaagattgcttttcctctctgagcctcatattccc

SEQ ID NO: 63866 - DNA, 1052 bp, Homo sapiens
gtctgatatttaagtcactgaggcatgaatctacctccctcatctgactattcccgctcctgcaagatttggtactcagggtgtatttgttaaagaacagaatgaagttatagtgctggaatttcaggtgttatgatagactggcaagggtaagggttttgggcaaagccttggctagtttttcaaataaggccccctgtgtctttctgatttgcccagaatgtgctgttattttcctggacatctggctttagagtttgtatctttttttttttttaatttttattttctcctcctcttcctcttcttttattgtttgtttgtttgtttgtgtttttcttgtagttggtttgcaacctacagagctaggcttaatgctccctggactggagtgatatgacaaaccctcagcttcgtcttggttgctggaatatgcctgttgaccatggtgcttggattttgtttgtttggttggttttttgcaaagagcatgccaagatactaaccttgcatttggggcttatactttctgcaacctctgcctaccagtgtatgtcacttcacaggataaaggctttcctggcaaaggcaaacacatgtaaaggcatccctataagttgaattatttttctcactgacttgaaaacaattgaaaaactatctcagacctttttctgtgcatatagtgtatacttcgtgtttaacataaaaagttaaacttcaatggcaaattggaacataacaaaatataggccaggcacagtggctcatgcttgtaatcccagcactttgggaggccgaggcaggcagatcgcttgagctcaggagcttgagaccagcctgggcaacatggtgaaaccctgtctctacaaaaaatacaaaaaattagccaggagtggtagtgtgtgcttgtaatcccagctacttgggggtagaggcaggaggattgcttgagcctgggaggccgaggctaaattgagccaagatcatgccactgcactccagcctgggtgacaaagtgagaccctgtctcaaaaaaaaaaaaaccccta

SEQ ID NO: 63867 - DNA, 1075 bp, Homo sapiens
ggaggtacagaatgctacttttggggtatggctgctttagggcctttcatttcgttttcagatttgatgaaagaatagggcatctgtggccaggcgcaatggctcacaccagtaatcctagcactttgggaggccgagacgggcggatcacgaggtcaggagattgagaccatcctggctaacatggtgaaaccctgcctctactaaaaatacaaaaaattagccggacgtggtggcatgcacctgtagtcccagctacttgagaggctgaggcaggagaatcgcttcaacccgggaggcacggaggttgcaatgagtggagatcgcaccactgcactccagcctgggtgacagagtgagactctgtctcaaaaaaaaaaaaaaaaaataggacatctgtgtccaggaatctttttatctccccaccacccctcaagcagtgctgggctgactgcagaaggctcttccctgttctgcacttgttccatttctgtttttgaaagatgaagcctgggaggtgccagagctatgccagctgctatggggccagaaacaggtgaggcttttaggtctgcttgagttaaggagtgaggggtttgtcctcttcagctagcttaaggtctctgctatgaaactagataagtattcacatagcttgtttttcatttggggctattttcagccttggaggccagcaaggtgaatgattgagatgcttttatggggttcaagcttttgctagatcctatttgccaggataggtgctcagccattttccaggacatcagcttttctgaacaagcagcactgaaaggaagaagcacttcccttttctttcagggggcagtataggaaatgtgagggtgggtggtcagtttaatattataacccaggttttaagtagagaggctgtatagtttggaacattgccatatagtctttttttttgaatttttgagacagagtctccctctgttgcccaggctagtgtgcagtggtgtgctttctgctcactgcagcctccacctcccagattcaagggattttcctgcctaagcctggagattacaggtgc

SEQ ID NO: 63868 - DNA, 1079 bp, Homo sapiens
atatgtaaggcactgtactaggcactttgcatgtgtttaccacaatcttccctgaaccttgtgagatagatattctcattttacagaggagatgactaaaactcaggaagattgacttagtaacctaatgttacacagctggcaagactaaaatccaggccttctgactttgtctttcgaaaatgacagcttccctgtttataactttctatagtaaaattgggctaggataatttaaccatgctatctttggggacacttgtattattgaattatctcatatagctcaggaaaatgggggcaaacatgaagggaggggaataaggcctatcaggctgtgggcaacaaagggagctcagtgtagcaggatggtgcctactgtacaggtccatgtgaccttagtgaacccaagtcagatagtggctgtcctgcaggttaatcaaccatatttcttagcttggcgtacaaggcattcagaattagggttcctgcttcatcccattttatctcttcctacttcctatcatacaaattgtttttcattctattgtttgccagatctgctgtcatcttccatgcatgggcatttggaggctctattaaggttctagtaaaaaagtaactgtggctaccttagggccgagcagacagttttgaatctccatttactccagaatcattttgggctggagctctgtcattcattcatgtattcaatcattcttttaacatacaggacactgcctctctgccaggtactgtactaggccctgctaatcagaataatgaacaagatagatatggttcctgctctcctagagcttgcagtgtagtagggaaggcaaaaatgaacaaaataatcataatgaagtctgatgaatgtcatgaagtgcaaataagggatgtgatgggagggtgcatatatcagaggaacttaatattgtttagggtgttaggaaagacctgacattagctgaggaggtgacatttaagttggatctgaaaattgagagaaaataagtaagggttaagaaaggtaatgctaggcagctggaagagtatgcaaaggcttacaggcc

SEQ ID NO: 63869 - DNA, 1291 bp, Homo sapiens
ttgtaccttctgttccctcatccttgaaggcccagtttgatctcttctctctggaggttgtcatgcccactttgtgcctccatagcactttgtacagccttttatatagtcttattcacttagctgtctgcttcactctccacatcttgaacctcttaagagcaagaggctgagttagtttcacctctctttagcaagcacagggtatgagggagactagagtctcaaaaattgtagaattgaacaattcaattcattacatcagtaccttggtacactgatgcccaaatcaaaagtagatgattgtgtacaactatcttgtgtacttccataaactaaataagtttctcttccataattcactgttttgtgtatctcccaggcccatagcccttcaaacatgcagtgcagtagctgactttgagagagaacagagcacagatgttatctttgcctgctttgcccttcacctcacagtgctcttctaagtccctgggcttgacccaaggaatgagtagggaggaaatgccagaaatgagccacccttggcatcctaactccttggtttgcaggtttggccctgtggggcagtgcaaggtgagcaaatggaaaagaacctgttccctgtaatagcagctgaaagggatctctacagattattactgtcatcttttcgcagctgcagttgcagcaatgagacactcccctcattgcattctgcatctaagacaaaatcaattcatcttttaaattggctctcttggcttgtcctgagatttctcatagggctgagagcctgaaacaagtcatcttacccgtgtttttctaccattgtaaggccaaagactgtgagattgtgtacccttagcccttcattttatacatggggaaactgaggcccaccatgggcataggactagttcaaggttgggtgactagtgtcaggtgaggctagacactggtcttccaactccctgcaaggtgctctcttcattataccctgctgtctctgatatcagtttatgtttgtaatgcctgtagattgtgaagttggtgaggctgaagtaaccaggaaacctggtttcttttctttctgtcaccttcctagtttctggacatcagggcacagtagacattctgggaagacttagtgaaggagtaaataaaaaacaaagttggcccaggaaaactgcatggtctaagccagaagaagactaacgaaagcagattcctcccagtttcactggacatctttggctttgatgatgattcctgtggttcgattttccca

SEQ ID NO: 63870 - DNA, 1019 bp, Homo sapiens
cctcacctcatccccattctaggccccatgctattttatctcttgaacttcatggtccttgaccaaatttgaaaatcttcccagggctagtactctcaagtcttagtcttttgatccctttccaagaatgagggtggattctaatcccatcaagagtagctgcagaatttgctagtcctggctgagaaataagaggtgaagtgggagaaattcttcttactgatggggcccctgctggtaaaacttggcaatttccaattcgtcctatagggatgaattactgtttagtgacgagaaacagaaagtggttgggaaagtcgaagcattagatggacagtggatattggtggtgggaattggtgggttgtattcaagaattcccttgactttttgggagatatggttttttaattaattaattcacacattcttcattcattcattcatttagccagcacatactgatttcatacttgacagggtagatggtagtggtaatattataatgggccctgggggatagagtgagtcaagcttggttcttaccacttggatgtggtatgtgaacaactcataacatgagaattaatataacagagctatgcacaaagtgctttggagcatagaacagtgaacagtgaatgattagctctgcctggagaaaggtgaggagatttgggcaggagggaaaggactttgtgtttttttctgccaatagctatcaaagtgtagtctttagaccatggcgggtggcagcaaggccttttcaggacatccagaagatcaaagccgtttcataataatatattatttgccttaaaaaaaactatgtatacctttgtactgatgttgcaaaaacagtggtaggtaaaactgctggcaccttaacacaaatcaaaccagtggcactgaactactagtaatgactgtattcctcacctccacacactgtcagttaaaaaaaataaaagttttcaacaaagaagtagaaatcattaattttattgaattgcatccca

SEQ ID NO: 63871 - DNA, 1020 bp, Homo sapiens
cagagtaatgctaggtcctgggaggctgtgagagttcgggaagctggcatcaggttcccgatgccaccatttggcttcagcgctcccaccatttggctttagctcatgctactagttcatgttatgctgtatttccttaatctatgctatagccaccccaaacagaatcagagctaagggagctaaactctgaggggagcagtcagcaggttcacttgcaatatctaaagtgccaggaggaacttggactttataggtagtagtatatagggagagagtaggaagcccagtgctgtggttaatatgggccaaattagatgaagattaagtagctgggttatttgcagatgttattaccataattaataataattatattcccttttgtgctctgggcctcactttcttatattcagatagctgtagacaacccttaagtgttctgcctctagtttctcccggaaagcccatgttgtacatgctgccagtgatcttcctaacctacatttgggttctgtgtctcctgcatgatttccttttcctgtttcctttaacttcctgtacctaccactccatctctttaaatccgattttagcctttcttttctttgtttttcattgaaatatatttttaaaagagtcagggtcttgctctgtcctctaggctggagtgcagtggcacaattatggctcactgtagccttgagctcctggactcaaatgatccttctacctcagcctcccaagtaggtaggactacaggtgtgcaccaccacactaggctaactatttttgtagagacagggtcttgctatgttgccaagtctggtattgaactcctggtctcaagcaacccctcacctcagcctcccaagttgccggggattacaggtgagagccactgcaccttggctacctttgttaattctctggacatacctcctaccgcttcggtctggctccaatcttctttgtcttataaacattttatgtttatttccagtcccctttctttgctca

SEQ ID NO: 63872 - DNA, 1122 bp, Homo sapiens
ttgtacttcatagcattaagaagaattgtctgattcacttaagttcagtgagtttcctttcatttcctttcattcattcttgtgttcttctcctcacttataaatacctcctttgaaatctttcttactttttgatgtgctccttgccttctttctctcttttttcttcaaacatatttagtgtgtgctatgtgctggatgctggatatgctttgcatattcatttaaagactaataagatgaatttactacctagaaaggtctcacatattactgaggcaaaaaaaaatacatattcaatccccatagatattgtaacaagagatgagccctgcatgctctggaagtacagaaaagagttaatccatctgaggatgataggaaacactatccagaaaaggtattgcctgagatgaatttttggagatgaataggggtttacatggggagggggctgagcatgatacatcatgtggagtaacaagtatgatgtccttgggaatctgtggtcagtggttcttttaacttgagcaaatgtaatagtggggcagggagggagaggttgggaataagattagaaaggcaggctgtagccagatttgtgtgccatactgaggaacttggatttcatcctaaagttgaaaagctagaagtaaacagagctggccctaattctgactgaaggtatgtcaggagcaggttttgcagaggaggtgaagttggaacttggtttttaaagatgagcaggagtttactagatgaagaaaggaagaagagcattccaggaaaggggaacttaacgagtaaaggcaggaggcaaaaaatatggcaactctgggagacatcaagtagggaagtatctagagaatagttatttcatctatgagatagggacaccagtaacatataccttcaatggctgatgtgaggcttgaaaaatatcctttgtaaaccatagagctgtgtgcaaatttctatagttgttgtgttatccagtttcttctaattttttgtcagtacccaacatgcatcaggccttctcaggtatagatccacataggcatacacctcagcagtttggcactggcttgatgagaggcatgccctcttttatctagccac

SEQ ID NO: 63873 - DNA, 1529 bp, Homo sapiens
caactctgctgttcttgtgtaaaagcagcaatagacaatatgtaaatgaacgagagtggctgtatgccaataaaactttacagacactgaaatttcaatttcatataaatttcacatcttgaaattcttctttagctttccccctaaactattttaaaatgtaaaaatcagggttctcccaccgccccttctggggatctcagcagctcgggcggcgggaggagcggcagcgaccaggcagcccagcttcgcgaaggctctcggtgcgccgcggctcacagacatcccgcacgcaccctccacgccgccaggatgcctaagagcaaggtcagctccgcggaaggggccgccaaggaagagcccaagaggagatcggcgcggttgtctgctaaacctgctcctgcaaaagtggaagcgaagccgaaaaaggcagcagcaaaggataaatcttcagacaaacaagtgcaaacaaaagggaaaaggggagcaaagggaaaacaggccgaagtggctaaccaagaaactaaagaacatttacctgcagtaaacagggaaaagaaaactgaggagagtccagcctctgatgaggcaggagagaaggaagccaagtctgaataataccacacatcatacattatcagtggtccctgtctcccttcttgtacaatccagaggaatatttttatcaactattttgtaaatgcaagttttttagtagctctagaaacatttttaagaaggagggaatcccacctcatcccatcttttaagtgtaaatgctttatttaagaggtgaaatcattcgctggttgtttattttttggtacaaccagaaaacagtgtgggttattgaattatgggaggttttgactgtctttgctgtcagcttaacactccatagatgggggttagtttttatatcctataatacaatgcatattaaatgacaatatggagtcagcagccctgcatttaatgtcttgaacattttaaattacttctattcccatgttattttttagtagaattgtttcctaaagaaaaccagtccttgatcatggctctccctgtcagaattgtgtgtactctgtaacatctttggttgtggtagtcctgttttcctaatcacttggttactgtgctgtgaaagattaaaaatttgaatatgtagtatacatgctattcagttgtgaattggtgggacatatgtaacagcttatcaacatgtgaacataccggtacttgatagcctcttaaggacaatttgcttccaaattttaagctggaaagtcactggaataactttaaaaaaaaagaattacaatacatggctttttagattttcggtacgtatgttaagaattgtgtacaaattgaaatgtttgtactgatcctcaaccaataaaatctcaattatgaaagaaaaaaatgtaaaaatcatttttagtttgcaggctacacgaaaaaaacagtttgctgatccctggactagatataataaatccaccctctgctctggcttcaggtgc

SEQ ID NO: 63874 - DNA, 1049 bp, Homo sapiens
gaatcaaactctaaagtatcatgttacattgaatccaagctagtgtaactctctggctcctggctaaatatctttcttttagataggctgacaatttggggacctttttctttcttctattcaatagacaattatgtcttgactagctattgtaagctaagctctctgctacatgttataggacaaactcgagagacactccttcagttatttaataaccacacactctgctctgtgccgggccctcggcttggagatggatttatggagctaaattaattattcatttatgtattccagaaaatttacaagatgctggtgaagaataaatgataaataaaatatagtctctatttttgagttgcttagggagagtaagagggggataatgtataccctgagaactaagggaacaaataggatagggcaatgaactcacctgggagagatctagaaaacttcacagaaggcagtgactttttatttaatagacaaagagtgggagaaagcattttaaatggagcaccttgtgcaaaatcttgggggtataaaagatcatggtttggtcaaggagcatgaaatggcttgatgtgtctagagcaggcaactttttctgtaaaggattagatagtaattattttagactttgatagccatagagtctctgttacaaatactcaactctgtctttgtagcatgaaagcagccacagaaaatatacatcaatgcatgagcctggctatgtttcagtaaaactttatgaaaactggctgggcatggtggcttatgcctgcaatcccatcactttgggaagccaaggcaggaggattgcttgagtctatgagtttgagactagcctggacaatatggtaagaccctgtctctacaaaaaatgaagaaaaaattagcccctgtgcctgtagtccaagctactcgggaggctgaggcaggaggactgcttaagcccaggaggctgcagtgagccatcttcacgccactgcatttcagcatgggcaatagagggagactcagtctcaaaaccaacaaac

SEQ ID NO: 63875 - DNA, 2146 bp, Homo sapiens
ctcatttataaaataagtgtgataattcattggttgtgaagatttgatgagaaaatattgtggaaattcttagaatattgcctaatttataagcaagtactcaaacattttaaattcttccttttttctttcctcttttagcttattgattttcagttaactgtcatgtattgtcttttcatagttaaaaaatatgaggaaaggatttctaatttatatatatttttcaagtgagacatgtaacaaagaggaagtgatagtttagttggcaactaagacatgtgcataaggaaggatacatgagtgatgtgatacacttgtatgttgggtagatggaatgtgttatggctagctagaggcaggtgacctgtgtggagatcttgacgggctgactcctaggtatctcttgtgacttgtgtacttttcccttgcagttcctgagggaagacctcaattaccatgacccaacagtgaaacacagcaccttccatggtgaggataagctcatcagcgtggaggacctgtggaaggcatggaagtcatcagaaggtaataggcagcctggtcatcaatcctagttgtgggaaggtttagagaagagagaagcagcaacttggccttagaagaacatgtatataaaatgcttagtaaagggcaaattattgaagttattctacatatagtcactaaaaaagactgaatatagtcactctgctgggcatgggggaaggttctccagagttggcgtttttcttcattaggatactttttgaattctatcctattcctacccctttcgtcacccacctaaccctggcataggaatcttccaggttctgctgctttatctccagagatagggagcttgctggtctcttgaggcagcccctttcttctctagcttcccacttagtcccagctctgctgagtcctagacaattcaaagattgggtgagggtacagacagactctctcctcttctataccatcttgattgaaagcttttctataccattttggttgaaagctcctgagtcttcttttttccaggttaagtagccctacttcttgaagaaaacattttctcagcctccttcttgtcttgatttcctgcctataagcacttttgttaatgtgtttcttagatcctatagttggctgcagacctccaagtgtgattttatcatcacggagttgagcaggactgtcaccttcttgtttctgaatcctgtgcatctgttagtgcagtctgattagattctggtgcctcactagtcataccactctactgacccatgttgagcttaatgaaaacttcagatttctgtaaaactgctaaaccatgattaccattttttttttctggagcatttccttcagagttcttagtgaaagagcatgtctaattgtgcgagacttgacagggaaggggaaaacagggctttagcttcctctccatttatatctgtggctagggcacagataacaataagactagaagaaatctctcttcccagggtctcttagggcaggttctgatgtaacaggggttaaatgtaagtaaccatcaggatccctggtttttatttgaggaaccttaggcctagatgtataaagttacttgtcattatcatgcatttagtagagccagaacttcagctgtaggccaatgcttttcaataccctcttggttgaaagcattagtctaaggtagagaagactagttttggtaggaatgaggcagtttctatttttatttacattttaatttaggcttatagaatttgagatctgaaagggataatctatattgtagatggggagcattaaatgtgaagcaggaagacctggattctaatcctgattatgggatggacaggctgatgcttcctgttaactctatgttttatcaatgtagaagaaaaattaggcagctgtaggagagagcttcctggatatctttggaagctgagttccttctgggggcttttctttaatagctctcgagcaactcaggctatgtactgatgaagattaagcagtgacatgagctttggaactataccagcggtgccaggaaaaaatcttccattagcatcatttagttttggctttcttatttttctctaataacatgaggacaggg

SEQ ID NO: 63876 - DNA, 1008 bp, Homo sapiens
tccccttatgaatgctcagttgaatagctggacgaatggatggatggataattgattctcaaccctggtcacaacagtttaaaaatattccaaaatcaaatttattgagttataatttacataaaagaagatacacctattttaaatgtacagtttgatgcattttgacagatgttatcatttgtgtaaccaccaccacattcaagatatagaatatatccatcaccttataatgttgcatttgtgattttttcccagtcagtccccagctcccttcctggctccagctaaccattgatctgctttctatcactatagatttgtcttttctaggatttcatataaatagactcacagtgtatactcctttcatacttagtattttatgggacagatagatattaaacacacaaatgtggtaaatattaaggtcagcatgacaacaaatgaaagcagtgcttggcattctagagtcatggctttgcttgtctcttttcacagtatacaattggaccgtggatgaggtggtacagtggctgatcacatatgtggagctgcctcagtatgaggagaccttccggaagctgcagctcagtggccatgccatgccaaggtcaggaggggactgggtttttctctgttgagggtacggggaatgggctggagtgggcctgccttcagattgctctggccagttaagtgaggttctgcctttttcagggcagcgtctatagatcttgcctcttctcacatctgttgtgcacttgctataaagtatgatgggcgctttgtatccactctcttctttaatattcctgtcagtcctgggaatagtactgatagctgccatttactgagtgcttagtacatgccaggcattctactcaacactgtatacagtatctcatttaattcttacatcagtcctgtaaggtgggtattattgtatatagatgatgaaactggttaagtaacttatccaaggtcacaaacatgactagttagggg

SEQ ID NO: 63877 - DNA, 1021 bp, Homo sapiens
ccatagattgagacttctggacctttccctgatctgtgccaagaatggcctggtagtccaggatacctagttcctacagtgacttcagtcctacagccagaactgaggcttctggtgacattgctttatatcctttataccagtcatctccatttacctactgtggaactttagaattgcttaccctgtatgacagaagccactacatcttggcatatgggctcatccagcccagagatggctggggcatattgagaaggcactagttctctcctcttcactgcatcttaagaaagtgtgatttaataagcatcctgtattgctgtaaggcctctcatttcaaaacaaagccttggctagcagagagatagacatagagcttactgtaatagtgtatggcaagtgtgtatctaagaagagaaactaattccttctcagtgggagagtgtgtctgttatggaaggcttcatagaggagggatgcagtggagtctgcaaggctaagtgtgcagtgggcaccctaactcatcatgccctcccctctctggcagtgactcgccataatcacctcaaggacttcatgctggtggtgtctatcgttattggtgtgggcggctgctggtttgcctatatccagaaccgttactccaaggagcacatgaagaagatgatgaaggacttggaggggttacaccgagctgagcagagtctgcatgaccttcaggaaaggtaaggcctgccccttcaggaaaggtgaggccctgccagttcttgggaacctcctatttccacctgggtgtgagccacttggcccctgagaccttgtcagcatggcagcccaggctgcatcatccttccaaaactgcattgcaagtttaggttgctgatattccaattgctattgggcagttattcctcctggggagaaacttgtttctatcttttttgcctcttagcttcagagggagaaatgtgtagctgccagaggtcttgagcttcccattgcttgttatggggtcatt

SEQ ID NO: 63878 - DNA, 1078 bp, Homo sapiens
tgcctgtaattctagcactttgggaggccaaggcaggtggatcacctgaggttaggagatcaagatcagcctggccaacatggtgaaagcccatctctattaaaaatacaaaaaaattagccgggtgtggcggcgggcacctgtaatcccagctacttgggaggctgaggcaggagaattgcctgaaccccggaggtggaggttgcagtgagtggagattgtgccattgcactccagcctgggtgacaagagtgaatctctgtctcaaaaaaaacaaaaaaagaaagaaagaaaaaaagaaaattataaaaatagtcactatgattttcaaagaacagtggataataggtgataacagttattttgttccttttttgaggtatttacataaagtgtacaagtcataagtatacagctggcaagcttttgcatatgcatgtacctgtgttactaccacccagatcaagatacagaaccttctcagcaccccaggaaactcacttttgctaccccaattaatatttcatccaaaagttaactactgtcacaacttgtaaaccagattagttttgtctaattttgaacttcatataaatggcattatacagtatatactcttttgtgttttgtttctttcactcaacattatgtctatgagagtcatcaaagttgcatgtagtgatagttggtttatttccattgctgagtaataatctattgtatgagtatactttaatttatccactcttctgttgataaacatttgggttgtctgcagttttgttgacttttatgaataatattgctatgaaccttcttgcatatgtctcttggtgggcataagccctcatttctgttggacatataatattcatgtatttagctttattagaaactgtcaaacaattttccaaaatgattgtaccaatctatactgccacaacaatgtaagagaattctagttgatccatgacctcagtatttttaggcattttaattttaaacattctggtaaatatatagtagtatcttgtgattttaattttcatttccctaatattattaaacacctttttat

SEQ ID NO: 63879 - DNA, 1838 bp, Homo sapiens
tccctctccctgttcctcccattgggtgaagagatatcctggtggtgggttctgtttctttcctaatgttcagctcctgacagtgtcctcaggcttctggaggagggaatgagggtgtaggggcattcctgcctgtcttctgggaaagatgaaacaagtggaggcaggcagagggaaagctctgccagccccaggctgccatggggacagaggtcctcctggggcaaaagggctatcaaggacccctttgcttctcccctcgctttctctattttgtccccctcctttttcttctaccttgcctgcctttctctttttcctctttctcttccctttccttgtacagcctcagttgtgctaggaggagtgggccccagccataggggaaggcctttctcatttattccattctcgaatccctgctctttttgagctgggggcctcatctttgcaggctgagaagataaaaaagaagagaaacacactctttggcaccttccacgtggcccacagctcttccctggatgatgtagatcataaaattctaacagctaagtaagtaacaccagttatctactctggcaatgtccatatcatcctcagaatttgagggcatacagggcctccaacaccaattccatttcctcattggtggagggacagctctggtctcctgcctcagcctttatttatctcctgccttgctcttaagtttgagtttattgtgtgttttattcacacatattctcaaaacttgttcctctgagaagaggcttcattcctattggggctcacaccaagtccatgcctgcagttctctttcctctgtcttcaggcaagcactgagcgaggtgacagcagcattgcgggagcgcctgcaccgctggcaacagatcgagatcctctgtggcttccagattgtcaacaaccctggcatccactcactggtggctgccctcaacatagaccccagctggatgggcagtacacgccccaaccctgctcacttcatcatgactgacgacgtggatgacatggatgaggagattgtgtctcccttgtccatgcagtgtaggtgacctctttgcggggatgaaggaaggagcctttgatgtacaggttgagaagtctgtggcctctgttgtgcttaaacagcagatggggcagatacccaggaagatagttcaactcatgaccttggtcaataaagcacaatttactcaggttatttctttatagttgtccttttggtgttctttccttgttgtatgctctgtgtgcccctttgggtctattgtgctaagtgtgtctcccttcattctttttcactttattgtccctaactaccactctatctacctttataaaaaatatgtcctttagtgaatttcaatgtaaaaatggcatttattctatttattgaacttatttattttgatttttgttccttattcttattgctaaagtagatgaatggaatgatgtttctttttgtgtttttgtgagaggccctataaagaaatagtcccttaaagtgatatagtcctaaatcctctaagctggaaaggcattcttgcccaggagggatctcctgcacaagcatgtctggctttccacctggactcttggatcctacccgctcttcctctgtcctggatcttccctctcccttttctcccctgcaagtgatgagagttgagtagagcagagccaaaaggaacaacactggaattcttcagtgaatgaagggagttttcccttactggcccacaattgaatttttctttggatcagatgctattttaagtaagtagaatagcccttatggtaaagctatt

SEQ ID NO: 63880 - DNA, 1038 bp, Homo sapiens
cggatgatcagtccctctggaaataccccggtttgaggagcccctttggggcattttgtttttctgactttcgggactaaatcaacactcttaccccatgggtcccttctcctgcctgcttcacgcccctgcctgctccctctatcccctcagcactgtccctactaactacagggaggggttcgggggtgagaagaatcagcttgcttggcaagagctggacagagaacacccatggtaatggaaggcttaggcttctccctttagcgcagctgtgcaggtaacctggtagcccttcttccatctgggctgggagggaaagagggaaggacaaatgacccctttcttttctctttttcatgtttctcccttttcttcccagtttcccccttctttctcccccttcccccccctattccagacttcctcatcctcttcagcctctctttcgtaccttgaaagctaccagcatagaagccctacctcctgaactctccatcactatggaattatgctgtctccctggtggtccttccaaggcttcgctcacccttgtaacctggccctttctctcatctttaggtagaatgcagggaagcttatctatcaggctagaggagaaagaataaaggtctgcactctcttttagctgggagtgagcccaaagggggatgcactagcatattcctaagttacttggtgcccatgtatcccttcactgggcatagtggccattatctccaggaccccgatttgcagcctgatccaagagctggttctttgttgtttatgtgcttattggaaagcgaaaaagagtgaacattagcataaaaagcatccatagtcccaccatatttgagcaccttctctatcactcttttctgtgaaattttttatgtggttaagataatgatagccactgccacttattgagtgccatgacctgtttcaggtgccttaaagacattattgtgaagtctcagaagaaccctgcaggattttagaaattaggaattaaaatggggaagtcagctgctc

SEQ ID NO: 63881 - DNA, 1044 bp, Homo sapiens
tcagttctgaaggctacgggaccagctctccatctgcctctgctgctgcttcttgctcctcttccatcaccaccatcaccactaccaccaccaccaccaccaccttcaccaccgtccatgtccaccctgtttattaccaccacagcacttcctatttcctccagatggagccctaccctgacacacccccttctgacagcaccgctgtgatgcctgggcattcagagagcttggggtatcagctgtctctcttttctttcttcccttccttccctttctgctgcttttaccttggtttctgcctgccagctgctgcttgatcaactctgggggtgtgtgcagtggggaatcttcttatcctgtttgttcccagctctgggattcctttttaaggtcagcctactttctccccttctgtgtttggggtttgctgactctaaaaatgagtaacgactttcttccctcatgaccctatagcacttttgcctaaactatgcactttcacattagttatctcacttgggccctcacttcctttactccttcaacaaacatttactaatgcctactctgtgccaggctctgctgggcataggggttcactggtgataagatacaatcccagccatcaagaactacaatcttgtctgagagagatacataaataattatggaaaaatttattaagtgctatgggggtgttgaggaaggagtgactaacagtgtgtacctgggtggaatgcttcaccaaagagatgaatttgtgctaacatcctgtgtgaagggaaaggagaaagagtattctaggcagaggaaacactgtatgcagagacatggagattccagagaatacaatatatttgtggttagaacactggatatgtgttggtgggaaggagaaacaggtgaggctagaatgacgaaggctccgaaagggaagggttttggcctctacccgttaggagatggagaactacaaaagggtttctaagagaaagtgaatcagtcacatttgcattttagaaataacattttagtggctgt

SEQ ID NO: 63882 - DNA, 1280 bp, Homo sapiens
tagcttctgacatgtgtgcctcagatctgttccaccccactcacagtggttctgtttgctccagactggggctagggcctaatctttgaagtttgttctttggtattgatgtgggtcagaaggagcctcatcctaatctcactcaggcctccagggatccatgggggagtgaaaccaattctcagagaacaacccaccagagacttttaaagagaggccaggcttgggaatgggttgggagaggcatctgttcattggagcatgagtggatgccagaactgtaggttataaggcagtcactttttctctctactcccacccacacctgcctccctcttacccctgctcccccacactgcaggaggatttgtctctaagaggtgctgccccaaagctccccaagcatcaatactcctagggctcaggacaagtggctcccctggccaggagagccacagccatgatacagggctcttatggagccctggagttgttgggcaaggatgctgtcattttttgaaccaaaagacaaacaggttaaaaggaaaaaaagtaatctgaatttcccaagtgcctacgctgcatattccccttgttagatcccattttcatgttactttgtagccttggccagaggctcaaaaaggacacaaccagtttggggaaggggtggctaaggaagatggtataggtgaaggcggctgtgtgaccactttcccccacccttcccaccctctagacaactctctcccttacctgtttttgctatggctgtaaaggtatttttcctctgccccactccctgccatacctttatcctgggatcctattttgggcctggggtgggtatacctggggctggtcttaggagggtgctaggctgcagactgccttgtactccctggacaccctcaaatggggttttctgtgttatttcataaaattctttgaagtccaataaagcatgtaggagattttaaccactgctggctttgactctcattgtgttctctgtgctgtggcatgatgggataaagagacaatctttcctttgcccagggaaaatgaaacttgaatgcacatgcccagaagctctgtgggcagggttaccagataaatgcaggatgaccagttaaatgtgaatttcagataaacagtttttaaagtataattttctctcatgcagtatctgggacacatttttatttgctaaattgggaaaccctatgtctgggtaaacttgaccctatctatcctataacttcacttacgacttttaa

SEQ ID NO: 63883 - DNA, 1021 bp, Homo sapiens
attataataaatgtcagagcaagaaaaacgttcccgccggttaggttttgttatttcaaaaataaattaaccgcctttcctccggcggagacgcgcaggtgagagggcggcgcctgacccagcgggctctaggtgctacgccagggccccgagggtcccgaactcggcttgcccacacaaaacatggtagcaggagagcagcatttccgccgggcatgtccatatccaatggggcccatgggagaggcgtagtcttctgggtcttgcccagactcaacatggcggctacacgtcgcctgtcagtctgtgaagcctaccccgggcgtgggccgcagcgtcgagtaacgtcattcgaaccccgtcgcgcccctttgtgcgtcacgggtggcgggcgcgggaaggggatttggattgttgcgcctctgctctgaagaaagtgctgtctggctccaactccagttctttcccctgagcagcgcctggaacctaacccttcccactctgtcaccttctcgatcccgccggcgctttagagccgcagtccagtcttggatccttcagagcctcagccactagctgcgatgcatgtgatcaagcgaggtgagggggggacgaggtgggcgagaaggaaggtgaggggatgcgggctgccgccgccggagctgatgcccagaccgcccgcccgccttcgctgcttcccgcctttcccgcatttcccgccgcggccttccgccctgtcagcccgctcggccttctgtcttcagtcagcctgccccgaacctccttcgggccttcaggctgcgccccctcggctttgtcatcctgccgcctttcaaaaggataacacttaccccgtatcgagtagtgactgcgtacgccgagcacttgccaggcactattttattcctccctgcaagcctctgagagatgattagcttattacagatgaggaaactgacgctcagagcgaggtgtcgccgactgacccaaagtcacccataggtgacaatacggtttgatt

SEQ ID NO: 63884 - DNA, 1050 bp, Homo sapiens
ctcgaactcctgacctccagtgatccacacccccccccgctcccttggcctcccaaagtgctgggattacaggtgtgagccactaggcctggcctgtggattgttataacaattttgacttttattctggagatcataagccactattaggagttttgaaggaggtaatgatatgattctgagtttaacttttaaagggtaattttggctgccatgtgggatgggggaaaaatttaggaaattatccgtaaacgtctgtctgtatagaattcatactctttgaaggtgacatcagagaagacaatctcttcatgaatcttttgagggggcctcaatcttttctgtgaaatagcacttcatgttggtcaatttacatgttaattacatttgattctttgacattgtagtcttaataattgctaacatgaatttaataattgctaacatgatttgattctttagatggccgccaagaacgagtcatgtttgacaaaattacatctcgaatccagaagctttgttatggactcaatatggattttgttgatcctgtaagtaaatatggtttttatcttgggttccttctttcatgtgtttctttccatttgtctcttatccctggaccttcattcacctgatatactttggtattctggctatgcccttcgatataaaatttgaattcattgcttaaaacatttttttttccttaattttggttctgtcctgtgagttctcacttttcagagaactatgaatgtgagtaaagaggaaaatttgatattaacatttaatatcagatatttccttgagtaaattgttttattcattagtggaaaagcctaggccaggcgccgtggctcacgcctgtaatcccagcactttgggaggctgaggtgggcagatcacctgaggtcaggagttcaagaccagcctggccaacatggtgaaaccccgtctctactaaaaatgcaaaaattagccgggcctggtggtgggcgcctgtaatcccagctacttgggaggcaggagaatcacttgaacctggga

SEQ ID NO: 63885 - DNA, 1033 bp, Homo sapiens
gccgggcgcggtagctcacgcctgtaatcccagcactttgagaggctgaggcgggtggatcacggggtcaggagatccagaccatcctggctaacacggtgaaaccccgtctctactaaaaatacaaaaaattagccaggtgtgggagctggtgcctgtagtcccagctactcaggaggctgaggctagagaatggcgtgaacccgggaggcggagcttgcagtgagccgagattgggccactgcactccagcctgggcaacagagtgagactcagtctcaaaaaaaaaaaaaaaaaaaaagaatgattaattgactatctctctaaacatgtatctgatgttaaagagactaggagaaaactgagttgtttgtgtgttgttaatttgtgtaatctcgaagacaagttgaagacaaaaatacagcagcagcaacagcaaaacctgtgtctaaaaatatacctattgatagtcaagtatttcagttctctaatattcacactgggcccatacctgcctttggcaacaaagatgaccttaaaattttaagagaaaaggaaagcaagctttcgtataggtttttctagtccttagatatggatcattatgtagaaacactgtcagtattttgaaaacctggctccttttttttctctccaaaatgattatttgtacgttattgcttttattttcctctgaatgactttgtagcctacaaaaactctgtaacaaggaccagttatgctctaaaatcttactgttacaatagttctttgttggaaacttgttaaaggactatagattttgaagagcctcagaattaacataagcctgcttcctgtcattgtttattatatatactgttatatacagtttgaagtaggctagcttttaaaataaatatatatatatattagtaaatatgtggtaccaatacttttggattaatagccaatctaaaaacatgtttaaggatgataatatagtcccatttatgctcatgttttttccctctttcaaaacatactataaaca

SEQ ID NO: 63886 - DNA, 1052 bp, Homo sapiens
gcgcctgtagtcccagctactcggtagcctgaggcaggagaatggcatgaacccgggaggcagagcttgcagtgagctgagattgcgccactgcaccccagcctgggcgacagagcgagactctgtctcaaaaaaaaaaaaaaaagtgccaatgataatgttccagatgaagctaggaagagtaaatgtgctattcttttcatttgaaattttatagaaacggcgaagatttaaagagattgccttattgtggatgatatatccactgcgtctttaaaaacggtgctctgaaaattttttgttgtttctctctttctagacgctagagcggtcttatttgttgaagatcaatggaaaaggtgagaaatgaacatgtttgtctgttacattttctactcattatattgaatgtatagctttgagctataagtcttaatattcttgcttagactctagataacattttggactttaggtttagtttgtggataattgtcctgtttattagtataaagtttttctagtttccttttggtgtccttttctgaaattcaaatacgtatctcaacctactttttctgacgtctcatcatgtgaaaactcctcttttgtctatagtggctgaaagaccacaacatatgttgatgagagtatctgttgggatccacaaagaagacattgatgcagcaattgaaacatataatcttctttctgagaggtggtttactcatgcttcgcccactctcttcaatgctggtaccaaccgcccacaactttctaggtaggtgttttgagtagggaaatacgccttgacctgaagaaactgggcagttagttcatcacataaaaaataatttaatgaccttttagtagctgcctgctctgattaaatgagatttagattctggaaagatctctgactgtaatgtggtaaatgaattggagaaaaggcaaatgcttataacaaaaatgttctaaaattgattggattgtggtgatggttacacaagtctatgagtatattaaaagccattgagtagtacactttaaat

SEQ ID NO: 63887 - DNA, 1675 bp, Homo sapiens
ttggagaatctttagtaaagtgaaacgtgtatatcttttgacccagcagttcctctcctaggttcatattctacagaaatgcttagagataaacacaaggtgttgtgttcaagaatttttatagcagcattgtttggaattgcaaatgaattggaaataatccagatgttcatcaacaggcacatgggacaaatgttttggtatatttatacaatagaataccttatagcaatgaaaataaagtttgtttacatatatcaaaaggattaatttctgtaaagcaatattgaattaaaacaagttgcagaatgataaacagatatgcaaccagaaaaattctaagtgtataacatgtaaaaatgtcataaaggaaatgcttgaaaatgttagaggattgcaatgagggtatatttgtggtgtctaattttttgaggtaggtggcaagtacagagtatttgttacatcattctctatatttttctgaatgtctgaatatttatataaacacctagtcaatagatagaatccatttgcatgattgaatattcaaggcagtgaagagattattgatagagtaaggttcctgaggtggggagcaggatgagatccaaagtgaggtaaaggggttgtctttaaaaagactgtaaaggagctatgattttggtagacgtatcaaagaattggttgacaattggagagattattttcataaatgtttgtttttcttggcttactaacaacctgaaaagacggtgatgtatgtttatgaatatgcatgagaaaatgtgaaaatagcacgtttgcagtctggtgaaaatgtaagccaatattttagacttatctataagacttcctactaggcttatttacttactatctaggggaggcagcaagatgattttaaaatgatatttcgatatgttttattgtgtcatgtacagtaaagtgggttttcttctttgaaaatcatttaggaactttctaaacttcaactcttttttttttttttgccttagtgtctttgtgttgagtaatcatttttgtgactctgcttcatttccttgctctaagttgagacattttttcccccgtagctgttttcttctgagtatgaaagatgacagcattgaaggcatttatgacactctaaagcaatgtgcattgatttctaagtctgctggaggaattggtgttgctgtgagttgtattcgggctactggcagctacattgctggggtaggtttctgccatttgacttttaaagggggattcaagtctaaaagcaaacagattcatggttgagagggcatatgctattttttgggagtcctgggtctctgttaaattactaaatggctatgtgacttggagtgagtcattttacttctggcttcattttcatctatgatattagatatttagatttgactagataatctctagaatcctttttagctcaggttttagaattctggcttattttagcagtaataagagcagttatcattgattgattgcttactgtatgttaagtttgttataaatgttttacatgaggtactcatttgacccttactacaacgctatgaggtaactatgattatagactcatgccaggaattttattccttaaaataaccttgtgaataaaggtaccattgtctaattttacaag

SEQ ID NO: 63888 - DNA, 1643 bp, Homo sapiens
aaacagtaaagttgagagaattgggttgtttaccttattttatcaacaggatggtttacaactagagtctgccttttgtgactgtaggcacactaatcgcttgttggtttatgaatttctctctgatggactttggggaccttgataagacagatcaactttttgacctacaataagagcatggcttatactgtcaaagcaacttcctttgggctttatgtacatgtcatgtggtgtaaagagagctgggctgttgctgaagaggaggctccatctgtagttcatcatgtcactttagaaaagttaatcttgtttcacattttgtttatatcattcgttcgtttttactcatagaattgtaaaatattacttttacaattatatatggaaaacttacacttttataatacttttatttatgttatttaattcattgtagtgaaaatcaaaggagatactataaaagtgctttgggagacatgatgtttctttgtttcatttttattctgaagagaattatgatttatttaccactagcgtcctggggcatttgctatttacctggagccttggcatttagacatctttgaattccttgatttaaagaagaacacaggaaaggaagagcagcgtgccagagatcttttctttgctctttggattccggatctcttcatgaaacgagtggagactaatcaggtgagagataggtacttgttggtaatagcaacttgattcacatgagctttctcttttttagtcatcttaagtcatgcttaggaagagcccatatgtgtgtgatgccacagaaggcattctgaacaagttaagagatgccgtgcttgtcttcttatatttctattctctaaagtagatgctttgtgacctaaatgcttaaaaggtcatgtataaacaggcagacctagatgtttgggcctgaacctgaaaatgattatttctacagcaaatttccaagagagcttgtaaaagtcaccttatgcttgcagtgtttctaatggattatggttggctatttgaagtttcttatgagtgattttgtcctttcctttttaggactggtctttgatgtgtccaaatgagtgtcctggtctggatgaggtttggggagaggaatttgagaaactatatgcaaggtatgggaaaaatatgaaagaaaacaataatgttttaatcatggtttctcttatttcaggggtccaaatatcaaaagtacttgtcaagaatcttttgaagcatctaagagaaaaagtgactaataattttggtcagatttgcttcctgactcttcaccaaaattgagttgtgtcttcttctttcttaaaactttggaatgtataaataggttcttgggatttttaattgatccttttaaaatttaagatgactagtagggttattattttgctctgtcatatagtacttttgataagctatgctttatgttgcataaaggaatcatgagtgactaggacacatatgtcagtagtttattaaaattaaataggtcaggtgcagtggctcacatctgtagtctcagcactttgggaagatgaggcaggtggatcatttgaggtcaggagttcaagaccagcctggccaacatggtgaaaccctgtctctag

SEQ ID NO: 63889 - DNA, 1392 bp, Homo sapiens
gtgcaactgagaaactcaaattttatttcattttaaatagatatatgtagccagtggctaccatattgcagggcactcatctactgaataatgagataggtatatgtaaaaagctaattataacatagtgtgatatatgtctggtaatagagctgtgtactgtggaacatagggttctctctctctcttacctattttgctgatgcatgttataactaacacatatgactaggtattgaagaaatagaatcagtgggatttagaaatggactgatgaatgatgaagagggagaagtcaaatataaaaatttaaaattttaatgtctgagtattagaggctcacatggtggtgtaattgacacaggaagtagaaataaaaattgtgtgattcttgacctgttttttgcattccaggttgctgtttgtaatttggcttccctggccctgaatatgtatgtcacatcagaacacacatacgactttaagaagttggctgaagtcactaaagtcgttgtccgaaacttgaataaaattattgatataaactactatcctgtaccagaggtatgaatagatttctctgcttattggtaattattgaaatccaaattgaaaggaatcaatcatgatcttcaagtcatcatttaaatggttatcaataaaatggtttgagaaaaagaggtagtctgtctcatttggtacagaatgttgcttttcctgttcagtaatgttttctccttttctttaaaatctgttgacacaaaggcatgcctatcaaataaacgccatcgccccattggaattggggtacaaggtctggcagatgcttttatcctgatgagatacccttttgagagtgcagaagcccagttactgaataagcagatctttgaaactatttattatggtgctctggaagccagctgtgaccttgccaaggagcagggcccatacgaaacctatgagggctctccagttagcaaaggagtaagtatatggatggaattgtttttgcctgtgagtacctgtagtgggctgaatggtgaccccacaaaaggatatgtccacatcctaattcctggaacctgtgaatttaatttcatttggttcaaaaaaaggtattttgcagatgtaattaagaaccttgagataaggagatttacctggattatccaggtgagccctaaatctaatgacagttgtcctgcaagaggcacagaaggggaagcaacgtgactatggaggcagaaattggagtgttacaaccacaagccttggaatgctgataaccactagaagttataagaggcaaggaacagaatctcttctagtgcctctggagggagtgtggccctcccaacatgttgattttgggcttctggtcttcagaac

SEQ ID NO: 63890 - DNA, 1050 bp, Homo sapiens
tgacaataaaaattgtgtataaaaccaaggtatacagtgtaatgattagatatgtgtatatattatataacgattaccacaccacaatgtttttgttgtcgatactgtttttgagaaaatgtctcactttgtcacccaggctggagtgcagtggcatgatcttggctcactgcagcctctgcctcctgggttcaagcaattctcatgcctcagcctcctgagtagctgggattacaggcatgctgcgccaccatgcctggctaattatattgtttcttgaataacagatgtcaagatcttaaaggaatatagctttcgtgtggtggcattgatgtctcgtctttataaaagatagaatttaccaagcaatctagcattaaataactcttaagtgattttagtttaagcttcaaagctgtagtcttttctaagcagtcactgttatttatttcttcatacattttctgcttttccattcagattgtaaatcctcacttattgaaagatcttaccgagcggggcctatggcatgaagagatgaaaaaccagattattgcatgcaatggctctattcaggtatagaatgaaaatgaagtgtgctctgcaggggctgagttggacattgtggtacctcctcactcatgctagacaatggagagaatgacttcattgtgttcatctaggttttgcttgtgtagctctgttcacctctgcattgttgtgctaggattgtacacatctttacataacccttaccatcttgtttttatgcaataatataaaaaagtagttctcaatttttctgcatcttagaatcaactggggagcttttaaaatcctgaagcttaggttgcattccttaccaattaaatgtctaggaacaggaaccagacatcaattttttttttttttttttttttttgagacgaagtctctgtcgcccaggctggagtgcagtggtggaatcatggctcactgcaacctctgcctcctaggttcaagcgattctcctgcctcagcctcccaagtagctgggattacaggtgcctg

SEQ ID NO: 63891 - DNA, 1157 bp, Homo sapiens
tttggattccaaagggagtttgaaatcctagcttatttaaagggttttatctcattgcttcccttggtccctgtgaattacagcccttattttttgtgttttctgcaaaactcaagggtcatttattgctgcttagctctgacttttcctttctttaagtgcctctagaagaatgaatgtttgggtcataaatcaattaaaaaattaaaaaattggtttatgaccaacaaaaaagggatgctgaaattactatcaccagattgatatttggttggttagatgggggttttgttcaactttctaaatagtcttggtaaacttgataaggatcatatcatatgatactgaatggtaaggtcagatctggcaggaagtaaaatgaagatcaaagcttgtgtcactattctattaatcatacactgctttctttaactggagtaaagtaaacattgggttttccttctttagagcataccagaaattcctgatgacctgaagcaactttataaaactgtgtgggaaatctctcagaaaactgttctcaagatggcagctgagagaggtgctttcattgatcaaagccaatctttgaacatccacattgctgagcctaactatggcaaactcactagtatgcacttctacggctggaagcaggttggtagagaatatcaaggagtacttaattgccagcttgagatattttggcattggaatgattttatgttttagccacctattaaatattatcacctagaagttctttaagttcaaatccagaacgttaaaaccaacccatggtttttgtaccagaacagggtcttgccttggattttcttgtttctgttaggtttatttccttcttaggtttgaaaccttgtagttacctgtgatgctttccttcctttactgtccgtacaattaccaagttgtgttgattgttcctttgtattatttcttaaatatcttccttccttttctgctgctgttattctaaactgaccttattgcttctaggatctctgctcccagccattttgtgtgcattaccaccattcctcagataaaactttgcacacgtcaacccgctattcaaaaacatccattgttttctcactttataaagtgaaagccagcttacttagctagtcgttgcc

SEQ ID NO: 63892 - DNA, 1026 bp, Homo sapiens
ggacggggcggctggccgggcagaggggctcctcacttcccagtaggggcggccgggcagaggcgcccctcacctcccggacggggcggctggccgggctgggggctgactccccaacctccctcccggacggggcggctggccgggctgggggctgactccccaacctccctcccggacggggcggctggccgggcggggggctcacacccccacctccctcccggatggggcagctggccgggcggggggctgacccccccacctccttcccagatggggcggctggccgggcagaggacctcctcacttcccagtaggggcggccgggcagaggcgcccctcacctcccggacggggtggctggccgggcgggggctgacccccccacctccctcctggacggggcggctggacaggaatgtattttaaatattggtgtggaatgtctagtattctcacagagtttctcctaataattgtctttactttccttgtagggtttgaagactgggatgtattatttaaggacaagaccagcggctaatccaatccagttcactctaaataaggagaagctaaaagataaagaaaaggtatcaaaagaggaagaagagaaggagaggaacacagcagccatggtgtgctctttggagaatagagatgaatgtctgatgtgtggatcctgaggaaagacttggaagagaccagcatgtcttcagtagccaaactacttcttgagcatagataggtatagtgggtttgcttgaggtggtaaggctttgctggaccctgttgcaggcaaaaggagtaattgatttaaagtactgttaatgatgataatgattttttttttaaactcatatattgggattttcaccaaaataatgcttttgaaaaaaagaaaaaaaaaacggatatattgagaatcaaagtagaagttttaggaatgcaaaataagtcatcttgcatacagggagtggttaagtaaggtttcatcacccctttagcactgcttttctgaag

SEQ ID NO: 63893 - DNA, 1013 bp, Homo sapiens
gagttgggaggaggacagagaaaataaaccaagaaggataaataggtaaatgcaattttattactgggggtgaaaacaaagagcattctaagaatttaacaagcaacagttgaccaacagggaacctgctgttgagcccgtaatctgctgaggaaatttgagcctgtccctgagtactgcctgcttatctcttctcagagatcatagccccaactttcgaaggtagtaaagtccctcaccctggcggtttccagtctcatgttctgcagcctctttggcttctccccagccttctgggctgtttccttttcacagagcatcttttctacatgttgctggatctccctagtcctcaccccataaatgacaggattcaaggctcctggaagcagcaagtatatggcactgagtagattctggacattctgggacacagtcttggctactcagaaggtgatggaagtggaaagaccagagacgtagatggagaggatgaccagtaggtgggagccacacgtgtgtaaggccttggcttgggctccccaagaagagatccggaaggcagcatagatgatgtgggtgtaggaggtccccagcagggccatatcagagattacagtgaccaaacacatagccagccccagccagttgttgaaggtcaggtctccacaagctatgctcagcagtgcaatgcactcacaggtgaagtgtcgaatcactgctgtccggcagaatcgggcttttgcagttagtactaccaagggcactgtcactcccaggctctgtgtcaaggcaagaatggccagcagtcccagcagctgggaggtcatcaggtcagaatagcagagtgggtggcagatggctacgtagcagtccagggccatggccagaggaagttgtagtccaggaggagggtgaagtagataaagaacacctaggccaggcggccatgcagcgatatggggttagcataatatacaaagccctccagcattttaggcatcacggctgtg

SEQ ID NO: 63894 - DNA, 1050 bp, Homo sapiens
agatagagagtgatagtggatcccgtgtttctgtcgggggatgggagtagataaggaaaagtgtttactatttttaccagcaggggaaactacccagatgaaaatggtgctggatgctttgggcaaaaagccattcagagccataatcaactacgaagatggtcaggaatttagtgtatttgtagatcagatgatcagtctatggctttggaaaattgtgaacattagttgttgagccttataatgagaatgtgatgattaaatcaggtctactggatactatgaatcagaatagataacattgttagatataattacctagtcagagagcagagatgaagtcaggaaagcaaaagataagaaataacagaagtcttctggtggcagagtggtggcttagcctgctggggcaaaatggagctcaaggccatgagcagatacaacagcccggtcaacccagctgtcttcccccatctgattgtagagcttttggccatcgacatgttcttcaccacctggttctttgtttacgaggtcacctctaccaagtacacttgtgatatctataaagagtatctccttggtggcctcactcttcatgggctttgaagtcctcttcctgatgctctgggttggcatctacatgtgagtgcccaagagtaacaaccaggtggcttcactgaatccctgcttttgtaaattaagttttctttctattgctggaagtgtcccgcctgttgcttataataaatgcagatgtatggcattaaaaaaaaaaaagaaataatagaagttaggcagggattggggcatgaaggttgaaaacaaggaaaaggagcccaaggaaatgcaagtgttgtaaaatgtgctaagtagatgtctgagtggcattcctccatgagagaaagcttaagggaagaaagagaccctgagtgtcttcaaaactcaaagttttacgaacagaatgattagtctggagaaatcatttttcatcaatacaggatctcaagtgtttccccacaacgaacccaacccctcacacacacacac

SEQ ID NO: 63895 - DNA, 1052 bp, Homo sapiens
cttccgcaaactcctgacctgtgggtccgtccgttcaacggccaaaggctggcggaggagggatcccctgcctttctcggaacggaacggagcagagtcgtgcgtggttgagtttagataaaagccgagtgagcgcgctctgttccttaagattagtttaaggtgccttggattgctctgaagagctttgaccacctgatattgcttacatctggaacttcttggcttctcattccccagatgtgcgggtcagagaggtatgtctaccgttctgttgactggctcttattgtcacttctggcagaggtgacagggcagtgaaagagataaggtcctttccctttcggaactcattatatctttatttctttttctttctcactgcaaatgaccccactgaggttagagacattttaatcagtcagtcaatagagacagaaatgtgtggttaggagcatagatgccgcagccagactgcatgtgttcaaatcctgactctgacagacactggctgtgtgcccgaagactgttaacttgacttctttgagctttagtttcttccatctataagatggacggagtaatatgtatatcttagagttttggtgaggattgagtgagacagatttaaacacgtaggaggctgcctgacacaaattatggtcattattactggcaaactccatgcctagctttaaaaaaatgcacaatcaaaacaatttttaaattataggtttctgaaatgcagggggtagaaattcttttgaagtggaaattaaattttttgttttgaaactgattatgttccaattcaaatatttattgagtcctgttagataatcaattgcagataataggttaaatataaccctacacaaagataaaaaaaaatgttattcctaaagtgcaagaactcatgcccaactcacttataaatgcaactgccacctattttattccactttcactagggctcccagctggtggacgggcccgctctgtcattcctaactctgaacccccagcctacaccagccccagtatcccctgct

SEQ ID NO: 63896 - DNA, 1039 bp, Homo sapiens
gaatcatgagttgtaaaaatattacctccccaggctgggcgcagtggctcacgcttgtaatcccagcactttgggaggccaaggcaggcagatcacttgaggtcaggagttcgagatcagcctggccaacatggtaaaaccctgtctctactaaaaatacaaaaattagctgggcatggtggcgctcacctgtaatcccagctactcaggaggctgaggcacgagaatcgcttgaacccgggaggcagaggttgcagtgagccgagatagtgccactgccctccagcctgggcgatagagcaagactcagtttcaacaacaacaaaaaaattaccaccccttattgtggccattgctgtttctttggtttttttctgagaaggcgagcatgtggtgagagggctctatgtggagcagggccgttaagaagtggaagtgttttcacagtcttagagatcagataccagagagtgatgcaaaggtgatggcagagaggtgaaagagctcatggaaaggtcacagatgatcactgtagaggatgagggggttctgaccccctcattcatccaaagttgaggacctatatgtcaggctctatgctagctgccgaagatacaaccatgaacaaaaagtctcagatctcatggagcttacatttcactgcgaggattcaaacaagtaaagatctgtattaagtggtgtaagaagtaaaatagaccgggtgcagtggctcatgcctgtagtcccaaccctttgggaggccaaggcgggcggatcatgaggtcaggagatcgagaccatcctggctaacacagtgaaacctcatctctactaaaaaatacaaaaaaaattagccggacatagtggcaggcacctgtaatcccagctactcgggaggctgaggcaggagaatggcttgaacccaggaggcggagcttgcagtgagtcgagatcacgccactgcactccagcctgggcgacagagcaagaccccctaatgaggtgaatatgtggagagtgattgtatggtggctgtgct

SEQ ID NO: 63897 - DNA, 1039 bp, Homo sapiens; identical to SEQ ID NO: 63896

SEQ ID NO: 63898 - DNA, 1039 bp, Homo sapiens; identical to SEQ ID NO: 63896

SEQ ID NO: 63899 - DNA, 1039 bp, Homo sapiens; identical to SEQ ID NO: 63896

SEQ ID NO: 63900 - DNA, 1054 bp, Homo sapiens
ggttgctagtgtgattcagtaggatggaagggagacaagagttgccgaactaagttcttttaaacatcttgcatttgaggtacctgtgacatatttgctggtgtatatattaatcaaaatcataaggaaagggggctgagcagaagtacagatttgagaatcatcaacatgtgtacattaaaatgaaggaaatggatgaagtcagcaaaggtagggtagaaggttagagaaggtgaagtttgagaaacagccatatataaagtccatgagcctgtatcttcagcaaccagaacaggatgtaagctactcaaggatagaaattatgacttcatcatctgaggttctctaggccaggcacaatgcctgacaaataatacatgctatacatacataacattacacacacatatgcacacacacaatgttgtgaaaatcaagacactgatgagtcaattgagttattttttgatgtcttcacatgggttcttagggacagtctgccctgagttttttctctactttgtggcctccacattaggattatctttatttgtatcatatcatggggtaggggacatggaaggagaaatgtggataagggcatgacctgttactccttgacttaacctgtctttttccttcctaggatgtgagtgatgtcacagaaaggtatgtgtaaggagaacatgaggtagttcccctggactgacaaatgattcctttacccatgatcagtgggaaagggaagaagaatcagagtggggaagattcaagagagtagtcttgaatcgcgcatcacatggagttttggcatccccaaataaaggggatgaactggcctctctggtaggaaaatgtgggtgatgggaggtcagtaggtggggacagtactgttatttagaataaagagttgcagtattgcgccactgcactccagcctgggagacaaagggagactctgcctcaaacaaacaaaaaaaaatgaataaagagttgcagtatcagtgactccccaagtaccctgttagtgtacttttccataaacctctgtgcc

SEQ ID NO: 63901 - DNA, 1576 bp, Homo sapiens
cagaaggctgaggcaggagaatcgcttgaacctgggaggtggaggttgcagtgagccgagatcgtgccactgcactccagcctgggtgacagagcgagactccttctcaaaaaaaaaagttaaatcttacacaagtttatgtagatggtgagatgatagtttctagtctagctcttctggctccagtgccagggctgtttgcagaatgatgctaagtgtattcagaaaggaggattggaattcatcagtaggcttgggaggtaagggagatgggtggtggaggaacccacagtcagcagtgtgggaactcagaagtcctgtcctttctaggagtgagttctggaccctgaggaagccagaagctctccctacaaagctgagaagtatgttccgagccccagatctgaaaaggatgctgcgagtgtgtagaggtaaggagattcaggggaaagagtttggatgtgaaattactgtcgtgggaagaaataaacgggatagaggctatagtcggtatttgagcatagtggcaaagagggaggtcccagagggagggacatagtgtgctgaagaagatgcggtttgtatttaaggggagatgaaatggccaggtgacatcctcacaggattcctcaccattcccctcaatgtagtaaggagagagataccagacatgagacagttggtcctattcaacattattgactcttttcatcattacagagctgacagatgtccaaagctactggggtaagtagaagccatggcctctttgggctggcacattctgatctcctttcacatgccctccccagacatagccacacagatcctaggtgttgatgcctcccccatccccgccatatagttccagttcctccaaccacttcctgtgtttcctcttctcagcataacgagacccatgtccccgttctcatctgctgatgttgtaccttttcctacagttgacgtgaccctgaatccacacacagctaatttaaatcttgtcctggctaaaaaccggagacaagtgaggtttgtgggagctaaagtatctggaccttcctgtctggaaaagcattatgactgtagtgtcctgggctcccagcacttctcctctggtaagcattactgggaggtagatgtggccaagaagactgcctggatcctgggggtatgcagcaattcactgggacctacattctctttcaaccattttgctcaaaatcacagtgcttactccaggtatcagcctcagagtggatactgggtgattgggttacagcataaccatgaatatagggcctatgaggattcttccccttccctgcttctctccatgacagtgccccctcgccgtgttggggttttcttagattatgaggctggtactgtctccttttataatgtcacaaaccatggcttccccatctacactttctctaaatattactttcccactactctttgtccatattttaatccttgcaactgtgtaattcctatgaccctgcgtcgtccaagctcttgaatattcttctgttcccacccacttctgataagtaccctgaggcttatc

SEQ ID NO: 63902 - DNA, 1091 bp, Homo sapiens
ataagcaaataaattactttgtttttgtataagtatgtataggattgagctctaaaaccaaaccattataatgataatttgggtagcttcaaactcaaattgaagagagtcttcactacaatcttcactacaacctttggccttcctctctacatttaagagtagcaatagaacaataaaaaaaaatacgtctttcaaattaattgcagtaaaaacaaaagagtagtggggagagaaaaacaatccaatacatatttttctctcagaatagaaagaaaacacaaagagaaaatatgaacaatataaagcacttaaaggaagaggatgatttcttccagcttttccacactctctttatgcgcaggaacaaacagctgttgagtgagctgctatgactttggtagagaggtgcaatatgttttttgaaccagctataaaagaaattaagaggtacatgtgagggtagaaacaaatatcaaggatgagaatggcactggctgtcccatatggtatccaggagccaccaatgtctgttgagtacttcatacatgcctagtctgaattgagatgtgctcaatgtataaaatatataccagatttcaaatacctacttcaaaaaataatgtaaaatatctcactaataacttttcctttgtgtattgcaatgataatatgttggctctattggattaaataaagtatgttattcattttacctgtttcattttacttttttaatgtggatactagaaaccttaaaattacatatgtggcttacattgtatttctattggacaactctggagtagatcctataatgaaatttctgtccctaagtgagccctagtgtaaaagcctatggactcaggatacagaggaggtttcaaggcacatatgtttatctctacagaacctgcaccttcccagctgccctgaggcatttttatggaaggtaatgacagagaaaagaagatctcaacatatctagaagtgtagaaatttggaagatcatagaaagggctcatgaccagagaatgattctgcagactctggcccctgccgttagtcctcagtctgttgggcacttgaag

SEQ ID NO: 63903 - DNA, 1014 bp, Homo sapiens
ggatattaaggatgagagcttttactgtcagacttcggtgacttcactcatttaattcatcctctgtccctgcatccagccctggatcttttattttatatgtgtttgtcatacacatggagggccttgtcaaatcctaaaatagggcatggagacagcttctttatatgtactttgcttacttagaaatagaaggtaccggatcattatgcaaggttctctttagatttccaaaagtagactcgagcctcaggacggtagctgtgactctggtgatgataattaatctctgccagttcacacactttagaagctcctatggaaaagtgtagtccttgttccttgtgtctaccattgccaacccacttggaaacatcaagtttcttacaaagacataaaattctaaccatttttagttaggttgtcataacttctcctttgccgagtgttcgtgtttcccaggaatctgaaatctcaaatatgcgccattccactggagttcaggctttgaactcgggcacaggctgacaggatttccctacagagccccgtatcacagtcaggatctacagctcagaataccacatctctggcccctcccagaaggcccactgagatgcagtgagttttccacatatcacataccatttctacaggtagcaaagtcttttcctatcgttttatccaattttttattatttccattagatatcaaaggagggtttaattatttcatttttaaggaagaaactgtgctttcaagaaatgaagaccttctcaaggtcacccagaggataagagggaaagtagacacagtcacatttcttctggatccagggtccggctctcccttctccccctcctcaggctcagggagaagggttcaagtgcatcagtgatgtgaaggagatgaaaccagtgatgtgggagggatggacacaggatgagagatgtgggggtcaaaaaatttttttcatccctaggagtgagatctggaggctgaaaaagccaaaa

SEQ ID NO: 63904 - DNA, 1062 bp, Homo sapiens
tgctgctgatgggattatatttaatgggaaatggctaggtggctgtttcatctcatcattcagcaatttactgccctaccatagggcatacctactctttccctaatctggagagaaaatgaatttcagtgctgactcctttgtttgtattcaatattgtgcatttttatcatttcagagctgacagatgtccgacgctactggggtaaggagaagtcacattatcataagccaccctgcggcttatcattattattatctttatcttttagaattttatgttctctattaggctcatgttttaagatttatgattctccttccaagacacacataacttacccctccttataacttctaaacaaggttcctcccagttttctctcaagtctttatcaagatttctctcatatcacaaataaagttacattatatcccttagctgacctgttaatttttctacagttgatgtgacagtggctccaaacaacatttcatgtgctgtcatttctgaagataagagacaagtgagctctccgaaaccacagataatatatggggcacgagggacaagataccagacatttgtgaatttcaattattgtactggcatcctgggctctcaaagtatcacatcagggaaacattactgggaggtagacgtgtccaagaaaactgcttggatcctgggggtatgtgctggcttccaacctgatgcaatgtgtaatattgaaaaaaatgaaaattatcaacctaaatacggctactgggttatagggttagaggaaggagttaaatgtagtgctttccaggatagttccttccatactccttctgttcctttcattgtgcccctctctgtgattatttgtcctgatcgtgttggagttttcctagactatgaggcttgcactgtctcattcttcaatatcacaaaccatggatttctcatctataagttttctcactgttctttttctcagcctgtatttccatatttaaatcctagaaaatgtggagtccccatgactctgtgctcaccaagctcttgaaccttcttac

SEQ ID NO: 63905 - DNA, 1076 bp, Homo sapiens
acgttaacttggggaaggtcatatagctagtaaatagcagagttaggatactaactctgtctggctctagcatacttgctgttagccactacctcaaaaattgtagctgaggtttagaacatgagtttttagaataggtggagcaaaatgcacccattcctgggagaaggagttcaggagattttgggattggcaggtgatcctaggattgctgaatggagagatgtacaaagagctgtaattatgtggcagtaaatggtgagctgtcatcagttcagggaggagaggagtactgagcaggtgggagcagtcggttaagagccatgaaggagagggttaggaaaaagtgctcttgtcttcaagagaacactaatggaacttttgactgccttggacacttgctctttgtgcaaagattgtttgtaaggtaaattacagaatccataagcccaaaaagtccaaatttgaagtcattgggttcttggaaatctactgtgttatgcatttcccattctccagtaatccaagatacactgggagatatcatagacttcgtctttagaaggttccttggttagtctcccaagctccagttcatacttatagaagctatctaagcacatcttgggaaccaactggctggtcttttcctgtgacgttgaccattagaggaggggatctgacacctgtgatctgggggctatataccagagcctgctccccagagcagggtgtcagctctctgtgaggagttgggtggggtagggagaggggaggcttgttggatttcttagttgctgttagactgacaagaaaaataggataggagggttctgtctggagactgactctgattttctcacatttttggctagtgcagctaccaccaacatctatagaatagggttcttagataacagctggctccatgtgggcctgttctattgttttccgcttaaaatgatccatgagcaagaacacatatgagtagcttattactttacatgatagattacagatcagaaatcttgggtcctcgcggtgttgtacagcactaaatcctcttctggaaacct

SEQ ID NO: 63906 - DNA, 2335 bp, Homo sapiens
tccaggagaggaattatgccaaatattaatattgagctcttttgtgctaggagctgtgcaaaatactttgaattcattatattaatccatttggtatcctcttgaagtagttactactattatctcattttacaagcaaagaaacaggttcagagaggttgaataattactccaaagcatatagagtgagtttatagaggatctaggattcaggtaaaagtctgcttgactgaacctttaaccaacacgttcctttggctcactttagtgtgtggtgggaggagtgtctgccagatggaaagtaccaagtggtttagtgaaaaggaaatgggcaggataagagaggagccacgatgggccgaatcagaaaccccaagtttcttattaagacaagtgaaaccaaattccttcctttagcacattttgattatggttgacaaaaagaggtcacctggtgtagtatagctgcacctctgttctctccaggaaagaattctgagtgaggcaggtggagatagagcaagagagagacatacacaaggacaagagacatagatatgggataaaactgacaaatggtgcaaggagacagagatgcagtggtacagagacaatgagagtgactgatagagaatggtgtacatccagatcccgaggggattccagaatgagaaggggagggatgaggtaggtgcagggatggtggactgtggtgactttaccactatgcagtctatgcatatagcagaattgcacttgtacccttcaaatttatacaaaaaaaaaaaaaaggacgaggaggatctctttaggacttttgggagaggggctcacaggggaaattgtgactgaaaacttctgactgattacttctcagttagaagcccatacattcttctgctgcctgattatcatgattccctaggatccctaaattccctactgatctaccccaacactaagtaagtcggtctttccttttgactcagagagagactgaaactaaaagttactgaaggaaaatggatgactacttggtcctggatggagatcatgagcctaagggctgcgctctttgggccatatcctgcttataggatttgcctctggtatggcatgagagacagaccatctgcagggtatctgagggtggtctgaatggagagcatggggggaataaacagatggatctttttatccagagaacacgaggttctcagtatgaacctgtagggcagtatagaatagtattgacagcaaagactttagagtgataaagagccctaacaagtctcttcatgtctctcagacttcaaggataatcacacagacccctcacaccttatttgaaacttttagggacagatattttggaattcagtttttttcagattatagaaaaggaatatgatatatatatatcatatattaaggaataccccagtgggattcaggacagtgccctataatcaaacatcaacatttctgaagttagatgtatgaacatttacactaaataagataaataaagattataaataggatcatgatggttgagatgtcagcttttgggccaaagttataaaaaaatattgtttcttcagagttttattttggaattatggatgagggattgtgggcttataattaattctcaggttgtcatgaggaatgagagtgtggtaaagctcttgaaacacatcatatggtaggtatgtatgcaatctcaatttggaacaagatacaaatgtccaagggagtggatttttagcttgaaggaagaaagttgctacaatggacaacgtacagctctggaaccagctaccttgaaaagttgtgcacaaccaggggttgaaggtgccttagaagagagtcttcctgtggtgggagggtgacagaattcattgtttatgaacgttggctgcagatgatttccctttcatgtatcagaggggaaaggcaaaaaatggtatacctgtatgtatgtgagacgcaggattatcatacatatatttatttataatcaataaatattttactgcatatatgcttgttcacatctcaattattttcttaggatagatttattaagggggaacttatatatttttgagacaaggtctcactgtcaccaggctggagtgcagtggtgtgatcacagctcactgcaataaaggggaatttagagtaagagaatgatacgaacatcttcaagacttgtgactcattaggattagaattgtgtcacagttatctgcaaaatcattgcttggaggccagttaaacccagaacttcatgaaaaaaattagtcttgagaatgaatgagcacacact

SEQ ID NO: 63907 - DNA, 1006 bp, Homo sapiens
ttagcctccttactttacctaccttatccttgatgagggtccaggtggcatcagcttcatccagtgtcagcaggttgggggtacccaccaacatggtggggtatgggagggattgggcagggcagtggctgctgcaggaaccccaggcagcccagggaggtgagacctgaggtcttgggccctaaaccactgcatgacatcatagaggtcctgctagataattgtaccttggatagggggaggacagtgactttcctagcttcactgcagtctgtaattcttactcttgagtcacctatccatcctcctgcattaggggaagaaaatgcagggtctgttagggtgtgtttgtatatgtgtatgtgtgtgtgtagttcttggtctgagttctttaaggaaacaggatcaggcctctcctcccttcagcagcatctctgaagcaatttactatcttagctgcagatgcttctctgtgaggttggattggggtcctaaaggacacgggagaagtacagttatgagccacctaacagtgttttggaaaatgatatgtgactgacagtggtctgacgccataagagtataatgccatgtttttactttactttttctatgtttaggtatgttttgatacacaaataccattgtgttacaatttcatatagtattcactacagtaacatgctgtacagatttgtagcccaagagcaataggctataccatagagcctagctgtgtagtaggctataccatctaggtttgtgtaagtacactctatgatgtttgcgcaatgataaaattgcctaaggatgcatttctcagaacataccctgttgttaagcaatgcatgactatatagatcagggcttatactgagaaccaagcagtggtcccagccttggctgcactttggaattgcctgggagcttaaaaattactgttgcctggatcaattactggtgccagagattctgatttaattgatctggggtgtgcctgggcatc

SEQ ID NO: 63908 - DNA, 1156 bp, Homo sapiens
agtagaacttagtcactcaggaggtagggaaaaaagaatcctcggctgtgcaccctggctcatgcctataatcccagcactttgggaggccgagacaggtggatcacctgaggtcaggagttggagaccatcctgaccaacatggtgaaaccctgtctctactaaaaatagaaaaattagctgggtgtggtggcacacgcctgtaatcccagctactcatgatactgaggcaggagaattgcttgaacctgggaagcggaggttgcagtgagccgagatggcaccactgcactccacagagtctcaagaaaaagagaaaagaatctttaaggattcttcttaggtgactggttacatgggtgatgtctttaatcaatagtaggttacgcagaaatagatttggaatgtccattcttataccatatctcttacctcatagtatatgccttctaccctagctgcaaggggtagttcttgtagggaatttgaggcctcatctttataatgttagttacggtatactttcagggattttagttaatcgtgtgtgtgtgtgtgtggtttgtttgtttgtttgtttgtttgtttcatcatggcctttttggggttggtaaccctggaaagtttatttcatgactaattgggaaacctataagagcctctctagtaattgtacttaagtatggtttcaacccattcaggattttgtggctgatgtttctggttctctgctctactagggagcaagggcacacagaatttcctctttgggcatctcttatatttgagcccagtgcttacagtgctgtactctactccctacctccaggaccaaatttcgcacatctatgcccctactgatggcattgccctctttgttggccttctggtagaattcaccagtggctccttaaggctgatctgctttttctacaaagctgttttggaagtactgcctcctagcataagaggaaggtagctaactatggagttgcatctgcaccttggataagctgaggtagcttgtagactactgtcttgtcacctggctgaaggaataactgatgttcttttgtggtctgcatgggacagtttcccatcattccttctcctttgcttcactggaaaacacttccttttgggtggggctctgaga

SEQ ID NO: 63909 - DNA, 2786 bp, Homo sapiens
agaggctttggtgcaggacagggactggtgaatggtgaagtggtgaatggtgaagagcatattttggagggacagtagagcatgacagaagtgaaattgtcactgaactataattgcatatatagcccctgtggatattgtaggagcagaggatgtgggttgggtgttatagataggctggggaagagggaagtggttgactagttcggaagggtgatgggaagcatgaaatcagggcatgctatagacagaggagaaatagcttggtggtggtagattagtgattggaaataggagaattcgtcagggtgagagggcatggagaaggaatggatcttaactgggaatgaagtggctaaagtgttgattgattaagactgagaaggatggttggctgggtggggaggctggatagagggaaaaaggctgggcaggcagtatttttggtgttggagtgagaaagaactcctcactctactcctcagagtcaacttcagggatgggacaggaaatggtacctgaggttcatttctggtccattttgtccttttttccatttcctcagaaccctaaaggagaagtccaagaacctagggggtgggggaatctcccctctcagtccaagggaggttccctgatcccagcaccttcatgatacccctgtttattcccagtgaagagccggaggccatccttgggggagttactcctgcggcatgcacacagtccaaccagggcccggcaggcggcacaattggtccttcagcctgggcgagacggagcaggacttggcctaagtgggggctcccctggggcttcaactccagttctactcacccggggcggggcccctgaacgccaaggtgaggctcttcgagtcaagaatgctgtctactgtgcagtcattttccctgaatttctcaaggagttggctgccatctcccaggctcatgccgtcacctcgcctttcttgttggagacttcagaggaaggatctggccctctcatctcaggctgtgggcccctcaatccttaactttcttccatggacaatcagggccatgggtggcccgggctggggctagggcacaggctcctttttatgtttggaggcagtggcaaaaggactttttaatttatttcagatgaatgttttatggagaacttgttgcaatatgtataaaagggaaatctctattctgtgctcatttttctttcccatttttttctgtggggctggggccccagaaaaggttgtacatagtcggggaggtggtcagaagtattttctctttggtaaggacattgctgccaaggtttcaaggtaccccttatgcccttagagggtgaagggactcttccctcttctctggatcccagaaggaataagcagcatgggcccaggatggtttgggggagcagcagctgatgtttattagagaccagtacccctatgccagatcttgggggctttgcccccggaatcttttgcttcagcttcagtcgtcactgtcgaactctgaggatagaccctgcagcaggggcagggacatggagtgcccgtcggggtccctggggcccccaccctgggctcctggtggagggctgcgggggctgaagagccagttctctgccagggttggggatagtcacagcttgactcatggctggtcttttccccccctagcttttccctctggtcctctgtgccatcccaatccccttcctagggcctcctcattccatctcaccctccccagtctccctcattccatctctttcaccagagccctgtgctgagtaatggattcctcacatacttaattctcatgccttctccctccttcactttgtccctcccatccatctcatcatcatttcccctagtagtacctgacagtatctggggccccctccagaaggggtttcggcccttgtaggagaatctggtgggtttgtcctctggcccttcctggggaggtggcgtaggtggggctgggacaggtgggggcacatcagcagcttcagttgtatcagcaggtgctgatgtgggggccagaggcggcatgatgctgaggttgggtctgacccagttggccccatggggcaatgggtctttagtgagaggcttctgtggtcccagcacgcccttagactgcagtgaaaacttgaggcaggagaaggcaacaggtaatgaccgaagtagccggaggagctggggctcacgggctgtagacgtcagccccagctgcagccaggaacaagagaagacctggtagatgacatagatgctgtgggtgcttcggagccagggaagagtctgctgtaggctcacctgccctggtggcagcaacaggaaggcaaccttcttgcgcaggtcacccatatgtaggcggatcttgcagggctgtccatccaacattcgcgtctcttcataggctctctctgctcggccatttggtgagtattcccgagtgcagtgggcgaaggcaccctcagatcctgcctgctccaggaggcttggtagtggccccactggtttcagtgccctccggccctgccgacctggcaaagccaggcgggtatgggctgggcgggactgttttaccagcacacccagtaggtcatagcaggctgcatctgacaggaaaggtactgctactgcattgggcccaaagtgctcctcgatgacctgcaggtggccagtttataggtcagggacttagggtcagaagttaactggttgcctactttaaattgacccccaggttcacgttcagttacat

SEQ ID NO: 63910 - DNA, 1023 bp, Homo sapiens
aagtacctcattgcccgtggcaagttggactgggctgagggccctgcagcaggacctgccccacgccgttctgatcccctaggtgaggcctatcccaccacacccgtacctgccctccctagatagcctattaacccaggttaattgagctcttattaagagtgaaatgttgtgccaggacctagtgagttgtagaaaattgagtcttcatgtttgttctcaggcttctggtcaggggacagaacatagttctatctattaagagccagatcagcagttctagcaaaaactactctagaatttggggacaagaaagaggacagagtagtctctaggttgcgatattattacagcttagtaaaggacatgacatttgacatgggccttgagagatgggtaggacttaggtaggcaaaggagtggggaatctttttttttttttttttttttttttttttcaggagaggtcctggactgtttagttggagtaggggatttaaaagttggtggaataattggcagtaaggctggagagatttggctggagctgaatttctcagagtagaagttgggatgttttaggcagtgaaaaaccactggaagttctaaatctggaagtggagagattagtatgttagctcagatgcagtcaagctaggagaaaagagtcaggaagcatcaggaggcttctgctataatgtagatgttaccagggaggcttgaattagaatagtggacgtggaagggaagcatttaatgaggcagaaatgagaaggaagtgttggtggagtttggtgagtggtataaggaaggaggaagaattaaatatcgttatgaagttttaaatctagacttttcgcttaacaggtatcttgaacatttgcaatgtgtgccgggcattgtctttagtacagggaattcagggaggtacaagatgtaatttctgccttcaaagaatgtacaatctggagagtgactagaggaacgtaataccagaaggagcaaggtcctaaaggtgttggg

SEQ ID NO: 63911 - DNA, 1072 bp, Homo sapiens
tcttggttcccagcttctgaaagacaaaactgatgtcttctctggtcctccaaatatttttttccctaactttaaattggctcacatagttactttgtctttgcaacaccatcttctagctttctttctgagcaggtttagtgttatcctccgttttttgtggaacctaattctttttggacctaattactttctcaacctatttgttcttctgttgtgcctcttgggtgaatcttttataaaaacaatatgtaattgtagcttatggttataactgaacacttaaaatttgccagatctgaggctaaatgctttatattgataactctttgatcctcttcatcaccttatgaggtaggtatattttcctattttacgaactaggaaactaaggcttggacaattttgacctgtccaaactagtaaagggcaaagccagtgaaaccagatctttcagagtccagagcctaagatctggcttgtcagcttgaatgtgtgtaaagctggcatctggaatcttgtgggtccatatggtgtctgccatcttatttcctccagaataggtggccacgggatatttaaacatacccagaggctgacatacaaatacttttcatctggtgggggtctcttgttttggggaggaatgcgtgcgatgtgcattgtgttcaggctttgtatccttgtgcccacctcccccccaacccaggccccttcatggctgtgctctttgccaaactcgagaacatgctgcagaactccgtctatgtcaacttcctgctgacggggctggtggcccagctggcctgtcacccccagcccctgctccgctctttcctgctcaacaccaacatggtcttccagcccagtgtcaagtccctgctgcaggtgtgcgatgcatgcatgcatgggtgcgtccaggctccgtggtgggccaggcccgcagctggagtgaccctgggtgggctgggaacaggcccagtgggactagaaaggactgtatcagtctagagctgctcagaaatgtcacgaaggtgtgcttcataggtgctgggctctgtgaagaataaga

SEQ ID NO: 63912 - DNA, 2004 bp, Homo sapiens
gaggttggagagttagctgtctgaatagattccatgtttctgcctccccattgtcttctttcttagtctcccgaggtgtcttatctctccttctgaacctctgtctccttgatttctcttatattttttccctttgcaggtcctggaagcccaagtgtggactcctcttctgtgacgacagtaccccggccctccacaccatctcgtctggctctcttcctgcggcagcagagcctgggtggctctgagtctccaggcccagccccttgctcaccagggctttctgcatcccccgcctccagccctggccgacggcctacccctgcagaggagcctggagagctggaagacaattacctggagtatctgcgtgaggcacgtcgtggtgtggaccgctgtgtccgagcctgccgtacctggtctgccccctatgatggcgagcggccctctcctgagcccagtccttttggctcccggactaagaaacgcagcctactgcctgaggaggacaggaacaacgtgggggaaggggaggaggaagagctggggaggagggggcgggctgggggtgcaggggagggccctggtcacctgccccctccccagctcaatggagtgccaggatcatggcctgagggggccaagaaggttcgtctggtgccaaaggagggagctggggaactgctagagggcatctccgagggcatggcaggactagagggctttgggcaggagctccgggagctagaggtggcattgagcaatgggggaactggctcagagtcccccttagaacctccactgccccttgaggaggaggaggcctacgagagcttcacctgtccccctgagccccctggccccttcctcagcagccctttgcggactctcaaccagctgccaagccagcccttcactggtaagctacttagcctaggccttcccttctgtgtactctttgcatgttctcgacatgtttgtgctggtttcttggacctcttggccatgtcatttctgtgtacttgcctagcccctcatccatcctgcttgcatcacttccagatacgtgtcatgtcatacttgtgtccctgtgtctgtctgtacgtcttccatgcttgtgctggtttgagtattgacttacatctgagccttgtatgtatgtcctatgtgcatgttcctcctctttccctagtctggccatttcctgcgatttgtaattaggatattctgtgtttgatgtttcctggtgaatcacagcaatatttctgaaccatattgaagacgtatgtgctgtcctgtatggagaggcacctaaacactctctatgccattccgtccagtttatctgtctgggtcttgggttttctgtcagctctcctggggcctaaggttaaccttctggtatttttctccctactcagctccttcctccccacctcttcaaagaaggacttgatttcaagtttttcctgttcgctttccttgtaccttcttggttgctgtgactgtctgctagcactaagactgtcttaagcagatagagtgcaatttctttgaaggcaaatgacaaagcgtggccctgagctccctgactgagttcatttggactctcaaggatgccctggagctagactcgatctgagtggttggactaactcctctttgtttttgtatgagagccagcttaccccgccattctaaacctcaggccaggaaaaccaaaaaacaaaaaaaccaaccaaacaaaaaacaaacccacctctgagaagtagtagctaaggctaagatcacaggccttggattaggcataccttacattagcctcccatctctgccatagatgcatataaatcatttactacaattatggcacattgtgagaactcagcaagtggtagcttttcactaggatctctgggtacatagcagatttaagttgactaaggcaaacactcatcttccagttgttcatagtcagattgtcatgccttgataagttcatgt

SEQ ID NO: 63913 - DNA, 2323 bp, Homo sapiens
gggagatgatttgaaacaaacaaacaaacaaaacgagcaatgacagcaatgtgaaaagcaggagaaggacattctagtctaggcagagggaacaaaaagtattcaagaaggcctgtgtcactaaagtgtgagtgagaaggagaatggtaggaagttatacagattagattatgtaggctcctgtaggccaagataaggaatttgaactattacagtgtgttaggaaattattggagagtattcagcagaggacaggtcatataatttaggttttaaaaatatcactctggttgttttgataactcttaggaggatagtaaaggaatcatggagaccagattggaagctactgcaatagtgagacatattttgaaggtagagatgatagagtttgctgatgaactggatattggaagtaaggaaaagaaaaaacaaggataatgtacacattttcagcttgagcatttaggttaattttggtatcattttcttttgagatggagaaagttgaaggagtaacaggtttggtggtagaaatctgagttctgttttagacatgtcagttgctgattgtgtgtatgtgtgtatgtatatataggtgtgtggagttttcagtggagtggtggttctgagttctggaaagtgagcttctatttatcccttccattatctcttctctgaattagatttagaaatctggactggccagtgacctctgggcttgccattccagcctggtataacctctggctccatgggcagctactggctcctacagaccggatgaagcagactggagacacaagtggagaaaacctccagctggcaaatcctcagagtgtaggcctctggctgccagtcctgcccagcctgcctcatggagaggatgaattggctgagcagactggcctcccggggccctgggcaccgtatacctcaaggggccaatctccaaaccccagtcatggctgatcccgagacctgcctcatggtcttcaagaatcactggtcccaggtaggagactgtatggcaaagggccttgtctgctgatcacctgagttctcccagccttctatattctcctcatcccatttagtaaccttatcaatttagattccttccatcttctgtcctttttccctaggtggtgcgaatcctggagcggcaaggccctcgggcagctcctgggggtgcagacgatctcagtgctgtgcgcaaccacacttaccagatgttgacactgctggcagaggaccgtgcagttccctcggcccccacaggccctgggcccctgctggagtttgctctgcacgaggatctgctgacccgtgtgttgacatggcagctgcaatgggatgagcttggggatggggtcgaggaacggcgggctgagcaactgaaactatttgaaatgctagtgagcgaagctcgccagccactgttgcggcatggtccagttcgtgaggctctgctcaccctgctggatgcctgtggccgccctgtgcccagtagcccagcactggatgaaggcttggtgctacttctcagccagctgtgtgtttgtgtggcccaggagccttcattgctcgagttcttcctgcagccacctcctgagcctggagccgctccccgtcttcttctcttttctcgccttgtcccttttgtgcatcgagagggcaccctgggccagcaggcccgtgatgccctacttcttctcatggctttgtcagctgggagccccactgtgggccgctacatcgcggatcactcttacttctgcccggttagcaccccctggcttggagggtagggtgtggtgtgtagatactgaacagcaccttcctatccaggagatggggagaggctatgttccagggcccgttcccctaggaaacagttcctggatttgaaagcagccccctggagttgtagtggggatgaatcatgggcttagatggatagggcagatactaagtctctttgtaggcctgtgaattctaggtgagtttcaggcacattgggtaggcaaatgcttgctttggtaatagcttatacccctattcccatcaaaactctggattactagctcccctgttccagtttttatattttataaatgtattttatatatgagcttttggtaacttctcataggtgctggccacagggctcagtgccctgtactcatcactgcctcgaaagattgaggttccaggggatgattggcactgtctgcgacgggaagactggctgggagtgccagcccttgcactcttcatgagttccctggagttctgcaatgcagtaattcaggtaggactg

SEQ ID NO: 63914 - DNA, 1051 bp, Homo sapiens
gtgcctctcttctctgaatagtctgtgattaaggcacactaaatttgcaactgttctttgaatttttcgtgttctttcacggtaccatagttttgtacgtactgtttttaatatgaagaaaacctttccctctgctctctgcttaattagtatctcattattaaagatctaagttcaatattaactctgtggaaccctctaatagcccaggcagagttagttgttttccttcatgcccccatgacactttttataaatacttctatttacaatatttgttggatttatgtttatgctacctcaactgtttttatccatctttgttatttccagtgcttacttagaacagtgcccagtattttatccatatggatatacattgagttaatgagtaagccctacctgctctttaggactgggcccctccctttataagactcacctgttctatagaaattttgcttaaacatagtggctaccttcctttagttgtgagctggaaattgtgtgagagagtatctgggtgaagggagatattgttaatataaccttagggcaaaatgtggggctggtgccaggtctctggattccttcggcctttgttgagtataaagaggaaggacaactgaaccacccctttcctttcaaggttttatgcttgtgagagacagtactgatgagggtgtggtggctgtaaaggagaaggaactatggttccttctccaatagctacttggtacttttttcctttttcttgtgaggatgtcttaccattttcttgggagcgagtttgggttgtgtctggcaggagtggagatgggaatgtgtctgtcttccttactggaaaggaaacagctcttctttattggttggctctgaattcttcctcttaagagtattcagtcagttaagggtcttatttgctcatctcccataggtcactgggtaggtttctagggaagcacctgtgatagacagaaatttcttcttcagtagtcccagagggctagagtcagatcaaggctggatttcttgattgattgttcattca

SEQ ID NO: 63915 - DNA, 1020 bp, Homo sapiens
cctatttttttttttgagacagagtttcactcttgttgcccaggctagagtgcaatggtgcgatcttggctcaccgcaacctctgcctcctgggttcaagcgattctcctgccttagcctcttgagtagctgggattacaggtgtgcaccaccacacccagctaattttgtattttttaaaatagagatggggtttcaccgtgttggtcaggctggtctcaaactcctgacctcaagtgatctacctgccttggcctcccaaagtgctgggattacaggcatgagccaccacgcctggcctaccctatttttatcctttctcattttactgaatttcctgaaagtacatcttacatttcgattcctattctttaactaactaatttgactaagtttgtaaaaaacttgattgcaccatttttagtcttcattctacttgatctttctatagaactatacactatgggcaacctccagtttcttgaaacttcctttctttgatgtctagatcatcgttatttcttgggtttctccttttatttctggctcccttcaaagtcttctttaaagactcctcctttttaactttcctacgtcctggttttccccatgattttacccttacctcctttcatgatctgctgttctccttggataattccatctacttccatagcttcatagttgtctataagctgctaactcttgaatttgtatcttttgtcttgattttattcattatctcaagtatggtattcctacttgctttctggacatcatgaatatcctgtagatgtctcaaaacttaacatgttcaaaactgtactcaacctcttttctaaaacacaattccccttcttatgtgtttctagtctgttaatggctttatcttttactgaatctcctatacttcctatgagagtcttctctcatcccccatttgtttgccaggtcttgttgcttttactttgcggttaatttaaatctggaggcagatattctgcatttgcattttagtcc

SEQ ID NO: 63916 - DNA, 1047 bp, Homo sapiens
tacacatctgatctccgaactccttggcttaaaaacttttggctctttgtgtcctgtaggacaacatccaaatttcttaatatggcatcatttagcttcagcttacctctccagtctcgtgtgccactccctagtctgtattctagtttgaataaattgttcacagttccctaaaaccatgctgcttttttgagccttgaaatctttgtaatagctgcttcctctactaggaatgccttttcttctctgcccagtgaactttccttatcctttaggatctagttcagtttcacctcctttttgacatctctgtcaaggtagagataactgtgtgtgacatgaggattcattgctgtaaagaggagtcactgtagaatagaggttcacttttgtgaattggatggaccccgctggagtcagatgaggagatccctgcaagaagcagaagtgatattgcggggagggaagggaatgagttgggaccataccctgacatcccatttgtctgagggatggaaaagcagggaagaaatgtgtaagctgagctctagtataaattcctagtaggtggtgtttttggttggttggtttttccctttgtatttctatgagattttaatcaggtcattcaacttccagtatttagggtaacagcccattcatcctccttatgtcagtaattagtcttcttgcctaggaagagccactgtaaggagagagacaccacagaattttactgacctgttcttggaagatcattttggtctctctgtccaatgtaggtgttgcaggtatatcccttcccccagctccctcctctttgcctctcccagggcaaaggttcataagtgaggctgagccacttcctgccctgtatctgcagttccgaggttggttgtcacccttgctgtgtgtggctgtaaggctgtattttgggctataaggtgagtgcctgatcttggccattttgggtctgagagatcagctcgttcccctttttactctgtggctgagcctgaaggtaaatctggagagtggcaggttctg

SEQ ID NO: 63917 - DNA, 1831 bp, Homo sapiens
ggcggcctgaactcacctaacaccgcagcagcaaccgggcccggccaggttcggcgttccgtgagtgaacggtacgcatgggccagagggcctggagagtcgtttgtggggatgagagactgggaaaagacggtgacgggtttggttactgtactggttgtgaggggttggcaggtggtgagggtccgggtgtgagtgtctaagatagggaaggagggtgagagcttacaggtgagtggacaaatgaggggctgtgagaggctgggtgctttcggaggtgccaagttgaagggactcctgaacgcggtttactagggctggggctactgagggctggtgtgaaggataccctgggactagagtgaggggtaaggcctgcgcgaggagagagagagtaaaaggcgcaggtgggagcctgcggggtggcggcaaattggtgagggagttgaaggcgaggcatgggaggagggaattagggcttgtgagacttggataaaggtgagaggttggttctgaggcctccttcgatggactgccctgtccagtgagagcaatagttttagacaaagtagggcagcttagatggaagtgttgtgcacctgactcctctgctcccatggactttccatattctggaggacgagaaaatgaaggtgtcataggcaatagtactatggtaatgaaagtcatatttgaggctcagacttcaacagagtaatcacagaaacttcagttccttcgagttccttctctggactgcatagttgaagatgggccctctcatgaagggttttgcgctgtgacagcttgtgttttctctctacttgcttctggacaaccttattccactgttgctccttacctgtgcttaactgtgggtctttgattggattgaccatattcagttgctaattctacttttatggaggtcatatggtttgccctatacagtactatatttaggatcccaaacaggatggccttactctcctttcttacagttgaattttttaaaaagctagtttatattatatttaaaatgtgtgtttgatgagttttgacatgtgtacacatctgtgaaatcatcatcagtctcaagatactgaacattttagccacctgaaaatttatctcttcctctccacaccctgtagttgggttcatcttactagcattcttttaggtcctcttctccccaccaacccaaatgcacgtgaaattctggaaagttggtttggcattcagtgataatggccactttcacactactaaattttcctctctactgctagtcagccatggggttgggacatcctattctttccagactcagaaagagttaagtctttccttaactctacagtggacagggagagaccatttcctgagaattagacagcctcagtccccattcttttccagagtcttagcttcagagccaactcctatatcctgtggtatattctcattgcttctttctggagtccagacaggcctccatattggtagaacacttggcaacttgcccagtcagtcagaacttacagttcagagtttagagtagtggttcctaaacactggaccaaggaccctgtacatgataaaattatcatctatccaagatggagggagagaaagacagtatggttattcatgaagataaatttattctcagagattatcattcctattcttttggtgttgcagtgctctttcgttgatgcagtaatggtaacagtagatggtgggttaaaaaaaaaaagatctaatttacccaaataaaaagtgtcaacccaatttttaattttaaaaattatttctatagctttat

SEQ ID NO: 63918 - DNA, 1002 bp, Homo sapiens
tgggggctggggctgatgctggtgcgctgggctcagaatgcatccctgatggagagggtggcatctacaatccatcactgagtttgctcccctttggggacacccatggctacatgccaccatcaccccattgtgacctttgtgaagtaagaaaataatgcagacagtgcctgaggaagtcagcttgccaagcaaaggcctcatgccacaggccgctgagctaaagaagaagcgatggcctggtgctgcctgagttacagggcaatatctggaaggcaaaggtgtgcactgagcttggtgcactgagtcctgcccagccccagtttggaaatggaggcccaaggggtggtggccaggggttggcctggttcctctgctctgcctctgatttctcaccatgcgctcctcccactgcagaaggaacccaatgtggctcgcgtgggctccgtggccatcaagctgtgcaatctgctgaagatagcaccacctgccgtgtgccaatccattgtccacctctttgaggatgacatggtggaggtgtggagacgctcagtgctgagcccatctgaggcctgtggcctgctcctgggctccacctgtgggcactgggacattttctcatcttggaacatctctttgcctactgtgccgaagccgccccccaaaccccctagccccccagccccaggtgcccctgtcagccgcatcctcttcctcactgacctgcactgggatcatgactacctggagggcacggaccctgactgtgcagacccactgtgctgccgccggggttctggcctgccgcccgcatcccggccaggtgccggatactggggcgaatacagcaagtgtgacctgcccctgaggaccctggagagcctgttgagtgggctgggcccagccggcccttttgatatggtgtactggacaggagacatccccgcacatgatgtctggcaccagactcgtcaggaccaactgcgggccctgaccaccgtc

SEQ ID NO: 63919 - DNA, 1016 bp, Homo sapiens
gatctgctactgcagctggaggatgagacactaaagctagtggagccacagagccaggcactgctgcacgcccaacccatcatcagcatccgcgtgtggggcgtcgggcgggacagtggaaggtgggaatagggcttgggattcgagggtgggagttcatccagcatcagagtcctcctctctaactctgttatttgcctctcttgtgctgctggacccagagagaggtactatgcctattttccccctcctacacctggaccagatgcctggaagcacccaagctcccctcttctgccctgccccttcccacccgctatgctccaccattaccctccacctcagcatgcttgcctgtctacccctcccccccaagaaggcagcacctatgggggaccagctgtgggcagaagccctggaggagctgtgatgggcagggaggacgtgggtggggtggggaccaggctcagcactggatggtactgggagacactgaggtgccccttccccaacagggactttgcctacgtagctcgtgataagctgacccagatgctcaagtgccacgtgtttcgctgtgaggcacctgccaagaacatcgccaccagcctgcatgagatctgctctaaggcacggccccctccactccctggactagttgccacctttgctctacaagggtgtgggtggggtcactgagtgctgtaggggggccccagggcaatgaggctctaatagattctccctggctcctcgcctcccttccttcctcagatcatggccgaacggcgtaatgcccgctgcttggtaaatggactctccctggaccactctaaacttgtggatgtccctttccaaggtcagtgtcaaaacccctccaggtccagctcagctttgttggcaaaggtgggtgacccaaggaaaggcatgagctcctggacagcgctgatagaaaaatgaacacatgaagactgaatactccaatacgtggagggactccggttaaagggaggcag

SEQ ID NO: 63920 - DNA, 1651 bp, Homo sapiens
gagacataattgtggcagactatgacaaccgttgggtcagcatcttctcccctgagggcaagttcaaggtgagaggcctgctgtcactttacttaccctggtgtccagctgaactgaccagtctagtgcctcttggtggtcagggtctggactgatccaatcctacctcctcctactccctgttctttccccagcccaagattctgctttggtactgggttaggactactttccccactgtcagaataaagcctcttatggatattctcttcctccagaccaagattggagctggccgcctcatgggccccaagggagtggccgtagaccggaatggacatatcattgtggtcgacaacaagtcttgctgcgtctttaccttccagcccaatggcaaactggttggccgttttgggggccgtggggccactgaccgccactttgcaggtatagggggacagctccaagatctatgctgatacccctgttccagagaactcccctagataccccagctgtaaaggccctctcctcctatatcttggctctggagatcccacttcccttacgttagccctatcatctcagaaataatttgtctcagtcctggagaccccacccctctcctaacaccctagcttttatcttcccagatactcttccccatcccactcagcatcccagcttactgccctgaagaccactttgtattttcagggccccattttgtggctgtgaacaacaagaatgaaattgtagtaacggacttccataaccattcagtgaaggtcagtgtcttccctccctccgtgaccactgtcccaacatcctttcctcttccacaagactcctctctattttacctcctccttttcccctttgagatcattcactcaaacaatacacatttacacatttatgcatggctgctttgtcccaggcagtatgctagaagctggagatacagtgatgcacaaagcaaatgtattctgtgtcttcttgattatagtctagtagggaagagaaaaaggtaaccaaaaaattacaatatgatgtaatagattctgtgataggaaggtgcagggaactgtgggaagggatacagaagtgtatgattcaggaaagactatatgaggaggacctcaagcacaagtgggaattaaatggaaggcagaggaggacgagagtgtttgagacaaaagacacaggaagagccaagaatgcaaggtgggaaccttaatagtgtgttcgagaaatcacaagtagttcagactcagcttgaggaggggaccgtgaaagctgagagtgaggcttgtgtgcccccttaaggggcttgctctcctcccaagagctatggggagtcacaggattgcaggcaggggagtgatgcagtcctgtgtgtcttagatcactcaggctgaggcaagactgagacaggaagatcaatcttttgcagtgatccagatgagaaatgatgtgagcctggaccgtgagaaagacgagacagtgtatgcatagggtatagacttgagagagggatttgagatggaatcaagagttgtgttaattcattggcctatcaaacagagaagaaattggagtcaagagtgactcatggccagctgggtggcaccagtcattgagatagaga

SEQ ID NO: 63921 - DNA, 1047 bp, Homo sapiens
aattttgattttatcctataggggattgtttctaactaccatgcactttacttcttcgaaacattttactgggtagcaaaacttttcgctgaagatccttacttctaaacacctatacgtttaaacttcctgaccctgcttgagtactcatgtcatcgatccagctctgctaaggtcctttccctcagtgacggctactctctgacccctgcttttcacctaacagtctaaaagtgcaagggactcttctgtggccatattcccagttctgtccagtcgtcctttactcctaccctatttctaagagcagaggaatggagaggccctgtgcagcacaggaaggcatttgggcccagcctggatagtgaggaggggattgcgggggagtaatgaggtggtgctcagttccctactcagttacaccttccagctcctttccaactccctaggctgggaatgcttcctggcataaaagttgagatttgggaccccttctctgttgtgcacacacacaggtgtgctcactgctcacatgcacagaaaaacaagtgccactttgtctgtcctggtgagggggctgaacttcctcatagtttttttttttttttttgagacagggtctctgttgtccaggctggagtacagtgctatgatcacagctcactgcagccttgacctcctgtgctcaagcaatcctcctacttcagcctcccgagtagctgggactacaggcgcatgccactatacctggctaatttattttattttatttttatttttagtaaagacggggtttcactatattgtttgggctggtctggaactcctaggctcaagctatcctcctgccttggcctctgaaagtgctgggattacaggcatgagccactgcacctggcctccccattgtttcagagtggggaattgagagggaacacctggtatagctccactctcttccaaacacctgctacttctatagcagtcctcctcttgcttctacttccacctgccctctatgtcgccactgctaggagcctggctcag

SEQ ID NO: 63922 - DNA, 1072 bp, Homo sapiens
cttctcctgccactccctccctgttttccctacagacaaagtaccctcacatttgccaaattcagtggacattttcctgtccttaccttacccaactcgtcagctgcttttaacgctgatgactactcattccctcctggaaatgtaccactcagttttctgccctaacacagctgctcttcctgcctctcggcctggtcttctttgttgtcctcattcagtttttgctaagtgctctgtccctctctcttatcactgtctatgctttcttgtctgatctcatcctctcccagtgctaccgaagccatctaaatgttgatggcatgcccatctcttgtctctaaccttcattctcctgtctactggtgacctcaacctgggtgtttattgttacagtaaattcaaccaggacaaggctgaactttcctatagctactcctctttctatgtttctcatcttagtgaatgtcaccactatccactcagttatcaaagctaggaatttggaagtcagcgaagactcatcatctctcttgctccccatatctaatcagacaacacctcccaccttccctccttcttaaacacttctcaaatttatttccacctcatagtctacattactattgcctaaatccaggtcttcttcacttcctacctagatgattgtaagagtatgctggctaagcacatactttgcatttgaagacaggcttcagcacctactgctgttgttaccttgggccacttgccctttctcctgctaacagaaacgtaatcagaaagcatggcacctggcacatatgcacttaataaatggtaactagctggtgatgccactgccctcgccccccaaccccatctgctgtctcattccctttaaattcactccccacacagagggggtgaagaggagcttggtaaaatataaacctggctataccactctcttgcagcttcctattgctggcaggataacttctaagctccttgacttctgtcaccattccttgccttggactttgtctctagccagccacatcaaactgcttacagttgcttattcatacta

SEQ ID NO: 63923 - DNA, 1033 bp, Homo sapiens
tgaaattggagagaataagggcagtttaagggggagcttgtaggttttcagaaagtgtttggattttattttaagtgcaatgggaaaccattggagtttttaaaaatatatatatacagggaaataatgtaatgtaaaaagttcaccctagctgttatggagagaatggattataaaggagcaagagtggaaacagagaccagttaggaagctatcgtgagccaggtacacttgacaaataggaaggggatattgctgaattagaaggtgttttgcatggggaaacactagattcagtgagcttggaagaaagctgctgaagaatagagtagaatggttgaaatgcagtgatagttgatgagaagtgggtgttagtgggagcatgggaaatgggggaaaagatcactgggggtgagaaggtcaaggaattaagaaatcacaatgggggatggatgttagtgccactgagaatgatggcagagtggtgcggggggtaatggaagaagagagtgagccaagagaaagatgtccacaattggaagtgggggcaaccattaggttagcagagacaacaataaggaggagtgatagagatagaaggcatgagcttcaaaggagctagagttgaatagttcagaaatgttccagttgggaagagggagggctcaagcccaccttctggccctaaggagtgtggagtatgagacagaaaccactctacttgagaggactgcaaggaaaagtaagtcacaattaaataagttacactgggcatggtggctcatgcctgtaatcccagcactttgggaggccgagacgggcagatcacctgaggtcaggagtttgagaccagcctggccaacatgacaaaaccccatctctactaaaaatacaaaaattagccaggcgtgatggtgtgagcctataatcccagctgctcgggaggctgaggcaagagaatcgcttgaacccgggaggtggaggttgcagtgagccaagattgtgctactgcactcacacctgggtgacagag

SEQ ID NO: 63924 - DNA, 1047 bp, Homo sapiens
gcattctgcacagaagaaagaccattggaaaagctcatgtgacatgagaaaatatgtcaggtaagaggcctggaggaagcctggtagggctagagcagagtgagtgtgactgagagtattatgggatgaagctggagaggtaggtggaggccagaccacctagggctttgtagacctgttagggaatttcacctttaccctgagagccacatgaagcctttgcagggttttatatgtgatcacatctgtattttgacaatattctcttgggcccttatctctcattgttctgtcttgggtggcctggtccctaggtcttctcaccaccactgcctctatccgcacttttcctctgccttctgccccaacggaaacctggctctgcaccagagatactgcttccctgccagccctgctctttgagattccagctccactgcccactctcctttatcaactggaaatggcctcagttttcctgtccattcaagttcttctgtcagcctggggacaaccaccctcttgtgcctgttggttcttaactgtttcttcagggttgtcccccattccacctcagtaacactccctcccaaccatgccctgaatcttataatccagaatcttatctgtagtcataaacgccaacgttccactcctggctcccgttaccccactcccattacaccactttcgatacaatatagatatctagcccctttgactgctccctcttttcccagtcaccagctgcgtcctggcctccctgtctttcctgcccatcctggaccctgtggctgaccgactggctcccctgcagttccttcacatctttatcctttgcaaaacccatgcaatagaagctcaatgttggatcagagctgaaattggatgtctctgcactttctcctgtgcccagatcactgagcactcctggagaaaatctggctgagaaattgtaataacagtagctaccatgtattgattgcttactgtttgccagggactggctaagtgatttatacatactgatttccttaatccctgcaa

SEQ ID NO: 63925 - DNA, 2272 bp, Homo sapiens
tccttatgggtacctttttcccttttcttcgtgatcgtaatatcccatctgtggctgagagtaggagcctggggggtgctggggtagatacctgttgtgtggggaggctgttagggtctctgatttattcccccatttcccaatcagtgcacaaagcaactgttatcagaacgatttggtcgaggctcacggactgtggacctggagctagagctgcagattgagttgctgcgtgagacgaagcgcaagtatgagagtgtcctgcagctgggccgggcactgacagcccacctctacagcctgctgcagacccagcatgcactgggtgatgcctttgctgacctcagccagaagtccccagagcttcaggtgcctcacccagaccaaagagggtgggggaactgggcatgggccctcccaggcagtcattcctcatcctccctccctcctgcagcccacagggagaaccccttcagggtgggcccagccctacccccagcagcactcacctgtggaggcagcctaagggtttgtacagaggtccagaagttggagggggtgggggagggggcacactaggtgcctcacaaataacccctctctgcactggggagaatgccttcgtgctcagcctaatcagagcccctcccctgcttgccacactagctctcagactgttccagtcttgtgaacttacccaagaatgcccaccacccacattcctaccccaggtatccccagggtgatcccactaactttccggctaagagagccttgctggaggcagtccttggttgttccagttttgctggctgtgtcctccccggggaggaggggaatgaagggctctacagcttcagtcaggtagggagtgttattcaaggtctgttcctcccttctgccctcaggaggaatttggctacaatgcagagacacagaaactactatgcaagaatggggaaacgctgctaggagccgtgaacttctttgtctctagcatcaacacattggtcaccaagaccatggaagacacgctcatgactgtgaaacagtatgaggctgccaggtgtgggcactggcagggcttagggtttggggagttggctggtatgggtggaaatttgggcattaggggcataagaattcaggaaggaaaggagagtatgtgttgaggataaaggagtggagaccagcctttatcaccccctccccaggctggaatatgatgcctaccgaacagacttagaggagctgagtctaggcccccgggatgcagggacacgtggtcgacttgagagtgcccaggccactttccaggcccatcgggacaagtatgagaagctgcggggagatgtggccatcaagctcaagttcctggaagaaaacaaggtgccaaccccacccccttgaccctagcccacctttccatctgtaacactaaccttcccctcagaccctccccattattgaatgaggaaatgcagcctagctggggagtagagtgttcaccccctcaacccctgggcctttccagatcaccctccctccaattcctggccctttcctgttggaggatttggctgctggtcccaggaacataactgggaaaaatcaccccctgagctggggtacaaaaaccctaggcccacaaatccagtgaggtttcttccatcatactgacccttctcctttgactccctgggtagagttcagcccctaccccaaaagcaccatcagagcagagtccttgtgcccctggtctgtgcctgggctcaggctcatagaccctcaagaagggcgcctgagtccagccttagctgaccctgctggacccccagatcaaggtgatgcacaagcagctgctgctcttccacaatgctgtgtccgcctactttgctgggaaccagaaacagctggagcagaccctgcagcagttcaacatcaagctgcggcctccaggagctgagaaaccctcctggctagaggagcagtgagctgctcccagcccaacttggctatcaagaaagacattgggaagggcagccccagggtgtgggagattggacatggtacatcctttgtcacttgccctctggcttgggctcctttttctggctggggcctgacaccagttttgcccacattgctatggtgggaagagggcctggaggcccagaagttgctgccctgtctatcttcctggccacagggcttcattcccagatcttttccttccacttcacagccaacggctatgacaaaaccactccct

SEQ ID NO: 63926 - DNA, 1018 bp, Homo sapiens
gcgttttggaggggagaaatacatatatctgaagaaaggaatgatggccaaacgctgggacactcaaaccctgggacagcctttaaagaaatgacagaggaggcctccttcttctagagtgctggccagtgtccagaacttctgtgttgggctttgcagggtgctggggtggagagttttactccaatacctttcctagccatgacggacgggatcctagggaaggcagccacaatggagatccctatccacgggaacggcgaagccaggcagcttcctgaagatgatgggctggagcaggtgcttctgtttgattcttctaattgtttcaatttaggaatccaatttataaatcctaggttctcaccctccattccagtagccttcccctgacttatctgactcccttcattctttttacgtatcattttgattctgtgcagacttcccttgtgtactatctttatgatgcttgaatccaaacttgttcccacctccaaaatgcttctgcagcccctatgttcctgaagcaacccctcttctctggcctataggacctccagcaggtgatggtgtcaggacccaacctcaatgaaaccagcattgtgtctggtggctatgggggctctggtgatggactcatccccacaggtatgaatgttcagaaacaggaatcttgggtggaggaggggacaggaatggtttggggaagcataggatatgtctaggaaagcttgaattatgtctggagatcttgggaacttctgcttgtaggaacctcatggactctcctcagcccaaaagcaactcccagcgttgtccatccatttcccttttgccacttagcccctgaaatggctcatttgtcctttccctgccaccacctgagtcaagttaagacctgcttcacaggaatgccccccctctacagcttgaggctgagttggaactttgtgaagcttctcagaatttttagattctaaagtttagaggaacaaacagccctgaatctcacact

SEQ ID NO: 63927 - DNA, 1012 bp, Homo sapiens
cccacacttctagtcaaggtcgcgccgcccaaagtttcccaggcccgcgcgccatagcccgaagtttccagccctcaaatccctggccctgtggggttcccgcgatgtgtgcaggaatgcgagctgaacgtctggcctcgaaacgacttagttctcacttacgtttcgcagttgctgttgctgctgctgctgccgctccatcacgccaccggcgcatgccgtacgccacttccgtttcagcttctcggtgccgccccggaagtaacctctcgctgatctcgagagctagctcgagtatcgccctgccctggctgcgacgtcagctccgcccttataatctgcgacgtggccggcttcttctgcccggagaggacgtcatttccgccgagtccctgacctgctgctaggatcgcgacgggaactggagcccgaggtccccgcgcggcccgggcctggcgccctgaggggaagagcggcccggcccgaggtgagaggaacatgcttgggcgacgggaagttgaacgcacaaacctgtccagagggcaagatgccccgagccccggggaaggatgaggacacacctgatgtccaggtgtatgggggtgggggcggggactcacacacctgggagacataactgactgtggaagggtcaccgatatcctgggagagagaggcttttaccagagactgggaacatacacccactgatctaactaaggcctggtggggagggcccgaggaagacgaggtgtatgagacggaggaggggagaccccctgaaggaagggggaagaaacgctaaaggaatgtgaaaggccaagcaatggagaacaaacctgaataggggggtgaagacctgagccctggaaagggttcatctcctcagcataaacacgcctgcatggagataagttctaagagagcagactttccctcttcactgttgtattttcattgtcacaaatagtgcctgacacatagtaggcactcactaaatgtctgctgaatg

SEQ ID NO: 63928 - DNA, 1023 bp, Homo sapiens
cctatcttccttctaggaggcctgtctgcacagctgtgctgggaagctgatccattccaaccaccgcctcatggccgcttacgtgcagctcatgcctgccctggtacagcgccgcatcgcagactacgaggctgcctcggctgtgccaggcgttgctgctgaacagcctggggtctctccatcaggcagctagccatacccaaccccaggaaggaaggccttggatggaccctcagattgaaggacccggtggaccttggggttggtgaatcctaaacagagagaattcgaggttgcctgaaagctgggtgtccttgctccttttcctggagccaatatacccagtttttactcagtttgatttatattctgggcaaggaagctttgcctactttattggcacaatccgttgttctgtcgtttagtgcatatctgctggcttcagccctggcagctgagaaattgttttctatatgtagaaggaaaacctgagcatttgcaggcatctggttaaagcagggtctgtgtgtacaattttaaaacgggtaatatgtcatgctcttagttcatcttcacaacaaaactatgagtaagcggtattagcctcacttaacagatgaggaagcaagattccagaaagtaccagaaggtcattttatacaacaggagattggttcctgcccagatgacagaaaatgggagctctgtctagttgtccttaagtctgactgacttcagtggctcataaccgtgagccaagtatttgttggttcataactgttgttttgtgaactatgtcttacatgtctagagttctgctggatctagggaaaggaggagctatcgaagtacaacggatcaaaaaaccacagggcttttgggcactgcctccttgggaagttagtggccacagaagagagatgaaacctgtaagaagtctggagtcttttggaacttcagccatttccccaggttgttactttcttagtatgtacagtcttctcaggatgagcagtaaaacct

SEQ ID NO: 63929 - DNA, 1088 bp, Homo sapiens
aggcaagcatacatctgtctaaagccagtgcctattctgtgctcggaatcttagtccttccatcttggaggatctttgacttccactttactgaattattctcatcagtgtttaaacatgctaaagattctcctgttaataaaccacttcatacctcatttcccctccagttacacttctatcttttctactttacagttaaacttctcaaaacagttggatagtttgggcctctccattttacaagtcatttcccattttcattcctcaaccgagtccattttgacttctgcaaccatcattctgttgaaatggttcttgccaaggtcaccttggtgatcaccttcctatccttcaatccggtggttatttcccagtcctcactacctcacttctcagtagcatttggtataattttctagtttcttatcattgatactcttccattggcgtctgattctactttcatggttttactactacctctttgatctttgaccacagctgcttagcctcctttgcaggctcatcctcctcccagcctttaaatctgaaagtttctctcggttctgttcttctcactctaattttcctaggacagtttcatccccactctgaactttagttactgatgacttccagatctcctccaagctatttgacatctccacttaagtatctcaaaaacatcccaaactcaacatgtttcctaataaactatcctatgcctggtactcatccagttggagaagctagaaggcatttgcctttttctatcactcaattgccagatcttatcagtttacatttctaaatatcccttgattctcactgcctctctctccaccttcaccataatctcccaccaggattactgcagttgctgctgcttcctatacccactcttgtatcccttcaatctgttgttcactcataagccataaaatgcaaactaatgcttaaactttgcaagagcttcccattcttaggataaaaactgaaattctaaatatgacctacaaggccctgcatgatccagcctgtgactacttccagctttatcttatcagtaactatcaaacaatgga

SEQ ID NO: 63930 - DNA, 1026 bp, Homo sapiens
acctcagcctcccaaagtgctaggattacaggtgtaagccaccatgcccagctgccctttctgcctttaaggattccatcagccaatatgtagagccagtaaagcactggggtctcaaaatggtgagagaagaagctcctcctttcccaaggcactgtgggcagactccaggccagctaatttccctgactagctgctatgagtatccacgtaactccatggaagtgctttgtaagaactagagcctctagcccgggaagagggctgaatggctccaggaccctacgtaatatttctatagcaagaatgcccattctgtcttaaaacgggtcttggtagagaagctgagaacaaacttttctctcatagtcttagtgcttggctccctggtgctgcttaaagagttatcccttcatgccacaagtgcttggtaagactagggctggaaatgaggtagggacactaattggggtaaaaatgagaagaatcaagaaaggaggtttattcagacacatgtaggactctccaaacatccctggtgggaagaaaactcattatcctgctctcagagtcacacaacttctactccactctctagagaaaacagcactggactaatgctttcagcccctctgtctatcttcttcccttactcttccccatgtgaggaggcaaagaggcccatcttttatgctctatgggatatgaggcaggccacagtcctctacacagctacctgtgtaactgtacttcagcttttctctgcatatccacacagacctcaagttctcaattaattgggggaagattatgacgaggtagcacgaagtctcacttgacctagatccaagctgtgtctgccaacatgatacataaaaagcacaaacttccttgggggtgatggttctgatagtatactttcattttcatatatatccttgtcctcatttggttaagaatctaaaggggagattaataatttgtaggtgtgcccaatcctgtaacaacctgtcttcttgaggtaag

SEQ ID NO: 63931 - DNA, 1175 bp, Homo sapiens
tggattctcactgcctcgagaacaaaagacaaacttttcaggccccgtgtgatcttgcccaggcctccgtcaccatcaccatctgcatcttaacccactcctcccctttcacaaaactccagccacacagacttgctttttattcctcaagctttccaaactgtttctactgagagtctttgcacatgctccatcttccttgaatactctttccccagtgagctcattttcatcttcctgaattcataccactattacctttgcttctgtggaagaaactggccagatgctcacccaaatgtcctctttctggacacaggtaaactgcatttcccagctccatgcatctaggcctatgtgagtagttctcaacagtggaaaatgagtggaagtgatgtttcaatactagaccaaggcagttaaagggtggctgagccatttccattattctcttcctccttcctcttcaaggtaaccttgaagcacatgttttgacggtgatggagtcatagcatagaagaagtctgaatacctgagttactatttagggcataatagctacttgaccaaaaacatccatattggactttgaacaagaaaataaacttgattacattctgctagtgagttttgagggtgttttagcagttatcattatatacactggatatatcttctatggtatcctgtccaccttactcttgaccacagtaccctctttgtttccttcagggtgtttcagatatttaattatcttgccagatgccagtcaacactttctttttgtcccatgagtttaaaatcaggggaaaacatgtactcccaataggaagttgagatactcttttttttttaaatccgtcattgtgactgtgaccggaaaaacaaatcccactaaagaatgtcctaaacagatgtttttttttgtcatataacctggagttaggtgatttggcattggttctggagctgaaggatgttagggatgaggtctctgtagttttcttgtctcatggtcacgaaatgaagtgttattgattaagcagggatgccctacttagtattagacttcttggaagtctccttaattgccacagcccctatctttttggcttcgtttcaagggtccttctacattgttaatactctggtataaatacgttccattattccct

SEQ ID NO: 63932 - DNA, 1022 bp, Homo sapiens
ccagcagtgctgcacagcgtctcttccaggaagaccctgaggcttttcttctctaccaccgcggcttccagagccaagtgaagaagtggccactgcagccagtggaccgcatcgccagggatcttcgccagcggtgaatgggggtcagggactgtgagaagccatgtggtgggtcagtcataggctcagatcagaccaatatgtgacccttgccttccactctcaggcctgcatccctagtggtggctgacttcggctgtggggattgccgcttggcttcaagtatccggaaccctgtgcattgctttgacttggcttctctggaccctagggtcactgtgtgtgacatggcccaggtaaacccctatgttatctggcttgtgctctagggccaacctccgtatgctaatctctaacccttccttcccctttcccatcctggtatctcagtgctggctttcttcttctgcactgtgtgccttatacaacactctcactctccacaggttcctctggaggatgagtctgtggatgtggctgtgttttgcctttcactgatgggaaccaacatcagggacttcctagaggaggcaaatagagtactgaagccagggtaagagcccccaggacacagatgcatgtatgtatgtgtgcatgcatgagtctgtgcacttacacagaactttctgtctttctcaggggtctcctgaaagtggctgaggtcagcagccgctttgaggatgttcgaacctttctgcgggctgtgaccaagctaggcttcaagattgtctccaaggtgagggccccaagacatctgtacctgtttttgtctcatgtggccctattcagggtactggtgttcaggaaggaggctttaggcacaggaacagacattttgctccccaacggaagtgggagccctgggaagctttgtgagcagaggcagtacatagagggaggtgttttaaggagttgggatgaggatttggttctcactgggtcttttctgcccctaggacctg

SEQ ID NO: 63933 - DNA, 1049 bp, Homo sapiens
cccttcagtttgttttctacactgcagctagagacatgttaaatatttaatatacgtgtgtgatcatgtgtctcctgtgttcagaagcctccttacctcttacagaaatgtatcagctctaggcaaaagctcaaggtgaagggttggaattcctggtctctggccttggtcttgttgcttgtggcctttgcattttcctttggggaaacctccattagctcatttacacattgaagaaagtgggataggtggtttctctgctctccagcttcccagaagttggggtggtgacataaaagttcttctgggttctggcaggcttgactgggaagaattcagatgcttctgccagtctgaatcaggtccacatctctcccttcttgttctccaggcctcatccattctctttaggcccactgtcatcccctgttttcctccagggctccaagcgccgccagctcttggccacattacgggccctagaggcagcatctctttcccagcatccccccagcctatgtataagtgactctgaggaggaggaggaggaaaggaagaagaaatgccccaaaaaggcatcatttgccagtgcctctgctgaagtagggaagaaagggaagaagaaatgtcaaaaacagggcccaccttgcagtgactctgaggaagaagtagaaaggaagaagaaatgccacaaacaggctcttgttggcagtgactctgctgaagatgagaaaagaaagaggaaatgccagaaacatgcccctataaattcagcccagcacctggacaatgttgaccaaacaggtaccattggatgtgtatatgtgtgtgtgttggtgtgtgtgtgtcggggggtcagctggttctacatacaagagtgattatccactgccattaggattggggctaatggtgtactcaggcaataagaagtacttctctgcaggccacagtcacgatctcaaagacagaggtatggctgggatgacttgccgtgactccgaatgtaagagatcttgcctcatgtgcaccttcccatctccctccct

SEQ ID NO: 63934 - DNA, 1067 bp, Homo sapiens
tgtcaatccattccctcaagaaacttaaaggtctaacagacaagacagtccattaacagatttttacaatccagtgcaacaagtgctgaagtagggggacatataagatgtggtggaaaacagaaaggaccaatagatgttgcagaaggggtgcaagagaaaccaggggaagagcactaccacctaaggaaatgagatgtgggatatggtgaagataacacatttttttatagaggttgttgagatatctaggtggttggtttggtttgaagctcaggggaaggtctgaaatggacagctttgggagttgctggcatgaatgagaatcaaagtcctagagaggtaagccttcccagagagtatgtaattatcagtttttcaggaatcaaaacctttgccccatcccacctccagctcaatgaccattgccccttcctcaaagggacgatcatggcttctcccccttgcactgggcctgccgagagggccgctctgctgtggttgagatgttgatcatgcggggggcacggatcaatgtaatgaaccgtggggatgacacccccctgcatctggcagccagtcatggacaccgtgatattgtacagaaggtacgtacaaactccttcgtcatccacatcacatacatgccatgagggtcagtcacaggcactgtaacatacagtagaaagcatgtgtgctcttcccccttttcccatgccctgacaccagtatctcatttggaactgactgtactttctgcctcttctttttgtctggccatggggtccagctattgcagtacaaggcagacatcaatgcagtgaatgaacacgggaatgtgcccctgcactatgcctgtttttggggccaagatcaagtggcagaggtgagtactcagcccttaattcctgagatgggtaggaagtaaagtctgagccttggtgggagattttggaaccctcaacccattctgtcagtactactgtgtgacacttacaggattaagttctacatttgtgcattcatggttggttcagtgactgccagcgaggtagcagtggctctca

SEQ ID NO: 63935 - DNA, 1024 bp, Homo sapiens
gctccggtgtcggcgggtggcgcggcgcccccggagggggccatatctaacggggtttacgtactgccgagcgcggccaacggagacgtgaagcccgtggtgtccagcacgcctttggtggacttcttgatgcagctggaagattacacgcctacggtgggcttccgcccgaacaaggccacctagcctgctgtcaaaactttcagccacatcgtgcttttcagcgttctcttccatttgctcccctagtcgctcttctgtgtttgccctctgctcacccaaactgtgagcttcctgataatcaggcctatccatttccctcaccctcctcccgctctgctgacagttctcttaattgatttctcagatcccagatgcagtgactggttactacctgaaccgtgctggctttgaggcctcagacccacgcatgtgagtaaacccagggcaggttagttttgggtgcttgtgcagtatgttgtccatctccttctcatctaagttttttctctctagaattcggctcatctccttagctgcccagaaattcatctcagatattgccaatgatgccctacagcactgcaaaatgaagggcacggcctccggcagctcccggagcaagagcaaggtgtgaggggaggcttaatgaatcagtaattaccttccacaacagtggaggcttatcctgccacccctttggggaaactgaatcgtaggggaggtgtaagacttactcagggtcacccatctgggattgaagtccgggattcctgtgctcagttggtgctcttccctcttccctcaggaccgcaagtacactctaaccatggaggacttgacccctgccctcagcgagtatggcatcaatgtgaagaagccgcactacttcacctgagccacccaacctaaatgtacttatctgtccccatgtccccacaccagcctgttttcataataaactttattgtgacaggcggggctgatccctcccatgttgggagacaccatgtggcaagtgaca

SEQ ID NO: 63936 - DNA, 1036 bp, Homo sapiens
caaatcccatcaggccacttggatgaaaacccttcaaggattactggatagaattcaggctttcccctccagcccccaatcatagctcacaaaccttccttgctatttgttcttaagtaaaaaatcatttttcctcctccctccccaaaccccaaggaactctcactcttgctcaagctgttccgtccccttaccacccctgatacaactgccaggttaatttccagaattcttgcaagactcagttcagaagtcaccttctttcgtgaatgttttgattccctgaggctactttattttggtatggctgaaaaatcctagattttctaaacaaaacctgtttgaatcttggttctgatatggactaggagagagactgggtcaagtaagcttatctccctgaggctgtttcctcgtctgttaagtgtgaatatcaatacctgcctttcataatcaccagggaataaagtggaataatgttgataacagtgcttggcacctggaagtaggtggcagatgttaacgcccttcctcccttgcactgcgccccctgtgcctacctctagcattgtaacgaccacgtagtattgaaatggccagtttacttgtctgccttcctttccaagaccgttggtgcctagaggactagaatcgtgtcctatttaactttgtgttcccaggtcctagctcaggagttggcaaataagaattaaatgtctgctacaccgaaaacctcacgcctctcattcgttgtgatttttgcatatgttgttgactcaggctgaaactcctcctcctcctacagcagcactgtgtgccgccccactgctgcccccacctctcggggcagctggcggagaagagagggggctttccaaatccactatgaatccttaaaaggctgaataagggaacttgaaacgatgcagacaggcaggcaacccgtagtcgagggacatagggccataaacgtcgaagccaggtcttgagcgtcagacagaatgaggtgtcccagagcggcggaggagagccagac

SEQ ID NO: 63937 - DNA, 1359 bp, Homo sapiens
gaacctcggtgagaatcagcccatctccaaactctcactcaggaactacccttaccccctaacaccttgaacaccttgcacctagaacccctgactccttagagatgtctgatactttaaagcatcactcccaaaaagtccaatcactcagaacccctgacctctacttgcaccttcactcttgtaggcctctactccagtgtttggggggatcctatccttgatcaatgagcacaggatccttagtggccgcccccctcttggctttctcaacccaaggctctaccagcagcatggggcaggactctttgatgtaagtatggaagggaagggtgtggacgttttcaaacaactatggggagtgctaagggggacttgggggcagttagggtggtgtggaatagcctttgaaatgtgagtacagggtgaggagatatactctttaagtactggtactagtaggcccagatctgatgccagcctcctccctaggtaacccgtggctgccatgagtcctgtctggatgaagaggtagagggccagggtttctgctctggtcctggctgggatcctgtaacaggctggggaacacccaacttcccagctttgctgaagactctactcaacccctgaccctttcctatcaggagagatggcttgtcccctgccctgaagctggcagttcagtcccttattctgccctgttggaagccctgctgaaccctcaactattgactgctgcagacagcttatctccctaaccctgaaatgctgtgagcttgacttgactcccaaccctaccatgctccatcatactcaggtctccctactcctgccttagattcctcaataagatgctgtaactagcattttttgaatgcctctccctccgcatctcatctttctcttttcaatcaggcttttccaaagggttgtatacagactctgtgcactatttcacttgatattcattccccaattcactgcaaggagacctctactgtcaccgtttactctttcctaccctgacatccagaaacaatggcctccagtgcatacttctcaatctttgctttatggcctttccatcatagttgcccactccctctccttacttagcttccaggtcttaacttctctgactactcttgtcttcctctctcatcaatttctgcttcttcatggaatgctgaccttcattgctccatttgtagatttttgctcttctcagtttactcattgtcccctggaacaaatcactgacatctacaaccattaccatctcactaaataagactttctatccaataatgattgatacctcaaatgtaagatgcgtgatactcaacatttcatcgt

SEQ ID NO: 63938 - DNA, 1676 bp, Homo sapiens
agttcctggagcagtatttccatgactcagacctggctcagttcatgcgcctcttcggtggcaactttgcacatcaggcatcagtagcccgtgtggttggacaacagggccggggccgggccgggattgaggccagtctagatgtgcagtacctgatgagtgctggtgccaacatctccacctgggtctacagtagccctggtactaccaagaggactggacagtggggaagggggtgggagatgggtgttgatccctgctccctcaagggaatgctataagctggagagagatcctgacaacccccagtgactatctttgtgcccatccctcaaaaaaaaaaaaaaaaaaaatccaggccggcatgagggacaggagcccttcctgcagtggctcatgctgctcagtaatgagtcagccctgccacatgtgcatactgtgagctatggagatgatgaggactccctcagcagcgcctacatccagcgggtcaacactgagctcatgaaggctgccgctcggggtctcaccctgctcttcgcctcaggtgacctcctaccctaaacttagacaatgcttacacctctgcagcctgggagctttgactccacagtgatccctgagcctggtctctgactcataatctgaactcagaccttccagtagggaccactgacctgacctctacactctgacctcctacagtaacaaatttcccctctgacatccgaacccacatactaagccctaaccaattaatatgaatgctacacttggtctctctcaggtgacagtggggccgggtgttggtctgtctctggaagacaccagttccgccctaccttccctgcctccaggtaagtactctagcctaccactcaggtataaccaccacctttcacttgtgatctcatgatgtagaacctttgtcttgaccccaccatgtgctcctgtggttcagccttaagctttgcctgccctggttgctgtactcctgtctcttcttcctgcaggtcccaggccccaaatctcttgtgtgggatacagctcccattgttccttttcgtcagttcccaggcattttagtggaagatttggtgggtgttctgtagagaaaagtgtgcacagtcacctcgggccatgccttgaaggctcaaaatctcttagtcaatcccatatacatgcttccccacagagtctagttcctccagcaagacctgggctatactcacccctccccacatatcttggaggtccccttgggtcccctactatccaaatgctgtcttctcccctcagcccctatgtcaccacagtgggaggcacatccttccaggaacctttcctcatcacaaatgaaattgttgactatatcagtggtggtggcttcagcaatgtgttcccacggccttcataccaggtacgtgtgtttgtgtggatggatgcagggtaagagtgaggatgggggatcctcagttcagctgactgctgggcaggccacatgccaatactcactcaaaaatgcctttcaggaggaagctgtaacgaagttcctgagctctagcccccacctgccaccatccagttacttcaatgccagtggccgtgcctacccagatgtggctgcactttctgatggctactgggtggtcagcaacagagtgcccattccatgg

SEQ ID NO: 63939 - DNA, 1116 bp, Homo sapiens
cctatcattcacctcatgtgatctgtatctgctcctaggatcctccccaaggtctcagctcctaatctggaaccttccatgaccaatattttccatctccaccctaaccaaagccatgtccctgacccctgaccctacaggctgcccccaggctgggtgtccctgggccgtgcggaccctgaggaagagctgagtctcacctttgccctgagacagcagaatgtggaaagactctcggagctggtgcaggctgtgtcggatcccagctctcctcaatacggtgccttttgggactgaggacaggatgtgggatgcggtggagggacacagggctgggttgggcatgggatggcgatcatgtcagagcctgccaagacacttgtgttcctcaggctagaaacctaaaaggggatgtggttcagtatacaggctttatgatcaaatacgaactcaaattctgactctgctacttactagctaccaggcatctagtacaacttacgttccttcccctaccctcaaatccattctaatttcctcttttgttcacatactaaggctgccagttctaactcccaaagagcctttggattaatctccttcttgccgtcttttgttacgaccaactccgttatttattcccactcctggactactgcccagctccccagctgatctgcagtctcctccctccaccccacccctcactgtactcccccactctgcttcaaaacagtctctccaacagtcaaaatggattggttccttctcctggttaaagcccttcacagcagggggagtgtgtgcttgtgaactgcagaggctggggacggggcagtgtgacactagtgtgcatggcaggaaacagtgactcaccatcgtgttaagcttaaaatcaacaagtatgcaaatttgagctaaactgaataactggtaccgaaagatttgaaaacatttaccggacataagcttaaaattaaaatggaaaatttatatgtattaacctcattcattttcatgatcatggcaatacatgctgtggtgcgacatttgcaacttactggcctttagggtaaatccatattattggccatggcatttcaagtctctccagcc

SEQ ID NO: 63940 - DNA, 1299 bp, Homo sapiens
tcatatcaagagaataagaaatgaaaccacataatcatctcagtatacacagaaaaggcatttgacaaaattggacaccttttcatcataaaacacccagtaaactaggaaaaaagggaattttttcaacctgatgaaaggcatggatgaaaaactgtacctaacattatacttaatattagaagactggatgatttccctctaaaatcaagaataacacagggaggtccactcttgcctcaacattgtactagaggttccacaagagccactggaaaagaaaaataaataaaagacttttatattggaaaggaagaagtaaaactatctacttgcaggtgacaaggtcttgtatataaaaaatcctaaggaatttacaaaaaaaaaaaacctatgaaaactaataaataagttcagcaaggctacaggatacaagatgggaatacgaaaatcaactgtatgcaaaattcaattgtatttctgcacagtaacaagaaacaactcaaaaaggaaattaacaattctatttacaataacatcaaatagaattaaatgctcaggaataaacttaagaaaaggacaagatttatacactgaaagctacaaaacattgttgagagaaatgttaaaatgcctaaataaatagaaagacattatatgttcagggattagaaaatatcacattattaagatgccaaactgatttacagattcaacacaatccctatcaaaatcacagctatctttttgtagaaattgctaaaccaatccttaaattcatatggaaattcaagggactcagaatagccaaaataatcttgaaaaagaacaaagctggaggattcacacttccagattttaaaacttactacaacataatcaagactgcgtggtaccagcatctacagatcagtggaatagatttgagagtccagaagtaaaacattacttttatgttcaattcatttttgacaaaaatgataagaaaattaaataaaagagaagtcttttcaacaaatgatgctgggacaactagatatccacatgcaaaagaataaaattggactcacatcatataccaaaactaactaaaatggatcatttacctaaagtaggagctgaagctattaaaactcttagaagaaaacacagcagtaaatcttcttgaccttggacaatgatttcttagatatgacacccaaatcacaagcaacaaaaggaaaatcaaataaatctaacttcattaaaattaaaaacgtttgtgcttcaaagcacactgtcaaggaaatgaaaattcac

SEQ ID NO: 63941 - DNA, 3199 bp, Homo sapiens
tcttctttagaaaaatatctattcagatcctttacctattttcaaatcagattttttgtgttttcttgctattgagttgtgtgagttccttatatattttggatatcagccccttatcagatatggtttgcaaatattttctcccattcggtaagttaccttttcattttgttgtttcctttgatgtacagagccttttagtttgatgtggtacaacttgtttatttttattttgtttgcctatgcttttcgtgtcatatctgaaaaatcattgccaaggccaatgtcaaggagctgttcccctatgttttcttctaagagttttacagtttcacatcttacatttaagtcttgaatccattccaaattcatttttatatggtgtaatacaaaagtccatttttgtcattttgcatatgtctatccagttttcccaatactatttattgaagggatttttgttcctcattgtgtattcttggtgcctcatcaaagattagttgaccagttgggcatggtggctcgcacctgtaaccccagcaccttgagaggcaggggcaggaggatcacttgagcacaagagtttgaaaccaggctgggcaacatccggagacctcatctctacaaaaaaaaatcaagaaaattagctgaatgtggtggtgtgtgcttgtagtcccagctcctcaggaggctgagatgggaagatcacttgagcccgggaagtcagggctgcagtgagccaagattgtgcctctgcactccaatctgggcgacacagcaagaccctattaaaaaaaaagaaaaaaagatcagttgaccacatgaccatacatgcatgggtttatttctgagttctctatcctgttttattggtctgtgtgtctatgtttaagttgtacatgcaaaacagtatggtacataatgttttgattactgtaactttgaatgtagtttgaaatcagcaaaggtgatgcctccagttttgttctttatcaagattatttattctatttgtagtcttttgttgtcctgtactaattttaggacttttttctacatctatgaaaaatgccatggaattttcatagggattgaattgaatgtgtagatcactttgggtaacatggacattttaatattattaattcttccaatccataaacatgggatgtatttccagctatttgttctttttcagtttctttcattggcacctcatagttttcagtgtatagatctttttttttttatactttaagttttagggtacatgtgcacaacatgcaggtttgttacatatgtatacaagtgtatagatctttgtgtgtgtgtgtgtatgtagatttttcacctccttggttaaatttattcttaagattttattctttttaatgctattataaacaggactgttttctttattttcttttgcagtccagttttacattgtacattcttcattacaacaacggtataattatattgttcagcactcattactaaacagtgaactacttaagagcacaaacacgtctaattcacttttcccaccaccctgtaaagaacatgaggcaaaatagacatctataaatgtctgttgaatgaatcaatgtgttatactgagttcttctgcttagctctgtcttttggactcactgactcctcccttctcctgtttcctccttcttcatctaaaaaagaacttcctgcaaagctgattccctattgttcatgcctgggtaatatctgtacccttaaggctttcctctctgtgctcttaaatgcatgggcatagtgtagctctcctttagtttctgggatataaatttgttagttattgatgttttcgttttgttttcgttttcgttttttgaggcaattctcctgcctcagcctcccaagtagctgggattataggtgcctgctaccaggcctggctaatttttgtatttttagtagaggcggtgtttcaccatgttggtcaggctggtcttaaactcctgatctcaggtgatccacccgcctcggcctcccaaagtactgggatcacaggcgtgagccactgagcccagccttaaatttggtagttaaatctgagatatcttaataatagaaatggtttgtgtgcttacatttccaggaaagaactaaacttttctgacatttttgcattctgttccacaacatatctgtttaatagaaaaataagatttttaattctcacaagttaaatattgtacattacacacagacacacacacacacatgaacacacacaattttctatcaaaattgatgtcttgggaagacaagccttgtttacactgtggtttcatatataccttggtacaccactgtgtagcccagtacaggaagcacaccattaaagggtttttctgctattcacttgaaaacacaaaaggagatgaaaacacaaaagctgtacctagggatgtcactgaagacttaatgacattgtcctggcttaatttctaactacttttccgtaaaatggtttcataacctttcctacaattacttctccttttatcccagaaggaataaaaagaaaaagaagatagttcagtttcatatgtgctgcatttgagatgcctggaagcatctggagcttgagaaagaggtttttgctggaagaacaaatttgggagttgtcagcaattaaagctaaataaatggatagagtgactcagagtatatatgtagagcaagaggaggctgaggtcaggcagtagggaacagacaggatagagaacttttgaaggagactgagaattttttaagagaggaaagggaacctgcaaaattcatcacagtacccagcttgtgtcttctttgtcataggaggcactcaataattaatcagttaacttagcaagcatatttctccctccaaagcactatgctttgaaatattggaatgacccctcaaaggcccaaaagaccagttagagagacagatcataaataagtacaacatagtaaaacagatactatgaacatggttgcacctgaggcctactggagtaccaagaaaggaagtggtccatgcagaacttctcaaaataaacaatgctagggctgaatcttgaagaatgattaggaactcatcaagcattggggaaagaaattagtttggagggcattccatgcagcaagatctgtagatgcattgaattat

SEQ ID NO: 63942 - DNA, 3091 bp, Homo sapiens
accctccgggtgcctttctcttcagacgctctctttcccaggagtctccgcggcggagcgccccatcgccctaaatgccactggctgacgcagccccaaaaaaaacccgatggcccgcttatcccacactagggggcgcctggttcttcggccgccacagagcgctctggatgcctgaagcccgcccagctcgccgcctctggaaaagctcaacaccgtttctccgcccttcccgagattgccaacgaggcaggctctgatgcgcatgcgcaaacacgttcaccacgctccgagctaaggcgcatgcgttccctgaaattgccgccaccggctctaccttccagtttccagttccggcctccaaggggcgggcagaagttggaaacatgcggctgtcggtcgctgcagcgatctcccatggccgcgtatttcgccgtatgggcctcggtcccgagtcccgcatccatctgttgcggaacttgctcacagggctggtgcggcacgaacgcatcgaggcaccatgggcgcgtgtggacgaaatgaggggctacgcggagaaggtgaggagcgcggccctcttgtccactctgcgggtctggtctgagggggcggagccggctgcaagtggaaagggaccgggaccaacctggtaaaccattccccaagtctgagtcccccagaaccttgggctgaacccgcccctccatcgcctctaatggaagactggttagggctgcggagttaggggtggcgtagattggagatgcttggctagtggaaagaatggattgccttccggcattagagaaattagattggcaccttgttttcttgctcggttggatccgtgatgttatgtcctcacagctcatcgactatgggaagctgggagacactaacgaacgagccatgcgcatggctgacttctggctcacagtgagtgcgacctatctgccttcaaaatcccaccctttgctccctgggggtgggggttggaaaaaggagaactatgcagaattaaacttgggtactcacttatgggccagtgctgctaactaaattagaaactgtgtcttaagttagttgaagtcgatgtgaatatacctctgcacaactgcctataaacgacccctttgtgtaacactgactatgccagattggcgaggggagggggaggtctttctatgtgtggatggaccttacctttgggaatggtgtaaagttaaatgcctctgcagttttgcctgactctgctgtctcttggataattctccctctaggagaaggatttgatcccaaagctgtttcaagtactggcccctcggtacaaagatcaaactgggggctacacaagaatgctgcagatcccaaatcggagtttggatcgggccaagatggcagtgatcgagtataaagggaattgcctcccacccctgcctctgcctcgcagagacagccaccttacactcctaaaccagctgctgcagggtttgcggcaggacctcaggcaaagccaggaagcaagcaaccacagctcccacacagctcaaacaccagggatttaactggatctgaagagtctgcagcccttaatcagtacccatgatcacaggcctttggagcacttttactctctgagaagaactggagctagagatgtaaaatggacagtcttgatggggttgagaaccttctggggagccagatgaccctctctttgcacaatagataaaagtctttatatgaatatatataaatttatttattttttccttcctgtgggatttctggagaatgagaattatccaaatgctcagtctacctgagatagtaaattcatggcttatgcttctggtccttaaatttgggttatttttggttagtgcaattttgtttttcttaatgccagtttacatgggaatgcatcctataattccaaatgttgccagaggtggttgtgttttgacatctggtctcctagagatgagtgcttgggatttcttagagaaagattacttcctgacaggggtaggggagtgacaatctgcaagtgaaacttccttaaacaatctagtaccctgcgaaccttcaggggatactgcaatcagtcctctgttttgaggcaggatcacacattaccttaatgtgttcccttcaaccccctgaatgggcctgggaggagaggacccaagaactcagatgttccaccagtttggccaaaggggtggagacattcagcagaggatgttgggctccaggataagctccttcctcttggtgaggggaaggggtaagaaagagggtctatgcgagagaaggattaggaaattaaacctcctaggaatttcctggaagtttttattgttgtcaaatctggcctctctgggaacccagaaaagggaaatccggcttcagaatgtgagaagctgggagcccctttcttggcacagccaggctgccgttcccttgggttcagaggctttagtagggtagtagttatggaaggacttagaaaggagccatcagtcttggtccaaacacttgatagcagtgcctgataattgccatatccccagtaaagtgggtagaagagattttatcttaggctctatcttctgagtgtatttggcccactgaacccatccactgtctgagataataagtaagagtaagggtaaagggatcactggtgtagcagacatggcttcagtgacagaacgaactattctggtgctaatttagctgtagctgccttagtctgatactcatctactcccaacagagctctttatctctttttctctactatggtttgttcttcacactatagccagaaagctcttatattttaaatgaaatatagtagacactcaaaacatttatgaaataaagctacaactctgcttctgctaaaaaatatacccctcttctgtcttagcatgaatatccaccctagctaggtatctaggagtcatacctaacttctagagaaaccactttccttaaaaccacatctttattttaaatagatggattgtggctgggctcctgtagcttttcctcttagaccccagaaatatatctccctttg

SEQ ID NO: 63943 - DNA, 1033 bp, Homo sapiens
aatggaggtatttattggaaactcctgcttgaagagcattctccaaaacaaagagaagggtgtatcatgtaggagacagagggttatggattcaagttcaaattgcctccaacttcccaaactcaaaacatgaactcatggataagaaagagaggagagaggaagcgaaaaatgtaaattgatatgcacttctgtgatctcttgctctttctgtgattctctttccttttctggcaaccttatccaaggaaaaatctcaatgaccttgcagtagggcaattggggatgatcctaaggcttacactacacctcagaggatgtacagaaacattttactctctttatttagtctataatctgatgtcctcccaaatccctatctacgagttagcaggaggaagaaaaaaaaactaataatgcaatctaattttaatttagtctaacctgacacaatgtaaatatgccttcagaaattattgtttctattggataaaataatgcttgatcactcagaaagcctctacttcccctgcttctctccccagtgtatgatggagagactatggttatgcaatcccctggcacagagaaggaactctagcctcaggctggtttttatgttgtggcagctccatctgctggtctctgggggactgtcctttgggcactgaattattcaacattctgcaggacaccactgctaaattggctaattcacatggggtctgtactttctacagggacaatgttcctgagttgctaaggctgttaagaaaaattttgctgtctgcagaaccctgagttgattgccacatcctccagcctgcaaattggtccagcagtctacgctaccttattgttgagtcaactcattctgctattgtaggcctatgacaatccactgggtttcaattcagtatccaaactgcataaaaactcaaggcacctttgtaaaattaagccttcttctttctgaccatgctgtgctacatttctgtgaatgaatcctaaagttgatgcatggcataatcca

SEQ ID NO: 63944 - DNA, 1146 bp, Homo sapiens
ctgtgtgaccttcaccaatcttcatggagatgcaaaagaacatgagcagcagctcagcttcctgaaggaggtgtctactgtcattgtggtcctcatgtcagcctccgatgacaatgaaggaaaccgaaaaattgtccgtaacttgtggcagtcatcaaggccattgatctgcttgctcgatgacaaagaagcaaccatgaccaatatttctggccaaagaatgagaatgggtatcaagaatagaaatgaggcagaattaacagaggaactcacaactacaatcagacatttgctagaactctcagatactgctctcagcttggaggactgttcccagattgctcaccagcaaggatttcttatcgatgaagaccagagagactgcaaggaagccaaagaaaaggcacaggctctaatggccttcctggggaaaatgaaattatctcagattaaggaaaaattactaccccttcagggacaactgtggcaccactggtgtaagaaggacaaagaactctatcatcttagagaaaagggaaatcagagcattgaacaacacaagagtgagattgagacagataaacaaataatacggcatgaacagttggccagagcccttcctctcaatgatttaatgcaatctgtccttcagtttctccaagagcattcagaaattcacaccaaactgtacttcttgcagtggctgagtgtatttttggacaaactgactgcaggacacttggaagaactgcatgagaagcaaaaatattggtggtcactggttcaaacagtaaagcaaaaggcacctaatagtcactccctgatatgcctgcaaagtgagatagaagccatttccacagagattagtgactgtactttgggaattgagcaacttatcagagaagttggtcagatttatgaagctctggaagaagcttcctccataaaaaagatttttttctcgcttccccaaattgccgcagacctgatgatatctggtgttcccattgagctgatggatggggatgcagcatatgtacctctaacatgggtggcagctgtttttgacaaggtctctgagaaacttggagacaaacggctatttgttctttctatccttggcttgcagagctcagggaaatccac

SEQ ID NO: 63945 - DNA, 1026 bp, Homo sapiens
aggcttgtttttaatatcttcttctcaaataccacagttacagacagcctgatggtccgcaaacaccggcagtgcttaaggcagaaagaagatacaagcaaatgtattttctcacaaatattaatggcaacctttgggaaacatctcattgcctggcttataaacgctttatcttgagtctcatacagacagtgaaacaactccagaaatcccagctgtgatggagaatagtcactgtttcctaatacttccatacactgaagtaactttgattttatcttcagtgacattttacagttaaaagtcctctccagttgttttactcgatcttcattcaaaaggccaaacaaaaagcacttcatctgtgtcaaatgggggtctttataacttgtgctttgaagtaatgacttcaaatcttcaaaaggctggcaggaagggttcccagcttcccaactgcctttcaacatatagaacatagctgcaaaaaactcctgaacatgaaggtgggtgaacacatagcagttttcatactctgcgtccttctgaataatattgctgtccataaaactagagacatcagattgagttaacccaagccttctgagattttctctgtaaaacacgtaagtcatagtccatattcctttggcagcgacttggcacagtcttctcagctgggcttggttgggtagactaggagagcctccatctactggtgtgaacaagctagaaatatagcaggtaaacagagctgtggttgtttggcaggtcaatgtgacatcaccacccttctccatttgctgcttcagacaagtacaagcggcccagcacactagggggacttggcacatgctaaacagcatctcattgctttttagtgaactgaatactttcatggcccacctcttatcttcaaaaaactggtaaatatactcctctcttgcatcctcagacattcctagtagctctacataatggtgattcttcaacaactgctttagtctcttagaagttgtgagtcttgtt

SEQ ID NO: 63946 - DNA, 1169 bp, Homo sapiens
ttaaaaacatacttttcagagagttttatgcttttcattttattttagcctctcgaccactgtgtgaagtagaacagacattttacagagaagtagatgaatggtatctgacagctgccaagtgcactatctctgggcatagagtatctgaagctaagcacccaagtctgggtatatatctatgtatgtatgtatttatatttatatttttaaaggaatgtcagtttcttcaaatcagaaacaccaccaccaagacacatcttcttcattatgatagttacaatctggcttaatgattaagtgtggattgctaactcccacagcttccagcagcttctgggcttcctcatcaaatgcctctttgcacaacctgagaaaacaagggaacatctcttttcctgcattcaatttccctacagccctccactttctctgtaaaggatttatttcaggagaaaaaaaactgttctgttaaaatagagagataatattataacatgggtgaggagtggggaagcgaactgagagagatacagtgagggagataaagtagtggaaggaagacagaataaattaacagaagagaaagagaaaccaattaaaattaaaaaggatcctccaagagccttttgctatccaagcaaaattaatattactactgataataataaaaacagagaacatatttattgtttattatcatgcaaggcaccattctaagtacttagcctatattgactcagatcctcatgataaccttatgggtagattttatcatttcacccattttactcataagcaaatcaaaacaaagagtgatgggggactagccttaattaaacatttagtaagtggtagggtcagaattcaagctcatctaggctggttccagggtgctcaatatttaaccactatgctatattgtatctctcaatattcagtgttctatgacagaaaaacaaataagtgtctagaaaatacccaatgatacacaattaggtggattctgaggcctgtattaatgagtggctccccaaatccctcattataggaaatgctccccctgagaagccaatggagacttaccctagaacttgtagtttacacttaggagacttcaagactttatataacttcacaattccttcatatcctaaggtattctgtgt

SEQ ID NO: 63947 - DNA, 1047 bp, Homo sapiens
taacttaataattttagtaatttaaaaaattcatactatttttttctgtttgaaaatggtttgggtagcttaggtttgggatcattacaattgttctcattaaaactaatagaaaaaaatttttttccacctaacggcttttccctgagctttcaggaggccattgaagccgttaagaccgggtcaggtgaacaggaagttaaagactgaaaaggagacacaaaactgccgactttcccgacggcgaattggccctctggaaacagccgaccaatcacaggcagcaggggcgcgccctgcagcggggctccggctgcggttccgtggactcggcgactaggcgccgcctgaccagtaggagccgccctcgacgagcgagctcgaaggctgcgactggcgccgcctcaccgcctcccaccgccactgaccgaccgttcgaccggcaaacatggttgaagcggatcgcccggggaagctgttcattgggggcctcaacctcgaaaccgacgagaaagccctcgaagccgagtttggcaagtatggccgcatcgtcgaggtgctcctgatgaaagaccgagaaaccaacaagtcgaggggcttcgcgttcgtcacctttgaaagccccgcagacgccaaggccgccgccagagacatgaacggcaagtccctggatggtaaggccatcaaggtggcccaggccaccaaaccggcgttcgagagcagccggcggggcccgccgcctccccgcagccgcggtcgcccgaggttcctgcgcggaacccgcgggggtggcggcggcccgcggcgttccccatcccggggcgggcccgatgatgacggcggctacacggcggatttcgacctgcggccctccagggccccgatgcccatgaagcgtgggccgccgccgcgcagggtcggcccaccccccaagagggccgcgccgtcgggcccggctcgcagcagcggcggtggaatgcgcgggagggccctggccgtgcgggggcgagacggctactcaggcccaccgcgccgggagccgctgcc

SEQ ID NO: 63948 - DNA, 3411 bp, Homo sapiens
tctaagatctttgataaacatctgctcacctaaaatggaaaaacggatcattctgctcatttaaaccaactagattttgggtggagagtgggagggattggtgtatgctactcttaagatttcagggtatctttcaaactgaatctttgtttccagtattaaaaagcaaacaaccagcaacaacaacaacaaaagtgatttagatcaaatgtttatgtaaagaaaattattttcactcagtaaatctgaaaagtaaatggataatgttggccatgttttgcctttttgctttttctttgggaatctacaggatcacctgtcccctcactcccaaaagtactatctatgttttgaacaacagtggaatactatatcaaaggtttggccaaccaaccacaaagctacaaaacaagcaaatcccaaatccttcaattgatagcattcattttcactaccaacaaatttattaagaaacaagtagaaaataaatcagtggtcgacttggggaccgtaatggcttccattcctaactccaagctacttgcctttggctctagagccagccactgagtcctgtggagagaattgagcttcttcccttaggggtggaggaatcaaaagtgagcagcttcagagctcaggagcaaaggtcagagaatccctgaaagagcttggcgtttcaacctctgaggatctcaaactggcatgaaggggctggttttcctgtccacaaaaggcgaggggttggatgggttgtttcctagttttaaggtggggagaagggcttcaacagaaaaagattagagtctttctccaagatctgtcaagaggaacgtaagtttcctcttaaacatcttttccattcagcacctgtggattccccaatttatctgtgagaaaggtaattgtacagtcaagggactgtagcaaccagagaaagaaggatggggttaaggttgatgacccatgttcagtgtaataattgctggaggaaacagataagggaacaacagcaaaaagtacttaaagggatctgaatgcaacacacatacacaacttttaacaacatgattttttttgacaataataaagtaggtgcattaaaggagaggacacactagtggctcagaagagcaaatgcaagaaatagctaaaaaatgatccaggaattaatctaacaaaaatatgtaagatctttatgaaaaaattaatctttattaaaggacataaaagaagaactataagagattgatatactcatggttgggaggacttcattatcaactattctcaacctcatcaaattaatttggaaaaacaatacaacttcaaatgaagtcacttcatgatttttttcacacagctcccctcccctcttcccgaataacaccatttatttgtgttgatcaatgatggaataataaaagatttggtaaaccaaccacaaaaaatcaatagcttcatttcaccaccaacaaattattaagaaacaagtatttagaaaagagacactaatgggagatatagctaatcttcaaatttgcatggtggaataaagagcaagaaaagccaaatcaattcagatgaacagttgttaggaaggactcatcctacagataccaagacttattacaaagctctagcaatttaattgtatgatgtcagcaaacaaggatagacagaccaatagaccaaaactgtgatcctagaaacaagtccacttctgtcacattatgcaacagaggtaattttaaaagtcattggtggcaaaatgaaattctaaaaaaaaaagactatttgttaaaagtgagattccataacagcatacacaaaaatacattccagatggtttgaagatttaaatgtgaagaggaaatttttaaacacttagaagaaagtgaagaaatgtatacaccacggtggggttgagaattccgttttaagacaaaaagtacaaacttggaaaatattgataaaattttccatattattattaaggtattttaatgataaaagtgactattaacaaagtgaaatttcaagccataatattggaagaatatatttacattgaaatgacttccaaaagaatgcttaaaaatcaataataagaaaaaaacaagaaaaaaatggacaaagacttacatttttgatagatgtataaattgatacaatcattttggagataattttagcaatgcctagtaaagttggaggatgcatactttacgacccagaaattccatttcaaggaatggacttaaagaaatttgtgcatattcacaaggagatacgcacaagattggtcagtaaagcaccctttgaatgtttacaacaaaagtagtctacctggagtggatcaactgagatttatgatgaagctcagtgtagaagctaatatgaatcagccaggtctacatgtatcattatgataaatatgaaaatattaatatttggtgaaaaaggcgaatcgcataaatataggtatagtaaacaaaataggatttgaatgatagcatgaaaaatcaggatatttagagttaagaggaaaggaaaaagatgggaggaggagtgaactttagctgaatgttttatgtctttaaaagtgatggctcttaagcaaaactgacaagtttaacatcttaaatttctgtggtctgtacattggcatctcttattccgtaagttcaaaatattttataatacacattttaatattaaaaaatagagcttagcataccacccagcatgtaattactgaaaaatgtttgttattaatatgctgaaactcagctgcaacattcttatcttggcaatgattctttctcctggctttgttctttcatcaatatgggtgatgccttattctatttaaatgagtttttaaaacctttctatctcggactgtgcccacagcttgtttaccataatctcaagggtagaaccggcaatacctgagaaccagatcttagaggaaggtgcagtttttccttttgttgtctgttttgaagtgtaatagcgatgaaaaacgttttccaatcaacaagctgtttctgaagagtaatctcctgaatattgaaactattaataaaaacaaagtattaacattaggaaaataaagactcactggagttcagtgagttaattttagagattatagcatacaaaggttgtagatctctcatacatatataatacaacagtctcaatatttctttactggaaatatttttgtaggaaaatatgccagaggtctagtcaattgagaactctttataatcactttcataatgatgagagagagagagagcttatcacatgttttccagaactcacccactgagtaaaatttaaggaatttgtatctcagtgaaaacctttatattttctatcatgtgcttttctccgatt

SEQ ID NO: 63949 - DNA, 1001 bp, Homo sapiens
atgtggcaactgacagcattaccgaatccccacaagatgaaggctgaacatcttctgtttctgatcacaaccggaattctactgtggctcctgtgactatcttaaagagtgctagaggtagaattttttttttcccccatagggcaatagttcccttttccccttgccttaggccaagtgagatagagaaggcttctctgctagtgttcctcctaactggggcctctaacatttttcaacctttatgtggtttccatgccccctcccttttagcctttattttaaaagtgatgtaactttccttcttttcctccatataaatgttctctctggggatagttactgtgttctcataaatgttttcctctttagaatgtgtttaagaactcaccaagcaaaataaggctgtattgctcttgctgtgcacacatgatatccaatgctcatggcaatttctttcagaacctacatgttctatttgtggtgaagtttattctgaagctaattactcttacagtgtagcacatctaagaatgattttaaaatgattttgataaatattttgtgagtgacattgaatgaacatatcaagcacagaaaattagaggaacgacatagcaatgatgtccttgttgaatgcatctcactatcatatttattaaagtgctcaaggggaataaaaaatatgaggacctattatgaaaattttagagaaaacagtaggaagaaatagtaaagctttctcaggtttgaaggctgcttgttatagtagagagagaatcttttgatcatatgcagaagctctcattctgttattcatgtagcttggacaactttcttaaaactttagaccttccgtttttttcatgtgtggtgataatacagtttcatcatatttatggaagttttaaataagatgactcatatacagcacccagcacagtgcctggaatgcagtggggttcgttaagtggtagtattacggcattctgcaaagcagt

SEQ ID NO: 63950 - DNA, 1073 bp, Homo sapiens
cgtggttgtggatttgcaggagttgaggacttgataataacatcagtctgccctagacaggttgacaatgggtcactgaaccttgcagtcaacagctggagaagggagagacagtagaatataaatggggctgagaagaacatgttttttgtgaataatacttttatctaaggtggtaaagggctggagtcaaagtcttgtaattgaagctgtatggcagcaaagcaaactagaggcaggacttgctacatcagcattcaagattgagaatgtactaacattatagctgcaggggtaactgtggcccaggctgtgcagctgaccatgattgactgcattaaaaatgggctaaaagcagctttcagtgaaatttgcagaaggccaatcctttccaggatgccaatctactgaggattagttttggataaattaatccttgtctcttagctaagcaatggagacatattggtgagccaaagtagacattgttaatcctcacatggaacagtgttcaaaaggtaagatagactggttaaattgtcatacaaaaagcaacattttaaccatgacaagcactatgaaagagagatacatagcactatgagacatgtttttaaaagcttgatgtagtataacagggatccccaactcctgggccaggaactgggctgcacagcaggagctgagtggtggacgagctggcaaagcttcatctgtatttacagccgctcccatcacttgcattaccacctgagttccacctcctttgagatcagcagcagcattagattcttacaggagcatgagccctattgtgaactgcacatgtgagggacctaggttgcatgctccttatgagagtctaatagttgatgatctgtcactgtctcccatcacctccagttgggaccatctagttgcaggaaaacaagcccagggcctccactgattctacttatggtgagttgtataattaattcattatgtattacaatgtaataatagtagaaataaagtgcacaataaatgtaatgtgcttgaatcatcataaaactatctcccccgactccctg

SEQ ID NO: 63951 - DNA, 2992 bp, Homo sapiens
gccagattaactttttaaatgtaaaaatagaaacaacaaaaagtttagaagaagatctatttgtgtttttatataattgagttttggaaaatttttctaagcccaacagtaaaggaggtatcaaaagttatatattgataaattttattacctaaagattaaaattttgtttacatctaaatgcctcaaagtttattcatttattatatatatgaataatttatcatatattcattatgatgtggttataggacttgctggttttcagctatggagctgctgtcagttcctagggacctcccacaattccttgccatgtgctcctctcacatgtccttttacaatatggcagtttatttcttttatgccatagcataaaagctcagatctctcttttatgatatcaatctaagtagctcagttctcaccctaaagttttaggaaaaattaataaataaggagtattcactctctaataagcatgcatattatagaaaaatatgtaatgagaagcagaaatacattaaaaattagtgtatagattacttaacaaagataaagcccacacaacatctagtttcatccaatatgttaatacctttttataactccctctttgtacttcctccatggaaaagatacatgggtaggacatgaggacatcctggatatttggtatggcgttctttgctgggtactgactatttttaattattttgaccattagcttccttacagttagcatattatcacttaacttgacagttgttttgaattaagaaatctcacaatcaatcttgaattggaactgatatgtgtgcttttaaaaacaaaatctatagtgttgtttggtatcaaatccagagttaagctcagctttgtcagaatgttggggcatacttccttcacaatggctgctttctagtggcagttgtcagggtataacttgaggttaaaccattctcagtgttccattccctggtttaatcatgcccttacctgaatccttcaactacctcacaggcagcaattcattgactcctatctggtatgagattgtaaactgaaagatgtcctgatttccccgttacaagatgatattgtcttctgttttatccatcagctatctttatcagtaacaccagaaaattatatataatatgattttatctctagtctcaaatttgtgctgatgaacttaatcatcataatgttcttattttcatttgtgttttgtcttattatgtggccacaaatacatagacagtgtatgtggttttagccttccattgtatctggaaatttaattgttataagccttttcttgtagaccttattctgtatttgtatgagattctaaaccttctacagtggctacaattttgttggtccctatcaaaatcagagatctgggaaaacaaaccataatgtttatattttccattaggggaaacgttcttgggaaagtaatcactctgggtatttagacagcctggaaatgcagttccacttttcagatgcttactggtttccacgaaaatgttcattccatgaaaatgttccgttgaggcggaatgaaggggctcgtgacagggaaccactgtgtgcttggcgttgtcctcagccttctgttcactcatttagtatagaccagtatatactactggctgagcatggttctgaagggtagaaatgcaaatatgagacactaattatgatctctatctttgaggatttatttctcagccttgtgaggaagaaaaacactaactagaaattgcaatccaactcacatatgagtacaaatgaaaacacttcatcctggaagcagaaaatacgcttctgctttggaatagaagcaaaattgaagactagaagtgaacctgaaaagaaggcagaagtgaagtaggatctgcataaactgttacatgttttctcttttatgtccagttaaatatttttgacagtagaactgcaaaaatacttaacattgaattgaagaatttctttgtagaagtgttgaagaaacaccatttctctgatttaaggaagtcataaatatatttgaatgtttgatattctaaaattgtttagtaatattagttttcactaaatggattttatgacctcagtcataacactgctttatttacttttattatttccagtggagtaaacactccacatataactaatatatttggaataactcctctgtccttcatttgttttaggaaggattagaacaaagctagatttaggatcctcgcgggaggggtgtgctttactgaaacactcatttgattttataaatgtttctagatatccaggagagatggaattaaccagtcctcagctccttaaggatgtaagtgctggctaaccagaacaataactatcaaattaaaaatagcggtgaagcggtactcaatctagggctaatccagtactatggcaacaagcactattcttggccctagtgagggacaggtactgctcctcctaatcattttgggttgctctttccccagtctcagatagcttcctcacacatttgcatgaatcaatacttggctaaatattctaggtggactctctggagatgtctggagttttttcttagtgcagcctcttttctctgttactctggcctgcaaatggtagcaccttttttcccttctgaactgttgtctttctatcttcaactaaggttatcagccaagctctgcctgagttcttcctccctgatttccataaaaatggatattttaatggaaaaatataattcatagaaattgactcaaggataagtaggatatataaatagggtaataaccatgtaagcaattttaaatctgtgaaagaattctctgaaagcatgcttactttggttagattgcaaataagtaaaataaaataatttccctgttatataaatcactgaagtatattttaaaagatagacaatatttaagttcattttacaagccag

SEQ ID NO: 63952 - DNA, 3229 bp, Homo sapiens
cattcagtccataaccatgtgagttgcctgttgtatatccagtaagatatatgaactgagcagtaggtctgacgctcccaattgaacaagactgaagataaaactctgaaagtcactagtgtattagtggtagtggaaactgcaataatcgattatacaacctagagaattttgttctgtgaaaagagaagagacagccgagaacagatcctgaaaacaaaaacatccaagggatgcctagaagacttgaagacttgcaaaacagcctatgagaaaatgattgaagaatgagaggaagaagcaagaatgttcagaagccaagcttatgggagtgacttcttgctttaagtcacttttgaatagctccccacaatacagctttctcaattaaaaatagccaaacaaacaaaagggaagaaaaatgtacattcagtgacaaaagcctaaaattaaaaccaattcctaataacatcagaatcttttaggaatctcccactccattccttaacactctcatgctttgtctcataccattgaggctctgaaagcatgagtggaaactaatatataattcataatcagctaaactacccacaaactactccatgaccaccttcctcctggcacatttttgtgtatatatatatatatatatatatatgtcttcatctcatccatcaagctgctccctccaccacccatctgcaaggttttctcatcatccatgtgtgtacctttgatgcaccctcctcaaagtttaatgtgcactgaaatcaagtggggatcttgttaaatgcattttaattataggtggagtctgagatcctgcatttctaacaagctccagctgatacatcactgctgatctgaggaccacacttcgagtagaaaggatttttctcacatctccacctgtttataacatacattcttatatatggtctctcaatctctgcccttttatttccccattgatgcctctttcaacgttactatgccctctactcctttctgctgatccactatgcatctgtagcttttattctggcattcaataatgttgttatcttcctcacttcattcttatcctgtgccttaactcgacacaattcctactgctctttccgttggactttactttgcattaggaaagcaagctgattaaatgaagccacactagtgtgttagttcctaatagccattttatgcctttctgggtgtttgttcaatgaacctctcaggaaagtaggctgatgcagggagattttccttaaatcataccaagtggcatcactgtgcaagaccaggcttgtgggttgaagggaagaaacaagaagaacatggtcttccaaaatctcttaattttccctgaaacaggagttgctcctttctccttctctgattgctttttggggcttggggcttgaaaatgccaggcatttcagactccaaattcataagaggcagtgaggattatagagattatggtttacagacccaaaattgggacactgtggtataatgacacagaatatctgaaaatgtgactctctcagaaaattctataaccctgtttgcaatgtaaaaattgaataaggattcagttttggctctggtattgtctatgaatttttaaaaatgttattcactctttaaaaaaacctttgttttttttaatcgccagacataataaaatctatttcaaagataattacaagaattaaatccccaaatttctatataatgtgagaatccagaggcaattcgcctcccttgtacaagtagtattgcattaaatcttcacaacaatctatgtctgcactattttttttactgcaactgtacagataagagaacagagaaacagaaaatgtaagaaattgatccaaggtcacaccactattaagttgcacagctgatttgaactttggcagtctgactccagatcctgcaattattctattttgggcaaagtataatacaacattctttttggacctaatgcaaattaccagcagttttcagcatggtgagcatgagcatttttacagcacagcctacatctgactgatctttgtatccctcctccaccccatcccaggtcttgcgctttggcagttgctcagtatatttcagttaaacaaatgaaaaaacaaaactctatggcaagtggcaaacagttctgaatggagaatgtaaactttagtcaacaaaaaaattatcaaaggcacaaaactttaataaatggccaagatttccaagcaaatttttattttacttttctactaaaaggtcagaattcatcaatcttaaaatccctggtaagactgaagttcaaacgaaggatgtctgtaattccctctttttatcccttaaaagcatatagcccattataataaaatatttgctcttgggcttcttctgtcttattactctaaaaaaaaaaagagatgaaggaattgacactttctttttatgtaactaaaaatatcataatatttttatttagttttattttaatataaataaaatatttatatattttattttaaaatataatgtttttttaaaaaatcatgatttaaaatcatgattttattttaaaatatcatgatattttatttagagttaatagggtaacataatgcagttgatgatttcctgttatcaaatctggatttgggtctggagagaccgatacaccttctcaagaacaatgtacagcaccaatacagcggtgtttcttgcgataattaaatttgtcatcattctgccagccacctgagaactctggtgatgtagtgacatttatcttattctgaagacagtatggagaaaaaaagtcaaaagtaactaatccatgaacacagtagtattttacaacgtgagttacagtctagaataaatatctaatgtccaaaaagcccagctggacaataaggagactaatttttgacctcctaaaagtcagtgtaggaactcagaaatagttattagacttggaaagcagattactatgatatgtgatagttaaacttcttttctgtttccagaattatctctgtttcccaagagattgcttttttcaatatgtataccttagtcatgctacaggcattccttaaatatataatggctcacagttgcccattcatatttaagaataagggagtagtattgacgagctctgtgtaaataagtggaatttagcaactggcaggcttcacat

SEQ ID NO: 63953 - DNA, 1201 bp, Homo sapiens
attataacctattgattaaaataaggatcagtgagtccatagtgagataaatgattaaagaaatatgggagaagcaaaagctctttcttacagtacagaatcaactagtaaatgtagaaggaatgatagaaagttaggaagtcattattagcaaacatcatagtaattatttaggcatgaatcatcaatagagtataaaactagtgggtaaaagtttgatgaggaataagatattaatgtaatatcaaaggatctctccacaaaatacttaattgtaaagggaagactacaaatttatagtgaagaaatttggcaagcaccacctttatctagtgataaaaattaacatcatttagaatgatacaaatcaacattgtcttcttgttatgatctgctgagaagaacatagcatcatttctgtgatgttcctgccataaatgcataacctgaatctaatattgaagcagcattattaaactcaagttgaggggaattctacaaaatagctagcttgtactattcaaaaatgtcaacatcatgaacgagaaaagacagaaactgtttcagacggaagaaaatgaaaagtgacaacggtagcattttatctcaggcagaacttgaaccagaatattcttgtactttcctttgctataatgtacaatattgggactatttgtgaaatttgaatggaatttgtgaattttatggtctcaatgttcattttctcaattttgtacttatataggagagtgtccttttcttagagatataggcataatggattatcatggcttccacttattttcaactggtttggggggaaaatgtgtgtgtgtggataaaggcagggtggagtggggagagagaatggcaaagaaattgtgtcaaatgttaacaattgggaaccctgacaaggcatactgaaattctttttactcatcttacaacctttctctaactttgaaattattataaaataaaatgtttttaatcactatttctttgccactttttgtacttcaattttctttcccaacttcaactaccttctagtgatcttcaaaggctcatggaaataaatttataaaatacagaaatgaattcattaaaataagaagtgtaacatggtgtttaagcttttgtgctcttgaatcaaacttcctgagttcaaaattccaacccatatgtggttttaaggcaa

SEQ ID NO: 63954 - DNA, 1025 bp, Homo sapiens
aatccacgtgagaattttaattataagaatgagtgggttttcttattaacatacttaaaaaccactgccaccactgcccagattcatcagacagtagggaggatggggaagcataaggcagctacttttactgagattcagaacggaacaaaccctggatactgcaggcaatgcccaatagtttttccatgagctatttaaaaactggagaagtattggattttatgaggtcagtcagtgaagcagaaaaagctcagtttgcctgtgatgctcctggaatacaagtaatatatctgcattgcagcagaggagcaatgtagggaaggaaatgtaagaaaactgggtgaagagaaacacaattaaaatcacatgctccaagctctcagtctaaaataaaatccttctcaagttattgtctttgaaggacattatggcagtcaagagcactggttttatagccagacagatctaaatgtgaatcttggctttgtcacttgatgctcaacagttaatcttgaataagttacagaacctctcgaagacttagatacctgaaatagaaaatgggatgatagaacttgcctcagagttttatgtgagcaccaaatgaggtaatattaaaatgactgtcacacgtgttcagtacacatatttattgctccttttctgacagaaagcatgaagcaacaagaaaaaaagacaaatttgggaagaaaaagtttttatttatttttcactattaagttaatattcttgtagttttttgttaactttttatttagagatatacattattaatataatacattaagaaataagaaaatattaaattattaagaaataatacagaaatattccagtttgaagaacctttattcaatttagtcagtttagagtaaccctcattaaactcttccaagcacgaatctcctccatttctataattttgtatttttaagaatgttatataaatggagtgatgcagtgtgtaacctttaaagattggctgttgtttttttaaactc

SEQ ID NO: 63955 - DNA, 1569 bp, Homo sapiens
ttacttctttgagtacttcttcagtccctccctctttctcctttcttcctgggattctgatgacacaaacattaaatcatttgttatagtctcacagatctctgaagctctgttaatttagtctatttttttctctgttgttccaattaaataatttctacatttctttcttcaagttcactgattctttccttggcaaatttatggcaggcctgaatatgcacaggtctttaggccctcagcttgaaaacatgattgtcagcataatgaatgcctagatctgaacctcaaagtgtactcacattaaacaagctcatggaggctaatgacaaaaaccttaaatgccaattaatttacttaatttaaaataagaagtttaaccatcaggtagacttagaacaaatggtttctcggtaggcaaatgaaaatggaaaaccttaattataactaaaaggctgcttagttagcctgcaactaggaaaagaggagttatttggcaattttaatgcctgatgtcatagagccctggaaattactaagtacatctccaccacaggatcatatctgccatatcacctggttggttatgatactgggccaggacactctctcttctgatcgtgaaataaaatactaccacggtttgactttcctttttctaaacatcttttattggctaaatatcttaaagacagtcatgtttttactctatatgtgctagtacatttaaacacttctgttcaagtcttggctagagcttattctgtctctgctttgtgactttatatacctctctaatttaaatgattatttaaaaaatagtttaaaattcaatgtgcaactttctttccaactttctgaaggttctctcattgttttctctatgaaccacatactaaaattactggacaacaaagaccaagtaagaattggtctttttcttttgggcaaaagctttttttttttttttaatggagtcacagctgacaagaccatgtctgctctataaaatcagctttaagaaatagaaagagaaattagagctcttagaaggtgggagagagtgagttcagtttcatgcctatacttctggttttaggggtttgagggaaagagtggcagtagggggcaaaagttaggctatgagggccatgtccaaaagtccctcaggttctgtctttggagaattgtagactgcctttaagggaactgcaaggtttccttcagtatacgttggattaattggttcctctggttaaatagttaccatgcttagttttaatacaactaattgatttcttatcatctgtctaataatttagttcaaattcttttccatttaaggacagaattctaatgttctcacatttaagaaggaaatttagccaggtgcagtggctcacacctgtaatcccagcactttgggaggcctaggtgggtggatcacctgaggtcaggagttcaggaccagcctggccaacatggtgaaaccccatttctactaaaaatacaaaacaaaaattagctgggcgtggtggcacacacctgtaatcccagctactccagagg

SEQ ID NO: 63956 - DNA, 1746 bp, Homo sapiens
cagccccaattaagctttcagataactgcagcctcaaccaacatctggactgtaacctcaggagagaccttgagccaaaatggcccagctaagcagcttctgaattcctgaccctcagaaagtatgtgagataggccagacgcagtggctgacacctgtaatcccagcactttgggagactgaggtgggcggatcacctgaggtctggagttcgagaccagtctgaccaacatggagaaaccccatctctactaaaaatacaaaattagccaggtgtggtggtgcacgcctgtaatcccagctactcgggaggctgaggcaggagaatcacttgaacctgggaggtgaaggttgcggggagccaagattgcgccattgcactccagcctgggcaacaagagcgaaactctatctcagaaaaaagaaaaaaacaaagaaagaaagtatatgagataataaatgtttgttattttcagtcattaagttttgaagtaatttgttacatagcaatagataagttaaacatctatcctttttaagaacagaggataggagagctgactaggagatctgtgttttagggtgggcttggtaactggaagtctttccttaaaatgaatttttagaaaaggagaaagctttgtgaaagtaggggctaactttggtatgataacagcttcattagacaccctcgttttcccttaagagttcatttaatttattcattattctttttcctactgatgattctttctgttatggcgagggttgaaagactgttctatacacagatcttcaactaatcttttagtttgcaaccaacttctgccctcatctagggttttgtcaggcatatagttcccttttccctttggtgccttgcagctatattcagactatgattccctccaatttattgaatttgtcagcattcttctatctgcttttcatttacagaaatatgttgaaatatttgctggaactgcatcttcacactttcttttaccttctgttgttctctttgctattttgattatataagttaaaaagcttattttactattcttttagtaggattcagggattagggaaggcgaagtatgctcaatctgccatctagaaccagaactcttctatgtggcatattttattctattcattcagtacacagcacttcacttttaaggatctacagcagggtatggctgttttgtggtctttatcaagagatctcgtgggccattgccctccctttattcactcttcatattgtcttgccagtggggtcactatcctctctctaggctatttttccattcattcaaaaatttccttcattccccaagactatcaaaggtatcttatggaaccttaggcctctggaagagtgatcctctcatgtctagggtcatatagtggaactcagttgggaatgatccattgatacagacctctagtcaagtcctggccctctttcatgtagctatacaaaatggagcaggagggaacaatccctgctaccaaggctagcatagcaagtcagtatgatgagagatgaagactccattcacctttcccctgccagaagtatcctcaatctccatggtctacaatatactccttctcatcaatccctgtatcacaagaaacccttgaccacagaaaaagaaaatgtagttcttagaataaaagaacatctcttcctccctaaactagagaaaggcagctctacaaaagatactcttg

SEQ ID NO: 63957 - DNA, 1025 bp, Homo sapiens
tacatatattatacatatatatatgatacacacacacacacacacacacacacacacacacacacacacacacacacagtttaccaattcagtcatgtgctgcataacaaagtcttgctcaatgacagactgcatatatggtggtggtgtcataagattataatggagctgaaaaattcctactgcctagtgatgttgtagctctcatagtatcatagcataacacattaccttttctgtatttacatatgtttagatacacaactactaccattgagttacagttgcctacagtattcagtacggtaaaatactgtacaggtttgcaccctaggaggaatatgccacagcattcaatctaggtatacagtaggctgtaccatctaggtttgtgtaagtacactctgatgtttggacaacaatgaaattagctaacaacacatttctcagaacatatccttgcaattaagcaataatatgaccataacaggatatatatatcctgttggttctgtttctctggagaatcttgactaatacagggtcgaattcttataaataaggagaaattttttgctgctgtaaaaattgcacaaaagtgaaagggtcatattaaatttggaaatagagatatgaaatatttaacgtagatattctaaagataagaaaaatgatgatcatagttctgtaccatgagactttaaattgaaagttggctttgaaagtattggaaaattctgacttaaaaatacaaaatatactaagtaaagagaaaaaatagaagaggcacatgaagatgctaagaagactgtagagggagctgtctgatcagcttagatactaaaggacaatctaagatgaaagaaaagaacacacaatcaaagactgccttacatgcactattctctgagaagtaacttattaaacatttgtgtgaataaagctgaaataaaagacaattatgtttaagaattgtgtctagaaaatttgtgttcaaatatgctagaattgcaaaaaatgctgtg

SEQ ID NO: 63958 - DNA, 3362 bp, Homo sapiens
gatcatgctctaataaatatttttgcagatggagagaaagtagatgtctcagtcctggtttggttctgtcttctctttcaaggtataatattgggctgggaaggactctggacttttgaaagaaggaaaagagtgcagagggagagtggaacatcagagagtttcagctcataccagacctagagtttacagtccaccttctaagagtttgcaaaggggattcttaatatattcacagtttggtcattgaaataatcatttattaagcattctgtcctattcctgtcaccaggccagacactgggaatacagatgaagacaatacaatataatttccttgggagtttgaagaattccagagtataggaccacagctggagatgaggaaatgttctgatttctcctgggggaatgaagtgtgttccctgaattagtggcttcctggtttttagacaataaggcttcaaaccaggttgacacatcccatgtcaaacatttggtgggcaataaaagtgagattcagtcttctgagtctataactcatcttactttgattctgctctagcccctagtccttcttctttgctatgtcctcctagcttctagtccttagcttggtctcttggttataactctgtcctcactctctgactaaaatactgaattgactttaattcattcatttaatcaacaaatattgactgaatgtctgtcatatgccagcctttattctagatgctggggatacaccagtgagtaaaacaatgtctctgttttaatgggacttacctctggtactggtcaaaatataaactctctctctccttctccttattatatatatatatatataatatatattatatatatattatgtatatatattttatatatatatgctgtatactgtgtatttatggtatgtgttatgaagaaaaataaaatcagtgtaagaaagacaaggagactgggggttataacacctgaacagagattgaaaggaattgagagtgagagccatgcttgtatctggtgagaagaacatttcaataaagggaaataccagtgtaaaggctggaacagagtgagtgggggagactggtaagaggttatagttgtagtgagagcaaggggagcataggatgtagagcctgctaagccatggtaaagattttgactataatctgagactgtgagctcctgaagggctttgagcagggaagtgccatcatcttatatgttttaatagtgtatcttggattgtcatatatagaataggattggggtaggggtagataaaattagaagaagagagaagagttaggagtctatcggagttatctgagaaagagttgatggtagcttggaacaagttgtaatagtacacgcaggaagaagcgatgcaactgtgaatatattttgaaggtatagcggaaaggatttgctgcttgattagatgtgggctatgtagaatagagacgtaacattcctggctttggccatagtgtcctctaagacatggcttatcctcatcttctgattttatccacttctagatactttggaggctgactcttcctacttccattgagaatcctggcacccaactctgacactggccttccttgactgtgcccctgctaggcttgctctaacctccccacaacccttcccaaaggagaattaaacaggctttttcttctctcaagttaaataaaccccctaattaaaatgactttcattgtgtcttaaaaatgtatgtaaatctaaggaagattggggttaactatgtagaaatctgtagcattttatttatgtttcttcttgactaaggaatcaatgtttagggacttgagtgatcataaaataaaaatgggcacagaaatcgtgactaaggaggagaaggttccaggaagatgaacttgtgttttcatatcaagccaaaagacagatgattcagaagtcttttcctccatgtcatggtgatgaatttattccagaaacgtctaacttattctaccaagagtctaatggctacgagagaaactaagtgctgattactgttctattttctacagttgcagtgcatgtcatgctttctcccctttacactaattggatcccaggccaatgtctttgtaatgggagttaagggtggtattactgcatccctggtcagaccaagggaatccagcttttcttctctgttttgactgttgcacagttgccttgccattcccaaaaatgaacaggaggtgattagcactctggtgccctatttaagctttctggctccaaagagaagctattttgaaaagtgaaaagattacactctgataatagaccagaggccttacacatgtgaatggctcacagaggattaaaagagcagacccagaataaatgcagcctatacctgatggagcaaagagggtgaatcgcccgcacccttgactgcaggagctgtttgaaggaagcaccttactcagattattgatgcctctgtgatccaacgtaatggtgggaggtttaggggggcaatgtctgatccaactgttgtcttctcaagaaaccaattagactgcttcatagtcttctgatgtctcagggatcttagttcctaattggtagactcttcccttccaactttgatctctttctgagtgttcctgcctgggaacattttcccaaggtcaccaatcatctgaagaagtgtatgcatgagggaattcacaattgttccaacttattttaaacacaagatgatgcaaattggaattttgttaatttcaggccaagacccctagaagttgcactaagaggggcccattagtgcacaaggcctttaagtcctataggtcagatttaaagaggccaaagctctgggaagactagttcactcaactgtgataattccagtatgttaatgtgttcatgtactaggaaaaattatatgttctgaggaatcaatgtttattgtaaaattggtctcaattattttctgtccaggaaagctaacctaggaaactaagaaattaaacaaatatattcaataacgtgattgttattaaacacatattatgtgtcaagagccttcccttgacacataattaggtccacttggtccagagctgagttcaagtcccgaatatcccttgttaattttctgtctcattgatctgtctaatattgacagtggggtgttaaagtctcccactattattgtgtgggagtccaagtgtctttataggtctctaagaacttgttttatgaatctggatgcttctgtattgggtgcatatatatttaggatagttagctcttgttgcattgattcctttaccattatgtattgcccttct

SEQ ID NO: 63959 - DNA, 1366 bp, Homo sapiens
attttgtttttggtcctcagattgtctcatgtttggacaatgggagccccttcaaagttgactcctgtgttcttttggaatgacctaccccaacaatctttgaaagcttctccacttttgggtaccaacaaaatgcttcatgcatatcttataaattttatactacaaatttgaattcagccatttctttaaggcatcttgatttcttttaatatgagtttgtattgtattttgctgtgttttctaattataaaatcatattctcaatgcagaaatgtggaaatagcataatagtgtgacaaagcaaaaattatcctacaattttaagggaaatacaggtaacattttaatatatgcttttccagatcttttgcaatgaaattctacataattgaaataatgttacatataaattaatatattgcattttcgtttcaaaaaaaattcataacaactctcatttcattcaaaacttcacgagcattattttaacagtagcatcatgtcccactatatggacttcatataatttccctaaccattctccaaatattagacatttaacttgtgcttataacttatgctttaaaagactgctgtgtatttaagtctttgatctcattatatgtatatttattttaaaatctaatccagaagtagaactcatggatcaaaggatatgaagatatttaaaactctggaaacctattactaaattgctatccagaaataattatactgtacccttgccagcattgagcattctcattttagaataaagtttgctactatgatgggtgaaatattactatcattgttttcatttgaatttgtattccagatatattaacacttgatctgttatgttactgcaaatgttccctggtgtatcatttgattttcagtttttgatttgtttttgatccacagaaacgtatttcatccgccagtatcttcttttgaaacttctttcagtgcatttataatgtctacgttgataacagaaataaaaggcatatttatatacagtttacgtaaattaactataaaactgagtttagtagagcacatatgttccataaagaaagaaataagagcaagaaagagattagctagtgtactgcatggccatgtcagtggagtccctggcctcactgtaatctggatgtggcagagcccttttttttttcagctctgttcatctgtgaggggcaaccaagtctctcatatctggcagaggtgatctctatcaggatagtcactgctgataaccagttgtaatttaacaatccacctcggctaaaacttttttttttgagacggagtctcgctctgtcgctcaggctggagtgcagtggcgcaatct

SEQ ID NO: 63960 - DNA, 1621 bp, Homo sapiens
agtgtttattgaatgaatgaaaaggttgagatgaataatttaaaaaataaagcagatgtgttcatgtatttttcttaagagcatgaagtgcatctcacctattacacataaatagttaaaatgttttagtgttttccaggagaaaacaaatatgcaaaatgctttccagtgtctcctttaatacttacaaccttctgagttacatgctatattagttccattttatagatggagaaactgaggctcaaagagatgaagtaactgctatttaaatcagagagtaggatctgtgatcatttgatgctatctagtgaactgttcatgtggttttatcttattaaaagtgtgcttattgtagttacaccttttctaagtaagattttatacatcttagaacagcagttaacaacaaatggtaaaaagcatcctttcttgcttctttcttgttcagggggtagtgctagcttttggtagaaacagttatctacaaatgaccaggttataaattatcaaatatgggaacaaggctttatctgctccagaatatatatagataataatatagaatgcctcttcagcttgtgggaaaggaataaatgaaggagtgacataatctgttattaaagaatatgtaagagactcagtagcaaactaatgtgtctttctcttatgtaggaaaaacactctgcagtttcctttgggaaatccagaccccttttggaggcagaagtttgcctctcttaacttcatggggtgccccactcccaggagcagcctgctttggaaggtggcctccacttccagctttaagtaggtctggcatttgtctctttgttggctccatgacagacagatggagcttgattctaaaccgacctgctgggcttgggtatgaggctttcagacatgaaatcttgattaacagcaaatgttaattgaagcagtgaattattaaagtgtttttccataaatgataaatgctgttgttggctgttttacccttcgtgacatcataaaactttccaagaaattgctagctgtgaccaagaaaaacaggaagagatggcagcatttgatggtgttcacagtgatctgcttatgctctgtggccaggcccagctggggatgacacatctttttttttttctggaatcccacatcatctcaatgaaaccaacaaatcatctttccctcaaatgcagaactctctgcaagtgatctcatccagcctcctagcttcagcttgtaccaatagctgatgactctcaatctttacctcaaacccagattttctcctgagctccagacttacaaatactacaattattattgagcaacttcacctgatgtctaataggacctcaaactcatattcattcatctaacaaatgtttatcaagtacgtgtcttatgttctcagggtcactttattctaggtaccagggaaacaataatgaacaaaatagctgtagctccttatggaacttacattctagtggtgacaggaggagaaaaaataaagcagagaaagaggatcagggagtgctgagcattggtggtggttgtggtggtggcagtggtaggggtttgtatagggtgctcagagaatatcttgttagat

SEQ ID NO: 63961 - DNA, 1309 bp, Homo sapiens
accatctggagaactagagtttcattttattttcttttactgtttagtccttttacttttaacacttacctgcatttaatcttccttgtaatttcctgataatcttaataccttttatggctttttttctcagaccttatagttactgtagtttgttttctacttcacaattgtcccttgttagcccacccatgcatgttaagatgttgcccacttatctcttcaatgtatactctctgtaaaaccagctcaatcaatcatcatagtatttgccagaggcagggaattttctgttattgtggtttggaagtgttttcttttttccttcaaagggaacagcaacttagcaagataattgatctgtggtaagaaaacataccccataagtgctctataaggattttcccagactcttcagccctctaatctttaggttgtgaaagtgaagattttcttttttcaccacctttggatgttaggtctcctctccttctatctgcatgtagttcgatttctttaaatttgtaatctgagaagttaagtaacatatctgtgactctctgtctcccttccatgctaatgatggaagacatgttcgatctctctcaaactcgaggatacatgttttttatcaattcaggaaaattgctttaggttaatttcttagttttgtaattgtttaattttttcacatctcttttggcaccacaattatgcacaggttggatttgcatctgtgacactccttaggttttatgttcagctggttgtgtacagttgccatctattctagttgtagcacccatcttgattggttagtacccatttcatcagttgaacgcatttctaaatatcttcctggtatgataacctttcaccagtctgtgagccagtgccagtcccagatgaagtttgcacttatctttggctaattgaaaaaattgggataataaaattagtttgtaataaagataagtgtcttcgacttacaaaactcatctttattctgagtctctatatcatccctaaattttttattacaaagtattctttgtcttatgaaaaaatgataatggtagtgtttttttttctttaacattcttacttggctcaaagaaagataacactaagttagtcttcaaattttaaaaaaagagaaaaatttgtaaaatataagaatctggaaacaggaatctttgtcatttctttctaagttaatgtctaggctggcctgttagtttatgaatccatctgcatcatttctctaggaaagatatttgaaatttaacttttgagttcttaattattt

SEQ ID NO: 63962 - DNA, 1086 bp, Homo sapiens
gaccataaaacaaccagaaaacaaaccattacatgaaagacacagaaaggcagacattacatgttctcacttatttgtgggatctaaaaatcaaaacaattgaactcatagacatagagagtagaaagatggttaccagaggctgagaagtatagtgggggactgtgggggaggtggggatggttaatggctacaaagaaaaaaaaagaagagagagaatgagtaagacctactacttgatagaacaacagggtgactatagtccataataacttaattgtacatttttaaagaacttagagattgtaattggattgtttgtaacacaatgggtaagtgtttgaggggatggataaaataataataattagaaataaagggtctgaacaggaaaggtcctccctcaatataacaaacacacaaggcattgggataaaataacccacagtttcatgaaaataataaaacctgataaatataaataaaagttttgagcagatatagcaaagtacattaatagatgggagaatgaccatctgctaattttgactggagttctaggatctagagctggaaagaggaaacaggaaaggctagcaaacagttcaatataatagaatcagagtaatagggaaaaaataacacctaacagagaacacaagctggcaaccagggaaattatcaaaagaatgtgaccaataataataataaagcagtaaagaaaagagaacaaagttcaaagccaaagttctactttgaagagaattcaagcaagcaagggaagggagaggaggagggcaggcgtgcatggtggggtgggtagaacctggagtttcctatgaatgctgattcaaatcctcttttatatgcagttggcagttacatccacaggtgttacagatgccaaactattcaataataattttccaatagctaatttagaagtcacatacaatgctgattaacactccaacaagattttaatcttagaaagcagcaaaatgcttcgcaatttcatatgaataatgaagatgtcacataatcacagaacttacaaagcagctgtgcaggggtctgtcctaccag

SEQ ID NO: 63963 - DNA, 1054 bp, Homo sapiens
aaaatttcaaaaattcatcaaaatacacatgcagtataattattagaaagctaatcagatacccaccagaaaagctaagtgtaaagtgtttgtgctaggattttaaaattatttctttttgattgtatatatttaaagtgtccaatgtgatgtttccatatacctatatgtagtgaaatgattactccagtcaatcaaactgaacatatccatggtctcatttagttaccttttttagtatggtaaggacacttaaaatctactctctagcaaattttcagtgtactaataacaaattattaactatagtcctcatgctgtacattagatctctagatttaatcattctatgcaactgtaactttgtaccttttgacctacatctcctgttccctgcccccatccccacaccctggcaactcctcctctattctgttgctatgtatacaattttttttaagattccacattttgtttctgtgtctggcttattgtacttaccataatgtcctccaggttcatccatgttgttgcaaatggaggatttccttctttttaaaggctgaataatattccattgtactctacatttttttttttaattgagaagcagtctccctctgttgcccaggctggagtgcagtggtgcgatctcggctcaccacaacctctgtcgcctgggttcaagagaatctcctgcctcactctcccgagtagctgggactacaggtgcacaccaccacgcccggttaatttttgtattttttttttcagttgaaatgaggtttcatcatgttgtccaggctggtctcaaactcctgacctccagtgatctgcccacctcggcctcccaaagtgctgggattacaagcgtgagccactgtgcccggcctagtctacattttctttatcctttcctctgttgtggatatttaggttgcttccatgtcctggctattgtaaataatgctgcaatgaacatgggagtgcagatatcgctataatgtgctgatttcattttgggggagtttatggccagaggagggattgctgg

SEQ ID NO: 63964 - DNA, 1038 bp, Homo sapiens
acacaatctgggagaaaatattaccacataggcaaccgacaaaagtaatatagagagcatataaatatatctttatatcttccaagatataaaagtctagaaaatctgtattatcagggccatgagagggttataataattaaggcttttttcttgtatgatatataagtaattaaaacagaaaaatatcatatttcagggtattttcatggatgctaaattacttgtacacaccatcaaaaagttagctgaatgtgtttttagataatgcagtctacatgaaaatagtgacagatttattcttggccttttagttctatatgagaacccagaaaaacaaacatattgcaccattaggcatcaaagtgaaaaaatagtggtgaatgattgataatccatagtatagtttaccaagtgaaaagtactgacatgttagtgcaaaaactcttcttaaaaataaaactaggttagaatcaccaaaaatgaaatcattgcaatgtctaaatctttaaaattccaagcagaaaaatgggtgttgactcagatgtgtaataacatcagcaggttttctccatcatgtcctgtgtcaaggcagatgtgccctccagcaagtgctaagccacagacctatagctatcccctgagggctaatggtaatgcttccaacttgctactaaaagcctgaaataagcatcatctagtgaatactgctaaactcagtttatttgttgctaaaaaaaatctgagaggtgacagataatatgtttgtcatttgccttttgattctctttttcaaatccagacaaaacgccaacacctaattgtcagcattcaagagaacctgaaagttatcaagtgcaatatcccattagtgtttaaatcctccctatgaaatgcccaccaggtgttcatcaagctgattgtacaccagcatggcagagatccaggcctatggtgcagagcagaagtagtacaataaatcagtagggagaagattactttttatgggagaagattatttttatatacatcatccat

SEQ ID NO: 63965 - DNA, 1036 bp, Homo sapiens
tagaaaactgcttattattataactatttctcttgtaactttgtatgatttcttaggcagctgagaaaattttagtttttatataaattagtcaatcttcctcatgacttctcattcttatgccatcccctaagataataaaatatcgctctttggtttcttctagtatttacacaactttaagttcttcctttagattatcaagccatatgaaatttatttttatatgctatagagatttacattcatcttccaccagatagagagccaaatactcaaaagtcatttttctaataatcagtcattccctcacagactttaaatgtcaccactttaattctaaaataatatttgtactttgatctgtttctggactctttcttttgttcccattgatataattcctcatttttacactggcaccttacttttgtaagttttaaaaatggcaatttttaaacatctgctaggcaactcttttattattctttacagtagattctcaattattattccaaatgtacactttcaagtaaaataatcagctggcagtcaatcttcttattgatttttagttcattttgatcttttaatctcttcaatgatgttttgatttgaagactatatgtcctctaatttatctggaatgcagaggttttgatttcaagattttcttttttgtagtttctatgaatatgtttcatattctctcctttctggttctcattaatctataataggggagcagggctgctacctgtagctgcacaggttatgtactgtacaactctgtggagcatcgtttatggagatgcagcacaaatcttgcaaaactgttaggcagcaggctaaggatctgttgtatgggatcttttatttactgaagagttggcatggagtaattctccttgattttcacctatggatacctggacactatttcaattgcggcataataaactgaactagagaatcatttgtcttagcttataatctttgtatagtccttcagttattgtcaagagacgggatacaa

SEQ ID NO: 63966 - DNA, 1038 bp, Homo sapiens
ataataaatggggaatagtaagcaaagcacttccgtgagttctgtgagtcattctagtaaatttagtaaattattaaacttgaggagtgggttttgggaacccctgatttatagccagtcaggcagaagtacaggaggcaacctgaaacttattattgagtctgaagtggggcagtcttgtgagactgagcccttaacctatgggatctgtcatagctctggatagttagtgtcagaattgaattgtattgctggacacccagttagttttggagaattggagaggtggtgtcaaaggacaccacatctaccctttagctttctatcttctgggtaaatacagaggactccgaggccccagaggaaggtgaaaccacaagacagccggaacctgtggccctaaataaggtagataataaacacctaccaagaatatttgcattagactgttatgtgaggaagaaattgttttttgttgtgttaaaccacacagattgggtgtttgttatgggacatgctgccaagtaaaatgtagaatcaactagtcaaatcaacatgtgccatgatctctcccacttttccttactgggttttagtgtcttttttgtctgttactctctttattgatgttttgagtcacatattacatgccctctttaactttcctgaaaatgtaaagaagtttttatttcaacttaggataaaaccataggatattattagcaatatcctaattaatattaacagttgccaccaaatataacaagttttaaccggtgtcataattctcctcattttttaccctcctttaagccaagtagataattaatggttcagtatgaagctcttggctcacaattagtcccattaactcataaatctttttttagtgaggtagctttaatttttttgttcatttgttttcatatctgctcagttaattttagtcaattgatgccaaactaatctgatggctaagctaaccttcttctaggaattgaatgtttgtatttcatccttattttccttatctcctgc

SEQ ID NO: 63967 - DNA, 1115 bp, Homo sapiens
gctagcagaaaaacctaaattttcaagaaactttaaccttgttcatggaatgacaaggagtccaatgtggctggagtagagtaactacgaggaaaggtaaaagataaaatcagagggtggcagagacccagatcacgtgaggtgttattggtcattgcaataaccatggtgttactctcagtgagataaaataccactggagagttttgagcaaggggaggacatgatctcatgtaaattcaaaggatttgcattgaccactgtggctgtgttgagattgaatagcagagagacaagggtgaaagcctaaaggccagttagaaagctaatccaagtgggagatgatcatcaaagtgaatgtggagaaaagtagtcagattctagatatatgctgaacacagatattaaaggattgatttactgatggatcaatgtgagctatgagagagggcagtcaatgacgactgcaaggcttgagcatgagcgatgggaaagatgcccttagctggatggtctagagcacaggtggagcagagagggctgggcaggagaggaggctcagttttgggcatgataaatttgaggtgcctatttgacattcaagaaaagaggttgaaaatgtagttggatatgtgagtcaggagttcaggggagatgtctaaactggagagataaatttaggagtttttcttttataggtgatatttaaagccatgagagacaagtccccaagggatagagaataagcaaagcaaagtccatggcctgagccctgaggtgctacagcattaagaaatcaggagaggaggaagtgccaacacaggatgctgaggaatggtaaggaggatggagggaatccaagagagggaagccaagtgtccaatcctacggactagatgtgaaattaaatactggttcaaaaggaattaaatatggaattaaacattgagttattagatttagcaatcatgaggtcattactgatcttaaaaagtgtttttggggactgatgaaagcagtctgactgaatttgagagaaaatcaaagagaattatatacggcaagtatacacaactatttcaaaaagttttgctgaaagctgagcagaaaaaatg

SEQ ID NO: 63968 - DNA, 1049 bp, Homo sapiens
gtgggtgtcacaaaggatcaaagatgaatctcaaaaaaaagattaaatttatatatcatttctaaaataaataagtatatattatgtggtataaaccaaaataacagtcaaaatgattatagcagaactaaatctattatatatgattttgtgaaatttaggcttatgacaaacatcacatataagtatgcattttttccccagtaattcactaagaatcaaattttatccagtttgaaaatgagaactatggaagaaatctaggagtcagaagaaaatttgataccaattgttctctaatcctcatctcactggaattgtctttaagattaggaaacattgttattccatttttgaagttcattgagttcatttctctaatcacatcatattttcgttcttctatatcattgacctctactttgaagaaatagagaatcttctccctctgcccatgttatttcaggtttcccaagactctggtcttttttgacctcttctttctgcacaatattcctgggtaatcacatctatgcaattgcagtttcgagtatcacttatatgcagacaaataatagcgatgtcttccactttataaatctcctgtgtgctagagctgtacatcccaaccagccattcaatctctccctcatgatgtctcataggtatcttcaatttaacaggttcacctcctagaaaccaaggaattatccgagttcttcctttctctcccgactacatctgctctgacatccattatatcagttcttccttcaatagtcattgacacaaacagtttctgagtgcagcaattacagtttttacctgggttattgctaatagtctcctgtttggtctttctgtttccaattctttttccctgtcattgaaactgtatttctaatatacagatctgattaagttacatttcttcttaaaattcttcaagtgtacctatcctgaggatatactgaaatacttaatggaaacattaatgcacatacaaagatgttaatcatagtataatattagtgaaaaatggaaatgac

SEQ ID NO: 63969 - DNA, 1031 bp, Homo sapiens
gaattctactagattctaagatattagagtaagatagaaagatgaattttagtcaaccaatcaatgtgcactcaatggatgcctactacagtcacaggcagtgccctctgggccctgggatagagagatgattgagatattatccctacccgatgatagtctagtagggaagatgagactaatacatatgaaaccagctaatctaacttcaacgttagactattagagcccaaaaagtgtcctgccttgtcaaacatgctattttgccattgaaatactgctatccagacatagtaagtaaatttcttatggccacatgatcaaataatagaccagttcttctagagagaattactctctccatccctttgcattgttttataattttataaaaaacttttacatggctctgtgctttaactaggcatctgcctgtctgtccttccttcagggatgtgatgccccacaggtaagaacctgaccttatacatttaaggagcgcacagtgactgataaggccatatttagccaggaggtgctcaactcatcagccttaagtgatcggaaaggatcaaagacaacagtccagggaattcctcttggccaaggtcgccattcattacaccagatagcacaggtagtaaagacctaaatcttggatacaaattcgaggtaagatattttaaacttggcgtaaaattatagacctgtttctaagcccttctgtcttcttctccattttaaactcagttgctttataattttacataaaagggtaatgcattttcatttcagccagcaggaaaaggttaggctcctcaggtgcttttgaatcttcatgtttgcagacaaaatcattgaaaggttttgatatatttctcctaagggtttttcttgaaattacaccaggtcactcaatcatcagacaagcatttttaaaaacaaaacaaaacaaaactgctctttgtcaaatactgggcaagttgttgtctacaaacttgcttggctgaattactgagcaactactttat

SEQ ID NO: 63970 - DNA, 1265 bp, Homo sapiens
aaggaatgatgcattagtttagacctgagcaattaaatcaataatttacttagataagaaatgttgggtagaaacaggttgagatgaaggtgaagttacacatttgaatagttgcacatagacagattaatacatgaatttgaagctaagagggagatcatggctgattatatgaactggagagtcatcagcatatagaaggaatttaaaaccacggaactgagtgaaatccttacggacaagggtagcaagggaggaatgcaggtctgagaacaaagctctgtggcatgccgacagttagaggtcaggtagaagaggggaagccagtgaaagacaaagaaagagagtagtccgtgagaaaagaagaaaaccaaggcacatctcagaggtccaagtggtgagctgttgtccagcctcccgagtcccaattcctccctaccctcatctcaccccattccattcctggctgtctatatttgaaggtaatgaccagattccacattttaacttgcgtctgtgtttgaagtttcatatagcagattaagtgagtttcactgtcaattgagcctaaccaccgctagatactgaagaaaaatagggacagaattgaaacaaaaacaaaaacaaaaaactccaatcctttataaaacctgtctactgtttttttcttgaataatatatgcaagacattttcctcataaatgtcatagtaaatggctgaaaaccagcctccacaaacaagctttgaatacgtcttctagcattcctaaaattttaaaacatgaagtgaataccgtctcttactatttgattcaagtagtatccttaaagaaattcacaaataacattatattgctttaaacgaactactacttcaaataggacaaatgatatataatgagcttttttatatcttaaaaattaagatgtacttttgttttaatcaatggaggttaaagttatagtttaaaaggtatacctcttctaattaagatatacctcttcttctaattaaaccctccaagtcaggcagccatctacagtgcattaaagttcagattttgcataaaaactcattatctaaacttgatgggttttccttcctttcaatacaccacaccctcagaaggggtctaaaccaacaagaccctttaagaaatgcaaaataagacctcaccttggctcactgctgttcactgacaaacctgaggaattctaattctacttggaaagaaatagtcttctatggggaataaaacatttta

SEQ ID NO: 63971 - DNA, 1015 bp, Homo sapiens
gggaggtttaatgtccagcctatgtgcatctcattgctggatgtgatgtgctgaataaaccacagtcccttatctcacaagctggagtcccaggaagatgtcttaagtcggggaagttcgtccttaagcagcagaagcaagacaattattttgcatgctttgcccaaagcaagtattagtattgaaacatctcacttccttgcctgtgaccagaccacgagttctccttgttatcccacataagcagttgtctttggctttacaagagaagatggatgaggcctatctctgaatcacatctttttggccagttttctgcttctactccttttaatccgggagctggatcctgtgttctcagattctcttcagcccctacaccaggcaacccctgagaaagagtcactaagtaggcttcttacaagaggaaatctgattccttggcggaggaatagctagagataggagtcgaccttgctgctctgagttcctgatagcagtgctctgctttcttaaactaggacacaagggttttgaagtagccccatgcccctgtggctctttggtttttgttggaaagtagccagctcatgaggacaggggtgggggttttcgagtgcaaggtgagaggaaatgaggccaaagattacatccaaagtgcaccctctccttcaggacacttctcccttcatttccaaatctcccttcatttccctccttccttgccttgccgacattaattcttacatcagatgcatttgtcttcatccctctgaagcaagagtgtctttaatctcggaaccctaaaagctgagtagtagaaaagctgcaccacacaacgccgtgtgaataatgtccctgctgttgatagtgtgaaccagaacaaccatgcacagcagccctgagacatgggttcctagagagagtcatctcggtaaatggatgacttctttttctggaaaggaatccacctgaatgccatgtcccagctttctctgttattgtccattcacgg

SEQ ID NO: 63972 - DNA, 1036 bp, Homo sapiens
atatatgggcacaggtgggcagatgtggtttgggaatcttgcagaagtttgccttctgattgctcttgtattcttggtgaaataggaagcagcaaggttataagctgagagtgaggatggttaggaagtaatggcaatttgaaaataagagagttataaatgtttaggagagtggaagagcaaatggattagggaaggaagtgtaattgccaggcaatactaagcacctgcttgaagttggcgatcatgaatttaaagtaatttccatcagcataggtgtgtgtgtttcttccatgttcagctcttttttttgcaggcatggaagagagggaagtttgtgtttaagccggggttgtgtgtatgagaacaaggaaagagtagcaaaagagttgagggtatgtagaatagattggaatgattgattctgaaatttcattggagtaaggagagaaaagcggatatgtaaaaggattagggatagtgaagacgtggtaggattaatggattgtaggtcctggaggggtggaatgcttgttgagaatgcagtgaggagaagggggccagagaatgagatgtttgaaatcaagattctggaggagctgcaactgttgacatgaccacgtccaggacatgatcatgagaggcatgatggggagagggggacaaatgattgaagacaggagctcaaagaactacaggcccagggttttggaagtgttatcgacatggatattggctttgctgagaattatgacaaaagtagttttggagagagtgacagtaagcgagcaactgggctctcccaggaatgtgggggaagcgacctgaggaatgatagatgtctgcaacaaggatgggcagttgtggtgtagtggtgtgttcagacaatatgagatttaaagctgggtgttttttaaagaaaacagcagcaggcagtaaactattaatttttacttaagcagaagtgttgaaggaatattttaagtcagtagagatgccttaagagatatttaagagataaaataattagtacaat

SEQ ID NO: 63973 - DNA, 1050 bp, Homo sapiens
ggaaagtgtggtttgatctgggagcacataggaggggcacctatcccaaacttggaggaagtggtgtcaagaaaggcttctccagagaagaaataaataagctctgaagtgtcatgggaatgagtgttccagtaaagcatttggaggaagagtttctagtaaacaacatgtgcaaaggtttaaatgcttgaagtggcatgtgaccttagggaccctcaatgagttaggattggtggagttgaatttggaagttagagtggggggttgttgatgtaatgacagttaaagtcagagaggtaaataagggtcttgtgggtcatgttaagaatttacattttatcctaatcttaatagttatctatcttatgatagaatctatagaacatgaaatgcagtaggagagtggtataaaggaaatctaaggtttctgatttaggcagctgggtcatataaaatgcagaagtaagagcaggtagagggaatgagaaagagagactgaattgggttttagaaatgtgtatttaaggtatgtagtacctgtagttgtaaatatgggcctgaaatgaaaaaaagagtttcaaatcttattttgaaatttgatagtgattgcattcattattctatactgaggtttttttcttttgttagtgtttttgttttttgtttgtttgttttttgactggttcttctgaatgtccttacattttgatgggcatagttaaggaattatggcccaactatatgtagccaagagagcaaagtttaagaagaacatagttaaagtgcgagagagaacccagtatttatttcttctgaaggcaattaggaaaaaatcaggagtgtttaccctctgatatcacaagagttgcttaaaagaacttgaagattgctgctaagtgagtcccatggccaggacatggcctaatggtagtctgagggaagtgtatgaatgaggttttggggtgagtgataagtaagagcttgtcctacataaactcaatctccagtattagagaggtctccaaagcacctaatttcattgaataaaat

SEQ ID NO: 63974 - DNA, 1144 bp, Homo sapiens
gtagttattctctctactacctctcccctctccaaatggtgtcttcctcttcacagccacactgctcataaaatagatttcctcccccaccttctccaaaccaccttagtccaattcccacacccaccacttctctgaggctgctgtaactacagccatcaatgacctgctaattgctaatcccagtggacacatttcagtggttggaatcctgctgtgtttgaaacagtgattactgcttcctgttctcttgaatttgcaacaccaaatcccattctattttctttcatgggtttcttttcttctacttgccccttaaatgttggcattttttatattactgtgacccatttcttctgtcacttatgcatttttcccaagttgtcctctccaatcctagaacataccagccttcaatatactgataattcaagattcatattccagcccagactgctgaagttcagacctgtatatctagccacctcctggacatctccatttgcatagatgaaggagcctctaaatcaatgtgtccacaacccaagttcattctggcctttccacttgctgctgttcctccacctgaaatgtttttctcacaggccccgcgtggctcactgctcacttcatttatcctctctgttcagtcagcaccttccccaaaagtccccatatgtgccttttccttccctggctttatttctcttcagatcatatgtgtctgaatctatataatatttgttacttgtttattgtttgcgcctcacccccaactagaatgtaagctctatttatctgtcttgttcactattatgtttgagccaatttctggtgtccaaatattaagtgagtgaatacaccatcccccacccccagactgatttctgtatgttttatcttcatgggtgacaccagtcccaccctcagtcactcaggttggaaatttggagttatactagaaacttcttttaccatcaccacatcctcactttcccatatccaacagtcaccagttcccgccagttttatctcgtaataatttctcagatctgtcttctatctctgtccctatgatcaccttatttccagccatcagacctctcttctgtcttattgcacctcttaatgtgcttcctgcctc

SEQ ID NO: 63975 - DNA, 1033 bp, Homo sapiens
tcagattggaactcactgagggaaaggactgtgtattatttatctttttattctcttcatctaactccatgactgaaacatagtgaggatttgataaacgtttgaataaatgaaagaataatgaatgacccatcgagatagatttctggctgaattctggtcattgtcatcaagttatggcataaaattacatttccaaaatctgaaaaatattagtgtaatctgcaaaatgtgaattcattatgtgctgtgtgttactgaacattgcattgttgcttttcagcaagtgctcatgtcttactttccctgttgtcctattaagttcaaaagtcgacttaacaaaatctaaacagaaaaaagagaatgggggaataggaacaagagaagattacatccatttttttttgtcttatgaatttgaagcattttctcaaatgtgaagaaaagggcactttttcagcagtaaagtaattgtgtttttattataaagtgtattatgttaggcatgtgggcaatatgactcaatgaatagttcttcaggattagtgtatgcctagttgaaacttaatgctctttccctcagcatgcatgtaggatctgaattttcactgtgaaagcaaatgctcctgttggagacctttatcatcaacttgttggaattcatgcctagaatattttaagttgaacaattctatcacagtggcatgcatagattgctgagaaaggcacagtgctaatgatgctgtagacatcttaaaagctaggaatgctccatgtaatgtagatggcagagaaaatgaagtgtgccagtctgttttctgttgcttataacaaaatatctgaaactgagtaatttctaaagaaaaggaatttattttttacagttatagaggctggaaagtccaaggttgagaggtcacatatgatgagaatcttcttgccagtgggaactttctgaagagtcccaaggtggtgtaaggacccagaaatttctgatcttcttctacatctaattgccctgggtcgaggcagg

SEQ ID NO: 63976 - DNA, 1045 bp, Homo sapiens
ccaacagctcaccaggactcaccaggggctctgctccttctttcaagaactatgagaaggctctagggagtgtctcacatgtgtttaaaaacaagtctgcacccaatctccaagtcattttctcatatatcctgtgtcttgctcaactgctgtgctctggggaaaaaaaaaaaaatctcctcgtgtaactctcttcatgccaacagaagcctggaagtcttctgcccataccaacataagtacagctagcagacagcatgtatgcagttctgctctctaaacacatgcatggccatgtgtttaaggatcaaggccttgtcctgaaggtgtccagctatacctgaggaaggccaggaagggaagtgtgcctaatcctggggtttggagcaaggacaaacatcccaatattgcaccatgccttgtgtaggaaggtgaaggtcaaatagaagggagaggcaagactgagtgtggctttccaatcaatcaaaaaactcacttcttggaatggagaagtgaggggtgagagaagtgagcaggagcatttagggaaaagtcacttctcatggaaggcaaaaatgggaagaaactttcccacattatatattgctttatgagatttttctaaatgctcattcacaaaggtgattataagcagccttttggtcttgttccacagggtagatgagaggttaaaacatgaatttgatcaaagcaagacaagatctggccaaggaaatgacatccactgaagaagtgtggaaaagggtcctgtgggaagtgtaaagatttgagccaatacagtagtgccaagcttaaaaagaatttcagccaacactatgaaagcactgtgacaggttttatacagatgcaagtgcatagccaggctaggaggaatctcttcccccattgtaaaggtgagaaatggcccaggagagggtgcaggcggcccaaagtctcacagcaggccacaaagctggtctccatttcctgaatcccattcccctccaactccacacagccctacagggcaggttgggatcccact

SEQ ID NO: 63977 - DNA, 1018 bp, Homo sapiens
ttttggcaatattgcatttcccagacaacttaagttcaatcatttaaacaaaaagtatctgatttaaactagaatctattacatgcttcttattcaagatgttgcaggatcaccactcaggatgccctctggcctgttgaggtgtgtatggatctaagttctccttcactggataattccagaatgttatgatgcttgaactcaacaatttctcctccttcctctcctcttcttcctccttcttcttcctgtgtctctttctttttatttaaatatactttaatttttagagaagttttagtttcacaggaatattatctttttaaattgcaaaagagagacacattcattttataaagtttaaaaatacagaaaataagatattaaataaaggctttgtatttacgtgaaagggatattgatgaggtaattgtggcatgaattgttctggattatcagtaagatttcattgtgttcattcttaatacaatgtttcctcattggttcagcaaaatctgaaacacttaacatcagagctgtctggtcccacctgtttccactctctaattacattaccaccttccctacaaagcaccattgatatcctcaagttctccatgggctgattttctaactaaatttcccagtattatatttattagccctccccctgacacacacacaatcatctgaggatcaggaaaatgtcttgtattctgaaccacggtgtgtgtgtgtgtgtgtgtgtgtgtgagagagagagagagacagagagagagagagagagagagagatcagatttattcagagttgagatgcttgctaaaaatggagactctggacctcacccaagacatattaaataagaatatctaagattgaagtcagagattctgcctaccaaaatatgttttatttttactttccatcaggaaattgacaagcatatttaaaagtagagaggttaatataataaactccatgtactcaaaactcagtttcaacaattatcaattca

SEQ ID NO: 63978 - DNA, 1040 bp, Homo sapiens
gagactcaggaagcagctttctttagaatgaaaatattggcctgagtgatggccagagaaatagcatgtgctgttatttggaaggtataaacacaatttggaggtattttttaaaaatatttgctgtttgttctccagaaacagaaataagactttaccctttttatgttaatcgagtttatcctagaggctccactcattctcattaagtgggatggaatatgccagtttctaatttgattgtttcagaaacttattttagcatcattttcaattctgaatcaaagagccaaatctaaaatatgcctctgtgaggagatgggtagttgtctgccgtttgatttagaagaaatcctcagattttatcactaggatttatcttcagatttaaaacttaaatataactagagctctatttgatgctgtcatagagttcatgcaatgtgcagacttataataaaatcctttcagtatttcaatagctaaagccttttagatagagtctccattgaaatttccattgaaattgccccctatttggttctactctgcatgtaacttttctggtctgagttcctccaatatatggtggtagtactgtgatcttgctagatttgatctggggactctgccataattctaacaaactgatagcaatgatgccactataattatcacaatatttatactgggaaagtatataaatatactgcatagcaataaggatttgcttaaaaaataactgttatcactactgatttgtagaaattgggtagaaggaaaaaaattaaaagggagagtgaaggaattatccctgtaaaatgcactttgtgttcagatttattttagttttgaaggcatgcaattacattatcttttctgatggcaaaaatcaagtttagcaatatctgaactactataagaaaactactcttttctagctgcatttgacctaatactgacaatttgcatttttatgcatttaaaacattcatacctaagttactactgacctagttttatggggtctgtctggaaat

SEQ ID NO: 63979 - DNA, 1471 bp, Homo sapiens
tttgaaccagtaagaatttatatccttataaagctataagccagtggcaagaaattctgtgtaatttagagaaagattcattcttcttaaggcaacacttggctatttcaatttcagaattatattatatataaagttgaataattttatttttaaagcagtttgtacaaatctttacattccaccagaggaataagcttctttaatggcatattagacagtttaggaactatattaaacctttaaagctctgaggtcacatgttactaggttcatttcctgataccaagcctcagttgtgagcttcaagccttacggagcagcttactcacactgatgagcattttgaatttaggccacacacacacaaaaaaggcccacagatctaagctcctgacaaaatataacagtctacctacatcccaggcaaaagtttctgagagacccatagctaataaggttataactttgttctgtgttgctcttcattcaaggcataattcaatccgaagacaactcaacttgtcaaacccggacttcaatatccagcagcttcaaaaacaggaacagttgactggaattggtagaattaaaccagagttatataagcagaggtcattggataatgatgacgggagacggagtaacagcaaggcttgtgggaaactgaacttcattttaaaatatgactgtgacttagagcagctcatagtgaagattcacaaagctgtcaatttgcccgccaaggacttttctgggacttcagatccttatgtcaagatctatttgcttcctgatcggaaaacaaaacaccagactaaagttcacagaaagaccctgaaccctgtgtttgatgaagtgtttttatttccggttccctacaatgaccttgaagcacggaagcttcacttctctgtgtacgactttgacaggttctctcgtcatgacttaatcggccaagtggtggtggatcacttcctagacttggctgatttccccagggagtgcatcctttggaaggatatcgaatatgtcaccaatgtgagtccagcatttcttcatttttgtggtggggggcatcttggttagcaaggaaacagattacttacacattatcttgaggacaaagtgtaaaattcctgtcaatgtacatgtagcagttatttcagaacctccttgtaccttttcagaaacagggttttaacaatattgattttgaagtttccaagcattattccatgaaaacaatattaaagaataacattctctcttttctactttcagattcttagctagcccctaagagacagcaggtgttatctgtcctccgtaccacattttctttagagctttttcaggttgtttgtgctgaatggaacctggcattctattaactgtagtctgcagctaagagaccattacctgactctgacagcagtaggtacttacctgtcttctgaggttggctcaa

SEQ ID NO: 63980 - DNA, 1452 bp, Homo sapiens
gtgttggcattccagaaatagaaaggaaaattgaacattcttaggtaactctgatattttaaagccacttgtttctttcacctgtccaaattccctgagataactttgttagctcctcttcctggatatgagctattctgaggccagcgtagctctctttctctgccatggcatccaaatggaccaagcaccaccgtctttattcagctcagacactgattcagcttgagtctggagcctatttagtgaaagactaatctctgcctaatgaccaaatacctgcaccagtaccctcttatcctcagccacttttatgaactagggactcacccatgctctgattgccctgtgggacaccttctctccacatgccacagggttccagtgccaactttgtgctgctatccaaataaacaaaatgtagcatgggagtctgctggcctttatcataatcatgaggaaagaaagaaaggagttggagctggataaggtgcagagaatagcagttgatgaaaccaaggtgatttgggatactggggaaggaataggtctctttatcttaaaagataataatacacataaacccaacaatggatgctggggaaagcaaggcttgtctcccaaatcccaactgacaaaatcaggaagcaacatgagaaggtttaaagaaacaaaatgggaaggctgcttatacaaagatacgaatggctcaggcatcaccccccactggggtatttactaagtctccctggttatgggagctgagacactgccagctgcagtgaggtgccttgaacttaagtctcatctcaggtatggtagggaggtgttggtcacaccatctaatgagacatcaatttatactttttgacaaatggattccataaaatagctggagaggttattagaaagttcaacgaggatcttgctgagagttgcctttagagactttgtggtgagagcaacgttgactgcgcagtggctgatacaaatctggataaggctgatgatccctggtgggaacgactcctaggacaggttcctgtggaacaagaatatggagtggcaggtgatggagaccttctggccctgagatcactgccatttcagcattctcttgggagtaagagtttcttttccattgttggaaaatcctggatttccatagggttaaggagaatgtgaaattatttatcagggaggaaaaccaataaagctacaggcttcagatttctcagttgtttcctcaggcaaacaataaatcttctgagcattgatctaagcctttggatggccacgggagagggtaggtcctgtcaatggaattacaggctatttcatagtctgccatattattacattccattttaaaaaatgttatttggggttgtggggtttttttttgtatagagactgaacataaagagctgagatttgccatgattctctttt

SEQ ID NO: 63981 - DNA, 1424 bp, Homo sapiens
tatttgtctttcaattgagtagaactttagaggtccttcaatctagcagataaagctgagatgaatggccattaggacattcagctgaggttacatagctgaataatagccaaatcaaaattaagaccaagttttttaaataatcatttcagtctgtgcaggaaaaggtggctcaaaatgatcatatacactggtttacttctccttcccctctttacctggctaactcccactaagctcttaaatcccagcttatgtgccatttcctcagagaactctttttctgagccctggactagtgtaggtttttctggcatttgtttccatgacactctgtatttctatcattactcatgcttcttttgtgtatttgttcaattttctttctataagtgcaaaacccacatttggtttgcttcctgctgggtgctcaacctctagaatggtgtctgaaagttagatatttaataagcacttgctgcataaagtgaaactccttatgagggactaatttgttgagtctctagggactgcttgagttggaggctgttatgcagaactgaactcataaactaatcttttttaaaaaattctttgtttctccaaggagagtgtgagttttataaatgttggcactcaaataaaaattaatcctcatgctttcctatgaaagaacaaaacggcaattattgagtgtaaaaatgatggtgtaattaaacctctcaactactgaagccagatcaataatagtacaatacatctttgtgaggattttatcagtcagcaagagagaagacagcatcaagggggaaggtcaaaatttcggagactatgagtccagtgttctgggttaatgttgtctgtcaggacgatcctcttggcatttttagtataccccacttactagtggctttctgaaaaagtaggcattaagcacttcaggaatctctttcttggtggttggcttagaaactggttcggagactgtctctgggagctatgatcacctcagttagactctgatttggagaagatgccacagttctcatgtaatgacagtagaagtaatgaatttccctctatgccaatacagattccagttcagaagaggcaaggacacagtttacaacagcatagactttcttttaatgttaagaacttaaaactcttatttcagcaaggtttgttattttgtagtgactgatttggagactttcctgttctgtctcccaaaggcctgaggccactcgcagacctgatggaggtggacacctggaaccacccaggcagggggaatataagtattcagggaagtccagagtgcttgctcttcatagtcgaatacaaatggggcaggcaggctctgtgattgaagatatttattaatttgaatcccttttcatttcattgtaccataagtcata

SEQ ID NO: 63982 - DNA, 1037 bp, Homo sapiens
ttgctgccttggcgttgtggctaccaaagacaggtgtctgcacagcaggctggatgctcctgagaggcaggttggctttgcagagagctgaggtggacttttgctgcatccccttcacacagttaaattattccatggctgaacacatggggagggttgagctagatgaaaaaaacaaatcttctacaaacctggaacagctgtaaaagaaatagagttgtcaaggtcagcaatttcatctctgaagaaaggtgagaccagtaagggagaacattcccctgggactacatttaatggtcttctacctatggaagtattactatccaaaatagtgatccagtttcctgacagaaagccttgtcccatggattggcatttgcttgcttggaaaatgagttttcaacctttcgagaatcgaaacagtttgtggtatttacaatacagccttactgtccagtagctaagtgtagtctaattctaacagatggctctccagggaaattttccttcagattggattatgcttccaggctgaaattcactaattaaggggagtctaaataaacatagtgggggagtgagagggaggggaaggtaggctgtttcttaggaagctgttttggaaagtggccatatttgcaatctttatctttccagctccacacactcagctatgtggagaatctaggccactgctttgctaaagacatggtagtgctggatcaagggtcagtctgccttcagcaaggagctatgacttcgttttctataaggccctggctctctaacctggttttctcctatgttacctgtcttgaaatgtagcttccagaataaatgtatctttaagatgagcatgactgactttaaaaactgaacagatctatgaatttggctctggtaaacattgctaaccttcttttataaaaagtctaatactttggttttgaagtctttaatatgtaaagatactcctctattacacatttcttaatgcttaccagtttgagacctaaatagctataggacaagtacat

SEQ ID NO: 63983 - DNA, 1671 bp, Homo sapiens
tgcatgagtgggctgagaaaaatccaatttgcaagtcaggaagtgagttctgggtcaggaagttagttgcagttttgtctccatcatcattcaacaaatgtttttgaatactcactgtctgccaggcaatgtattggacatcaagcacataatggcccttaccctcttggggcttttggttttgggagatggaaatgtgggaagaagggacagatagtgaaacataacattgcacagataattactcacatgtgttattggtgctgcagaggaaacgtaggcaagcgcttcctgtggcacctaacctggcctggtatattaaagaaggatgcttggaggaaataacattgaagctgagacaaaaggatagttaggcatttgcctgaagaagggcagagtcccacgcaaaaggaacaggaatgtggaaaggccccaagacaggaacagttttggcaagttcaggggacaaaaagtgcagggtggttaaagatagggaaataaaatggaagagagaccagaactcaggaaggagcaagaataattaagatttttaagacaagaataagtctttgagtctttatgagtaattttgggcagtgaattgacacatagaaatttacttttttaaaaaatcactctggctgcagtgaggaatggacaggaggggagagtgaggggatggtcaatctattatagaaggccactcgcgtgtggttaatagacatggagaaaagtagcagattccagaaattatttaagcagtttcactgaggaataattgtatgtaattaactgcatatgtttaaagcacacaatttgacagtatttgacatatatatacatttgtgaaaccatttaccatagtcaatcaaaataatgaacgtatctgtcacctcaaaaccttgcctgtacccctttgtaacctctcctgcctccactccctgccacccatccccccaatccccaggcaggtgttgatctgttttgtcacactacattagtttagattttctaggattttatagaaataagcatcatacagaaggtactccgcttttacttctttcaatcagaataattatttttgagattaattcatgttgtatgtattaataattcaatctttttattgctgagtactattccattgcatagatatgccactttttgtttatcccttgcctattaatgaacatttgggttattttcagtttgagatattacaagtaaagctgccatgaacattcatgtgctttgtatggacatatgcttttacttctctcacataatgacctaggaatagactgctggattagatggtaggtgtatgtctaccttttgatgaaattgctaaactgtttaccaaaatgattgtatcattttacatttacaccagctatgaactgtgaaagttctagttgctctacattctcaccagcacttggtagagttggtctttcattttagacattctaagaggtatgaaatagaatctcattgtgatttttacatttccctaataacaaatgaaattgagcatcatttcatgtgcttatctaccatctatttatcttttttgataaactgtacaaaatctttggtcaatttttaatagtgttctttaactttcattttaggtttagtggtacatctgtaggtttgctatatagg

SEQ ID NO: 63984 - DNA, 1053 bp, Homo sapiens
ctctctttggaggctgaggggtcacagtcagcgtacccagaagagaagctgggacttatcaattaaccaatactgctttcaaaccgttttcatcaaaatattttttttttttgagatgaagtctcacgcttgtcccccaggctggagtgcgatggcacgatctcagctcactgcaacctctgcctcccaggttcaagcgactctcttgcctcagcctcccaagtagctgggattatgggcaactgccactgtacccggctaattttttttgtatttttagtggagacggggttctaccatgttggccaggctggtctcgaactcctgacctcaggcgatccacccacctcagcctcccaaagtgctgggattagagatgtgagccactgcgcccagccgaactatttccatcaaagcatggggaagtttcatatgcagcttcagggatcttggggctggcagctgtcaaataagcatgctgtgggaactggggagtcaggaagattgtggatatgtgcttctacttgtgcctagaggaaaaggtttcctcttgtttcacaacagccttggccagcagctttttgagggagtgggaagcaggacaaggaattttggtgtctgccagattgagacagggatcaagaactgagtgaggacagagcgtgaaagagtggtctcaggcctcctgaagcatttgttctttcaacagacaggctccgtgctagcactagaatgcccatggaaactgaaggaggaaaccacaggctggcagaaggctaagtctgtggcatcagagcaggaagcaattccgtgaaacagcgactctgctctagctacatttatttccctctgttcctggaggagtgaggggaagggggagacatccttttctaacaagggactttcctgaatacttggattttatattaattcatgctttcagaatttaaaggaactctttctgcacagagggagtcccccatcaggtcatgcaatgtttaacaattatggtttggccacattctcctagaaaaactacaggacctccccctt

SEQ ID NO: 63985 - DNA, 1365 bp, Homo sapiens
cttaatggttaagtatcatgaactttggtggggaaagaaactgaaagcccagtaattccctcggtctttatataagaagagtattatctgaatgtcgtttggggcagtggttatatttttaagcatctgtcattcatgctaattgaccagggatgtggctagccagggtcaagctcccacagtcagtgcaagagggccctgaggctttgggcagcctgtccgatggcagccacctaatgtaggatgcagtggcagtgctggcccacttttgagagcagccgctgagttacggactccttgtgtgggagctgtatgtcggactggagctccagactgctcattccctgcccagagccttaccctgtcatcattgattttatggggaaagaaagcatctccttttgtaaacaccacaccagcatcttcaataagatgatgcaatgggattaatgatgcactttccagcatcctcatcgattctgaagatggaagtagaaacttgagatgagactaagccatgttttgtcaacattttgcttctctagcaagcaaaatatcctcaaattgtgagtttacttgaaagatatgctggtatttgaatccccagggctgggaagattctattttacagacatcaccaggagtgtgacactcaggcctgagagtaaggagaaaggaaggaaaaattaatgagtaaccaaccactctatttcagagtctgttgtatgggtgagctggtggtgattggcttgcaaatgtgttttccaggaaaaaaaactctacaggagtggtgggaacaggatgggagtgggagggcacagagggaccaacagaccttccttttctttgcaggtctaggtctgaggatggcccagatggtgagcaattgtgtggctatttagtcaaatcccaactagctcagcagataactgaacatccctgaggggcttgggaaatatatgtgtttgtgaagtgctgtgagaatttacccagtgtagctcaatctgcctcagactgacttctgacataaatgaattttaagaaagtaggcgttttccttcttgaagaagcataaactcatattaggttagaatctcaggagtttgtattcagttgatgtctaggcacatcagagatggagaggagataaatgtctctccagcaaagccgctgggtttgcacacctgtccccaatatctacactgggcttgacagagggtttatgtagactagtcagaaagttgtgcagcagatattcaatactgaaatcaacgaatgcactttattactcacttgcctactatccctggatgacaataagacctagatctacagtttaaagttcagaaatatatgatgcttctc

SEQ ID NO: 63986 - DNA, 1168 bp, Homo sapiens
aatacatagctacattttgttaaatttctagtgttagggacatatttctaatgcccaccaaaaaatccaataatgtgattattttcattctatagataaagaaacaaatgttaaataacttacccaaactcatatggctggggtgtatgccatgcagatggcagagctgggactgaaccccagatttgtttgactttaaaactgacactaatttgaaaaattaaaagagtatgacaaagacaaattatctcctccagtttttcactggctagttggaaattctctgctgtctcttcattggccttattacagttcatgtggatatttaagatcgttttgtgacccagttgaaaactctaacctgcctgagcagaattagttgtcttcaatggttgcatttatttctgataaatgcaaagcatcactaggactaaaatagaatttggggtcagattccttcatggctggggagctctgcagctgtgacagatggatgagggagcaaatgctagagggaaaaaggaaagaaaaaagaatctgtcctaaactgaacctttgttcagacagttaagacttgcctcccagacaggttttatggattgctaggggtctcaatttgtgccctgatgtgtctgagtgagtgtgattttcaggcatccagacccctcctcccaggcccaccccgcacatattctgccttcacttccttgcacagtgaaacgctccattgactgcaaggcttatgaaatgaaaggctctgataatggagtgtaagcatttttgtcttcatgattgtggaaaaaaaaaagcgatgaaattactaagaaatcctcaagatggggtggggaaatgggaacaaatgattcgttgggaaaataaatgcttcagtctaaaaaaatccaagatggaataaaagatgtattcccctcccaatttatagaggagagcaattttttggtattttctcagccgaaaggaagaaaaccttaaatttcttcttttctgtctttatgagtctaaactatttttaagactttagagtacatcaggttctgatatcgtgtgcattttgtttctttaactgtagttggtattttatatggacttctgagcaaactgaattggaattctgcaaggtcaggggactgtttcgtttgtctttgctcac

SEQ ID NO: 63987 - DNA, 2550 bp, Homo sapiens
agaccagctctggcaccaacctgtgattctgggcaagtgggttagtatcaggttcaactacatataataaaaaccaaaacaaccaattataaattaaaaacaaatgaaatgagaatttatttctctctcttatatacaaaaagtctagaggaaggcagtctggagtatcttagcagctccatgatcaacaagagacctagacttctgtctttctgcctcacagtcccagtgtggctttgttccttgaagtcccctcattatacaatatggctgctaagctccaaccattgcatattttctaggccacaaaaatgtgcaaaagggcaagagccaaaagggcacacattccctttttgattctctttgaattctcatgcaagactgctatttacatttaatttagtcacaaaacttagtcacgtggacatgtcaagttgcaggggatagttggaaatgtaacctttttgttgggtgtcaatgtgtccaactaaaaaccagggttctgtttgcagagaagaggaaagtgaaaacctggagtcaaccggccatcattctgccactcacatcctcattcattcactccctccccctttacttctcattcattcttcccctacttatctttgctcattgattcactctcttatttattcactaacttgttctctcaaaaataatttgcactccctaagtaacatgtctgagggtccaatgctataatagctacagaaaatacagatatgaataagaaacagtcctttcccttgtagaacttacagactgtaaaataaacaaaagatgacatgtaaactaatcttcgagaggcacaaatacaagcatttccatccatataaagtgctacaaaagcgcaaaggagagagatgtttactgtgcttagaggagattgtgaagcatctctccttcatgctctcaataagtaaagagaactgagcccccgggaactggaaagccaggagggcagcagcagttatttactgaggatgcgtgggttccaggcagagagctttcctctgttctcctggtgcaggaagctctcttccatgcaaagccatctgagaggccaagactagagcctcacccagtgtgggcacccctgccattgatagtcaggtgagtctggttgaagtgaacacagggcggctgtggagaggcagagaggcagagaggccccaaacccagacaggggaaccaagggacatctttgttggaagtggggcaggaaggagaaggcaggacagggtttatggattctaaccatcagggcacccagatgtattcaagaagagcctaggaccccctaatttgcgggttcttaaggatagttctgcccgtgggccataggagcaaaattgatccctaagggagacccacaggatctatgagccacttgagaaggagctggagactggtgctcactgaactatacctcacttcttcagctcctggtggaattctcaaaggagtccatctgtgggctcattagattttgggggcctgtcactagcagtggcatttagaagagttgtaatagactttttgcacccttatgagccattgctgactttaattcttattggtaattaggagtatcagagagtgttaaagctctgtgcttctcaggaaacaagaaatgagaaaggagtaaggatgaggtgtgtggtgtagggctgagaggtgagccctgattcatgcacaagcagttttttttcagtgacctgggcaggggagtagtcctgggtggagtgttgcacacgggtccctgagtggcagtatatgcacgtgttacacaaaggagagtgcagggagcaggccttggaggccttttccttcactgtggagaaaaagtgtgatataaattcattcacctgagagatattcctcaaaccccaaacactcagctttttggaaatctgtgctccacagttatgtaactgaaaagtaaatgccattagggttaaaccactgaaacttagaagtcatttgttacagcggctaaaattactttggccaatacaatggtcatttctgaactgttacagcagaactaaggaaatgaaatgcctgtggggcttatatgaagggcaagccttcatataagcagggggagggcaaaccttcctataagcagaggcagagggaggctgcctcttccccgttgcttcctgtctctttgaagtacacgtctgggactccagatccatcctgagagaggaagtgatgctttttcttttaaaaatgaacattgagctggcagaattggggcaatggtaccagatgagatgaaaaacagtattggagaggttggccatgcttcgttagcagctgtaaggatggaggaggcaacaggcagactggccagaaacattcactttggagttggaaggacctatattcgaattgctgtcctgccactcactagatgtttgtttttccccttctgaacctcagtgttctcatctgtaaagtggccataacagtgcttgtctcacaagagggatggtgaggattaaacaatctatttatatgaaa

SEQ ID NO: 63988 - DNA, 1034 bp, Homo sapiens
atgacctaagactttgggggattattgggaacacatggttgtattttgcaatatgggaagaacatgagatttgggaggggctggggtggaattatatagtttaaatatttgtccctgcccaaatctcatgttgaattgtgaaccctaatgttggaggcaggacctggtgagaagtgtttggataatatccctcatggcttggtgctaccctcatgctagtgagggagttcttgcaagatctggtttaaagtgtgtggcacctccaccccccttgctcctgctctgccatttgccacactggctccctatttgccttctgccataagtaaaagcttcctgagacctccccagaagccaagcagatgtcagtgccatgcttcctgtatagcctgcagaactgtgaaccaattaatctgcttttctttataaattatccagtcttggatatttctttataccaatgcaagaatggactaatacaccaatcaagaaagtaaataccatccaaagggattaagattgactataaattttaaaatatgaacattctgaatttttcttcctgttattaatgcttaatgaagtcctggaaatgggaacggagaagtggatccaaatacatccacatctgcgtgtgctttttgctggggctttatctgcattctctctctgctatggtctgagtgcttgcatcctcccaaaattcatatgttgaaacctaatccccaatgtgctggtattaagagatgggaaacaattaggttatgagggctctgccttcatgaatgggattagtgcccttataaaagaggcccaaggaaacttgtttgccccttctaccatacgaggacacagaatgatggccccatccatgaggcagagagctagcactcaccagacaccaaatcagctagcaccttatcttggactttccagcctcaaggactgtgagcaataaatttctgtcatttataaattatccaatctaagatattttgttatagtagcccaaaaggactaagacatccccctta

SEQ ID NO: 63989 - DNA, 1235 bp, Homo sapiens
tgttgtcaatatttattataagcacacttataatcttaaatttgcactttatcctagcctccgtggtgcctattgtatttatgggtgagtagttggaggtgacagaatataatctttcagttgcatttaaagttttatgtttcttaaagttacagaaagttcgttcccaggactggggctaatggctcttctcctgctccttacagataatgtggcacttccattgcctagtatggaaccaatatatcacatgaatgtgcacttacctagaactagtcttatatcaggaatgaggatccagggatccttgcaaagaaagaaataataattcagagaaaccctacactctcaggataagaagggggaaaatcaaggttcccgccatcaaccaaatggtttgagtccaggcagaatctaaaccatcactcacagtgcgccatctgctccagcaccagccctcctgattcttttgcaggtcagcaggcatgaaagagttaatagcaaaggccatgagaaacttgctcgctgttatagagaaatcacttttagttccagttgctgctgccagaggagatgcttgagagcaagataggaaataataaggaagaaaaggacttttgaatcacatgagagtcttcgaggactactcagcccagatgttcctcttattgcttcaagccaataattctctaaagcccccatgcacagatgtagcttccttcactgtctttacagattgtgtttgaattcatggcagaccaggagactgtcctgctgagtatggacttcctcagtagcaggaactagggacagaattaagaataatataacatatatgaaataactgtattccataactggaaatacagtgctgagccctgtgctatagctgaggtggatagtctctgcactttaaaagagagtctttgagcaactgcagacaaagactgatataacttcttgattagaaaatcagctgaaaggccgggcgcagtggctcacgcctgtaatcccagcactttgggaggctgcggggagtggatcacttgaggtcaggagttcaagatcagcccgactaacatagtgaaaccctgtttgtactaaaaatacaaaaattagctgggcatggtggtgcatgtctgtaatcccagctacttgggaagctgaggcaggagaattgcatgaacccaggaggcagaggttgcagtgagccgagactgtgccattgcactcca

SEQ ID NO: 63990 - DNA, 1038 bp, Homo sapiens
tcgcacttctgttcagacttcatctctgatttcagcattagatacagaagctttttcctgctaagtcctctcctcccagatctaattcacagccagcaaatccagctgtgggcagtctttgagcatttactctaaagctctaaaggacccaaaggtgatgcaagagccacctccctccactcagaaaggaaacactcactgtgtccatttggcttcaatcagacaaacccaagacattcagagggatgaaccgacctgaaaaatatccctaaaaacctactttaacagaaagcacaaagtttcaggaaagaatggaagaaattatagaaactggaattatacaaactagtaggggcatggaggcatgcacacagcttagaagagaaggaagtcactctatctgcttcagtgtcatgatggtgtgagaccttgaccaagaatgtaaatttaaaccttctgggaaactttgctgtgctccagcagacaaagaaaaggaggctgaggaaagtgtcagagccaaggtggactgataggagggaggagcgtgtctaatctcaagcagcctgctctggtgcaaggacacagccaggaacactggaactcaggaacactgggacacacctgccaaggctgccagagaagcatttcatgggagtggaccccaaggccaagtcacaggaattgcagtcaagcaacatcaagtcaaaagacaggctgcaaggtaggaggtgaagacatgagcagaaggctggagagattgagcagagacttcaaagctggaaatcagactttagcaaatgagaggtcaggacaaggaagcaggggtatgttacagagcagacaagaggcagagcccaccctggaacatgttattcacggtgcctaccatctcagcctcccctgcatgcatgtacaacttcacccctaatatctgttgaacaagcagccctaaccaccgaggtttgtaaaatgtcctggccacaggtgattggatcaagatggggacatgctcccagaaagctgtttatgggctgtcca

SEQ ID NO: 63991 - DNA, 1043 bp, Homo sapiens
gtcttagtcatacctagcaagagctccacacagcaaggatagggcatggggtccatgttttagggggtagaaggagtgaaccacagagagcacagcccgtgcacatggtaggcacctcaggaagtgctgaatgcatgaaagaggctgcgcagcagacaaggctcctgggagccaaggccagtgtctccagccagctcagctgaaatcagcagctcatgtgctccgttcttcaccttcagcatgcccacttcatcctgaaactctcttctacccaccacctcatctccagatgcagatcctaatgtcccagacaggactgttggcaggttccaagtcaagtgaaggataattcaagagccacagtccaatagtgcaggagccatatctgctctatttgccattgtatacccaatccttcacatagtacctggcacataggaggtactccataattctgtgacggttgttgaatgaatgcatggattttgcataactattcaggcaagagcttagcttctatagagaatttggtcatgattggattcatttgatcagtggaagcagccattccagtttactatagaagtaacattccagttactatagaagtagatttagaacctaatttggcctattggctacaaaaagggtacagactctgagttgtagtgagactgccagtctacctgcaggtcgatgagggctcctccatcctccctgggctgagatttaatagtgcctctttttgctcagcctgctctctaatcctcagggtgagagatcagtatgaactgacaggtctgagaaatcttcctaggggaggaagaagggtttccagctgcaaggagagagcagcgtgcagtgacagtgaggcaccaggatgtagaacaatgctgccagaacatattccctgaggtttgggaatgaacttcttcaagggctgtgctccctttttgatgggtcctagtgggcctctgtgctggtcgtgaccgacttttcttcaatgatccagtggaggctgcaatgtattttgcttaaaacta

SEQ ID NO: 63992 - DNA, 1048 bp, Homo sapiens
gtttgtgattttccaaagcaggattagcactgggacttagaggtcagtggctggagacagacaagagggtggcttgttttgccaaggagcttccaggagagtcttcccctgctgggattctgctagggccctgggctgtcatccacttatcaaagtcaggatggggtcttttcactttgggaacccaggagagagtgtggtatttaaaagcatgagtgctggagctggcttcactttctggctttgccatttttgagttgtgtgtccttgagcaagtttctaaattcctctaaacctcaggttattccactctttagcaacacaacaatagatcctacctcacagagctgtgtgagacttaaatgaaaaaatgaatgtaacatgtttaacacagcatctggaacttaatggatgctaggtaaactttgataattgatattattcaacatacatgtatgtacaagaaaaggagagaggcagaagggagaaatcaaatgtccaaaaatgtgcttcagcgggaaccagggcctctgaaagcatatgtggcatgggctgggactgcccctgggcttcactgtccagccttggactccacggctgctctctgctctctctgaccttgacttcccttggggatggtcgcctgggaacctctgactgcagtccccctctgtacccctcctccctgaccctaccctctcatggctccagcctggtgctcctccaaaaaccttgctgcactgctggtaccctgaatatgcctgttctcctcctacacttccaaccatccttttctctctttctcatgggctttcgctggctgacggtgggatatagtcatgcctcaagtttctgacctaagtcactttttgtttttttctacaccacacaaagcagcatctgggaagacggcccacagggatgcaactgcttcctggcctctttcagccagggaggcaatttttctaatagacaggagtcttgggctgaatcctcttcagactgttcctaacactggaatcccagaggcactgtctatacagtgggg

SEQ ID NO: 63993 - DNA, 1060 bp, Homo sapiens
aaggatgacaacatgccagttccacatgtttctactcacccccttgaacttttagcatctgtcatgggaataacatgcgctggaagacgggggcttcttcagctcggtcctggaacaagaagacgcagaagtagatttctacctgtctggcagagctgcagccaaccacaaactcatcagcaagaaattagtgtgtattgttgtaagcaactaagatttggagttgttattgtaagaaaagctgacaaaatacagatttaaactcacagtgttcctccatctctgcctgttggacatagctaccaagcttatttgggtccaaatgcggacttacttctctccacctgttaggaaaggctttctctcttcattattttatcatcaagatgaatctcacaacctactggaattccagtttaacttttcttttccttctcttgccctctccctggaaaaagttttacacatgccgacacatgtcagcaaacctctcaacctcacatctgtgctggtcaagcggctttgaagacacagctataccagtcagagcacaatcagtttctgacatggtcagtgtcgggatcacacagtaatgctggttttaaaagacttttctttctcagctgttattattcagctcacttaacaattaaaactagaacaatgccttagaatttttaagaaaattcttttgtttccatcctgctggcaccgattcatcatcctttatgacttcacattcccaaatgatttgtgatgtaggttttttgctaatgtactttcagttgttttgcttctgatgtttcctccccacctaatcaaatgcttcaaaataaccataatttctaaacccagtaggacataggacatgcactgaataatatgcactaaaatttattaacagaaagccctttgtttttaaaactctgaaagctaatggaatactcttttttactttagaaggcatgctgtgttctgtgtggttttcccacagatgtgtttttaaatgttgcattctgttaagactaaatgttgtatttgcaaagattttactccccca

SEQ ID NO: 63994 - DNA, 1023 bp, Homo sapiens
cagcctgtctttttagcatctaatcagttgtcagcttcttcaggaagcattctgaagatcctgtggtatgagctaaatgcttctcgtctgtgctatcctctcctagcaccctgtgcctgcccctgacatagcatttggtgccacttgatattatctgtgtgtgtgtcatccccagcacctcccactgctccttgagaatgggcctaagtgttattcatcattgtataacaagcacctggcaaaatgcctggcacaaagtcagcattgaataagttcttgttggacagaatttcaatttcttctatcttacaacttgtaaaatgatttttacaagttttacttactgatttcttagataaattctccatgtcaatttttcttcaaatctacaggcatagtggttctattaatgcaccaaagcaactgagagctagctctgaatgccaaagagccaggcaacacccatgagaatgaagacagtggcagtgaaggtcccagtcatcatctcagatggatttgcagtgtcatgagggctcaaacagttctcataaaggtctttataagagacttaccttagtttaaaaggcaggttgggaaacccatgaccatttcctccagaaagcacagaattcctgcaagcctggggtcactattttggctgccatgctgtcagcttatcccagcaatctttcaaggtgcttcactgtatggcatcatttgctgtattgtaagaattctgttcaagtaagaatcaatcaagcttcctttgaaacaatcactttgcataaggaaatgggagtttcaaggatgtatttatttgttcaacaaatattgattgaatacctactataggtgctgaagatacatttttagggacaaaatagtcaaaaatctttgctctagtgaaacttgactagtgggagacacagatgtattatgttatagtgaaggtaaatgctatgaagaataaaatagggccgggtgcggtggcgcacacctgtaatcccagcgctttgggaggct

SEQ ID NO: 63995 - DNA, 1118 bp, Homo sapiens
gccttctttccagattgggtttggtgaacctgaatggtccagccaccttctgcaggtggcccaaggtgatgtgctgcagggaagcatgtctctcatgccaagaaccaagatcggactatgaacaaaaacaaatgatagatatagtgacagtaccaagagtaccaggactcaatgtttcatatgaagcccttggtgatgaggacatagcatctgccctggaaatcgttattccaacataatattattttctagaatgccctggaaggacagaatatttaaaaatatatccaggtgctaaataggcagcagatctcaattcacacatgactacctttgagctaatgactgtctccagaaaataactgtgccccaagaagtgctccagatttgcaaggaatagccccaagagaataccaagacaagcaggctgttccctggaaaaaatctaatgcaaggagggctagttcacagcaaattcactgcctcctcccatgcacgtggtagagagtaccagtatcaacatggccctgttttctgctaaaaccagattttgaggaatcagagacccccaacactactcactcagtagctagcagccccttcctttcaactgggagtgttattagaatgaaaagtaattagttagaagggcatacatctcagtggcatgagcattgtggaatatcctttcctaggcacattcgtccactaagggaacagcctcagaaactggtacagcaatgggtgagatgagatcatggagagagaacacagccatcccctatagaaaggcacagcttttgggcttctctggcctgaatgccttctggggtatttccatatgcaacagcccagagtcatagccttgggcaaccacacatagaggtttccttctcacttcagacacatacatcactttcacaccacttggggatggaaatacctacaagagtgaaggtcaagggccctccccaggcatctcattcattactcagcttccttcctgaccaagtctgccaaccaatggccagctatgcgcctcatcctcattgcttctgcctccacgtaaatgaaaccaaaggcctcagcatatcctgggaggactgggggctgttacc

SEQ ID NO: 63996 - DNA, 1025 bp, Homo sapiens
acagtagtttagtcttctgagaagcctcctgtctcctttgatacctgtgaccctcagtcatggcagctcctccatcaatttatccaatgtgaggatggatgacactcacctccataacccagtctgcagccaggaaagtgtcagtagaggtgaccccacctttccaggcccatcatatgtgggtcaagaaaggatcatgtccaagaccacagcattaatgtttaataaggcttccatttctattgaaaagttgtccttcacctgcagtgtttgcaactgattgctagcctgaggaacactgggcaagaccaagatgcatcatagtgtggtggacagagccatgagctggggctgggtcccagagctctgctcctgccgctgaggctgaaaccacccctgctggtcacagtttcttctcacatgaggaagggttggcctactatgttctatgctcttccacctctggtgtctgtgtgtctgtgaatctagggaactgcttgtgcccagcactgaggaaaccgggcacctggggtgggatctatgcaatcctagacacacgctgccagaaatccaagcacaggctaactctggagggtaggttttggtgatttccacagacatcagccgtctctttaccccctccattgtttcttagtttccccttcaatgggttttcatttttaataaatggaaaggaatttgactttgagattgtcctgaaagcccttgtaatgaccagtgatgtctagcatggattataaaatgacaactggcccactaaacagaggaaattccattttgagttaaataccaaaataagttctttcaatataccctaaagagttcaccacagtcctacaggtaagccagatggatgagaggagggcagcagaaaggagagcctcctggatggggagcttgtgcacagagaagcaggtattagatgaagaaaagacagaaagacaatctgtgtggttggttcacatttggggcaggaaactgggacccacagggagggtgctggg

SEQ ID NO: 63997 - DNA, 1030 bp, Homo sapiens
cattcttgctgtgtcctcatatgggcttttctctgtgcactaacattcctggtccaaatttcctctttgtataagggcaccagtcacattaaagtccaccctgattgtctcattttaactaaaacacctttttgaagaccctaactccaaatataattacattttgaagtcatgggggttagggctctaccatatgaatctgggggcaacacacttcagcccctaatagttctatgtttcttctctttccccttccacagtgctgtctgtcccagaggcagcaagcccacagctctcaccaagcaccaatgcccagattagccttcccctcaaatttccaagattcaggattcaacatgttacaggtattattctgcctggaatggggtcaaataggtggcaggaggacttgaagaattcactagttacaaaggggagagacctttcaggctgaggaaactgcataagcaaagataccacatgttaaatttcatggggagcttggagacaattagatgtggctgttgtggaggatgaatgtggtagatgccaattgttgaaggaagaaaggttgaccgaggttatacggtaaaaagctttcattttggcataaaatcagccaacactttatctaaagagatgaagatagggaattagaggctgttccaatcactcatgcaggaaacaatgcaattaacttggtaaaaggttggaagatttgaagatgacttacagcaaataactatcaggaagggggaagcaggagaggtatgacaagcaaaagataaagggaaaaatagaggcaaagagaaaaaaaaacagaaggaggaggcatcctgttcatatctaaatgacgaattccaatatcccagaagggattctgttgactggggttctgcatcctcaaaaaggcaaagtctcctccagactttgctggagttgactagcatctctcagcaaagtgagggagtactggaagcagagaaggctctagatatcagaaggtcggttaacgtggaggcacagcagc

SEQ ID NO: 63998 - DNA, 1084 bp, Homo sapiens
taggtatactttaattagtatcaaagtatgttcacaatatatctgcaagtgaaaaagatgatacaaaacatatagtaaaatcacattttaaaaatatatatttacatatgtatgactaaatgcttgggaaaacttttaaaaactgatatactcaagtatcaatactacctttgaatttaggaattatgggagatttcaatttttcccctatttgatgatgtgtaattttctaatccttttctataaatgataggtatttatattatttgggtaatttaaataacaagcaataatttgcaaatttattttctgactgaagcaagggctggaaaaatgtacccaagcaacgagggcatacattcaagaattccaagagttctcaaaaaatatatctgtcatgctgggaagatgtcagacctacacaagtgagtacaagagtgcagtgggtaacttggcactgagagttgaacgtgcccaacgggagattgactacatacaataccttcgagaggctgacgagtgcatcgaatcagaggacaagacactggcagaaatgttgctccaagaagctgaagaagagaaaaagatccggactctgctgaatgcaagtaagaaaactgcatcttttcctagcccttctagggactattatgctcagaaacacacagactcagagcagtcagggagcatcatagagtaatgagagtaagaattggaggtgtgcttttgtgtgcattgctgagagagaaagctatacagagaacaggtgtccaaagagaaatccattctcgcaaagccattctttctttcacacacagtgcctaaagcctccatagatggtgaaggctatagtgccaaaagtcagcccaaagagactacctcctgataaatcttggtttggtggagatgtgtggtcccagattttttcagggaaagtagcagtttggtggattctacatccagtacccaggctgtagatagcatctgcaaatgtaccaagaaacagtcttaaattggaaatggcaacagccaaccctcagggatgggaactgcagtgaatcactattgtgtgtgctgtctgaga

SEQ ID NO: 63999 - DNA, 1049 bp, Homo sapiens
ggggaggctgagggggcacagaagagacaggctgaactcagtgaagccatctccaggactgccagggaggcacatgaggtaggagccttctgttgagagtaggtgcctgggcccagaagttctagctgttcctgatcttatcatgggtcacagtatgaagaccatgttagttttctatttgatgatgattcctacttacaaacaggctggttttagattcttaaactctggccaagaaggtccaattttctttccctaccctcctgttttttagttccctgccatttcttcattgactttcaaacaataaaactcctgtgttttccccactttttgctcagttaacagaatagtcacacacacactttcctgggctagaaatcttccctttggccctcgtctgacaggtcactatatccagtagattttttcttgtgaatctctctcaagtgtactctttccacctgcactgctctctcaccatctctagtcttgattcctatgaaagcctcctcgctgaccttcctgcctcccatttctccctgtttcagggctttatcctatattgccacagagtaatcttgccagagttaccacatcactgctttatccccttccatggcaactgaaacctgtagggtaaagcaacccccccaaaaataacatataaagaaagtcctttacaacctgacccccgccagcctagctctctttggtttaagtatgaaagtaatactcacgaattaaataaaaactatgaatatggtatccgctatatgtgttgtgcttacttttatcataaaagtggataagaagccaacaattgaacacagcaactttgagtatccctcagcatctcgtgccgctgctgcctatccctatctgtctggtgctctgtccatctcacctgctattctgaaaacataaaatatacctcatgcatgcctgagtcatttatgctgtgcctggaacagagtagagaatcaatcttttctgacctgaaggaatcgtttatttgaaaatggagggaactatttgccagagatagc

SEQ ID NO: 64000 - DNA, 1085 bp, Homo sapiens
ctatgatccactgggcactatcagtgaggaggacttgcccaacttgttcttccccaagagaccaagaagtcactccatgatccattacaaccccagagataagcagctctatgcctggaatgaaggaaaccagatcatttacaaactccagacaaagagaaagctgcctctgaagtaatgcattacagctgtgagaaagagcactgtggctttggcagctgttctacaggacagtgaggctatagccccttcacaatatagtatccctctaatcacacacaggaagagtgtgtagaagtggaaatacgtatgcctcctttcccaaatgtcactgccttaggtatcttccaagagcttagatgagagcatatcatcaggaaagtttcaacaatgtccattactcccccaaacctcctggctctcaaggatgaccacattctgatacagcctacttcaagccttttgttttactgctccccagcatttactgtaactctgccatcttccctcccacaattagagttgtatgccagcccctaatattcaccactggcttttctctcccctggcctttgctgaagctcttccctctttttcaaatgtctattgatattctcccattttcactgcccaactaaaatactattaatatttctttcttttcttttcttttttttgagacaaggtctcactatgttgcccaggctggtctcaaactccagagctcaagagatcctcctgcctcagcctcctaagtacctgggattacaggcatgtgccaccacacctggcttaaaatactatttcttattgaggtttaacctctatttcccctagccctgtccttccactaagcttggtagatgtaataataaagtgaaaatattaacatttgaatatcgctttccaggtgtggagtgtttgcacatcatttaattctcgtttcacctttgtgaaacatgcacaagtctttacagctgtcattctagagtttaggtgagtaacacaattacaaagtgaaagatacagctagaaaatactacaaatcccatagtttttccattgcccaaggaagcatcaaatac

SEQ ID NO: 64001 - DNA, 1062 bp, Homo sapiens
aaaggtgaatggagcatactccttgctctctagcagttaatctagacagggaggcagacacattgagaaataatacaaattattatcatcttcataaataatatagacagctctgacgataaaggtgtgtaccagatatgacaggagcagagctgaggcatccagcaccttcagggatgaggggtaatggtgttaggaaaggttttctggcagtggtcatttggataaggccttagcatgggtgggatttgaaagtagagatggagaaaagcacccacgtagaggaagtacagaaaatggggtatttctgtatgcgagggtaggacgtggtccagtgaagctggaactcagagtggtgaggactatagcggggaaggttaactgtattagaggactttggcagagctgcaaaatgcagcttctctcctgaaagcactgtgaagccgaggaatgtttgagagcagaggagcatgtcatgagctccatggaacatgtcttgcctgcacagggaaagaaagacagattgcagggaagttggctagaggtagaaagcccagaggaagcagcttttgcaatctggctgagagatgatgaggttctaaactgtggtgaggtgagaggtaaggagagtttggtggaatgttaggacctattcagggagtttgaatggcactgtagaaagagcaccaaatgagtcatcaggaacttaggttcaaatctcagttctgctggaagggaaagtagaattctctgccccctgccctgaaaagtccacatccccaggtggtggtttggttttttgtgttagcctgttactataaaaagaattcaaatgtacacagaaatagaaatagtaaaatgcatcctcttacccatcatttagcttaacctcttgcttgtattattttttaggggggcaatttttgagatgaagctttttggaaatattcactttgaggttgcatttgaagcatttctctgaatctgtttatgatctggttgaggcaatgaaataatttcacgtccatttgttcctccctggaggtaaattgtgtgtatgca

SEQ ID NO: 64002 - DNA, 1048 bp, Homo sapiens
ggtgttttggggtgtgtgtgcctgtgtgtggtagggggaggtattgtccagcaaagccctgctgtggccaagttcttcatgagaatctaattatagacaccagggagaaaacagtcagctgtctttgtttctccactgacattctagtgaatgagcctctgtacagaaaggcaagaatggagtgaggaaagttggttattttaactttggcacctaaacagtcagaggctccaaacaccgtgaccagaagaatgtgcccaccgcttttcagtttgaggacacagggaggaagctgctgcctttttaaatgcattggattcggaagttgtttaactcgttctcactctgatgttatccggtggagcacacatctgctgtcagcagaatgagcttctgcatttccggaggaaagctttcagggagttctctttgaatgctctgaagctgagggtttatgttgcaagttgttcatgccctttctttagaggataaacctgagtgtgtggtatgagcaaggaatgaacggacgttgggggctggagtagcatcatactcctagaattcaggctgtttcctcttttgtggctgcctttaaattggctaagataggtatgaatttattttcacacgaagggattttaggctgagtgtttttcagaggcaggaagggcaaaagcagctgacaggttagagatttgacattgtaactgcagaaggacagaagaaccaggaagtgtccagcttggaaggggcatgcagatgcccggaccccgactcccggacactgagctggctggcttttgtgtgagtgcagcagcactcattcagcaaatctgtactgagtttgggtactgggtgtatagtagtgagcaaaatagaaccagcctcttgtggatcttctacctaatactggagatgtaggtgaaacagtcccaggaaataaacctcagattacaaacaataagtgtgcctggaggaagaacagaagacacgggactgctgttttgatggagaagggggttggggcggtcagggagtttgaggaaat

SEQ ID NO: 64003 - DNA, 1032 bp, Homo sapiens
aacacacctctaaaaatagctccgagcagggtctgtgggacccacccactgctctttcggcaagagttcattttcccaggaacagaaatcccagactgtcagcatcttcacactgcttcctggcttccagcactctcagtgcttaagcaaattccaactgtaggtcacaaagaaaatggaatcactacaggtcccccatgcagttggctcaggttctgcagtaaaaagtggaattaactcaagctgctaatgtgagactttattctgtgtcatctggtgctcaaatggttgatctagtagcctggccacttgggccagaagagctgcaaaggcagacacggaggtctcctcactccagacactgacttgccttgcattcatgttggactgcagtgaaagttacagaaataggcagcagcttctgtgaaggctgttcctactagttaagagcatggatcctggatctagattccttgggctcatatctcacctctgtgtagacttgggcaatttatttaaccttcctagaattcaatttccttgattatatatatggataaacaattctatagatagatagatagatagatttttttttttttgagacagagtctaggtctgtcacccaggctggagtgcagtggcacaatcttggctcacttcaacctccttctcctagcttcaagcgattctcctgcctcagcctcccgagtagctgggattacaggcatacaccgccatgcccagctaattttttgtatttttagtagagatggggttttgccatgttagccagtctggtctcgaactcctgatctcagatgatgcgcccgcctcagcctcccaaagtgctgggattacaggcgtgagccaccgtgcccagccaattcaatgtatgttaagtgcttaggaagcactttataagtgttagagttatggggaggatgacatcgatcagaactgacaacctctggttactcgggagccaggtacccaaccttgattctgaaaagagaggtttttcaatcctat

SEQ ID NO: 64004 - DNA, 1375 bp, Homo sapiens
ctatttctggccaacacacccgagatgcctgtacattatgtttcctggtataatttagaagctagaattctgccatctctgacatccagcacctgtaactcctgccagctccttgaagagaggcctcttttacccagtgggatttaacaaactggcatcacaccagggtcatttgctgaacaacttgtgggcactacagagcagcacagccattgttggttttgtggactggcagcagcacttagggatcctttgactcatccctgcttttctctgtcccttcctccatagcagctctttcacacttttccattagtcttcaaccttatactcccctttcaactgatgtcactaccaatgtcataggaaaaaaaaaaaaaaaccagccaaactgagatgagtctcttcaccctccctccctttcaccgcaaaatgtaactgtatttcagcatcctgtttcatgggccaggagtcccttctctcagccaaggctatcccagtatcctgtccttgacccaatcctgttccagctcctcttgttgctctgattgtttcttctctcagctcctccctgcctatctgtcccttgcccttggtggaaaatgcttctcctcaattctcagggaaaaaacaaatcaaaactatctttgaccctgtgcttgtctcttcatgctgccttataacttaccttcctttcactgttaagattcttggtgagttgttagcctgctcgttcatctctactccctcctggtcactcctgaagccagtgagcactaactttgttcctatagtcatcttttaaattccttctgtaatgttatttttgctgcctctagttcccaggcaatcttccccatacattttcctttgtattcatttccatttggaaatcttgtaggattaatggcattcttgtgacccgaggagcagctccttactttggctcttgcctaattctgtgttctcaaactttggatctttcatgccgaagagacaccaggctctaaagcctccaggggagctaagacagtcacagcgcccactccaccctaactgtagcacccagtcctgctgcactgtctctgaaggtgttttcagtaataatgactcagtgcatctattggagttggcaaggtgaggacagtcttcaaagagtcttctctttttactctcctcctggctttcacatcctctcattacaggataccagcacacatacaaatgctatttctgcagcccagtgctgtaagctttttatgtgtccagctaccagataaagagaatttagcagtgaccaagctcagccaaggttataattttggggaaaaaaaaaatcttggtaaatgtgtttctctacaaatctagctcccca

SEQ ID NO: 64005 - DNA, 1056 bp, Homo sapiens
catttattcattttctgattcattttctgataatatcttttagactttagctcctgtttatttcttgttttgtttgaacttactttttcatatcacacatcctgctccccacctccaccaaccccggttgatgcccatgggcctgttgcatcttgtattcattccctgtcttaacctttttgctctacatgggaaataagaatggaagcaaacaggtggtggatagaaagccatctattccacacacaaaggacactgagtgccctttttatcctagtacatcccacacagacactccctgtgccacaaagtagatctcaattagcccctgatgataatcctggtttgaactatagttggcttaggactgacagccctgtcttaaaaattgccactttaagcaaatcaagcaatagtggcagaattcctttgcaattcagaactatatccaaatagcaggaattctttcctacaagtctgtttccaaaggagtaaattttagtcagttgatcaccttttgagacaaatgtattaaccagaacttttggttgcaaataacagaaactcagtttgaactaggccaagagggaaccaacaggaagggctggaatatatctctgcctttaggcagcgtgcaccggggatgagaatgcctccagtctttttcttggcttttgtttgcttttctgtgcacactgggttcatagctgtctcttgctgcaaaccagctttttccacgtggagcaggacatggccactgacaacctcagaactgtggcaccaccactaccatgctctgttcccaagtttaaaaattcagaggaaggatttcaacaagtcaagcctggatcaagtggcagggagatgaggatctttctaagaagatggcagccctcatttataccacataattacagtaaaggcgatgatctcagcctagtctacacaaacaatagattccattaaagcagggtgctgattctctgccaagactgatacaagtcttctctgtttcttttccttagcaagaaaacaaggggaacaatttggctgatc

SEQ ID NO: 64006 - DNA, 1063 bp, Homo sapiens
atgcctatgtttttagaaaagacttttcctgaaataaaacattaagtaactgaggggacaatttaactctagacttggcttaggggggctgtgaattcagtcattcatttatcatgcactcccaagcacccgcttctatacactggcagccccatgaccaggctgatttccaggtgctaagaatgaacaaaatgggccctgtcccccagaagctcctgagtcttgcgagggaggggagatatatcctcatgccactaataaaacagagctgtgggtgatacaggcctaagggtgaatgctaatgaatcaagtccaaattgtctgaagctggatctagactgatccctttaatgccaaatcccctggagctggtaacaggggctaagcctttgatagctgtcttgcttgaaagagaggagctccaaaaccttttacggagaaagatcatcaagggagctttttcgctgttgaaagtttgtgtgccttggtaggacatagagttaggtattctcataagaaggctgttgaagaagcaggcccagcactttgctgtgttagctcttgaaaatataaattgattaagcaagcatttactcaaggtctggtatgcatcagatattaattagtgatttggaaaatataaaggctagtatcctaatcccagctccttaaaagcttaaagggtgatgagttagactggtggtagaatgaagggaggggttgagcggggcctggaacccaccccaggctatgggctttagcttggagcactaaggttatgaggtggcagtgtgtttgttttttctctttttaccttacttattttactctttcattgtattttatgaacataagggtaatgaatgattttaaaaacctttaaaattctaaaaatgtgaagaagcaggttaacacttcggccttttttccagtgttgttggttttttttcttttgcctctattgtaaataactgagctcataccaaatatatagttttacattccagttttgtatttttcttcacttcattgatttcttcattataaaataattgggtatcta

SEQ ID NO: 64007 - DNA, 1059 bp, Homo sapiens
gtaactgaattttcttctggtttgaagtattttaccaatgtttcaacctgcacaattgtatgtgaacatacattaggactttgggggcagaattccataaactctgtgagaaggcttaaagtggcagacactcaactcaaagtcacttaagagaaaaagggaggagagagacctatgtcacataacttgaaaagtctagtgtttgaaagaatacaatatgactagatccgggtaatctcacagtgtcactagaaattagtctcagttgtatcacctggttctgctttagccttattctcaagaaggttctccccaggtggtgacagagatagccatcagtagctccggaatgatatcctgccagccaggcaacttctgcagtcaaagaggtgctttctcaaaggttccagcaaaagcctcaagattgcatctcattgggccactttgggtcatatacctggttctacaccagtcaccgcagggatctgtgcatgaggggtgggaggtgcgaatatgaaagtcagcccgtgtgtggaagtatacagagttagcaccaagctaggataatgcagtccctttacagggacatcagaaaggaaggagagctcccacttctgggacaagaagcactaatgcagtcattttactgtttgcttttttctttcttttctgaaggactatttttaaatctgaattttttgtttttgtttttcatcagtctgttcatacataaggcgacgtagaccctgagtgtctggcctcagtcctaccagataacagcccttcccagttgctagtacaaatattaggtttccacgtggaggaattctgtaggctgttcaaacctgtgataatcagtgagcagccacatggcctgaaacaaattcctcgttcttgtaattgcacataatctttgctggtatgcacagaacttctacctctatttgtgagtgtctggagcaaccaggggtttaaaaccacagggtactgcttaagctgcactattgtcatgtgcatggagatgtttattttgagtgagacattttgctaaggtcacca

SEQ ID NO: 64008 - DNA, 1028 bp, Homo sapiens
agcctctgccaggatgtgactgactggtcactggccagggcctctgccagccctcacacacagccctcttttttttctctttttgagatggagtgttactctgtcacccaggttggagtgcagtggcacaatctcagctcaccgtaacctctgcctcccaagtttaagcaattcttgtgcctcagcctcctgagtagccgggattacaggcactggccactatacctggctaatttttgtatttttagtggagatggggtttcaacatgttgaccaggctagactcgaactcctgaccttaagtgatccgcctgcctcagcctcccaaagtgctgagattacaggcgtgagccaaagcacctggcctcacagccatctttttaagatcatgggtcaagtcactctcagggccttgattgcctatagctaaggagtgagaggtttggaggcaggggtacattacctctgttctgcagataaactttgaccttgaaatgatcctgatgccagcccttgctcagatgccctgaagaatcttcagaatcacactcttactgtccctttatatatttcttagtccttcttaatgaaggagaaacaatgttagaattttgtggtacgattataggtttctgaacatgaattcaacaattcagtcttactaccttaatgcttgcagggccttcggagagaactctctcaatcaatgaagaagaaccggagggaggtttcagcaagtggaacgctacaaataaggaccctgaagaattatttaaacaagaggtactgtgtttccatccatgacgtagggtttcagcaggtcctccgagcttgccctgagcttgagggaggatctagtcagacacgtgtcaggtgcacatcttggcaggtgaatacttaaattaatatagtgcccctcaggctgtgatggggatgggcgagcaagaggctgaggctctggcctgtgctctggttggaggcagcatggtggatactggaactttcaaggataggagttctccttttta

SEQ ID NO: 64009 - DNA, 1040 bp, Homo sapiens
ggcttctgttcccctacagccaggaggattgttctttttggagacaggagaaacagaactggagttgagcatccttgtttcctctgcgtcacgtcttgacattgcactgccttccacatcagtgagtcatttcttcccagcccttattcttggcctgagcagagctcagagagccctttccattgtccttgattcctttttgctgtctttcttacaggtcggggctgccttttaaaccccatccttgggttaggtatgtgttctccttgcatctcagctcctcagggagctccccgggtggcccacttgcttccttggctgtctctgccctgccttgagggagcatgcgtgatgatgcaaccagaaacacgtttttgagagctcttcccccctccatatgtcgtatataatagggagcttggagtcatgcccttcaggtctctaacatctttgaacactaccttctcacagtcagtggttcctgggtctgactgcattagtataatctgagataatctgagatccttgttaaaaatatagacatctggggtgtgcttccagagggactgaatcagggactgggcactgggaattcatgttgttttacaagtgctccaggtaattatgaagagcagccggcacatgaactaccacttggaaactgtgggtcttgaccgtatgtctgatcatgtctaatcttcacctcatgggtcatcacaaacttgaaaatctcatagccttcctctctgaaggttctagttacttctactccaccagccagttctttcagaattcagtttcctctcactgtatctctcctttctgaactatttatggggagttaatagtcaatgttcaatgaatgaactgaatctcaaacaatttctaggacatatgtttataagcaaattgaattggaaatatattggatatttggcctttagctaaatggaacttcataagatgtctcagtcacagcagccttccattactgttgtgacttgccagtttgaaatctgttttgttttttatattacttt

SEQ ID NO: 64010 - DNA, 1124 bp, Homo sapiens
gcactcagctcacgtgtacccatggtggttattttaaacttgattccatatattcttaaggccttgaaatagtatcatttgtcacaaaagaggtcccaagtagcagagtacaaaccactgtgataagctattggtgtctccacgtgcaccttcctgagatgtggttgacttgtctatgcttggtctggtgagggacatcaggggtcttttgtcactttggaaactctggtttataaaccaaactttcctctttcagaacgatttactcttcttaaaagtcaccagccaactacatcatctcagcatcaaatgtgccattcacgtgctgcatgtcaacaagttcaacccccactgcctgcaccggcggccagctgatgaggtgagaccacaaatagtatctctccaggtagccctgagccaggacccctgaaacatcgagcatgagcaaacaagaatgacatcataaaagcactgttttttgcaccatggtgcctgggattcttttgtttgcttgtgcttcctgttgccccaaacatccgttacctgcactttgtgtctcacagtagccatagacctctaagctcccaccctccactggggagacacatgctataaagtcatcatagtgattaaaggagatgaggagatggtgcaaaggagagggggagggaaagacaaaatggaaagatgggtgtcacagtagaagagaagagaagagacagaggagggggaagaggagcccgtagaagctagacatttcagaataggtatccctacttgtagatccaaaattaactgacttccaggcccaggtacaggggatccatgagtagtcttgctagagaagaaatagtatacgtaaataacagcaccccaagtcttgaagaaataactgattatgttccatgaacttcggagttcttggtggacccccaaactgaagattgtcagtcacatcctatctcctctgttcctgggaactaggtctaaccttgctgtaaaattaactcagcttcctgggctgctacctttgctgtctatctcctattttctccttattcaaccaacatgttttgaatgtcttgtatatgtcaggcacagcgctgtgcatttttaagaccaca

SEQ ID NO: 64011 - DNA, 1255 bp, Homo sapiens
tctccttgagtgcctgctcttaaattttaagtatattgtcagtcatacctgcacactgccttgattgccttctcataatcttgcattttctgtgttttagccaaggaaactaggattttcacacttcggaaacataagaaaaaagaagttcgatgaatcgacggactacatttgcccaatggagcccagtgacggtgtcagtgatagtcacagggtctacagtggctaccggggcctcagcccccttgatgcccctgaactggatgggctggaccaggtgggacagattagctgatgcccttgtcacctgccctctgtgcaccctgagagctcacagtaacactgtgtgtgtcaccatataactgcacctcacccccgcacgtgtgcatgactcgcagagaatattccagcaattgtgtacccctgggccagtctctttgaaccctgagggtggccaggatctggagctgcatctctaaggggccaggctttggggaccattgccaaaggtggactcaggaggaaagacacttaaagacacttttacatgtctagtaattcttgatgttcatcttcagcaccagtggaaacacatgaacttcgatgcaggtccagagaccatggacactcccacgaggctcagctctcaggcaccccctacacttcagttgagggaaaagctcaagtgccttaggcccgtggaccacagtcttggctgagatcaaagggatgagcaacagggacttctgccacagtgacaatggaattgtgttgtgccttacttcagaggtggtctcttctttcttgtaataaaagcaatatttatgcggaaagcaagcagctcaccatatctttaactttgttggggaaaaagagctgagggtagctggaaatggagtcctacggattgcagagctgaagagccggtggcactgagcctagtcctcagccaggtgcatgctcaggattcaccaggggggtagagcaaggcgggaccccctcccatagccttcagaggaggtccgtggccgcactgcttcagaatttgcttccctctgtgaagccgagggggcttcaagtctcatgcacatcctgaccatagggtccatctgtcgtgcagacctcaaagctgagtgctttcagtggcatgagcccccccagtgaaggggatggtggggagacaagaaggcaccttgctggaaagactctctttcatgtgttttgctggcttctctattactgacttagctaggct

SEQ ID NO: 64012 - DNA, 1107 bp, Homo sapiens
aaaagcacgttctgtgaagcagccccggagggacctcctggtgaccatttcacaaaacacagtctctacagaacattcaaaacagtttttcggaactttttttccagcaggttttatgaactaacagctcttcccctcgagtgtgagagcctccaggctgtcaccaggaatatcacgagccatcgagtctgtgtgctgatatgtcactgccctcccacaaagtggtctgcagtccacgtataaaagtacaaaaggtatgaagcctgcggtgaagagcgcagcatggttgaagacacacatggaccctggggccacccctggacacctgtcccacagctctgcttcatgcctgtcagcagcctgtctgagacaccctgccagcccggactgggcttgcagagggggctgtgtgcccgctccccacagaagcaaaggctccggggcccccacacatgcctccctacgctctcagccacgaagaaagtcatctccagtcatcagagttgggggcaggcaggcgagagtcattcagcagctggtcctggctcagcattgtctgaaaaggacacagccgaagggtcagtttaatagagttttggtccaggctgccctgcggcagctgcaccggaactagagggcactgggtgagggctgcatctgacacaggtgcactataagtttatagtgtcccaagaaaccctgagtattgggtcagaataaacaacactattaagataaaaataaattgttcatcttagaaataaattttctattttcaggccaccaaaggcctagatcataagggcaagtgtgggcagattcctttcatgggtgggccaataaataaaaacgttgagtaaaactgatcctgtttggagtcagggagactttcctgttttgtccttgaaaacaaggagagtcgtgtgtccctgtccttgtcctgtcatcccaatgggccttgctagacaagcaagcaaagtacagggacaggggcctcgatggggacagacactatagccaataggctcagtgatggaatgtccaagaactaaaaggccttgggagtgatggatcctcaaaaacaaatcctgtgctctgtggctggcc

SEQ ID NO: 64013 - DNA, 1015 bp, Homo sapiens
gagtcattgagcctgttctgagcccagagtgttggcacctcaaagacttggctcatccccttgaatcagcttcagggaccagcccctctagtgcctactctgcctgcttttttctcctcctgcctcctcctcctccctgcaccttaggtcttggtttctatccatctctctgttccatcttccttgtctcgactaatttcccgtatgtagtccactcagtttctgagcgagtagaaactgagggagtaaactgactacatacatacaggaagttagtcaagggttagggttacaaaactttctcttgcctctagctcttagtatctcttgattgcactcctgtccctgccactaattgccttagtaatttgagtctcacattttggatccaacaggtcgtagctgcccagtgtgtcatctgacagtgggatgtagtcatgatccataggtctctggccacacctggtttattgaattctacccaggaagggcagagttacatggttaaaaacttcactgctactcctcacaaggccataggccaggaagacatgatattgttgtttcatttgctccatgggtacccaaatcctagggccctgtagtatctgtgagcccaggcctgctctgtgcctagtaccaggatacagatggagtagttgtaatttattcacagatctcagtgatacatccagtttaggaagaaaggagtttgtgaaggccacatatttttcttgaatagacaaatattcctttctaattttttttttttttttgagacagggtctcattctgtcgtccaggctggaatgcagtggcacagtctcagctcactgcagcctcgacctcctgggctcaggtgatgctcccacctcagcctcccaagtagctgagactgtgggtgtgcaccaccacacctggctaattttttgtatttttttgtagagatggggtttcgccatcttgcccaggctggtctcgaactcctgagctcaagcaatccacccgcctctgg

SEQ ID NO: 64014 - DNA, 1051 bp, Homo sapiens
gtttcctgagtgctcctcgggccaaaagcagagcgcacaaattccagaagaaattaccaacggcgggactatttcagtgctccgagaagtatcaccagtaaccaatcagcaaaaagctctagctcacgtggtgtatattcagcctatcaagctcctgatattcatgaatgctgtcatttccgcttccgcctccttctttctcgacaagatggccacaccggcggtaccagtaagtgctcctccggccacgccaaccccagtcccggcggcggccccagcctcagttccagcgccaacgccagcaccggctgcggctccggttcccgctgcggctccagcctcatcctcagaccctgcggcagcagcggctgcaactgcggctcctggccagaccccggcctcagcgcaagctccagcgcagaccccagcgcccgctctgcctggtcctgctcttccagggcccttccccggcggccgcgtggtcaggctgcacccagtcattttggcctccattgtggacagctacgagagacgcaacgagggtgctgcccgagttatcgggaccctgttgggtgagtggtcagagaaagttaacattcttttcttcctcccacttctcatttatctcactcccctaactcattaattctttaattcctggtgtcctaccgtcctttcctcccatccccaatgacctcttaatctatatctgcatcctaccttttgctgtgacttatcttctcaagcacttgcatctctcctctctctcctgccggattgctgtcactttaagcgacataaaatacacaaggagtagttgtgtcatttactgaatattttatgccagtggtttacatttatgccagtggtttacattttacataaacagcagtttatggcaagtatgatgggctgcatctaccaaaaatgagttcacacgccgagtgggaagtcaggaacccttgactccctataccagtgaccacatatttctcccttatccactgactaaatgtcatcgttttccaggtattgacaaagttttctaacc

SEQ ID NO: 64015 - DNA, 1050 bp, Homo sapiens
tgataaggttaagactgaccatgggaccagatggctaaagggaggtacagatgaagctcctgacgtctcagtgtctgaaacttggccactatattagcagtctatgtaaccattaaaatattccaggtagctctgcagattaaattacagggagaaagtgtagaggctgaaaaaaaaggccgtagagtgaaggtctggaataggctagtagtggagagtaacaggcaaaaggagaccttgtaaaggaagaataaaccctatttggtgatgattagagggagaagttggcgatcacaccacagtttcagttccctggagaattctggtcccatcgatgcaccggactaaacttggagctaatgagttcagttaggtgttcattgacattgaagagatcatcaaaagcatttcaaaagtagtcagaggttgttgggagccctaggattatataacacatggacgattctctctttcacaggaactgtcgacaaacactcagtggaggtcaccaattgcttttcagtgccgcacaatgagtcagaagatgaagtgagtgggaatccaagctgtccctctgcagtttttagctgttcatttgctcggctcccctcacggtccctcccacactcataactagagctcctgtagccaaggagcttcttcccatttgtacgtacttcctgggcctcttctgtttattgggggtggcctcttgtcctttttaaccaatttttctttggacttctggcttcttagcttgctttcctgccttccctcttaggtggctgttgacatggaatttgctaagaatatgtatgaactgcataaaaaagtttctccaaatgagctcatcctgggctggtaagttggggaggtgggggctggggttaatggaaggtctcttcgtgattgccggtgtcttttgctactggactggatcttatactcttccttttggaggcaagagtattgcaagtgtattactgactgtgagcagtggctcaatgcctgtaatcccagctgggaggctgaggcaggaggatcacttga

SEQ ID NO: 64016 - DNA, 1708 bp, Homo sapiens
tgagcagactgagtctaaggggagttgggaaacagagttagtaggacgttaagaccatctctttcctggtgggatgactgaattctctctcttactgcccaccactgccgctgccaccctgccaaccaacttccatagttgacctgatcatgaagacctgctttagccccaacagagtgattggactctcaagtgacttgcagcaagtaggaggggcatcagctcgcatccaggatgccctgagtacagtgttgcaatatgcagaggatgtactggtgagaggggaaagaaaaaacaaagggggaggacatagttctctatcctgggatcactgaggcatgtgctgatgaaatggtagggctcagtggttataattaactgcctcatcgagtctttgttttggtactcagtctggaaaggtgtcagctgacaatactgtgggccgcttcctgatgagcctggttaaccaagtaccgaaaatagttcccgatgactttgagaccatgctcaacagcaacatcaatgtgagtgcccttcctgagccccttcttgcctggtttcttcccccacctcagcacatacactcaaatgtgaaaagagttgggtgaggtgacctggagtaggatagagacagggcttcacctatagccccactgaagtccaggttgggaggaaggaagaggtgtgttatgcgtggttggagacttccttccttctcccatgattccattgtctcatttactgctgatactactgtgacttactgtctaaattcgtgatggaaagaaacactaaaattcagaggttaatgaaaatgcaattacttatttcccccatctgagttcacagaccccctatattccatccatgggtttcagctaaggcacccctagtctataagtgtatcagtagagataagaaagccttctcaagcatttcctttctgtcttctacctttttgacttttattcagtctctcctagctgtcatttatccacagctgtcctcatacccagtgtctaccatagagctggccaaagccagcctttttgctccctttccacccaaccccccactcattgtgtattctttgtcttccaggaccttttgatggtgacctacctggccaacctcacacagtcacagattgcactcaatgaaaaacttgtaaacctgtgaatggaccccaagcagtacacttgctggtctaggtattaaccccaggactcagaagtgaaggagaaatgggttttttgtggtcttgagtcacactgagatagtcagttgtgtgtgactctaataaacggagcctaccttttgtaaattaatttcatcttatgtgagtttattgccgggtggaagggaggaaaatgttttagatcacacagaaactaggaagtgaatattgtaggtagagaagttggttatgtgtttggcatgttactgttttaccaaactgttcttttggttttcaatatggaaaggtgtccattggcaaaacaaccttttcttgaggattcatgtgatttctacaggaaatgaaaataagaatccatggagaaaaaatagctaagaaaattggatgcttaatctgaactaaaagagtagagtgtgtagtcactatcttaaaatacattaatagtaagatggagctctttgccactttggttcggggaggcagaattaagatctgtgggttaaagattaa

SEQ ID NO: 64017 - DNA, 1026 bp, Homo sapiens
ggtctcctctgcatgtgcattcctgctcctaacttctcagtctccaacaagctgccagggttgccgtcctcccactacactttatcccacaaagtgtcccactgtggacagtgccccaccttctgcattccctaagcatcattcataggaggtggtggtatatacataccagactttttctgaaagtttcgaggtaatagagcagcaccaaggagcaggaaccaacttaaaatagaacattagacatctccattcctcgagttccttggccatccgtcagaatttctcaccagttactttccttcttagagtccagctttctaccatttcaccttctttttactcaagcttttctcctgtatcctctcttctcccagttccaatcttacccctacaactcatcatttagctacaagaagacaactcctgaattcctatcgctcctctgtgcagagcagctcatctctgcagatgaactgggacccttcctgccataaccaaagggccatgaatcagctttcaaggaaaaagaaccagttcctcggagatgaattctgcctgcctggttatctacggtgtaaaacaacaaccgtttcacagtgttcacagattctctgggtcaggtcagggcggagcaaggatgacttgtctctcctttgtgatgtatagggctcagctggaaggctcaagcagttggggatgacttaaagggctaggggctgtaatcatctgaaggcttcttcagtcctatgtctggtgcctggctgtggggacttgaaggctgggctcagctgggactgtcaattgaagcacccacatatgacctttccttgtagcttgggctttctcacagcatggcagcatcacagtagtcagacttctaacatgtcagcccaggggtccagtgaacaggggatgttgaagggcctttcattacttaacctcagaagttacatagcatccagattaaaggggaggtaacatagaacttgtttctcaacgagaggaatggaaagattttgtggc

SEQ ID NO: 64018 - DNA, 1129 bp, Homo sapiens
cgactctagcccggcgtggatcaatgttaaaatctctatcccctttcttcttataacactagaatcctacaacaaaaatgacttgcctgtgcaggatgtcaccactttcatggtcttcatcttcggccgggccaccaatgccatctctcagtctttctgcttctccctgatgaacttcactcccattgcccacaacagcccttccaaaccttccgcactctcaagacccctctctgcttgacccttatctgcaccccgtgtgttatgtaaatggccctgcctcctgctccttggagaaaaattgatcacatcaggcatcatcttctgtcacgtcctgactccacttcatttccactctacttcaatcactcccttgtggggactttgttgttcttcccagttctttgctattataaataattttgtgttgaacatcttgtatatatgacattctcccctcatgtttgattattcaattaaaacaaacttctgaagaaggattgttagtttccaatgttggctactgtcagattgtcctccaggaggggtgaattgatttctttttccacaggcagtcactgactgcattgttttgcaattatgtttgtgtgtgtgagtgtgacctctcagactctgagacaaagtagcatcactgcgcagaacttggattttggggtcaaagtgacctggctttgcagcccaggtccttaaattattgcttatatggctttagacaagtgacttaacctccatcagcaaatagacaataataatggtagctacgtcttaaggtgggtccattcactcaatatgcatttactgaacaccttctaaatgccaggcaacattttaggcagtggagacagaatgaaacaaagtctgtggtctcgtagttcttaccatctagttgggggagatatggacaaatatatttaatgtatcagtgctaagaggcttatataatatgataaagtgcaaagcagaaaaagcagagtctggaggagagagtctgacagcatgggcatgctgggggtggtgtgtgtgctgtgtcatatagtgtggtcagggaaactctgaggagggggtatttcatccaagagctgaaagaggcgagggaatgagtcatgtg

SEQ ID NO: 64019 - DNA, 1062 bp, Homo sapiens
ttttgtgaaatatcaatgatagcatccttcttagaaggctgtgctcaccattcagtgcactaatgcaaagcactgtgaccgactgaagagtcatgttctgtggggccatggaggacagaactaggactgaagggaggtgtgtttgagctttaggtgaagcagcaatggccaactacaaagatggagggaccgctctgggaagagcaaacaccctgatgctcagagtgtgcatgaggaggtttcataatcaccatccagcagcttagcctcaaaagggctgcctgccccagggagctatgacccttgagagatgcagtttatccagccctgaggttctgtttgaccatctttccccggttgtcctccagggggtcatggcacaagtctcagtagcacgggccccatggtccagccttaaggtaagaatggacctccctggaggaagctggcttcatctacagttgataagttcaccttttttcctggtccactttccttggtttaaccctgtgaccaaacctgagagctttggcaggaaggaaaccagggaggatgttgtgcttgagaaagtgctggcctgagcattggctttgagatgtccttttactctgactggagggtctcattccacctgtagcaagactaaagacacctgaaagagagtttctgggagatggaggatgaggtctccagttgcaggtgcatgcacacgtccacttccccacctggcaggtgccggcatgcaggatgtctgtgcgtgtgccccttgcactgactcccttgaggctggctgtgcagctttggggcatgtgtccaagcagagagaatggaagactccatattgggagccttggctttgacctttcctttctctgagcctgattttcccaacagtgttatgggaggggaaggatgagatgcgcttctcagctgatgtccgtgattcttctgttttctggaggccatgagtgttaacagaatgtgttcacttttgcacccttcttccatgaccacttacagtctgtctgcttagcagatgaggggtctgggtctccagcgtcc

SEQ ID NO: 64020 - DNA, 1023 bp, Homo sapiens
atgtgtgtatgtgttcctccatatatgtgtcagcatgcatgcacacatggtctctgcagccatggagatttccactttgtgtgaatattgtgtacatgttcctgtgtgtactgtacctgtgttcatacatgtgcatgggtgtatgttcctgtgttactgtcactgggaggcacatggcacatctggctaaagggatggtagagtagctcagcacagccttggtgcttacatggcttattctctgccattttaaacaatctctcaaagggccagaaggtgaagaggaggtgggcttgggcaagatggggtgtggaggctggcccgtcctagagtcactctgtcatgactaacccaagtctggagcccaggcctagatgctcagcctgtgtcccctggaaaccccctcagctagacagagaggagagggtttactgtaactcatcagtcagggcagctgtctgctgttgccatggaaatctgaaggcagcatcttctgcaaggaccaggatgtagagtctagagaggacaggctgcatcagcctggtgggatcagtctggagtggcctgtgtgtgtgcgtgtgtgagagagagagaggtgggaggagaatgcaagatagtgagtgagctttctgaagtgggtggcgcatacctcaccattgctctctaaggcctcagccattactctggattatcgctgggtggcgctgtaagaaggggtgtacccctgagatggcttccctgtgcccatcaggacccggtctggcctgaggctgctcttagagtgtcctgggaccacctagacagatgtgctggcatctgcccatcatgggccccagagcccacccagcatctgctgcacactggctcctccttgctcagatgatggggtggtccaggaggcaggcccttaccctggccgcacagatgctgggtgatgggagcagacagacagaggcccctcaccccaggactcagctctgctgctgatgggctgggggtgggggcaaggacagggcaagagta

SEQ ID NO: 64021 - DNA, 1050 bp, Homo sapiens
tgtttatagttgctccatggtgaatagcagaaaacaaagatttttccagtattcagaaactattaacctattcagcaaagaagtcactccgaccaccagtgaaggagtgaagttctgacatgtctttgttgtttcactttcaacttacttgttaacataaatgaaaatatcaagcagcattaagctggaactacagtaatttgtcattgcaaccgtaggttggctacagataaagagttaggcgaaactcattgaatgggttgatttctgggacagtcatctggctatatggaatttacaataaagaatattggatatttcattagtatttgtaaattatgtgctatacatcctttgtgtcagtaaaatttataataaacttattgagtctacgcatgcagacattttctggagagcttgttgttaaatgtcactgttaacaccccgtaggccctccattacacatagtcccaacatgtctccttactgtgcagacggtgaggtagggtggggtggagggacagatgtaacttgcagagaccctgggagcagtgtcttaggtttccagacaagctgtggcttgtcactagatcagcctgacctcctcctggccgggggcactggggctcaggtgggggtcccgttcattggtcccttctctgtagcaggctcagggatttacaggtcagaggaagaagacgtggtcactgcctgtatggagctcacagcccagcagaggagacatccagtcgcagttagttacaccctggagagtacaggggcaaaaaaagaagaaattgcccagctgaggcaggagcgaggctgggacaagaggagctgctcagcggaacagtgcctctcgacatttagtgtgcagcatccacagatttgtgttaaaaatgcggagattctcttttggcaggtctgggcagggtggtgcccgggagtatgctaggggatggtgaagcaggtacccaagggcacactgggaaaagccttgatctgaggagacgagagggtgtgtgctgaggcaggagatgagaaagaagt

SEQ ID NO: 64022 - DNA, 1047 bp, Homo sapiens
tctccagaaatattgagcccgtttactgtgacaccaattatgtatagctgtccccacagccctccagtataaaggttcatcatttttatttatttatagctgttttatttactttcttttttctcattttgcgattttggtcaggagtggtgtggcgagttgttttaatgccgttgtttcaatgattggtgacattggacattctctgaaggactttgagaacctcataggcgtcatttgtcccacagggatatggcaggatcggttctgagtctaagagctggatcaggactggaaaatggatagctctgagttttcagacttactcagttctcagtctcccaccaataggccagaatgtacgtcagggccatagtttccaaagctctgaggctgaacgatgaatatggttttaaaacagcatcacttgccccagggagaagactgagatgaaggggagaaggagaacccgtggccccatgcttgtccccaccttgatggactgtgcctgagctccactggacaggctgcacagcctcttaccccagatgtgaccttctgggtacacagattaccatgttatgcttgtggctgtggccatagggataaaccaaatttggggcttgtagtacacttgcctgttgatcctaatgagcatccaggagctgcaccaagagtttacccagtacctgtaaaaccagggctctgatggtggctagagaggcctggctgggtaagatcagtaacatttgctggggtctgggccctcatgtcttggctgaggtctaagcatggggagttgtggaaaaggagactgttagggaactttgacgtaagtggggtcgaagactgtggccttcagataatgacaggggcctcctcagtgataccaggaactcaaggcagagacagtgagggtcaggggcatgaaacccagtgatagaaactaggtgccatggctgttgcagacagggccacagggcctcctgggatctcagagcaaagaggccagatgatgaggacagtaagtcagggcagacatggctg

SEQ ID NO: 64023 - DNA, 1036 bp, Homo sapiens
atgtggggcaggatggccgcaccgtgtgggcatgctctcacgggaaaatggaggtggtgttgctgatcgacactagccagcgaggcaacatggccacactggctttcttatcacagagcccacgttcacaaaccatcttggggctcgccctcctttccttaaatcatcaccacagggaagcataaaaaaatctctgtacattatcaagtttcagaatccccttggaattttgctttgaactaaatgaagtctcatttaggaagaatgactgtctttaaaacagtcttcctatcatatagaaatacattaggaatctccatttcttcaagttctttttataaatctcagttgcattttataatcttctttatatgaatcacaaatcagtctcattggtattattttaaaacttttcatatgtagtcttgtaccactgtaaatgagatctttttcattctcattttgcaaatgataatttttttatagaaatgttcttggctatttttccatctttttatctggcaactttactcaactttctgattctgggggttttcttgttgattcccttacattttctcaggtccagtacagtaatcatgtgcaataatataaaccatgagtcctttctaacatagtagactaataactgttcatcaatgcccccctcaggaactttaaagaaatacaagtagttgggccctcctcggtccccactgaaccataacttcagtctcagccatagggctttggcttgcggggcagggatgggaagtggattccagacccaaaagtctgcaaaggtggagaaagcctggcttctctaaaagcataccagtatagctacagaccagaaacttcattgctttgtaggaactttttaaaattttggtctgtgagcaagggaagtgagtgaaggatttgaagcagcaggtgcaaggatagatttgcattatgaaaaaatcactctcactgccatgtgagaacagactgcaggggggctggagggaaagggggtgcagatcattatgtaacc

SEQ ID NO: 64024 - DNA, 1045 bp, Homo sapiens
taatagtacctaccttgaagtgttgctctgaggattaaatgggagaagtgatgtgtaattgttaagttgaataggcataggcatgactcatgagatgtaatcataaagcaaactttatttttgtctcccacagtctctttaaatttattctatagggctgttttcccttctaaaattatattaaatttagggtaagtcccatgacttttctgaccattttcaggtaaccagaggttgtcttgtcagtaattaatgcatcctgtctgctgtaataaaaaaaaaaatcttgaaacgtcagagttacaccatctctttcccagcacggtctgctgtaggccagctgcctgtggggaccttgcacatgacagtcctgaccctttccagggtccaaggtggaggggcaggtaggtaggagaggagatggttgggaaaggtcttcaacgactgtactctgatgagttgctgtcccgttgttctctgggccctttctctcactgggctgtttttgtgggttggtggagaccaccccatcgctggagtctcaccctgcacctcccttgatgagggtgatactttctccccgtagccgatcctatggtttctttctcaggctctgggaaacctggtctccctcagtgtcacctcctcccttggaggagccctcttgtcctggatctaagacagtcacatctggctctcttgctgggtgctacctctgtccacaagagacactcatgtgtgctttgccctgcaaaccagggagcacaggctggtcctgaagcagcagcactcttgctgctctttggatttctccactgtggcaccaagaccattttggccacatatcaactgacttaggggtctcctcaaggccccactgtctggctttgaggtgaaggtgatagcaccctgtacccctcccatttatttgggatcactggaccccaaaggctgtctctgaaattcattctaaacctccaacaaccttttttcaacctctctcccattttgtatgcattagagatgggtgtcagctaatggcatg

SEQ ID NO: 64025 - DNA, 1318 bp, Homo sapiens
acatcctgggaggctggaactcctgtgagcagtgtggtcctctgccttctggagctgcactggttcccactgtgtcccagtaagctgccaggcgacagaagccacagatctggacttgccgggggtccagggttgcagccaggggcacagggttgcagccagatgccctggtggcctttcctctcctgacagcccacatctgtgatttcctgggtccagcaggggtagcttccactgtgactgaggggaaagaatgagggcaggaagaggagaaggtgaagtcaacatggaaagtgtggccagagggttgggtctgtccctagattccctgacccctgggcctctggttagcactgatggagtagctggagcatgtaaggtagagtctctgaagagagggagttcggaaacaggctagaggatgttggctgtgtgtgcttttccagggcacagaattgtccttgtgtccttgccccttgttgtcaatcgtggatgactgctctgatatctgtggggtgccttgggggaagtgagtggatgtagaggggcaggttccctgggaggtgaagctgccacctcgttggtgctggactgagcagatggattggtggacactgaagcctgggtttctctgccctcatgagccagtggctttcctgagcctccctgttcaggcccccagcaggaggtgcccgtgatgtaggagactccagggtcagctgaaagacctatccatcagcgccctgtctcttgtctgagtctcctggcggggctgcagctggcagcctgggcttggcagttattccataattggagctgaagtcattaaaaaaccattactgtctccttgtgtggttatcgtttaggtcagcctagaacagggcccatcagaaacaggcaggctggggaagcgtcggtgagaaaggaagatgccttaggaatggtgctggggtggagatgaggaggaagggccatctgggtgggggcggagaagggaactgggcctattgaggaagccaggggagcttttggtgctgctcttcctggagacagccatcgcagttgcccttggtctccacaacagctgctgttggctggggattctttgttattcaccagggagagttgttgcgcacttgtcgttagctaggaacacccacctggtacaagcttgtcactgctaggtaatcgtggtcccatctcgtccccttgcagctcttctagaacactgctttaccaggaatcgtgcccactctcagagcctccccattttagtagatttagtgtagaccctcctagctgggtcttgctcagccag

SEQ ID NO: 64026 - DNA, 1039 bp, Homo sapiens
ctcctctttctccagaaaagacccctaaagattaaggacagtgattggcggtacctgccccaggtcctgtctcttggctacacaccccgtttcctcaacttttgttcacggacagtggtttccaggccactgcgtcacggttggacagtgatgtgtcacaggccatgggcttctggagctggccgagcactctgggcatagctcagtaggcgggcagggtggctgccacctgtgtgggtcaggccttgcttctgttgctgaagctctgtggtaacgggcaggaaagctgacgtaggatgggagatgctccatttgggaaggcgagtgtatgccaattgcaatctttctcaaggggcccacgtttttaatgatgtatgtgagttactgcacgtgtgtatgttgtgtctgtttgtggaagaaaacaccagcattgatggcttgtagctggtcgtgtccatgaatgattgctggccttgcctatggtctggatcagtccttgttctccatcttgtttttccactgtgcagttggttttgtagatggctgccgtctgctttaaggacgtgaggtgttgtaaaccaaccctcggcaattaatttgggggaagagcagaagaaatgaagcccacatcccttactagcttaccagttgttaacaggctggtgcaatcattagttttataaaaatcacttttgcaaataaagttttgcagagggtttccccactcttccctcatccccttcatggacgtctgagaatccaggccctcctctcctcctcctggatgtaactcaggcgtgtccgtggcctgcaggcaccagcgggccagcagcactggcagaagacaagtctgaggcccaaggcccagtgcagattctgactgtgggccagtcagaccacgcccaggacgcaggggagacggcagctggtgggggcgaacggcccagcgggcaggatctccgtgccacgatgcagaggaagggtgagccccatggggacccagtgatacccccaaaactcagtcccaggttctcagatg

SEQ ID NO: 64027 - DNA, 1029 bp, Homo sapiens
cttcggagacaaatgagaaactcttaggcagggcccctgctaaggccccagggaggccctgatttgggggcagatttccttttccttttgctccttagaaaaagctccttttgcaagaagtttcccatatgtttgctgagctactgggagcagggccaggataccaagagacggggtagatcctccgtggaaacctgctgttcagttttcccaccacaagccctgccctagggagcccctggtgcagggtggcagagggaagaagcctggcagtgccacacattgtgaggaatctaatcaaggatggcttcctgtacaaaggactttgagacaacttgaggatggggatggcattcccagggaatggcaggcgggaggacagctgagatagaagctcagggcaaagatgaggagtcagtgggtcccctccacattgggctgaggaaggagctgaggcctgtgccctggcagattccgtggtctatgccagccaaggcctctaataggcctgaggtcagaaatggagattcccagttcaaggtgagctcagtgcaggccttgatacacaagagacagtggtagggtggctgctaggtagtggggtaatgtagggactgagctgaaactgggtggtggggatatatcctgaggattgtggccagccccggctcatgtgtgtacctgagagaatatccttttatatctggacatgtgtgggaatatatgtgtgaatgggagtctatatgtgtagatatggctaagagtgtgtgcataagtttgtgggggtacaggtgagtcagtgtctgaacatgagtatgtgaccatgtgtatttcaggggcagcgtagacttctcctccttcatcccttcttcttctctccttggcccaggcatctccagcagcatgagctttgacgaggatgaggaggatgaggaggagaatagctccagctcctcccagctaaatagtaacacccgccccagctctgctactagcaggaagtccgtcagggtgagtgagtgagtctgc

SEQ ID NO: 64028 - DNA, 1028 bp, Homo sapiens
agatgggaatcacacacccgaccccaagctgttcccaggaggtgggtgcaggcccaccaagagtgatggatccaaccccagggtgtcactgataacgcaggccaccatggaagagttgccttggctccatggtcaatgccaagggacagggctgagagtgagctcttgagggaagagacacacagcaatcttgggggtggggggcagtggtgaaggggcaggaaggctctgagcctaggcctccaggtgggggcagtggggaggtagggtttgctgaggaactgagtaccagatttggggagcataaataaagatgagaggtcaggagctaaagctggagatggggctggactgagacttaggctggctgcgacagaggagatctcatcctctctccacgggtgctaagcctcttccactgtcttatcagatgccattctgtttgctcacctcccatgaggagaactcccatgttcccccagataaatcttctgaagaatcctgattgacctccctgaattgctctcactgaactgaaatgcactttgagtcaactcagagcaagtccaggccttctgcccacgaagtgtcttcaaagatgtggattcagtgagcagtatgcctccctgggcctgctcctgttccagcccagaatgttttgcaggctcctcataggacagacgatgagctgttccctgctctggggcagagggtgcatgactctatactgattgtgcctttatttcaggtccaacttgatgggcaccaagttcactgtttatgacaatggagtcaaccctcagaaggcctcatcctccactttggaaagtggaaccttacgtcaggagctggcagctgtgtgctacgtgagtcctaggttcgggggtctctgatttccaaggtagatatgaaatccaggacttgatgcctgatctaggggctatcccatccatcttagtgggtagacaaggctgtgtggagaggggctgtcctctgtggagtgttcctggcctaggacaggggctctg

SEQ ID NO: 64029 - DNA, 1205 bp, Homo sapiens
ctggaggtctagggaaatccaaggacccccattcccgggatagatccctttctggggtggtcatggtgccaaaggcctgggcctggctcaggtgaggctgccctcccaggagcatgagacactgctagcacgctggcagaataagaacacggagagtatcatcgagctgcaaaacaagacacctgtctggaatgatgacacacagtcctatgtactcaacttccatgggcgcgtcacacaggcctccgtgaagaacttccagatcatccatggcaatgaccgtgagtgtttctgtccctactcattatggtccgtaggatacccaaggcccttagcgtagggttcagcccacctagccctgcctacactggctagagtttaagaatgtgagctatacagctaaggttagatgtatggaactttctaaccctaatgactgggaggtcctggaagaaccttctttgcagccctggtcctagattctgtgtattcaacggagtctcaggcacgggaacaccctttaaaaggacttttcctcttttctgtcccctggtgttcacatgcatcttactttgtcctttgccatctgccacctctttcctgccacttctcccaattggcctttgttttacttccctttgtgattcccctggcatctctgcttctcacttgttcttccctcatgtggtttgggtgtctgtctatccttccctggctctaccattcctgtcctgtccttttctctgtctgtgcctgtgcttggccccagcggactacatcgtgatgcagtttggccgggtagcagaggatgtgttcaccatggattacaactacccgctgtgtgcactgcaggcctttgccattgccctgtccagcttcgacagcaagctggcgtgcgagtagaggcctcttcgtgccctttggggttgcccagcctggagcggagcttgcctgcctgcctgtggagacagccctgcctatcctctgtatataggccttccgccagatgaagctttggccctcagtgggctccctggcccagccagccaggaactggctcctttgcctctgctactgaggcaggggagtagtggagagcgggtgggtgggtgtgaagggatgagaataattctttccatgccacgagatcaacacacactcccacccttggggtagtagtgtgttgtagtcgtacttaccaagct

SEQ ID NO: 64030 - DNA, 1051 bp, Homo sapiens
aggaaaactcttggcctctgctttctcctgtagcacaaagagggagttggctggatcttttggtggagtcaggaaagacaggctgagctttctagcctaagtgtggagaaggatagcctcagccacaaaactctgtcaggcattgaatgacaagcatcagtagctgagtgcactcctggtgatcctggttttccttgaccactggccctggggccatgggtgcatggactcgtaaagctgctagggcccctagaaaccacctgggttcagcctctcccacaataagagttcttgcccttcataccctctacctggatggatggtctttgggcagggaattaatgacagaatgagcagtccctaatggtattgggcagttgggagtgagtttaggcagcttctctgtaaccgcttctggggccacaccccaaaactctacaccctctgccccagaacaattctgcagagtggtgaagttcacttccccaactcttctccaagtctagctttcctttccttctggctccaaggtgctctgtgtccgtctgtgtatgtgtgtgtctgtgcgtctgtgtgtttatttggggaaaagggcaatcagcaatcaactgaggtttcttaattgtgattatattcctgagaatgaatgagtaggaaaggaataaggatgttgttatgatcgcctgtggattttgtccattcatctcatgctctctgaacagaaggtatacctgggaagataccagctttttctctcagggttctgagtcagaggacaccatccaagaatgttgttagcttttcagttcccgctctgcattgcctgaaaaaactggtatgttgcacgtatgcttttggttgaaattgaacatactctagtgaatgtgccttaaaaatcaagacactagttcagaggaagcacataatgtccagatctatggcgaacacaggtgttggaagccaggactgtgataatcagaagctataagagaactttcggagcctgcctccttcagtgacaagtagggcacaaaattctagaagcagaagg

SEQ ID NO: 64031 - DNA, 1045 bp, Homo sapiens
ctcaaaggccgttgattctacaggccaaatacacctccactcctcatcacgactccctgggcccagcttctggagctagtcatggagataatggtttctttgtgctcctgttgtgaccaggaaaggggatctcctggctgcaccacccacctgatttaccaagagtgatcccagattatgcagttgttttgtgagctaactgtccataaaggtatgacttgtgtactctgccacagtgccaaaaggccaggggactgatcaagttcccagcaccctcgtgagaaatgaagaccgcaagaaaagagacagcagccctggcaacaaaaaccggacccatgattttgtcatcctgggttgtatatacacatataactgtcatccccgaaggataaaataattctggaaaatccaaaaagaattttctaaatcctaaataactgaaaggtacatccaaatgtctgatatataaatacacaaatatattccttatatataaaccaaccaagagctagggcaggaagaaccaccataagggcttagtacttctggcaggaatttccataagccaattttccccaaagaccaacaacactttacataacagcctcaccaaaatacttgaacatccatgtattttcacaccctactgcttttttcaacaactctttctgccaagagtgtcctctcttctttgcctacctgaagaagttctttgcatgcctcaaggcccacctcccaagaaactgtgaagtttcttggcaatactttagcaaaaacaatttatctttcctgtagttttgggcccatgtctgaattacagcatagcccttataataaaaacataattaccacttaatgagtggttatcatgtatgagctagaaccaatgctgttttacacacactgatgatttcatttaaccaggacctttaatacccctccctttactaccctgaagccaaagctcagaccagttaaggagctgacccaagattccacagctagaaaatgcagggacagattatggctcatgtttctctgcctg

SEQ ID NO: 64032 - DNA, 1021 bp, Homo sapiens
cagaggctcaatctctaccctcagaaaactcagtgtgacgagagagagcctgacagataaaatgaactatgaccctgtaagagggctcaggatcgtgaatcctgcaggcagagaaacatgagccataatctgtccctgcattttctagctgtggaatcttgggtcagctccttaactggtctgagctttggcttcagggtagtaaagggaggggtattaaaggtcctggttaaatgaaatcatcagtgtgtgtaaaacagcattggttctagctcatacatgataaccactcattaagtggtaattatgtttttattataagggctatgctgtaattcagacatgggcccaaaactacaggaaagataaattgtttttgctaaagtattgccaagaaacttcacagtttcttgggaggtgggccttgaggcatgcaaagaacttcttcaggtaggcaaagaagagaggacactcttggcagaaagagttgttgaaaaaagcagtagggtgtgaaaatacatggatgttcaagtattttggtgaggctgttatgtaaagtgttgttggtctttggggaaaattggcttatggaaattcctgccagaagtactaagcccttatggtggttcttcctgccctagctcttggttggtttatatataaggaatatatttgtgtatttatatatcagacatttggatgtacctttcagttatttaggatttagaaaattctttttggattttccagaattattttatccttcggggatgacagttatatgtgtatatacaacccaggatgacaaaatcatgggtccggtttttgttgccagggctgctgtctcttttcttgcggtcttcatttctcacgagggtgctgggaacttgatcagtcccctggccttttggcactgtggcagagtacacaagtcatacctttatggacagttagctcacaaaacaactgcataatctgggatcactcttggtaaatcaggtgggtggtgcagccaggagat

SEQ ID NO: 64033 - DNA, 1036 bp, Homo sapiens
tccaccaaggaagatttggaaattgttccaaatagaaattataaacattagcctggagctgtgctgtctctgtctggttttgatgctttttttgttttaactaaaggctcatgttgtttgtttaatcttcatcagtactgcaaaaacacatggtataagacttaactctgccccaagcaccctacacataagaagggattttcatctgaattagtttgtatttcaaagagcactgggatagccagattgctaagaatttgctcaagtaaaactttagaactattggaatcttagagatgtcttgaatggatttgttaggataggatggctgctgcctgagaatcctctttgaacctgacactattttttttttttttgaggagacattctttgtaatactttgtgctacttttctctctaggttaccctgaagagacttacccaatttatgacctttcagactgtatcaagcgtaggcaagaaacaatcttggtggattaccctgacccaaaagaactttctgctgaagaaatagctgaaagaatgggaatgatagaagaggaagaatcagatcatttgggttgggaaagtctgcccactgaccccagagcccaggaagataattctgttacctcgtgtgatccaaagccagaaacatgttcctgctgttttcatgaagacgaggatcctgctgtcttggcagagaatgctggattcagtgcagatagctaccctgagcaagaggaaaccaccaaagaagagtggtcccaagactttaaagatgaagggttgggcatcagcaccgataaagcatatacaggcagcatgctgaggaagcgtaacccccagggtttagagtgaaaacagccagtctgaagtatccattactcaagtcccaaggtgacctctctctcctcagatttccttcttggccctgtgccctgcactttcttcactgtgttcaagtgtcatagctatcaggccactatcatggatatcatgtatccttcctggtgctcacacacctgtcaccttg

SEQ ID NO: 64034 - DNA, 1050 bp, Homo sapiens
gaaggaaaattcattgacagattttctccagagaaagaagctgaggaggccccttacatggaggactgggaaggtaaacagtgtcttctcatttttttgttagctgtcagcccagaaaagagatgttacagatttttaaaaaatcagcttcattattgaggtataatatataaacagtaatattaaccagttttaaatgtacggttggatgagttttgacaaatatatagagtttgtgtaatcacaccgtaattttgataaagaacatttccattactccagaaagctccccctttgtagctaatgcccttctcctgcccctggaaacaactgaagtgctttctgtgcctttagttttgccttttctatgtaagtgatcatactgcatatactcattggcttctttgatttagcgtaatacttttgacattcatgtttgttattgagtgtatctgaaatttttttcttgctgagtagtagtcagttatatacttataccataatttgtttgtccattcaccagttgaggagcgtttgggttattcctagctttgcactcttatgactcaagcagctatgaacttttgcatatgagtctttgtttgaacatatatttgtatttcttttgagtctatacctaggagtgagatttttgggtttaaggtaattgtatatttaactttgtttttgtttttcaagacagtctcactttgtcgcccaggctggagtttgcagagcaatctcagctcgctgcaacctctacctcgtgggttcaagtgattctcctgcctcagcctcccaagtagctgagattacaggtgcctggcaccacacctgaataatttttgtatttttagtagagacggagtttcaccatgttggccaggctggtctcaaactcctgacctcaagtgatctgcctgcctcagcccctcaaagtgctgggattataggtgtgggcctgtgggccaccgcgcccggccacctgtttaactttattagaaactgtcaacctgctttcctaagtaggtctactttttcccttcccac

SEQ ID NO: 64035 - DNA, 1040 bp, Homo sapiens
tgaatggtattaacatctatttaattctctgtacttaactcttgcatttggaacttgatgattctgctgggcttatagaattcaaaattctggtgagggtgtttcccaactgtgaccttttatttttctatcatcttagaatcttccatactcagcctcttctggtcttcctgttcatgcagttgctcacgatcctgagccaactgggacctggtttcaagaggtgaatttaaggttaactttaacatagttccaaggcctccaagtggaaatgcccaggaaataactggagttgtgagacaggaatttgtgtggaaagtcaagattaatagtagcattaggacatcttttctatagaggtgatggtctaatctgtaatactgggtcaacttcctgagggcatgattataagaatggagaaatgagagtcctaggattgagccttgggaaaattgttttgggaggtgggtggaaaaaagtgagtcaggatcatagataaaaggaatgtttaaagaagtgggagaatacaaatgtctcaatagctaagggaggaggaggtttcaagcagaggatggtctatggtatagagaagtcaagaagaatgaaatgtgagaaaaagacccttggacttagtaaagtgaaaaatcacttaggagtaaaagtttttggccgggcgctgtggctcacgcctgtaatcccagcactttgggaggccgaggcgggcggatcacgaggtcaggagattgagaccatcctggctaacacggtgaaaccccgtctctactaaaaatacaaaaaattagccaggcgaggtggctggcgcctgtagtcccagctatgcgggaggctgaggcaggagaatggcgtgaacccgggaggcggagcttgcagtgagctgaggtggcgccactgcactccagcctgggcgacagcgagactccatctcaaaaaaaaaaaaaaaaaaaaaaaagtttttgcaacttttcataaaatgatagaacggaatccagaattcagggaggtggaagaaaataatggat

SEQ ID NO: 64036 - DNA, 1026 bp, Homo sapiens
ttataactttcagctttggttttcattgatctataaatacaacaatatgatctgagcaaaatgaaaaatcttaacaccttccgtatcctttgctacaaaccaaaagcttctttgtgttttctcatgaggttcacttatagcttatcaggtgtagggaggtactgtggcctggcacttgttctacccatacaggcagagcataggtgggagtgggcactaactaggcagagggtcacttaggatctagggagtattctacagttcccagttcccataatgatgttgtgctgctggagctttcagtcattcttgttcttccttctctgtcattctcaagattcagtcaaactccatgtcctgctcatttttcctttgaaatatccttacctattctttgatttctcttcacctgtatcttttctccttatgattccttttctagactattgcagggtctttctgactgttctccctacttctggtcaccctccccatgtttgtccttcacgttgctgccaggggtgtcctttcaaatcacaaatctgatcatactgctttcctgattaaaatcctctgatatatatataaaagcctctgatatatatatatatataattataatataatatatatgtaatctaatacatatatatatgtatttgtatacggagaagtgtcagagcatcttggcatggcatggcatggcatagcagagcaggtctttcatgacctgattccagaatgcctttccagtttggggctggatatgtattcctgtgcacctacactgtgctataatgattccaggtcacatttcaatactcggacacaccctgtgtcatatgcctctggagtgtgtatgggtatgtgtgtattctttttctctgtaagattctctcctgggtggacccagctcaaacattaaggccttctatttctctactcctactttaccccaccatagcagagttcctacatttattaggtatatactttctcatgctccacaaaagattttaaggtatc

SEQ ID NO: 64037 - DNA, 1037 bp, Homo sapiens
ccctaaaacaaatctgccattcagatatatacacaccatctatacatgttgcatatgtgggggctgagacaacataggttactagggaggaatttgagtgttggtctgacagtaaagcttgggttctttctactttagcatgagtacaaacatttcgttttaagtttgtgtacatgaaaaatagatgtaaaattgtctcagaagacttttgagattttaatgttgaataactgtttagaaacttggggtctttagactctcaaatggtagaacattcatgttctatttcttaaaattgatatagctttattggcaatagtactgaatttggagtaggggcatttgtgtgtatatatgtataaaataaagaacttaatatttcattgtggaagttacagtgagaagcatcctttggtattttttgtaattttggcactcattagaaataagccatttattctgtcacgttgaaacactgactatagtgaatttgtcactaaattttaatatgttcgttcggcagtagattttgattgattgtactggctggagcctattcttgatgctctttagctttacagtttatattttcagcagacattgatgccctgtgccccctccattgcagagtttcaattgcttgctgaagagttagtgttgaatttggtggccactctctgttcactaaaacctgtgtctgattagggtcagttttggaagtgcccacctaagactattccattacagtagccttttcttttttgcagctcttcagtacaagagcctcatgtcccactccaccccatccatcttttgtgcctattcttcagtgaaaatactcttatttaacccgaatcttttctgaaagtgcttcttctcacttctcatcccaggagagagactcgactttctctctcctatttttcttgccttcaaattgaaaccacctccttccattcatctggaaccacaggttctgggcccttgcatgtgctggtgtctctacttggagaacctttccttgacgtgttcacagg

SEQ ID NO: 64038 - DNA, 1082 bp, Homo sapiens
aaggaagggatccagttttaatcttctgcatatggctagccagttatcccagcaccactgattgaatagggagtccttttcccattgcttttgtcagctttgtcaaagatttgatgctggtaggtgcacagcattatttctgggccctctattctgttccattggtgtgtgtctgtatttgttctagcaccatgcttttttggttactgtagccccgtagtatagtttgaagttgggtaacagacttcacttaaattaattttggcaaatttttagggacgacttaatttttaaaaatttaaatataatttatagaccataaaatctaccattttaaaacatatattttcatggttgtacaatcatcacactatgtaattgagaacattttcatctccccacgaagaaacctcatacctattagtcacttcccaagccctgaaatacactaatctgctttctgtctcttatgatttgcctattctggacatttcatataaatagactcatataatatatgggctttgtatctagcttcttttacttagcagaatattttcaaggttcatccatgttgaatatatatcagtggccaaataatactctattgtatgtatataccatgttttctttattcatcagctgatgggcatttttgcaacttattcatcagctgatgggttgtttgcaactttttggctattatgaataatgctgctgtgaacatttgtgtacatttttgtgtgaacatgttttcaattatcttggatctaagagtagaattgctggatcatatggtagatgtgttttactttttgaggaaatcccgaactgatttctggctataccattttacattcccaccagcagtatatggaggttctagtttctccacatctctttatacactctccagcacttgttattttattttatttgttttttactatagctgtcctagtgaatgtgaagtgatatctcatgcttttgatttgtattttcttgataactaatgatgctgaacatcttttcatgtgcttattggccatttgtatattttctttgggaaaatttattcaaat

SEQ ID NO: 64039 - DNA, 2369 bp, Homo sapiens
gtgagactgatcactgtcgcccaggctggagtgcagtggcgaaatctcggctcactgcaacccctgcctgccgggctcaagcgattctcctgcctcagcctcccgagtagctgatattacaggtgtgcgccacgacgcccggctaattctttttctatttttagtagagtcgggggtttctccgtgttggccaggctggtctcgaactcctgacctcaggtgatctaccccccctcgtcctcctaaaatgctgggattacaggcatgagccatcacaccggccccacgtagctttgtattcctgcaggcaagcaccggaagcaccccggcggccgcggtaatgctggtggtctgcatcaccaccggatcaacttcgacaaatagtaagtgtccttggactgcttttattgacacagcttgggaggtaggggcagagagagggctggcttaaacaaaaagtttagaagcaagccttgcctattgctgttttttaccaagttaacacttggtgtgaactgagaacctgtcatcgaggctagagtcacgcttgggtatcggctattgcctgagtgtgctagagtcctcgaagagtaactgctgaccttattcactggctgtgggccttatggcacagtcagtcaccaggttagagacatgcttcacattcacctacccacaaactagtggatgataaattttggctattcagaagacgtttattataggagtatgtagattttccatagagtgctgttatgtgacttgaattttagtctcggccctgcctctgacattgtcggtggtttatcctggttccaggaaataagactagccttttcctcatgatagtctttggtggtttttaaaacagttgtttaagtcaacagatgtatcatatgcctgacactgctctacaccagtgaataatttacactctaatagggggtggtaactataaagatgataaacatagcatcttaattggagtgtgtatgaaggtggttgttacctcttcctagccacccaggctactttgggaaagttggtatgaagcattaccacttaaagaggaaccagagcttctgcccaactgtcaaccttgacaaattgtggactttggtcagtgaacagacacgggtgaatgctgctaaaaacaagactggggctgctcccatcattgatgtggtgcgatcggtaagttaattggatgtttttctgtacttccataccttcccttacaaaactctggcttaatctaatccacttatataatctgtacttcccagttacctaccagacattgatattcttcctgtggtagaattatcataggtagttccctatccgtagcagtgcctactgtcactgcccaggttgtatcaggtttgcatttcgtgcttgaactatagctggttttcactgagcacagctcttggcccttcatgttctccagataatagaatcctaatatgttccattgatactcagtgccatgcattatctgaagagattttcccccaaaacagatgtattatgtctgtccttgcgggggttctggtccctgtgtcagtcttaactctcatgaatatagaggtagtgttaagaggccagaaccctagggacgctttaaattcacttcccagcctatttaatgtccattgagtagttctggtggtcaggaaggtggttgtcttcttttgcttagcagggggtatttgagcaggaggaggcttatgctttgccgagactagagtcacatcctgacacaactcttgtcctggtgtgctagagtactcgaagagaatctactggtcttgattcactggtgggggcagtcggtgcccccgttagtgcccagatcagaaacatacataccctgcctagggatttagaaagtgggttggcagtctttcctcacgcccatcacgcagttggtacctactacagtgtattgtaaacttttttctctgttcttctagggctactacaaagttctgggaaagggaaagctcccaaagcagcctgtcatcgtgaaggccaaattcttcagcagaagagctgaggagaagattaagagtgttgggggggcctgtgtcctggtggcttgaagccacatggagggagtttcattaaatgctaactactttttccttgtggtgtgagtgtaggttcttcagtggcacctctacatcctgtgtgcattgggagcccaggttctagtacttagggtatgaagacatggggtcctctcctgacttccctcaaatatatggtaaacgtaagaccaacacagacgttggccagttaaacatttctgtttataaagtcagaataatacctgttgatcactgaaaggcctgcatgtattg

SEQ ID NO: 64040 - DNA, 1036 bp, Homo sapiens
aaaaattagctgggcatggtggtgggcgcctgtaatcccagttagtcaggaagctgaggcaggagaatcgcttaacctgggaggcggaggctgcagtgagccgagatcgtgccactgcactccagcctggcaagagagactccgtttaaaaaaaaaaaaaagatgagggggccacgtggaaaaaccttgggctgagaacttaagtcctaaaggaccatctcattcctatcacactgcccctctttagaatgtgacccatcaaaatggaatctttccttttgagccctgttgaacaattagggtacattctctcattcactgtaaaattcagagtacaatacatgcaggcctttcagtgatcaacaggtattattctgactttataaacagaaatgtttaactggccaacgtctgtgttggtcttacgtttaccatatatttgagggaagtcaggagaggaccccatgtcttcataccctaagtactagaacctgggctcccaatgcacacaggatgtagaggtgccactgaagaacctacactcacaccacaaggaaaaagtagttagcatttaatgaaactccctccatgtggcttcaagccaccaggacacaggcccccccaacactcttaatcttctcctcagctcttctgctgaagaatttggccttcacgatgacaggctgctttgggagctttccctttcccagaactttgtagtagccctagaagaacagagaaaaaagtttacaatacactgtagtaggtaccaactgcgtgatgggcgtgaggaaagactgccaacccactttctaaatccctaggcagggtatgtatgtttctgatctgggcactaacgggggcaccgactgcccccaccagtgaatcaagaccagtagattctcttcgagtactctagcacaccaggacaagagttgtgtcaggatgtgactctagtctcggcaaagcataagcctcctcctgctcaaataccccctgctaagcaaaagaagacaaccaccttcctgaccaccag

SEQ ID NO: 64041 - DNA, 1690 bp, Homo sapiens
tgagttaagagcgacgagttctggagggaactacttcccactctgagtcttctggttgtaatccttgtcttttctcttgatctgaactgaagactcatgaggcttcaatctctgtcctagtcctggcaaatggcagagccagaaaatgactttgccttcccagaagacaaaccctccactttattctgtgaggctgacggcaggcccaaaccatggacaggttggggcctgtgcaggcctcagtggagatggggaggaggaagaggggaaggaaacttaggatgggatcatctctcaacagggtggaaggacaggaaaactttactcatggttcaaatcctgtcagacccaaacacaataccaaagaaaatagttgcagcttaatgcctcacttgggagtttgcaaagtctctgctctccgaaggccttggtgggtgaaaagcctaaatcgtccttatttcccaccttgcttctctccttcctcttccatggaatgtaaccgtactttctgtatgaaaacctagggttccaatggaaaaacgattcacagagtgacatgcaagagtcacagggagtaggtcagggctatgcccaagcctgggttggcattagctgggctttactctaccaatgttaggacactcaatgacatcttaggggcttcaggcagaagaggaaaatgttaagatttacctaataatggggccgaagggcaaagagcattctttccatcactggaaacacttaagcacaggctgaacagttgagggaagctgaactactgcaatgactgggtatcttctaactcttaagaccggtcatgcaacttaggctggagaactccatttcaggggaggtcagtgactcacactgaagctaaccccttaatctagtactcagttccctgtgtgatggtgtttcatccctgactggccagtcccagcccattcccaggagagagaactagataacaaagccaaggaacacatgaggctctgggcccaaacaactgtacattgtttattgagaacacccgtagatgggaaggagggatgccctgtaccgcatcgtggccaccactgactgggagccaggcccagagagcactggcagagctgggggtgggcttcccatgacacactgaccatctcggagggtgggaggaatgagaggactaggcctaagaccctggtgccatgctacaaatggggactgattggcctttgcctttcaaaaacagagggtatgggtatgcggactaccagcaaaaaatagaaacttgatttttttaaaaggtcctcctgtacataacaagacagcatctgctctccagggcccgggactggcagcggggacctcaggcaggcaggcaggccgaaggcctccagggaagatcagtggtttggctgagacagtcagctgcacaaaactggccagtcacgagcacccagcgaaacttcatccatgctctggcaggacaggaaagcacccggccccttgggaatatacaaatatttgccatattctctttgcttgttacaaaaaacagttaagaaagcttacagcagattatttacaaacagtatcctgggatatgatgaaggcagaggtgggctggcttggaggataggatctgtgggggcagaggagccacagcagcccagagggtcccaggctgggccttctcccc

SEQ ID NO: 64042 - DNA, 1034 bp, Homo sapiens
taaagatgatctaaagtatatgggaagatgtgcacaggttatatgcaaatactatgccattttatagaagggacttgagcatctgtggattttggtatccttgggtatccaggaaccaatcccccacagatattgaaggaccactactgtgcaaaatgcccttggaattctggctgagaaccttctagtcactatgggatgtctacatcctgttctgtctacagccccagtataacacctgttgacattgatttagagtattcgggaacacaaatctcccagccccttccttcttgctgaacatctatctcatcagtaacaaggccacttacccaaacctcggagaaacttattcattccactctgctcagtgtctgggagttcttctaagtactgctccactcgctgctcaaaaaggcctgggtaaaagaaacaggcacagggaagagaacagtcattggaggaagggaaggagaggcctacatgaagggaaccatggagcacagatgccaaaaaaggagaaagaaaacatctgggatgataatttgcaggagcatcttactagaattcgggctggctcatcaaggcgatcattagtgacatcttgccggggtttgctgctgccaccctgcctccccatgcacattcccaagctgcactaggtgaggaggctgcttctcagttcagagctgccccaagtggacatctctagcttccttcagacaactctaccatgttgttccaaaaaggttgttatactaaatggatagtattagaggacagaagaagtactaaccctgaggttagacagaaaaattgtgatgagatgaaaaagccctcgaatgagctgatgaaatagcaaaaaacaagataaccatctgccttaaatgaagactgccaccaacctacgacagctggcccaatgctctgtaagggaattcccaaccactgggttctcagaacccccgaaattgctcagtctgctccttttctctggatagaagggctttctcctatctttctctttgaggagg

SEQ ID NO: 64043 - DNA, 1113 bp, Homo sapiens
gtacatttccctaagagagtagcattgttgtccttgaggcgctacgcagtgggaaagcggggactttaccagtctgcagggtccctgaaccccattagcatttttgttgcactgggaggtttacgatcaaaggctgtcctgagcctccagcgagctctaagttcctgggcctgggctcaggtactctgtctctctgtctgcccatcagtaccctctccagctgctcccacgcggtggtggccttgctctaccccttctcctggcagcacaccttcattcctgtcctcccggcctccatgattgacatcgtctgctgtcccacccccttcctggttggcctgctctccagctccctccccaaactgaaggagctgcctgtggaggaggtgggccaccgggggaaccagctggggggaagggtggagggggaagcaggtgctgggatcttacttgtggcccctcggcctctttaccaggctcttatcctttctccctgggaggtctatccccggctggagtacttcctgttagctgaccctgggaacctgggaggtctggaggcctggcagagggcattgcgggactcatgccctgagccactctgctaatgactccttttctcaggcgctgatggtgaatctgggatctgaccgattcatccgacaggtaagagggtgggtgcttgctagagttgggctcctgagcaccctgcaccatcacacacactactcaaccttcacaacctgtttgttgagctctctctctgggttcagtactactcacagactagtcaagggtggggagaagctggtcttggaatccttgaccttagcagggtccgcctttccagtgacatcatgagcttctagaaggcagtgtgggaatttgaagaacacggcctgggagtccacagacttggccactggactttgccccctttgagccacatggtcttaggcctctaaattcttctgagctctaaaggagaggtggtgacaacacctgccttgaaatgtttgctgggggttacacaaataactatagattgttatgtaacgtacaggtttgcaatcattgttgtcaactacaaaaagcctttgttagtcgtggaaa

SEQ ID NO: 64044 - DNA, 1007 bp, Homo sapiens
tgtcctgacactggactcccaggctgtaactactcagctccttcagccccctgggcttgatctccttgaaggcagggatgcagggaacaaggccgggagtgggagcagcctgtgtgaattctcaatccctgggggaagggggagggttgggccccagggacagtagggactggagctgggtgctagagagcagagcctgttgggctgcatgcagggagcttgcgaattttggggcggggacagggcctggagcaggtataaagggctctggcatcattgtgctacttctttctgtgagtccacgttcactgaccatttggggtgtacccagcatctggcggatcactgggccttctgggagtacaccatcaggcgggagagacagtggacacagaccgttaccatgccctgtgcccattttgctgcttctctggggcccagaaggatggatgctgagttaggagttagaactccttcatttgcttagactctgaggaacaaatgagatgacgtgggtataaaaactccttgtaaagcattacctttgatgccatggggcaatgagagagaactggtttctcaccctagttttcaggaggcctgcacatctatgctgcacacacatgctgcgggaccaaggaggaggccaggcagaccccagggacagctgctttggcacggcctgagcgtcagcagttcctcctgccctcaccgctggagtcactcactaccttccacccctgtgactcccccagagaagtggctctctgagctgtggcactcaccttgggagcagcctttggaggaaagagggccaggcctggccctgataagacagtcctgcttcctggcaaggctgcagaatggccagccctttgcttatgttttccttgtgactggcatgggacttagggtgatggagataaaggccaggatagcaggacaaacagcctctggaaggaaactctttctgcaggaaagggagggggacagggcaacaaggaccc

SEQ ID NO: 64045 - DNA, 1035 bp, Homo sapiens
agccaccgcgcctggccatgcctaccttttaagtcccattcttcttttgctcctttactccatagcaaacctctacccagtgtctttgttttctttccttcctgtcagaaagcagcaggctttaggggtaagacagccaaacagggccaaagcaaactcctggctccacagcttctagataggtggccttaggcaatggctttatctttttgaactcagttgcctcatctataaaggggataataatccctctctcacaaatctcttgtaaagtcccaagcccaggagtcaggtatagcaaatgttccataaacagtagctcccatctcttgttttcagtttgctctcttagaatggaggtggatcaagaaagggagaaaagaagcaaaaaaaggaatggtatgccgaatgtgccctatggggctaaaaagctacaatggcttgtcctaaggatgtaccctagtccttcccatctgctggggtcccagcctcagggctatgaatccacagacaccctgtagcctctgccaaactgctttgccctttgccagcccccgtcagcgtcctcctgggaggaagggtggagcctgtgtggagcctggcaggagcctggtacctggtgctgggagaccctgcagagctgaggcctgtcctgagagtggtggctgttccttcagggctctggttgcagagaggtttagaggaggcttaaagtcttcctccactagaagggcagtccttactcctccgttcccaaggaaaaggagccagaaatggtaatcatgcattctctgtgtctgtctctctcctcctcctccttgtcctggcccagccaagtgggaaagggccccggttgccagaggtgtactgtgtcatcagccgccttggctgcttcggcttgttttccaaggtaagaggctctggcaggcttccctccccgtcccccagctgacagctcccacaggagtatctgcagccagcttagatgagaaaaccacctgtgactgtgagcgagcgggagacagaatgcaggaa

SEQ ID NO: 64046 - DNA, 1777 bp, Homo sapiens
tctttttgctgagatcagcggtagagggaatagacactacagtaggagagtcatcgaacagatcattactgaacacttcctccttgctaatcactgttccgttccgaggttgcctcagtgaacaacacaaaaccctgccctaaaagacttgttgaacggcatcgtaggtgagaagggggcctggcgaagccctgctccctacggttctgtgagttcctccatgcccaccctccaaagtaggtccccagggagatcccctgagagttgggtgaagggacagccatgtgacctgaaaacccttcctaccttgaactgtgttatctctggggtgtttgcagcagagggaagggagccaaggaaagactcttgttgctggctttgtcctctggctgggcacaggcaggggtggctgagccagtcttgtgcaatccctgaatttataaagcagaggccaggctgagctgggctgggggtggggggttggggggggtgggggggtgggtctgcttctggacttggagccaggatctgtttgtagcctccccactgcagacgggcagctgcatgactcatgagctgaggggccaggcagaagccattctctttggttcacaggaattctgcttgtttatttgtgtgtgtgtgagttcgtgtgtttccttcttcccttctcccccttctctaactcttcctcctctgcaggagatctgcccaaggagaatccatatgaggatgtggacttaaagagccgaagagcaggacgaaaatcccagcaactgtctgagaactccttggactctttgcacaggatgtggagtcctcaggacaggaagtacaacagcccgcccacacaggtaactcagccctgacatcggcctgtagggttagcgtgagggccacagtgggggcctgctcttccaagacttgggcccagcttccactcaggcttttaccctcactagtacttgataaagggtctacggccataccaccctgaacgtgcccgatctcgtctgataaaggaggtctcctcagcaaaggactgtgcactcaaggatgtccaccatgttgaaacctctgtggacaattggcacctgctctgaggggcatcctgtcctatcttctttcccttcctacacaagctctgagctgcaaaactcagccaggagcccttgcagtctcctctctgattatttatcaccctgtgggaaacaggaagacagggccctagtgggagtcttggcattctgcaactctgccagaagtcatctcagtactggcattagggggctaggtgtaggtccccaaaccacatttggagagccagacaggtgtctgtgacacctggagccagtcctgtgggagagagtaagcatgaatctttaaggaatggatggggagaaggcagaatgacaggaaaggtgaaaagccaaaggaagctcttggacttcagctccttctgtccttgtccaggatgtcaggaggcaggtggagaggcttctctgacctccccaggtaactctaattctctttgcaaatggaaggacctggatattatatagcattggccagataatataaaatgataatataaaaatgatttcttctgcctttggaataaggtgtttgtttttataaaagatttaccccatagctgggagtggtggctcacgcatgtaatcctagcactttgggaggccaaggtgggcagatcatctgaggtcaggagttcaagaccagcctggccagtgaaacctcatctctactaaaaatacaa

SEQ ID NO: 64047 - DNA, 1132 bp, Homo sapiens
ctaccgtctcctccaactctgagccattcctttgatacttatttgctctcagctggttcagtttagtggtccaggactcagggtccacttgtctctgtacatctccatcccctggtcccctgtccacctggagagatgactgggagaatctatttgagacagctcctccggggcagtcaggaatggtccaggaagctgagagatgagttagggcagtgaagggaccaagctgaggctggggaggcagcgtgtgggctgcagccagccgtctatttgctggagaactgattagtggctttgttacattagacaggatgttaaacattgctggagaagagaggctggcacaaggggctggggaggagcaggccttcctgaaattgagtttccagagacaggacctatcttgagaacctgatgttgctggctgttttcccctgggttgtcagtgatgtgcaccaggcttgtacatctattacttccctgggcctcagtatcctatgtctttttcttggagctttggattttgtatcaatattcaaagctcttactgtagggaaaagaaggaaggaaggagggagtgaggtgaaggagggaaggatggaaaaaaaagagggctagtcttgggactcatgtcacactcagaagccattggaagtttagaaagctctatctaaagcagtggttctcagttgggggacaacttcactcttccctccctccattcctgcctccctccctctctctccctccttccctctgtccgtcccagagagcatctggcagtgtctggagacatttttggctgttatagctaaggagatgctaatgtctcctggtggatagaagccaaggttgccactaaacatcctaaaaatggacaggacagtctaccacaacaagaattattcaaccccaaatgtcagtggcttggagaaacccctgggattgggacaaggcttcctataggttggggatgacaataaaggccctggctgatcatgcagtccaaggcagtttcgatttgttgagcttggcataaatgttctccctgccgtgatgtggacagtgatgctctggtcctgttttaggggatcagaagactgtgtcctggcattctcccttcttagtt

SEQ ID NO: 64048 - DNA, 1048 bp, Homo sapiens
tagagaatgggaggaccacaggattgccagcacccagcatagtcaagggacatcagaaaaacacagccctctctgcccacggcagcagccacactgggtgctcccagggtcctgggcagcaaactgacacattgcagtttctgccaaactagaatgtaccctgcaacaggaggtagggagggggtggggcaacagagctgcctccccactcattagggaggactctcttccactctgggtgttgcatgaggagttaaaaaaaatatgggagcaccttggctgcctcttgggtggctgagtacagctaggggtcagcgctgtgtgggcagaaggtagaggtagctgctcacctggcttctggatctttggagcacttagagaacagggaaagaagagagggggaggatgcaggagaaagggaggggagcgacccaggcaccagtttgggaatatactgcatcggatgtttaggttttgctttggcctcgtggggtggtgggggtggtttccggagtctgcagttaggacagtgccctgtgcgtgttttccctttttatgtccccatagcagcccaatctgaatttctgggacctgactagggaggccagagggaaatacagaggaaaatactctctttctgttagattctggtgggtttccttttccttccctggggacaggcccgagagtttggagctccccacaaggcttcagggggtgtcttattgctgaactcagaatggcagtttcccgtcttgcttaggactgatcagtggctcggacttcctgggagccgtctctctggtcttggcccagcctgtgctctgtggggtgaaggatgactctgaccccgctggatcaggctcctgcaggcatgcaggaatggagctgttgggaggcagagagcctagtgctcatctccatcttgggtcctggtgattggactggagtcctgtctgtcataggtggagggccagttggccccaagacaaacatgtctgtctgtgaacagtggactcgaatgggggttgtggagggtttgctggcc

SEQ ID NO: 64049 - DNA, 1033 bp, Homo sapiens
taatgggagctatggttttgagagttttgaatagatggggtgacaggagccatgatgctggtggggagtacatgtgatgagtgtagctcattgaggatctgttcttagtggaatcggaagcagaggcagctaaaagagtgaggatgagggaggaggtgttgaagttgagagctggagggaaagctaaaccccagcccggagacttccagtagcactgggctctgagtacccactgttctttgtagatggcttctcattgttctttgtgttctcattatagaggtggagtagtctccgtaagctatctgtggtaaaacggaggtattaggattttgcccagtccctttagcctttattatttcctagtcttactcggagaaggtgcagcttgtggatgataagtttcttctagagcagaggaggcagcttgccatcagtcaggttgagctcagctagaccagagagcgtgggaagggtgagaaggaggtcaggacttagagtcaggaagaagttgacacttgaactggatatttaagaaagaatggggggcaagggacactgaaaatcaaaggaattggttgaacaaaagcttggcggcatgaacattcctggcatgtgcaggaaatgtcatccagtgagatgtggctggccagagtgaaggtgctgctctaagataggactatggcctctggatcatcgaaattgcaggacccaccatgttctccttgccagagcgaaagagggcagtggttggtccccaggagcagggttttttatggatcaggcttccaatctgcctcctttttccaagtggtgacaagatattgggcagagtaggtgccatagtcttgacagagctaggataagccacttgctgagaggctgagtttccagaatggcagaaacagccatgtctaggtttttaaaactatgtgagaaacaactagatttcctttggcctgaaattgcctaacaagacctcactccaattcaggctttcaggaagtgtgtaaacccagctttaaacctctgc

SEQ ID NO: 64050 - DNA, 1517 bp, Homo sapiens
ctgctgctgcccagaaagaaagcacttttagcagtggtaagtcctttgcatgcactatcttactcaatctgtacaacagcacttcgtggttggaactgttctctccattttacagatgagaaaactgaagcttacagagggtaggcaacacatccaaagcttcatagctggtagaggcagagtttcatacccaaagatcacccttttcccattgtttcttacagaggaaactgtgataagccattattttttataaatgttacattttagaatagtttcagatttacagaacagttgcaaagatagtacagagagacagagagttcccatagaccctgcaagccattaattttttttttcctccttttctggtccattttatgagaattcattgggggtggggaacagatttggaatgaggacattttttccagagattccaacttggtaatttttttcagtaggattttttgagcgtccatcagactacattatttcttccccagttctgctctgcctcagctctgctggactgggctgggcctggctttgacatctagtttcagagtcaaatgccccactttctgactctgtctcaatagggtcagatggtaattgggtttccgagagttaggaaggcaggtaggtgtggggaggatctttagcagctgggcttctggatactcttctgtctctgatggggctatgacaggggagtgttaatattttcagctcatgtttgatggcatggagccagagccctcccgagggtcagaggcagcgtctctggggtgaggcctgtttgcttggatgccctcgagtctgtccttgtatggtgccagagtggctcatggtggtcgctgctgtgggccctggccgtggtctgcaggcaggcaggctggctggctgtaggcaggagaatatccctaggtagctggtgtgctttgctttgggtcccaggcacattctccatttaagggaaaggggtctgcagtcttcttggctctgggtgtgaatgggctggcctgaagtctgctcatggcctttgctggatgtgctttttcaatgagatcattccagaattacattcctatgaaattatatttcactcaagatgtaaagctggatttgtgtaaaagcactggcactaaaactcagggctcagagcggggcagaaatgagaagagggataaacagctcttctttaggaggaggggaaggaaagacagaaagagagagaaaacagttgttaaaggattttgcattgaaaattggtgcgctgtaagcatacccaaggagttgggattgccactcacccctggaaaggcaggcttgatgtttgttgtcccagctgcctgccacccccaggcagtttggagggagatgcccttgaggcttcagtgtgtaaggttgctggaacgctggagccgcccaggtgtcccctggtcatggcactctaggcctatccctgcctttctagcctcattttgcaccatcccatatctaatttctttccc

SEQ ID NO: 64051 - DNA, 2683 bp, Homo sapiens
aaggggaagaaaggggaagaaggaggaagaagggggaagaagggggaaggggataagaatatgaggaaacagaagggatctgaagtgggcatagacatacctgcttagctaaggaagtcgaattaatatagtctgcatacttcttgggatcaagcactatgtatttttaaattttctgcagattttaggttagcggtaagacattagtgtaatgtttactctgttctaagcattgtgttatactaggcatttttatttcattgttttagtaaatccttacaatgatctgtgagttaatttgttgatgttgtaacatctgcagggatgtggagtagctaacttgcttaaaatctaaatctaaggctgtttgattccaagcatgtgttcttgccacacttccactctggttggtatatcaaatgcagctcttctttggttatctagaacatctaatgagttttttcctttgtatcactatgtgttatttatggtcacattttgaatgtttgcagaattgaatgagttttttttagctttctctgaaaggggtacctggttaaatactgagaatgcgagtccatataaacaactggggagggtggggctgtggcaagacttggaagcagttaacctgacttacatctctccctctgggcaggaaaaaaatggcctttctccttaacgctccataagtagttagatgtcttagattgcaattccccctattgtataagaagatggaatttacttttggaaaaagtaagtaatttgtcagtaaactagtgtttgtaaataaaccctgatttcctagcgtacagatctcttctagagtcttcaagtttgttggaaatgtttgagaaaagaaatgtatcaggccacaaatttcacttcttggaaattgaacattgactagtttctatgggttgatacttctttttctttttcgagatggattctctgtcacccaagctggagtgcagtggcatggtcttggctcactgcaaccgttgcctgcctggttaaagccattctcctgcctcagcctcccatgtagctgggattacaggcacacgccaccatgcttggctaatttttgtatttttgtagagagggtttcaccatgttggccaggctggtcttgaactcctgacctcaggtgatctgcccaccttggcctcccaaagtgctgggattacaggcgtgagccactgtgtccggtccatacttctttttttttaaaggtttgatcctgtttggattctatcagtagtgaaggcccgggattctgaaatgaaaatgtatgcagtgtttataaactctcattccttggtgttcatgagatctgtggtcagcccaatcagcctgcttagatggaatagtttgtgaagggcagagcagggtgagactgaatttcagatttagcatagattgctagaaaacagaggaatttctttggtaagtcactggattttgctttcctgtctccccttcccagtctgtttcagtaacagacttgcttctgaaggaaagataatgtagttgggaaaggttcctttacagggtgttgttcagatggtcttcatcactgattcacaatgagcagacattgaatggtcatctgccatgagcagggacacacagatgggttggaagatgaggctggaaagactggctgaggtcagatctttaagggattgaaccatccagaaagcggggaatcactttccccaggaagcaggaaggaaacacatttgaatatgatttgtagaaaagaaacctaggagaccatgtagaagatggaaatggagtgggaggaaacttgcctattttattggctgtaactggaggatgatattccagtccctcaaaattcatttagagcagaaagtaagggaagtctcagggtgggcgggatcagaactccagattgcagagctttctagagcccgtagagcagtggttttcagacttgactgtgcaccaaactcacctggagagcttgttaaccaatttagtagaaattttttagtaaaaatttgcatttttaacaagtttggaagtgatgctgctactgttggctgggaaccccactttgagaaccactgcttaagaggcttggcagctgagatgccaataagggtatgagggccagatgttaattggcttgctttcttttactgacccagaatttcatgtctacaaagctttactttagatgttcttaggtggcttactctaaaacatcaacaaagcctggtaaaggtccatgctctcaatgactcttctcaccaaatccgtatcacttctggatgagatttccaggtatgtgctcgtctttaaacagatgcttgtctgatttttggaaaatgcccatcctgggcacttgatttcattaggattggtggcatttctgccaggaaaagcttccccccgccagtcagcactactactggctggcagggctgtttcagggacagccagcaggggctgcacagaatgtgttctgttgattagccaaatttacacaggacatgcctgggagattatctctttaggccaggagttgaatttcaagggcaaagtccacagttggcagccgaaaggctgagaacacctggaagaggggaaggatttcacttgactttcacttccccaggcctcagtgcctcttcccacagaggct

SEQ ID NO: 64052 - DNA, 1711 bp, Homo sapiens
ttgcattagtgtgtgccttctcctggggaggcaggggctggggaggctaggcatttgtttcatcctggaggggaggtgctatgtgtgtctgtctcagtaggtgggtcggaggaactactgggtgcatctgtcttagaggaatatgccacgtaatattgtgctgatagaaacacctgagctctctatttctagccataggccccagaaagctctcctgggtgtgtgtgtgtgtgtgtgtgtgtgtgtgtgtgttttgaagggagaggagggtgttaaatgagtctagattaccttattgaagaatttctccaaagaccccttctcttatttttttggctctgatgtcatgaatgtactgttgttggggagggtgttgaaactatcactatactcttctcatctaaaactgcctgaatgttagatttcactgtccttataaaagagtgaattatatgcagttagcgtatgaagccttcttaaccaaagcagacctattcctacaggcttgtcacgaaaccaccacagtttctcaaagctccagactcttcctctgtgtgacctgtcatcaccaaaggggttgtgtgtgagctggagatggactgttggaaatcacatagtggatggaggattatttggaactgggaaaaaatgagataaactgagggttacgggagacaagatctgaggcaggaggaagactactggaaggaagcaggagtgaggcactgggcaaggggccctgggcggaggcagttctcaggagcagcaggtggtaatcgagagaagggctgacctcggaggcctacacaatttagcagaaggccagactgcccccagggagctcagggtgacagtgtcgtgcaggccctcagaagcactggagggggtaggggtggctggcattagggttaacacctctgtttgtttgttcttggctcagaggtgtctctggtgcccatctatgcagtattggtctgttcacccatttagtcagtgaatacggagtgtctgggccaagagctggggaggaacgcagaagtatcaagtatgggccttactcccatctatgtcatgttataatagacgttgtgttgtagttatttcttcccctctctcccccactctgtctgtgtgattaagagagaagcagcatagacctgctgcagttctgagttttgatggtagggttaatgaccatctcatgctcttaggctgggaaaaaggaggagggtccaacagactgatttcaagcacgattcgaatgaaggaagagagccaactgaaggactggaagtaggagggtgaggattctaggcctgtgttgaagcttctcttgacagtgtcaaaggatggtgtatgtgggagggagtcataggaaaggggaaatgggaaagttggaaaaaaactatcaagtcagctatttttaaaactctagttttgttcgaggaactgacttttggtgtgcttgtgacttggaacacaggctaccttatggagttctgacaactgagtattgtagatggttttaaaatgaactagcctgtggtgtgtttgttcaactctcagtgactcttaggtactcagtgagtgcgtggtgctgccttagagcaattctgatggaaccatttgcatttaatatgagtatctgacatgcattgcagtgcactgcagtgatgaacagctatagctcaggggtcttagaggcctagct

SEQ ID NO: 64053 - DNA, 1101 bp, Homo sapiens
tttggggctcaggaatgatgtcatgctccaacagttggattctattagcttaaggaggagggaaacagccaattttcttgactttgcaaatctagctgatctcactcttgctgaatctgaggtgtttagacttcactctaaaaagcatcattttacttttatttagcacaaaggcacaggatatttttacaggaagaatcttttatatggaaaaatctgagttaacatcactcccgtggtgtttgtagttcttacagggaaactccagtgccttttgagccgcttgttcgtcctagtgaacactgtctgttttgtctcttggtgctgctatgtctgacctgtaatggaaaaaaaaaaaaaaaaaaggctaattaagctcagccaggagcctgtggtgagttccaagtccctctagagcatttattaggacagagggactgtcacagggatgcctgagctggggttttgcactctctctcttccaggcagcttggtaagaatcaagctgtcctcccacatcaaaaggtcgatcacagactttcctaagaggtggaggagggggctggcttggggttggggggcctgcaaacaggtttctcatccagatgtcccagagtgagctctcagcagcagctgctaagagctggggaacatgaggcactgtagttgtgccgggtggattcctttggttacattttgaccaaatctcagggcacgcagtgtccacgctgtgcactcctacactgattgtcctaagttttggtaaaacttgttctgacctagaggagtggtacatggtgagctgtgtggccttggaaaggagaccctcccagaaaggcagttttataggtgatagggtagtggggttgtcagtaatattatgaggaggatgaatgcagcaaacacttcctgcaacggagacccatcaggggttgtgcttccacttgagccatgttatgtcttaaattcacttcttggcctcagggaactttgcaaatgcctttggtttctctgtgggatgagggaacagctgctgtcctggttcttcagtttttcttcttgaactttctgaacagaatgtcttttgtattctggcaaaca

SEQ ID NO: 64054 - DNA, 1081 bp, Homo sapiens
tttgagcccaggagtttgatgatgtagtgagctatgattgcaccaatgcattccagcttgggcaatggagcaagatcctgtctctaaaagaaatttaagaagaataataaataaacttgaaaaaatggtcataaaaatatctgtgcagtgtatttcaaaaggttatgaggatcaaacaaaatgatacatgtaaaaagaatgttacaaagcagaaatgtatgctgggtaggggggagaggaagggacaggatggggatggggatgggactaaacttagggggtctgccgtgtcccagggactgtgctcattttctgacaggagcaatattattaccgactgtgacagcagctcccactaagcctgcaccttagctgcagatccttagcagggcagagagacaaggctgtatttgtatcaggtttgtcgtctgggttgtgactctcgacttgcccaggattcttcctggtcctgaccgagttgtctttgctctccatttcaggaagatgagagactgcttaggcgccaccactagtaccatgagtccctgcactggttaaagccatcgccacaacctggacaggcagcaaggtaagcagagaggccagtccaggcgagctcctgggatgtgagtgcatttccgccccaactgctgcccggaaaaatcccaagtgcacaaacaagtcaaggcagcgcatcagggtccctcctacccgagctccaggacccagaggaagctgggtccccttcaagcgcttcagctagctccctcccccctggcagggattcttccaagttataaaaaatgagacactggaggggaagaaaacaagtccactcactgtcttctcccttctcccctctgagctgttcaagcaagttcccaggagcagttcagagcccctgttggactggaagggaggtaggaggagtggaatgcatgcaaaaaccgagctgatcaaaagacagtgctgtttcatggaagcctcccagaactgagagagagagagagagagagagagagagagagacagtgagaaagaaagaaaaagagagcgcccttgtgcacgcgctaggccaaga

SEQ ID NO: 64055 - DNA, 1016 bp, Homo sapiens
tcaaggatgccatccttctttgcagctgccaatcttcactggtgtctgtgccctggcagggtatagagcccttctcatgggtgctctgcctctttgggggcttgagaacagatggggcttaatttgaagcagatttccctccagggcccaggtatgaaatatatattagaagatgactactggtcttggcttttctttcttatgtgtctctttcttccttttatcttcccactactgtcaggcactgtgagcagctgttgctatcacacgggcggatcagaacatgaagaatggagctaaatagagctgtctgcatgctgttctgatgggctcaggctcagcctcagagaataggtggattggagcctgtgatgggggctctttcccccaccagagtgggtgaaagcagggaggaacaggcgggaagatactttaggagttgggagggtattaattccacctcttctctccttcctctgtaccccaacattccctgtgagttgtcaagggctggagagataacaaagatctttctttccaccatcaggcagtaaggcaatgcagccctcgctgaattttcagctccactgacattgtgatgcaaatattaaataaagcttattttctgacctgagggaatttataagctattgggagagacagtgtttgttaaacaagtagagaatatccaagatcttaactgtgttggtttacgaaccatggatacatttatagttcagaacaagaaagttgtatcttaaaaccacagaaaactttccttggaggaggcaggatttttctggtctttaaagttgggtcaactttataaggaaaggagagatgttcactccagtgtcacggcgatgatctaccttggaggggtaggtgtggcagagcagagccagggacctgagctctggaagtcctgccattacataggtgatgtgaagtgatgcagtgaaggtggagttttgtggaaatctctcctgtagatcgatgaaaataggataattttg

SEQ ID NO: 64056 - DNA, 1029 bp, Homo sapiens
cccactttgaaaatcatgatgtaattatgacaggatcgcattctttaaacttactgtttagtggggttagtggagttatctcctctgatttttgacaaggaaataatacattcttgttgcaatgctgtatcaggtcttaggatggaaagcgtctaatttaaagctacagacctttcctgtaggacgcatatgctgctaatctatgaaaactgaagatgtcccagtgcactgtgtgtaaactgcagcatctccttgtggaatgaacagttcaggaaaatagaatgactttccaaactgtactaggttccaggtgactgaaaatttcctgtgagggtgggaaagcttatccagatgttcttgcttggggatcagcatgtgtcatcccgttccaaagaagtacagtcacagctgattttatctttgtccttctttctgtggtgcccagggatgctctttttgagttcatctttggtcttgtctctctgaaaaaagcagcatgcattttgatctaggtttaaacagttaaaatctgtggccacagggtaaggtgaaactaatggctctaagtagccaactttttacctttgcttcactggcaccaggctgtgagtaactgaactaaccagctgcagacccttattatgcaattttgaggtaaggatgggtgaaatcctaggggctgggagacagacatgtttggctaccagagagatgacatcagttcatttactggtgctgtggaggaaggggagattccaggtgcttagccttcttcctgcatgtgggggtgtccagagccacccttaatcctattcgcagccaaggtctttgcttgggaaaaaccatatttaactctgtgcctcctgttatccccatagggacatgaagttggaagggttcttgtatctttggcttcccgaacaaagctttgaagaacagacgtgtgtctatatgtgtctctgtgtgtattttgtattaatgctagcaactgattaaggttttcagagtccaggtcgtatatgagaaggg

SEQ ID NO: 64057 - DNA, 1012 bp, Homo sapiens
ctacagcaaagagctaaggattaatatcaaaatacaaatggatcatggagcggtttagaaatattgcaggccgcctctggtataaacagagaatgatgagggtttagaggtagaagaactgactataagcagaagtgtttgaggaggctgcatggagaacaaggggcatcatcttggcccttggcaggttggcaggatttgacttggtgaagagaacgagaaaggggactttaactgggaggactactctggggcacagaggagggaagctgttttatgaaaccaggttcatttgttcccatctgtaggttctgccctgtccgcaagcagccgcgtcttggctcactcctcttctcccctcctccccattgtgatgaccatgagccttctcttggagtgtctgcccagtgggcccttcagcctgggcgctgctttggttcggatgatactgtcctccacttgtcttcttccaaggatagatagcgccctgacctctagggccagcagcctgttgggggatcttccttccaatgtcaccagccttaccagcttcttgagtatttattccttcataccacactcagccttcttctggctccttgctacttgttctcttagcatagacactgtcccctctccctttccccagacataggcttccaggttgcaattccatgagtgttcataacaagcctcagcagtacactttaggtcttactgtccttatgtcctctggcacgtccctgtctgtgttgctctgtggaccatggtttcccatctagaaaccattacttgcagtggggaatgatgcacatgaggaccttcgaagggcttgtaggagctgaggctgtgggaataaagtgtgggccctgattctgaagggacttgattcagtcctgaagagaaaccgtgtatttttggtttctagacactctgtaatttatttaatcagacctttattgagcacatttaggctgtcttcagtctctttctgttaaaatataacagtaat

SEQ ID NO: 64058 - DNA, 1380 bp, Homo sapiens
attttgacctcctccacctccaaatatccttaaatctttctgaagagatttaatctctcttaaagagatctcacaatttccctgggaaacactttctaaggaaggtttccagattgatgatcacagattatctccttgtagttagcttttcttttaatgtttcctacttttactgttttcctgtccctcttcaatgcacacatgttcacagagtgaacaaattgtctttcctggactccaaaggcagctaccaaatgtacagactgtcccatctgtacccatcctttccttcccttcctctggctaaacaagctgagctttctctgttttccttaacaagtctctctttttagacctatgattatacttgttgctttgtgttttgttttatgcaggaagttcatatcagatatgttggcaattagagctttcaaactggaaggagccttttggagtaaaatatatatatttttttctatcagcataagtaattgtggaatatatgtaaactctggagatgatcttttaaaaaaattaccatcaaaagaattttactcaagtcctttaagggcttaagaagaatccagcctttgcgagattgcactaaaagtaacagattagcccaattaaggcctatctagaagtctgggaatcatttgtttaaactggaatttaggatctccatgcaaatatgatagaaataatctgcttaaccctttgttagtagcattagaaataagcccctttttatgggactcttaatgataaaaggtcatagtaattagaatatgctgggaatttgtccctgtttgttaatgttttggaaactcctttgagtaggcaggggtcactttgggtggcttttttctttctttgatgtgaagttgggatcttggatgtaaatttagccaaggacaagtttgaatttagattttttaaattttttccgtcttgttccattcttccttttggaggcggctaactagagtggggtaaaaagtgcctttaatcagagtcagtgtcctgagactgtcagacactggtctctgggaagtgctctgtatcactatcatttatatacttttcctttcttgtgtcctatagtttttgaatatctcctgcggaaaaagcactggggtgtgtacgggcatctgtttattctcttattacctttcttcagtgaatatgcttaatgttaggggtttgatgaatcaatgagtggatgaagttaagaaattagatggaggccaggcctggtggctaacacctgtaatcccagcactttgggaggccaaattgggaggattgcttgaagccaggagtttgagacctgcctgggcaacacagtgagactctgtccttatgaaaaaaatacaaaaa

SEQ ID NO: 64059 - DNA, 1023 bp, Homo sapiens
cacccacatttatagccaggccctttgattctcggcagataatgggctcaggaagggcagcagtgggtggagacattttactagaattagtctgccgctttgaatacaatctggatttcttgctatttcttgtgcaacctgtacgccgtttcctctgaacttgctagtgctctggagacttggttgtttggccaaggaatatcccctagcaggagggctcactaaggaggggcagcttgacaggcagaaaagtgatgtttgtcaactaaagaagttttcttttaattaatgttagagtcacccatggttttttgtcaaataaaaaatgcgaaatcaaaatatgatctcggttctccacacccatttttacctttaagagcctctcacaccttggagagcttgccttactgaatggggttttgataggtgaaattatcaccaggacctctacatgggtcaggatatgactcagtttgggttttggacctctgaggaatgtgacccctcttagtgtaggggatttggagtacaaaaacctgggttaaagttccagctttgccatttattcagaagttcctggaatttgatgtttgagagatctctgagctcagttttcctagttcttctagatcagggtaatcccttagggccagatagaggtggtcacaccctgattagcaccttggttccttctcccagtttgtattttgtgtcacctgaaagtcattttattttctctgtagcctctggttataggttatgtggtcattcctccagagaatggcaaagctcattgttggttggggatcatttggtatgtcttcccgggagaatgctcttgaacctagttttgagagttggggcctcaagaagagactttggcaatgcccttatttaaatgttagaaatgtttggttgcatttttgatgcattgcttacatagttaatgtttttgtatttggtacttgtcattttaataatttattaaacaggtgatttaggttttctaagatagctaagagc

SEQ ID NO: 64060 - DNA, 1069 bp, Homo sapiens
aatctctgcctcctgggttcaagggattctcctgcctcaaggctccctagtagctgagattacaggcgcctgccaccactcctgctaactttcgtatttttagtagagatggggtttcaccatgttggccaggctggtcttgaactcttgacctgaagtgatccgcccaccttggcctccaaagtgctgggattacaggcctgagccaccgcgcccggcctcaggatgtatcttaaactcattatttttgatgcttgccctgcagctgagtaaatacctctttaggatatgtgacaattgaactggcttggattttggaacatgtcctggccttggagcctgcttatgttcatacacactggttccttagaaatgtaaatttgtaaagtcaatgtaaaactgaaacttcaaaagtcaattttcattgctgctgttgtgcatttctattatcaaattttatttacagtgatttacgtgagtaaaaaatggattacacgatttcctaacatctcactaagtatgggtttggatcttaagtaatttacatttttcttttccaagttgattgttatactgggctaatgatttccttcaaattccactaataaatcacagattctcagtgctgttattccattgctttattattaaatggcacccttttctagtttttgtttttgcaaaccagtggagtatttaaagtaaaatttcagaatcccttttggagctttcggttgagaccaggctccttggaaccctagtgctttgggagttctgctgctgctgcagtaccaaaagtagcttctttgaatttcatttgggttttgtagggctcccccgaggcccgagaactgggagaagggaaagagctcatcggtttgtttgaaggccggcgggcggtgcaggcagcttttcccagactctcccagctccggcttttcacgcataccagaagagccgcttttttcctccagtgattgaaaccatctggactccaggggggtcacgtgtgtatgagaaaatgacataaagtttcagaccccgttgtgctttgctccagacccagaca

SEQ ID NO: 64061 - DNA, 1107 bp, Homo sapiens
aggagtgtttttatttatctttcatttattcagacagcatatatttactgtgcgcttatttcatgctgggcactgtgctaggcagataggatgtaattattagcaagacaggctaggttgctgtcctcaaagagcttgccatctcttatacatagtcgaccttgtttgtcaagtgatgtgaacattacgttaacgcaaattactaaattactactatttaaaatatagcattaacaccatttctgatgtcagtgtctctaataaatatttggccagtattaagatgaactaatagtcacatatatgaagtttagactcaaggctatatttagactatatttagacaatttaagggatgttaacttttctttctgagagagcagatctaatgaagtttttttcctaagaattaaaacagttccatgcataacttacaatggaattggccaacaaaaagaacaagtatttatatctaattattgccctcttacattgcttcagcacatataagaggcagcagcagcagctgccaatgatgaaaataattattgtcctgggtctgattagagaaaatcttgatgctgtctgttgagttgtctttccttagagatgttacaagaaaaacgggactttagtagtagaggttctaatagttttgaaagtgggagacttaagaacctccttacagagctcagagagctgcaggtagaatttacctggaggctggctaaattctgtggcttgcctttacattcatgagttctcttgttccacgtttggggcagaaccatcctaatttgagattggagagattggaaaagactggagagggctaagttcatccaaatatggcccaggtctcctgaggtgttcaagcacttcagtgaactagagtagaaactcacttagattgtgagtttggagaaaaacttgttctgattaaagtaaaactgttctgatttttggagtaaaacctgtgctgatttttggcctttgtgttttcaatgtgcctcaacaacagctgaaatcttgggctttcctaatgtagaagcaactcaacgaggaattgatttatttttcatgcgcagactgcatcacaccgcatat

SEQ ID NO: 64062 - DNA, 1050 bp, Homo sapiens
tcaggtacccatctgggtgagcagatgatttaaaactgaattagctttttgaattctgtgcaagtaactctgtgcaagttactatgaagaatgcgcctttgtataagcttgggaatgtttattttaaaaataatatttaaaaattatttgattgattgagacagactctcactctgtcgtccaggctggagtgcagtggtgcaatcacagcttactacagtctcaaccttctaggctcaagagatccttccacctcagcctcccaagtagctgggatcacaggcatgcaccactattcctggctaatttttgtattttttctagagacagggccctgctgtgttgcctaggctgatctccaactgctgggctcaagcagtccactcaccttggcctcccaaagtgctgggatcacaggcatgaaccacagtgcccaaccaaaaaatgataatcttttaaaattaaaaataaccatagatgcattttgaaacttacataatatttttctagtgggttaggtttctggttacattctatgattaattaattattacatagtcaaatatttatactgtatgttcacctgaaattattgtaattcaacagctatttattgagtaacagccatttgctagaggttaaagatggaacttatactgatagataaataacccatgctttcaagaggctcacaatctggcagtcagcagattggctcatggtgagcaatacttatgaacaatggttatgggctatgaagtgagccttgggtgccaagggagagagtaatccattctcccaaggagtaggaagaagtcggagaaggctttattaaaaaggtgacatttgagttgggcctatcagagatgttacctttcataatattttctgggaaataacaagttgtttatgagattggagcataggatgccagaagccagcaatgtaatgtaaagtttgaggtgtctggaacatctaggtgcagatatccacaaggtagttggaagttcaggtctagaaattaaaagagagaagtcggagctagagata

SEQ ID NO: 64063 - DNA, 1031 bp, Homo sapiens
gttggttgaatcgtgaattagagggtcttcaagtgatcaaagtaactgaatgaaaggagtgagagagcaacttctgacacaggcatagagcctgaatgcattttgaagatgtgagagagatggaactgtatctctatagaggaaaatctaagaagtcaactaagatacaaagaaattactgacctagccaaggctatagaaccattgagggcagtactggaaagaatggggtgtcttcatttctagatttcatgctgtgcacactaaacaaatggtttgtaaagattcaaaacatcgcttaagtcagccaaaaatgtttttctattaatctaaagtttgagtaagtgaaattttgaagacgatggtatctaattgataacttccttactccttaacctgtagataatctccctttttaaagtgctcattacagtagtgattatgtagagaaaaagcttctgatgaaaatgtggtataaaattgtattctttgttcagcaagttaaaacaagctggtctgtaagcaattattatcttcatcaaatttcctagctctaatgttttggcttcataggcccagcacgtatgccttctcaaacaattggatggttttaaaacacttatgagatgtttgtgcttatatcttaacatagcatcagttcaacaagaaaaagaaaaagaaaatgtaagatttggcattagggcttagtttgaaaaagaaaatcaaaccaaactaaagaaaacaaaaagcccctaatgacacttaatccctgcataggaatgaacattcttcattcagcttcataatgcccttagtagcagtgctctagttaagagttcagaagtgtctttcttttcttcactctttaatcacttgacatttttggaaaagaaatttatcagaatgcttgttggctaaccactattaatatttttatatgggtcatatattctaaagagatctctttttgccttttctttggttttatttgtagttatcccaaatgaaaacaacaacaaaatgtgttctgt

SEQ ID NO: 64064 - DNA, 1003 bp, Homo sapiens
atataataacaatgcacatactacagttaattgtgagcaaatttatatcctttctgcatattgttgtcacataaactaatcatctcttaattactttgtccttccagaatgaattaaaaaagattctataattttagccagcactagaactataggcagccgtgggtggggaagcaggataagaaactgtgatgagactgatatgcatggcatgggacaggtggcaagagaataatttagtttgtgatcaggcctaggcctggggtcaggaaccagataagcatttcagattggtagcatatctgtgacccaagattacaacaaggccatggatcagagccaaatggcctctgaatggcaaggatcatggcaagcaacaggtcagagacaaagcggaggaggttgtcacacaggtaccaatgggattggtagatggggaagaatgagcaaatatccagagttgggagtctcaaagttaagttctgccgttagaaaatggccccttagtacttctggacaacatagatctcttcccatcttcctttcctctctttacaaggtttcagacttagttggaagacatgactctggctttaacacactgatattgaagacttatgggctgagatgaatggctccctgtttaagagaatcagaagtcaacatagcttgcagagtaggtctagagagttctgccttaaagggtggagtaataaagccaaaggattcagcaaaccaagggtcatcattggtaccatgcatgaagagttatcttcatcttgtgaaattggtgactttgctccattctgtgacttatctctgttttgaaaccatattaactcctaggctgcctggtcctgtaaccatcgatcactgaatgactgccttaacccaatcctgtaaacctaccacaacttaattcttagaatttctagctgaatatactagaggaaataaagaataggaaatctaaatcagatgtggtggctcgtgcctacactct

SEQ ID NO: 64065 - DNA, 1091 bp, Homo sapiens
gttcaaaaccagcctgaccaacatggagaaaccccatctctactaaaaatacaaaattagccgggtgtggtggcacatgcctgtagtcccagctacttgggaggctgaggcaggagaatcgcttgaacccggtaggtggaggttgcagtgagccaagattgcaccattgcactccagcctgggcaacaagagtgaaactctgtctacacccctgccaaaaaaaaagataaatcttcaccaaaatcatgatgaaaattaatggaacggtaagatttaatttactgcaaaaatccaacagacatgtattgagtacatgtttgttgagccgtgatgttcatgtatgttaaaagtgacggacagaccactgatttaattgtcataaatcctacaggtactatcatctaaaatttctcggtgcccttttctgcttgttgtgtctatgatgctagtttaactcagtacatttgctttataaaaagccagagaaagatgatagtctgtttatctaggttctccaaagcatttcctgccaggcagttgacatgtagccttggcacaatttcaggaaactgtttgcttctgtttaccctttccagatacagcatctcctaagaattgaggtgaggaatctcctttaacttttttacattttagaagtatactttattctaacactttagaatgctcttcatgtaagagcaatgaaaatctttgtgtctttaaattaaaaaggatatgttttagtgcttcactagtagaaaaggcaaagccttaaagcaagttaacctaataagatgtactcagaagaatatttctaggctgggcgtggtggctcacgcctgtaatcccagcactttgggaggctgaggtgggaggattgcttgaccccaggagtttgacaccagcctggacaacatggtgagaccttgtctctacaaaaaaattttaaaaattagcctgatgtggacctgtagtcttagctacatgggaggctgaggcaggaggatcacttgaacctgggaggtcgaggctgcaatgaaccatgattgtaccactgcactccagcctgggtgacagagctgaaactctgt

SEQ ID NO: 64066 - DNA, 1022 bp, Homo sapiens
tcagggaatatttttatcttatttgtgttgttcagtggttttacaaaaatcaatagcctcaactctactgtaaagtgattaaacccttggttcatggttcagcaaaaggaataatatttgtctttggtttgaggtttagcaaattgctgttcttcatttttgttttcagttcatgcttcagttcaagtctctgttatgaaatggagcctcagaacctcttggctttctagagatagaattaagaattgtgtactgggtttgtctccacagtttgaagcagccactaaaacacatctttaggtctgtgtcctcaagtgctttccccagcttctcgttcttctggtcacatgttttttagacagtgtgcctaccctgttcaaaacaagcagggctgtgatgtcattagtcattatcaagggcaagtctaaggctaactttgagggggaggaaggaagcagacaagagaaatgtaactgttttccgatctttcggaagattcttcttaaattagagacttctccctccactcccccacgcgcaggaagcacagagaaaagggctgcagagcagctcttgggtttgtttcatttcctgctgtgtttctaaatctcaggaaaatgtacccctctcttcccgtgtcctggtctgagacttagacaataaacatggaaccgttcatccacattttttaggggaggaaatgaaaggatatgtgcattggacatgggggcaaagatgtgaaatttgtttaacctggcagagagcatggtcctgcccacctttagttagccagcgttcttgccctatggaggcagcaggtggcagcacggggatgccaaatgcatttctttctctgcagccactttgggtgggctaaggtttgttgcatgacttcagaggcctgtcaagagggcaggtaattcacctttgctctcttgcctccctccttaactgcactttgcccaaatatcagggttttttgaaaatttgacaagacaatttggttagctaacatctttgac

SEQ ID NO: 64067 - DNA, 1091 bp, Homo sapiens
acatgaattaaggtcacaagaaaaaatcaccggcctagaaaatacttttgtatatctaaattgagctaaagagtagctgaatttaggacattatgttcagctgggaaaagaaacaaactgctgtgctagcagtggtgacaggtgattagcagtaggtgaagttggagtcttgaagacttgcaaaaaaatcccaaagatctttcctctttttttcttaaataatactttggtgaagagttgagtttatttcttatattgctatctggtttgtatagaaatcctataggcttagcagatatgtcagtcagttttactattatcatacaaagttctgatttatgggcttgaacaaagatgtaacttaattttcaatttcctttaggttaccattataatttatctctccattttgggccttctacttctgtacatggtatatcttactctggttgagcccatactgaagaggcgcctctttggacatgcacagttgatacagagtgatgatgatattggggtaagttcccagcctgccctagctgctcatggccagtccctgtcatcattcgatgtgaagtgcaagtgaaaaatagtcatatatagatgttcacgtgctgaagcagatcctcaactagagaagctaaaaacagctctgatttcagtatatacctctttatgaagaaattgcttgatgaagccataaatgtgatgatttaaacgatgatctttggtgagcatgctatacagggccttgctttcagtaccaaaggcacaattttattgccattccctgtttacattgagaaaagtatcagagatggttttctctccaagctctcctgcctgaaacaccttctctgtcaatatcaccaaatattttagaaggcagagaggttttcatcaagggaagtgtgaagatcatgatgttcttttcttaatgaagtacaacttgataacctgctgatgttttatatttcctttttttctactgcttaaaaaaaaatctgtgggccaggtgtgggggcatacacctgtaatcccagcactttgggaggccaaggtgggaggatcacttgagcccaggagttcaa

SEQ ID NO: 64068 - DNA, 1033 bp, Homo sapiens
cactccactacagcccatgtgacagagcaagaccttgtctcttaaaaaacaacaacaaaaaagaatgatgttaattcacaaaagagataatcttatatttgaacagtgccccatatcactttaaaccattttaagtagttttccttagtaactgaacaagtctaaaggtgacttgatttgttaagtagtttttcatcccatttgggattttttgtgtgcgtttttgtaactgttaacagtagcagctttgaaaatagacactactatatgtgtgactttgtggcttcttaaatggttaaaacttaccaaaatgctaatattgagagcagaaattattttactttatcttattgattatttgttttttatgctctttcattgggtaagtttagtgattattctagatttcaggaaacttttggtcagagcaagcagaagagctagctgggcttaagcagcattttatctttgttttttcagtgattgccttcatgttgtggagcccatgcctgtgcgggggcctgatgtagaagcatactgtctacgctgtgaatgcaaatatgaagaaagaagctctgtcacaatcaaggtaaaatatatatccctctatctacctgtctgtctgtctgtctacgtcttttctgcttctggatggtttctagacaagacagaaaaatttggacccctaccccaaaaggaataatgggcctgttctgcctgcctcactgacatggtttgtggattagttagggtatgttagatagatatgtgaaatggcacaaaaatgccctatgtgtaattagcatattccagaaagatatcccagcttctgtgtaggccatgtgtgccagaggctgagagagcagcatttataagccctcctctccttgcctttccagccctttgaaaaaattaaatatatagtaattattctagaactattacttctggattttaagatttcccctcttcatttcctgtaggacagtggtccccagcccccaggccacagcccagtctgtggtctgttagg

SEQ ID NO: 64069 - DNA, 1037 bp, Homo sapiens
tgcggctttcactgagtcacggcccggcccgccgctgcccttggctcgcggtcgctgcgtcgcggattcctccccttccagtacccctgctgcggtttcggtggggattccgtcgtagcttttctagcttgcgctcccctcggctgtgcctcctccctggatgtctcttctccagtagaaagaagaggtcctgccctgccctcttgccctcgggtcttctttctttttccttattcttaataccgaattttgttcacggggcttgtgcctcctatgctgtgtggctgttcctatgacccagacagaggtgattcctaatggctttccgtgagggggaaagaagtggaaagagggttttttgacagttgccagatccagaggacttctgttgaatccattgtccccctatgcaaaacccacttctctagttttggtcctaactttgaccttccatcctgagtggggagagagaaaaggggccaaatgtgaaggtttcctgaacccccaacatctcttcatcattctcctcttccagccccgcccccaaggagtgggtagagggaggaagccaggctgctgcatctcaccgaccagctaatgtgtgcatctggagctggggtgggtgcagtctttttttctagcacagttgttcctggcattaagtagaagcacctcaggacagggggcctggggtcaaagatggtactgtcctctttctatagaatgggatggatggctaagggttaccaatataaagaactgtatttgtcatccctcagccactgtagtggtcctgggccaagtttatgtttaactttgtagttttatctggagttttcttgtagtttgattgttttcttgaatttcacaatcgctttattcatttgggtggtaatatgtgaaacactaattaaatgtcttttaacaaatgaaataggtgctctgcataatttttctagtattttttattttaagcttttgaaatatttaattttggatgtggttgtcggccctagttcactgaaattgccatttct

SEQ ID NO: 64070 - DNA, 1109 bp, Homo sapiens
gattatttcctgattttatagatgaggccattcaggcttagagatttaaggaactgacctaaggtcccagcatggcaaggttgcaaagcaaggtttgaaccaggactgtgggactccagagcctggattcttacctgtaactttcctgcgtttctaatgagttggagcaagtaaggaaacacagtagttcttaaaagcagaagaaatattttttttaaacgatagcagtcgggaagcatttggtggagtggcaaacagctgtctagttttctattacaccagaacgcagcacagcaaccgacattcttaatggtaagtcccatcaacaaaaagaggagagatactgccgcagaggaattcaagatgaaaagaaaatgtattctcatattttatattcactaaaataaaagaaagacaccacactaatggagtaccaatgctattgtaaacatatcgaattagtaattgtgactattataccattactttccatttgccatcccttaactgagagaaacttttcaagagttcctctcacacaatttcaatgatgttctcataatgtgtttggctttgtcgcacatgatatgcatacaaagaggcattttttctgtgtctggaatttggaaaagattgtgctttgcatatgcttaatttgaatgatgcctataggaagtaagctagacttcaaagggggaagattggcatttggagaagtacagcatgcactgcatttaatgtgtatatcaggacaaaaaatattaatgagagaacacacacagttttcttcctccccgaccagccaaattctccaccctccagccccattcaaataaaggagagaagagtctttcttggtggataagaagcttgattgttttacataatacaagaatagagaaaaaagcgggaggtggggaggtgagagggaaaggagagcctgatgagctcaacaggaagtgagtatagacagagaagagaagaccaaggactaagccctgggaccctcctttggtaataggtcagagagaagaagaaaagcaaagaagcctcagagaagtaaccggtaaggtaggaggaaaaccaaagagcatggtgtcctggaagct

SEQ ID NO: 64071 - DNA, 1070 bp, Homo sapiens
gtcccagctactcaggaggctgaggcaggagaatggcgtgaacctgggaggtggagcttgcagtgagctgacatcgtgccactgcactccagcctgggcgacagagtgagactccacctcaataaaacaaaacaaacaaaacaaaccaaaacaaaacaaaacccacagtggataccttcaaagtgattaaaagaaggtaacacaggaagctagtattttctattgctgttgtttttaataattatttaccaaatgttctttaatatagggcatcataatcattgactctgagggaaagctcaagatactgattttttattttatttttttttatccttagagactccaaagctgtgataaagagactgtgtgttttcacccatataatgagggtaggctggagagaagcacatcacccccggcccgcctttgttcctattcatgggtgctcaggctctcagaatgagcactcctcttttgttttgtgtgttctgagaatatttagatggtgtactgatgccttttcagggcaacagggaaggtgtcagggtggcaaagtggaggctgtgctttcagcaggacctgttacccgttttatgtcatgttttcctcccaattcacaaggcatatttttgtttggtttccagaaataatcttcagtggagccctgatcttggggtgcaccagaatgggggatttccaatgtttctgagctgtttcccttctggtgaacgaaccatcctggacgtgacaaccagaccaattttggaaagagctagggccatttgctgggctgcctagtttggaacagattaatctgctcaccccagcagtggtcttgcattaagtcagagtgctacaaaggctttgaggtcacttcttgaaaagctgtcagcgtttccagagccatttaagtctctattatgtcttggtaacttcaggtgtagcttgatgtggtaggacattaggtggtaggttctctgtgtatcacaatggcatctggcatacaggcattcttacgaaatatttcttgtgtaggtgaattactctgaggcagtaaaggtcacttt

SEQ ID NO: 64072 - DNA, 1036 bp, Homo sapiens
aaaggaaaagcttgtcacaatctaactggctatgttattattattaaatttatgttttgcaacttagaaaccagctacagtatggcccacttaataaaacacctgaaacaaaaactgcatggatcactgatttttatggaggtttatgagcagtgggtggctgcgggtgcagttgggtccatctgtgaggatggtcttgtggcatcacctctctttaccagcaggctcggggttgtggcctgcccaggatgcccctgagggcctggggtctcctgggtccttctgcccgcagtgctaggagccttcctagctgttatgtggctgattcacatggatgcagacagggttctttccccactccacagaggaggagactgagacacaggagggaaaagacccggccaggggtgcagaggttgtcacttgactgagacaggatgggccctttcttgagagggtaagggagaccaggtgtgggaagctgggggtcgggggaagctcttgaaagaaaggtttgctttcctggggatggcaggtgggagacctttatgagaggtccagcttcgttcatttttattcttcaggctgctttggcaggaagctccagaagaagtgtaacgtgatcaagtcaggcacctcagaccaatcagtgccctcttttatgctttcctggtttgcatgcattttccctttgcctggaatgcctccccttcacccactttgtgtttgttgtacagggtttactttagcagtcacctgctgtgaagtgtccccaatctccctaggcagttaatcattccatccttgtgctccttcattttcttagatgctggcatctcctctctggattgtcattgcctgctttcgtgtcaggctcagcccttgcaccgtgagctcccagagggaaaagggggatctcttgcctgtctccatcccctgggcctggcaggtggtaaatgcttctgaagagatgaggagagggcccagagagctgcagcgcagcgtcctgcctgcagagggggtgagaggccacact

SEQ ID NO: 64073 - DNA, 1043 bp, Homo sapiens
ttgcttaatgacagggatacagtctgagaaatgtgtcattagacagtttcgtcaccatgcgaactttatagggttctcatacaaacctagatggtagagcctactatatgtctagcctgttgctcctaagctacaaatcggtacagccctgtcaccagcccccaggcctgctcttctacacttctcctggagcttcctgccacagcagcctgaagaataaaaatgaaggaatactgtgctgaataccgtaggcaactaaaacacaatggtaagtatttgggtacctaaacatctcaacctataaaaggtacagtaaaaacagagtataatcttataggaccatcatcccataaacagtccgtcactgacaaatgttgttacgcagcacattttatgcagtgtgtgaccatacacgatacacagaggaaattcagggcttctaggaaaccttctaaggcctcatctccctaagggcacctgatgagccattcctcacccctgcactgcaccaggcctccaacaccaccaccaaggctaaccgctgtgcactctgggccctgggtctgcagtacctggctcccaagcacaccagcatctgaaacttgccatccttgccgatgttccggggagtattgttgattgcagtgacaaatcggcagaagttccgggctcttgtatgccagttttcctcagggactacttcattcttctctaatgtctcataataggtttgtgctttttctgtgaagagtagaaaagcttgccagtgaaaaggctctcaacaccaaccctgacggtcctacaggccacttgccatgggcctctccaagtccacacaggtaacttaatgagaatagcacaagtgttctgatgtcactggtcatgtttcaaaatgatccttagcttccctatccttattttttaaatttatgtatgtggcccttgatataaagatgttcttttccctagtctgaagacacaaaaaattctgaggatggtttcttgcatgaaaattctccatatgggtgcaacacagggcttgg

SEQ ID NO: 64074 - DNA, 1758 bp, Homo sapiens
tgtggaattgctgtgcccagatcccaggccacctatgccactcagggtgattctctgatgatacatggtggaaccagcagagcattgaaggagtctctatcctggtttcagagcctatctccagggattggctttgttgatggctcttcctgtgagcagcagggaggagctggctgctctgacagtccattgtctgatcttcaggttcccgtgtggccggtggttagggaagggcatggatgatggaagcctggagcggatcctagttggggagctgctcacatcccagcctgaggtggatgagaggccatgccggaccccgccgctgcagcagtcccccagtgtcatccggaggcttgttaccatctcacccaacaacaagcccagtaagtgggaggaggggttgggccctcatgccatacagtctagggaatgggtggatctctgtgagccctgataatgggaacctgggtcccagcctgtgcagctgcctcaggaaacacttctgctaacaaagccacctcacacatatggcacccttctcttatgaatcactgagagcatttggcactctccttagagggctggcaggagaggagagaactcatgctgccaaacctgggcgctgtatatattcatgcatgatccattaaaggagaggggcctactttctggactccccctgcctgattcctgggcttcacagccaaggcttggctctcttttggttacccacaattccaaggtaaaatggaaactaaactttaccagcatttcttagagatagaactctaaggtgttagcttttgtgtttttcccccaagatttgcggaagagctaaatcagcaaagctgggtgggcaagcgcctctgcttcctagggtccagctgccctgcctctcctatgggccctccccgtgtcctcagtctcctgctcaggcagctaagcactgttagcctcagagattggttagggatgtctgcttgatttttattagagctgaacactgggcagatccaggagtccatcggggaggcagtcaatggcattgtgaagcacttccataagcctgagaaagaggtgagccttcctgccctccaatccagggccttacattgaataagagagaataattttgtttttccgattatcttgttatgctcttccaggcccatgtgctgtggacaccctagagtcttgtagagtgtgtgcctcagctagttggagatggagcagactccttcctctgggggcctttgcctcaggttaccctgttttccctccatactgatgacccaatagagtccctgggcccctagtgaacagtgcctattcctgtcctcttctagatttgcctgggtctccttgaatagtggccacactggctttgtcctccagtggagaatctccttgtgtgtgacccagatccatcatctcttctttcatccatttattcagcagctcttcactgggagctgctctgagccaggcactgtgccaggtgttagggaaacagacaaagtcctagcctgtcttttgcagccctcccaactctgggctgtgggtttagggatgcaatggtgggagggcagctcggctgagacaagcctggcaccctcccctgtttccttacgtagcgaggcagtctgacgctgttgctctgtggagagtgtggccttgtctcggccttggaacaggctttccagcatggatttaaatcgccccggctcttcaaaaatgtcttcatttgggatttcc

SEQ ID NO: 64075 - DNA, 1085 bp, Homo sapiens
gtgatgaatggtgaccacagaccttcatccactgccactcacacaccatacactagctgacagcctagctagaagcctgagaagacctgtgtcatccttgatggaatttcattccagccctcagtttagaaaaggagatttcatgacttctgacacttgatattatagtaacatcaacataccttggacacaggcagtatttgatttttgttgttcctgctgtagcttaaaccgttgtccctctgtcccttagttagagtagctagctttgttcctttatagggtgaacctaaggaacttgaagcttgacatcttatgcttcccttagctgtctccttccagaactgaaaattctagtttctttcccttccttttggtcggagactgatgtattacctcctctccaacagaaagttatataagcgctatgccttcctgcgctgtgatgacgagaaggagcagttcctctatcacctcctgtctttcaatgccgtcgattacttttgcttcaccaatgtcttcacaactatccgtgagtagccctgtgctcccagctggccttctcaaggcagtctttatgaacctgcctgagactcactcattgtcccctttttaaagaaagaagattatcccttgtactttctatttgtcttttgcctctgtggggagagaggtgcacttgccctccttggaggctgtgttttctctgaagtttctcattcttgttctgaactggagagctcagtcttttttgccattgtgttgtcggtgttgtcctaggcactgctctgggagcctaagctgatgaaggtggagtggagtcagttgagctgatgcagtttacctccctccctgcatacccacaaagaatctcccttttgttttcgcctgagaggctcacttggcatcacagaatgtttcaaaccaggctgaagggaaaaagagctcttttctgaggtagcagaaagaactccagataccagtgggagatttcattctgggctcagctttggctaactcattatgtgtctgtgagcagagtctatcctgctgtgagtcccagtctctctatttacagaagaggg

SEQ ID NO: 64076 - DNA, 1393 bp, Homo sapiens
tcagtggctgctacagcatctcagctaacatggaagccctcctaatcacaaagccttgtgtttcataatacatttgtaaagctgtacaaaccgttgggtttcctggcatttttggaggtgagggagcataggagagtatctcaggccctaagggctcagagttagcctggctttttaagggctgtactgtcttttttcctcccaaaatatggtgagcctatctggtaaagctacatggaagcccagtatttggagaatatagagataggctctcccagggtgagataagtctgtctcagcaggtctcctttggctttacaggtaagttattggcagtgagttcatctcccatcccaccctccacttcctttttacattcttcctccaggcacatccagaacatcggggaaatcaagactgatgtgggaaaggccagagcatgggtgcgactgtccatggaaaaaaagttactttccagacacctgaagcagctcctctcagaccatgagctcaccaagtaaggctgctccgccaggagtagaagcaggctcccaggaatggagggaagagattggaaacttgtgtgggaagggggagtattcagtgtgacattgctgctgcattcagctaacctctttgcttatgaaggttttgcagtatttcctcttctccctttttatcagtagaagaatacttccgctatattggttctccctgtcttctcaacctgcatgcccaaaactagctttcttggagaggtagtgggaaggatgaggtcttcctctccttcctgtattcaggtgacatgtatacctcttggacataaggcgtttcctttgtctctttcctgttctggggagcaaaggattggagaattaaaaggaaacttctgagatgtcctcttctctctcttgttcaacacatcatacccctcacccctctcgggatgtctgtagccttttcttgtctgtacttctgcatgaccctagtccctgtccacactctacctggtaaacttcttcagggctcagttttctttcccagagttttcctggactccccagaaacgtggttcatccctcttccaggcatgcataacatttgttagaatatttgttcatccccttttcaccatgatgtgttgtattatcattgtctatttgcttgctacttactgaagtttgctttcattgaaggcataaacctgtccctttcccaaggctgagcatgttgcttggcatccactagggattcagccagcccacataaaaggtatgcttagctgcacagacaggaggtggacagtctatgaagagtatatcttgatagaatgtccctcagtctctgggatttccagctagcccccaagactgtttgtagcttggagatggga

SEQ ID NO: 64077 - DNA, 1048 bp, Homo sapiens
ccttaactacatatttttttttttttgagacggagtctcgctctgttgcccaggctggagtgcagtggcgcgatctcagcttgctgcaagctacgcttccttggttgacgccattctcctgcttcagcctcctgagtagctgggaccacaggcgcccgccaccacacctggctaatttttttgtatttttaatagagacggggtttcaccgtgttagccaggatggtctcgatctcctgaccttgtgatccgcccaactaggcctcccagagtgctgggattacaggtgtgagctaccacacctggcctttcttaactaaatttttaaagcatgcactcccttgtaacctgacctacatgggtataaatatattctgtgtccttggggctaattcatcctgtccttcccagcccaacagatgtactgtgcaggctgtcagaaccctctccggttgtatgtaatcctgctcactgtggttatttaatcctgttgactgcttccttgtagaccaagaggatgctggtggaaaagatgggccgagaagctgtggagctagggcatggggaggtgaacatcacaggggtggaagagaacaccctgattgccagcctttgtgatctcctggaaaggatctggagtcatggactacaagtgaaacaggtaatgtatgtcttgcctctcattgctgagcaaattgtcttcctgttttcagttactagctttcccacactctttttgtccagctgactggctttgaagaatggtgcacagtgccctggagtgagatttgaaataaacaattaaataaatgtgatccaaactattttccttaaagataggctttataaatctgtgtgtttgtcagacttttaaaaagaggcatctttcttcctgggggtagagctgaaggccaacctgataggtcctgtttggcagctggccctagtctagagatagaccagaaagagagaagttggagctcaggaagtaccagtcatacactaaaggttcttcactaatcatatattcacagtggaaaaaaagtct

SEQ ID NO: 64078 - DNA, 1050 bp, Homo sapiens
gattgggatagctccatatgtctaggacctgcaaaaagctgcagatgggttaaaatcatctcatgcctggatcccattcaacagcaagctagcattgtatttaataaatggcagttgaaataatcagaacctgaactgaaaagtaggtaagttagcagaattactcattagttacttttgaagatgactgtatcaaagcccagatagagttaagtgaatatagttttagatctatatgtcaagtgtttgtagatgtttcaagagagacatgttccatgaggaggtgtctctctcatgtccagtcactcatctttaatctgctcttcctcaaggtctctgagctgtctctggtgacatctaggtcatttcctgtgtccagcattgactcgtagtcattcatgttttctcctgttagttgacattgctttttaagtgagacattattaattgcctgctttggttctgattgtgttaggtggacgaaaaggaatgcccctgcccagtggaggcggaaagatcggcagaagcagcacacagaacacctgcgtttagataatgaccagagggaggtaagataccttaagaatgataaggatgaccttgctatcatgctgtgcactccttctctttctcatttcctgttctctggtctgattcaaacgtctcagcaatgacctcaccccataaagaagggttaataataggtctagttcctgatatctaatgctgggcctgggttatcacaaatcagaatgtgggatgttttgcaaattccagctagctactaaccgattgtaatttctcatgcatgatgctccctgaggagttcaataggaacctcagaagttaagagtctgaaacttgggagaaatcctttaaaaattggtgtgagttttgtgtgtgtgtgtgtgtgtgtgtgtgtgtgtgtgcgtgtgtatataggaaaaaagttaattttttttaattctttttttgtttgagacagagtctcgcttttatcgcccaggctggagtgcagtggagcgatctcggctcactgcagcctccatc

SEQ ID NO: 64079 - DNA, 1045 bp, Homo sapiens
gcttatgaatagatgtgctgattattattatcagacgatttaccttcagccaaagggatctcttaaggcaaagatagacatgtagagtgaacatcaggattctgggaagattggttgactcagtaggttacccaagtgagtttgttccagtgtcaaagtttcaagatacctgaacttacatgagtgggtttttttttttttaatgtagagattttgcagcttggtattcttaaagacctaggcagcctcagagaataattaacctactggatcccttgggcacattgacattacccttttccctgtcaattactgcttctttttggtcccaccaggcatcttttctgtcagatcagcctgagccctacctgcccttcctctcaagattcctggagacccagatgtttgcatctttcattgacaacaaaataatgtgtcatgatgatgatgataaagaccctgtactccgggtatttgattcccgagttgacaagatcaggctgttgaatgttcggacacctactctccgtacatccatgtaccagaagtgtaccactgtggatgaagcaggtaaggcctccttggaaatgtacattcaggcctcttggattatggcattaacatgtcccttttcctaaatatgccagcctctttatctgtttctgcctttgtgtatgtggttcccattgcctgcagtcttcttccttgttttctttttgcctggttatcttcttctcatcctttaacactgttagttaggaatggatctcattgtatgtagtagagaccctaatcagcagtgggttaaacaaatagggggttctttttcttatattagcaagaagtacacaattggtggttgctggggttggctcagctgctcaaccatgtaaacaagaactgagattctgtctttttattcagtgaatccttgttgttggcttttatggtcatactgttgcctcattttttttttttttaaatgatgtcaatgaaagcctcatggttacagaagctctttcttttctgcccttttttctgcctg

SEQ ID NO: 64080 - DNA, 1025 bp, Homo sapiens
ccagcttctgcatgcttggtggttctttgtgcttgactttgcaggcaaagctcacataagctccttataggatgttctgcagatgtatcttagtgagaactgagcatgtttttgcttccatgctgaatggagacccaggaccactgtctttctttttgttcagttctcctaccccctttcttaagaggatctacttaacattctgtggtagtatttggagcaagatgtcattaattatttttgttgtatttccatattagattttattatgagcaaggacctgtgtgtgtaggtttatttcaatttgtggtccacaagggtctcttggttgtctcttggacaccctcaagggaatcacattgagcataccctagctgaagtttatcgtgatcgtttctaaataagaaattgtactgaaagttttaacttactgtttggaaagcaagtgccttgtttttgactgatttgtgtgtgtgctttttttgttgttgttgacccagattaccagagactgatgactgtggcggagacgattacagctctcatgtttcctttccagtggcagcatgtctatgtccctattctcccagcttctctcctgcatttcttagatgctcctgttccatacctgatgggtttgcattccaatggcctggatgaccggtcaaagctggagctgcctcaagaggtgagatcttgagtgttggtgcctctggccccaatccaggattggggagagaagggctttgggatgaacccagcatgcatgatgttaccaagtttattttcttctattttggtgattatgaataacttctcaggaaaaaagtaaaaacaatgaatatttagttcaatttatgtcatcccagagacacttattatctttatcaactgacatatgtacattgtaatttctgtatttatgctattgtttttgttttgttttgctttttaagagacaaggtcttgctgtgttacccaggctgggtgcagtagcatgatcgtagcttactgtagccttgaac

SEQ ID NO: 64081 - DNA, 1548 bp, Homo sapiens
tttattatcacaagggaggatggctctcggacatttgggtttgccctcacattttatgaagaggtgactagcaagcagatctgcagtgcaatgcagaccctctaccacatgcacaatgctgagtatgatgtcctacatgctccccctgctgatgacagagaccagagcagcatggaggatggtgaagacactcctgtgaccaaactgcagcgcttcaactcctatgacattagccgggacactctctacgtctctaagtgcatctgcctcatcacacccatgtctttcatgaaggcatgtcggagcgtgctggagcaactccaccaggcagtcacttcacctcagccccctccactgccccttgagagctacatatacaacgtactctacgaggtgccgctcccacctcctggccggtccttgaagttttctggggtctatgggccaataatctgccagagaccaagtaccaatgagcttcccctatttgactttcctgtcaaagaggtttttgaactgctcggggtggagaatgtgtttcagctttttacttgtgcccttctggagtttcaaatcctgctctactcacagcgtaagtcagtgcttactagagccttctgcctgcctcaggcttctttgctttccatgttcagatacagtgaggctgactgtaaaggttaagagctattacagtttgagcaaaacccagatcttttgcaggtaggtggtggatggcaaattgatagacatgagagggccagtatttctgattaactatcttcatggccttttgctgggcattccagtcttggaggggaacattgcttcctatgtcccttctgattgaagtgaaaagaggggtgggtaggaggtgatggtcacaggaagctgactttccatcagttctgttctgtcattctgcagagttatttctgcctcttcctcagcctagtaaaattgaggattcacaaaggataatcctttatatattgagaaaatgtggatgtgttgcatctttttgttgtttgcttaactgaattgttttcataaatgggaggttgagtgtaagcagcatatttggacaaaatagtaaagtagattagaaagaaacagatgcttacttaatgagccaggctagtaacatgaaattcattcattcagtacatatttactgagagtgcactatgtgtcaggcattgtttcaagggtagtggtggacaagacagaaaaattgttgctatagtggaacttaaattttagtgggagaagagaggtgattaaataaatatataaaatatgtagtttgtaaggtacttaataagggttataaagaaaaataaaacagggaaagggatagtatttggggaagagaagttccagtttgtaatagggtggttaggtaggcatccctgagtgacctgttaatatctgtaggaaaagtattccaggcaaagggcacaggaagtataaacggtctaagacaagaatgtgcttcgtgtattcaagaaccagaagctgggtggatggaatggagtgaatgagcgggag

SEQ ID NO: 64082 - DNA, 1046 bp, Homo sapiens
aacaagacttcttcccttagctaatttaaagaaggggcagatgtggagaggtggtggtggggacagaggctctaacaatcacttctccagtgattcatagcctttctctcccttttgaccacacttcagatcagctggtcatgctcacctttggctccattcttcatctcacttttaaaaagttctccccttaatcactcagctttcctatcttctcacacatgcatgtcatgtcttagggagctccttacagccattttagatgagatcaggcgcatttagggtggttatggccatagacgcctagagccattttaggaaggcgtctttcctttacagagaacggtgatagttgtcctgattcctctctctgttgtgatatttcgtggtttttactgaggggattttctggctagttaggaagaaatgaacaaactgataactgaaagtgaagaagcttaggaggaagaaacagttatcttctttcagacatgaatgcagtttaaaaatacatcccaagaatttcagactgtagacgagatcattatgtcagcggcttgctgcttaattactttgtacagtaagtgcaggcttaccatgggtgggctctgcaggtgttacagaaagctctgagcctagctctacataagctgtaggccttgttgctgcagctattaccagctgcctgctgatttttgccagtctttagtgaagattaccaaatgtattttgagggacgaaatttactcaaaaagaaagtttcagaagaatttgtttggaagaaggatcaggaaataagaggaatgaaattgtggcacttgcttttaataacagaaagaaggttgggtcctatcagaatttgaaaattgtgaataagtgagctgctgcttctgatgatggacaaaacctcagagaaaatagaggagagattgtagttataaaagcagtaactttctgactggaattattattagtttctggaacaggtgccttagagttattataaacttttctcttttagaaacttttgaggtgcctttgggatt

SEQ ID NO: 64083 - DNA, 1013 bp, Homo sapiens
tcgatctcctgacctcggaatccgcccgcctcggcctcccaaagtgctgggattacaggtgtgagccaccgcacccagctggatttagttcttaaaagttactaagtgaagcagttagtcaaatgccatattccaaatcttctgtggttgctgattttcatttggcgtatgtagaaccctgggctgagtcttatgagtggtagaatcctggcatggcagaaaatgagagtgtgtgccagatgtcaagttgttttcagtatgccttcaggggatcagatatgactcaggaagtaagatggcaataggtatagtttagaccgttgtgtttctcaaatattgtactgtctttgatatttgcttgttgtcgtacatggaatctcttgtagagcttcctgttaaagagaaccaggttagtaattttttattttttattgttcattatgtgatgggtaagtcaggttaaaattttgcttggccatctgtggtctactttatgtactgaactagctgggttagcctaaaatgctttcctggaatgctgagaggtctgagcagtgaaaagtctgtagaggtttctcacattgagtttcattcctctgtgaatgtgggattccttgatatctttctttctttttttttttttttttttgtttgagatggagtgtcactctcttgcccaggctggagtgcagtggcttgatctcagcgcactgtaacctctgcctcctgggttcaagcgattctcctgcctcagcctcccaagtagctggaattacaggtgcctgccaccatgcccagctaatttttgtatttttagtagagagggggtttcaccatgttggtcggggctggcctcgaactcctgaccttaggtgacccacccgcctcagcctgccaaagtgctgggattacaggcgtgagccaccgcacccggccggaagtccttgatttctaaactattccagttggccaaacaatgtatgtgcattggtttatattggtcacagaatcaa

SEQ ID NO: 64084 - DNA, 1479 bp, Homo sapiens
cctcccaaaatgctgggattattggtataagccaccgcacctggctgcccaactaattattatttttttgtagggatgggttctcaccatcttgcccaggctggccttaaacagcttgaacagtgatactcccgactcagcctcccaaagtgctgggattatagacatgaaccaccatgcctggctgagactgtatattctaaagagaacgctatttgactccatcaggcagggaggatcatactgaaattagtggattttactttaatgatattggggccctgcaattttcttcatagaaggaaatcctgagtcacagtgtttggtgcttaaaccaaattctcttagagtctgctcagcccttccttccttcctaggttaaaaataaagttttctttgcctaaagcctcctttggtaacacccctttccagtcctacatccttttataagcttgttttttggctttgttggaaggtgtacttgggcttcgctcagcttgtaaattcctgttgtggccaggtatggtagctcatgcctgtaatcccagcactttgaggggccgagtgggggaggatggctttaggccaggagtttgagacaatcctgggcaacatggcgagactcgggtctctacagaaaatagaaaaattagcctggtgtagtggtgtatgtctgtggttccagttccttgggatgctgaggttggcagatcagctgagtccagggaggtccagactgtggtgagccatgattgtgccactgcactccagcctgggcaatagggtgagaccctgactcaaaaaaaaaaaaaaatcctgttgctgtccctggctttgaattactgtcagatagtcttagaggtctcttaggaacctgggtacacatgaaggaacctatacttcatatgttgatatgttttaggttcctgctagagatggcctaatgtccagtgagaaagaggcttgcctttcagaagctggtgacttccttgtggaattcagttttttggtttttttttttgagacggagtctcactctgtcacccaggctggaatataatggtgcgatcttggctactgcagcctccgcctccaaggttcaagcaattcttctgcctcagcctcctgagtagctgggactacatgcaagcgccaccacacctggctaatttttgtatttttggtaaagacgctttcgtcatgttggccaggctggtgttgaattcctgacctcaggtgatccacccacctctgcctcctaaagtgctgggattacaggcatgagccactgcacctggccgaattcagtaattaaacacaggctattacggccagatttttatatttagttctttttttttttttttttttgagacggagtcttgctctgtcgcccaggctggagtgcagtggtgtgactgcggcactgcaacctctgcctcccgggttcaagcgattctcctgccttggcctcccgag

SEQ ID NO: 64085 - DNA, 1032 bp, Homo sapiens
cgccgagcccggggcgctttcccgcgcccgctgtcgtcggggaccccagaagaaaccttccttcagccccgctttgtcccgggagccgggcgagtgtcggccgggaggaccagggcgggcgcgggcgaagggggctttggactggaggggggaaacggatgaggggctctgagccatgaggggtccaaacctacggcccgctgcgcagtggccacgtcttcggcgaccagaaagagggagggttgtgtgttctcagtttggtgtaggttgagtgacttcgtttaaaataaaggaaagcttgtcctctggcacccattagggagggaaggcgtcccacgtcctagtgaaagtaagttccacccagacttaaaaaaaaggaaaacaaaaacttggtgagtttatctggccacttcccaagaagcttgtgatactagttcctcaaaaccgttataccccagccctgggctgggccccctgagtcagattgcagctctgcgcgtctggatgggatatgaagtaataaagtgaacttgggcggcaccaagaagagtaggaactcccttagccttggaaagggcttgtatcccggggccatgccttttttgaaaagtaatttatgtcctttatgaggacagaggcgtttgtgaataaaagggtagcagcattgtagttggagaggcttggtgtgttctgatgcgtttcaagtcatatttgaaagggaaagtgatgaggggagtcaaagatggggccctgaccagatttggcactcactgcagaaggccgtgaaaattatacagtccccgtgaattttccactgcactgtcattggagtctttgaattgtaacagttttgaaaataagtttttgtctggagtttccagttagtgggtttcaagtgggtggaggtttgtcgggttgtactttaaggttgtgtcatcctgatgagggggactccttttcacttttctgtcactgtaaagtttctctttcgaaagtgattatcctgttgactaatcttactcggcttcaacg

SEQ ID NO: 64086 - DNA, 1556 bp, Homo sapiens
tttttacagtatttccactgtgcatatgcaaaatgggtattacataactgtatcatatttggtattgataattttttttttttttgagacggagtcttgctgttgcccaggctggagtggagtgcgtggtgtgatctcggctcactgcaaactccgcctcctgggttcaagcgattctcctggcccagcctcctgagtagctgggattacaggtgtgtgccaccgtgcccagctaatttttgtgtttttagtagagacggggtttcaccatgttggccgggctggtcttgaactcctgacctcaggctatatgcccacttccacctcccaaagtgctgggattacaggcatgagccactgtgcccagcctggtattgataatttatattcagataatttgttatggctctttaatatcccacaaggggctctaaaaagcaaacattcaagagtatgtagtttttagacattaagttaattattttaaacagtgacagcaaaacacaagtgattaaatatagtttatttgttccaatgactaaattttacctcatttattaatctggtcattaaggaatatatttaataatattatgtaattattctttttatgcatgatacacctagaaaaatgccttttgtttctattgatggctttgttgtttggagctacttttgattacttattgcagtttcccaatttagtctttactttatctaactcacaaagtaaaattaactgatcacatggcaactactgtatttaaatagttctggaaaaatgaaagtgctttttgctgcttggtaaatgggtaatgcccttgattccttgactgtaggacatagctgatctaaagtactctgtcagttttaccttcacccatgactgttattagttgtcaaagttgaaaagtactttagctgtgagaaatccttgtatgtttttattataagaggtataatcatcctcaaagcctgtttttattacatgatgtggactgattattttttctatcacagtgttaacagatggattttattgtaaatacaaagaaaacatattgattattgtagtattcttatgtcacctggccttttgcgtgagattatttattatttctagcaaggctttcttcctttcttattgcccagagactgactgatacatcttttgttatttttacacataaattaaacatagcctttttggacaaattcactaaatattaatgtataaaatgtaattgagtaaatttttatcagaattttaaaaataaaagagcttagactcagtagaactcagtagaagcttcactatttactccagcgtgtgtaaattgtacttactctattctcagagtatatttactgtccttaccattgattctttccctttgctaatttttttttttgttaatggtagctgcgactttaggtggggtatattttcttctcctaagagaatagacagtttttccagattcatcatcattgactgtcaagaaaggacccttcagcaaggctgtaccctcaatgcagttgatggcctgtcttca

SEQ ID NO: 64087 - DNA, 1145 bp, Homo sapiens
cagtgagccaagatcgcgccatcgtgttccagcgggggcaacaagagcgaaactccgtctcaaaaaaaaaaaaaatcattatccttaagaggtgattaggaaagattgaattctttatatggaaataaacttgagctttaaattcttaattttttttccaaaatggaaatagctgtgttgttttaagaaactttatgcacacagaacattttaattttttaaaaacaattgcggtggtttttactgtatctttttatattttatttcaggtgtcgcacctccttcttttgtagccattaaggcaggaacaacactgtatcaacttacaacagcaggagaagctgtttcctggaactcaatatttattctgatgatcttggctgttctttctattctgccagccatcttccaaaaaaaactaaagcagaaatttgagtaaaaataatcatctgatttttagttttgctgtcatcaccatctcaggattaacaggtgcatccatttatgttttaaaatcacctcttcagtaattaaacaaggaatttgtaaaataaaatttcctatcagatagttaaagtaatacatttaagtgacaaggggagaagaaagtaaaaatggaaattggtatactgtgaaaagtgctatcaatagttaaggtagacatcttagacatcttataaattattataccaagggtagctgtagataatagtagtgtggtaggaaattgttgatccagctaattcattcaatttaattgaatattttttatctttaataactaaaatagatatttttaaattctagattttttaaagtagtgttgcaggttttgttaatgttaggcttttttcagagcataaactggaaaacttaaaaagagatttacattttcttcctctttttttttttttttttttttctgttttgagacggagtctagctctgccgcccaggctggagtgcagtggcgcgatctccactcactgcaagctccacctcctgggttcacgccattctcctgtctcagcctcctgagtagctgggactacaggcgcccgccaccatgcccagctaatttttttgtatttttagtagagacggggtttcaccgtgttagccaggatggtctcgatctcctgacc

SEQ ID NO: 64088 - DNA, 2901 bp, Homo sapiens
tcttattttcttttattctcttgtagttcctattcctttaaaatgagtagtgaatttaggtaaaccttcatagttaaattagaaataattgtatgtacatgatttccctgaaaacatttgggagtaaaataaaatgtattagagaagcactaaaagattacggaagaccttttcttttttcttttgttcctcccccaaagtgcccggttcctctctatctagaacatacggttttttgtcttggaaaccttttagtagcacacacttactagtatttatgatactgtttagtaaatggtcaacttagaggctagacctttggatataatctcattgtatgataatttttgtatttatacttttttcctgaaatgttacatttgtcttttaaaattctacttaattatattctaatccttaacttaaaagttaccagcttgcaaacatttgctattccaggctctatatttctcagtatactctcagggtttctttatccctttccactagccttatttcttgtttgtttggtaagtatgaaaaaataaaattgggagactgaaaaaacaatagaatgatgaggatgatgatgatactttaaccctactagtctatgtaagcataaactcattaattgaagaggagttaatgttaaagtccctccacaaggaggtgttataatttgtttttcccccagaacagaccaattatagacttagttgcatttataagctatgttttagcttttctttcctattggattttgtaactgcgacagtccaaggagtgttggtgagcacaatgagttaagtcccagagccagaggtggtgttttcaagcttaggaactgggggggtcgggggtagggtcggggggaggtggaaattggctcctgaaattttattcttaggctaaagcctagcattaattatttggatatagtcactaggtgtaatcacaagtgccagtttgttttagctgatctcatttgaggtacattttggtctgagaaagtactagatcatctctgcacaagagatgtcatgcagagtaccctccccacctctgaaagaagtaaattaattgagctttttactcaggtgaataaatcaatgtgagtaagacggaaaaatacaaaacgcttatggcttcttttgttttccagtgttctggacttggtgcctctttctgttatatgctttcctatttagttgggagaccagttgtatacaaatacctaacagagaaagcagtaaaatggtcacagcaggtaaacatgtatttttaaattatttgatgtaactctttgttaattggaaggtctgtgtttagtccctacatgaattaactacatgtattaacccaacataaattaattcctaagttaactcaagtaataagaattatcttctgaccaaataaaaatgggtggtaggcaaatatgaatgttaataatttcaaatacaaatgtttcagacctgtgatggtaattttaattctttatcttagtaaatttaatcagcagagaagtcagtgtgaatataaaggcatccacataattagatacctatctgttttatgttaatgcagtattgtgtgcatctgttatggaaacacttgtatcagccaactcccagtgcatttttttcttttctttttttgagacggagtcttactctgtcacccaggctggagtgcagtggcatgacctcggctcactgcaacctctgcctcctcggttcaagcatttctcctgcctgcctcagcctcccaagtagctgggattataggtacatgccaccacgcctggctaattttttgtatttttagtagagacagggttttaccatgttggccaggctggtctcgaactccagacctcaggtgacccacctgcctcaacctcccaaagtgctgggattataggcatgagtcaccactggccttttttgatgatttcttttcttttttgagtcagagtttcgctcttgttgcccaagctgaagtgcagtggcgtgatcttggctcattgcaacctctgcctcccgggttcaagcgattctcctgcctcagcctcccaagtagctaggatttcaggcacatgccaccatgcccggctaattttttgtatttttagtagaaacgggtttcaccatgttagccaggctgttctcgaactcctgacctcaggtgatccgcctgcctcagcctcccaaagtgctgggattacaggcatgaaccacctcgccagcctgatcatttctattgggtatactctgaagtatcaggaatgagaatttgaaataaggtgtttatattaagcaacttattttgaagttgtcctcatctgatgctaattcttttctttcttatgacaggttgaacgtcatagagaacatctcattaactacattatatttttgagaataacaccatttctgcctaattggtttattaatatcacatctcctgtgataaacgtgccattgaaagttttttttattggtacttttctaggtaagccctctggttcttgctgtgtatgagctcactgtgtacatatctaacagtgtccagctgggctagattacatgcatgctctctgcagattatgccagcaccatctagaattcttgggcacaaagcctggctgtataaatagatgctcagaagtgtttgttgaattgtgttgatttaggttatttttgtgtcgcctctttaaagaagaacactttctactgtatatcgttttaatgatatagggttaagcaggacttccagtccctctaagtggagaggaaaaaaaatcaaattgccttttttgagcaattttctcctatgtcccttccccttcctcttccctgagtctcgatctgtcgcccaggctggagtacagtggca

SEQ ID NO: 64089 - DNA, 1076 bp, Homo sapiens
gaactgtgaatttgttacatttttacttaattttcattgtaaattattatttagtttatcatcaggattacccaaaatgatgttaaatgtttttaatttactaacatcagtggttctttttttctttctttcttttttttttttttttttttgagacggagtctctgttgcccaggctggaggctcactgcagcctctgcctcccgggttcaagtgattgtcctgccccagcctcctgagtagctgggattacaggcatgcaccaccatgcccagctaatttttgtatttttagtagagacggggtttcaacacgtttgccaggctggtctcgaactcctcatgtcaggcgatccacccgcctcggcttcccaaagtgctggggttacaggcgtgagccaccatgtgcctggccagtggttcatttcttatattcaagttaaaatttgtttcgatgttggaacaaatgcctttaacccttggtttgcgtcatccagagccttcatatataaattacctgtctctgattctgctgagacattaaaaagaaaaaattgcctgtctcatgaaattatattaaagcattaaaaaataatttatagccgggcatggtggcttactcctgtaatcccagcacgttgggaggccaaggcgggtggatcacctaaggtcaggaatttgagaccagcctggccaacatggtgaaaccccgtctctactaaaaatacaaaaattagtcaggcatggtgggacgtgcctgtaatcccagctacttgggagactgaggcaggaaactcacctgaatccaggaggtggaggttgcactgagccgagatcgcgccaatgcactccagcctgggcaacagagtgagactgtgtcaaaaaaaataataaaaataaaatgaaattaataataatttataggccaggtgcggttgctcactcctgtaatcccagcactttgggaggccgaggcaggaggatcatttgagcacaggagtttgagaccagcctggcaacatggtgaaactccctctctactaaaaatacaaaagttagctgggcatggtggtgcac

SEQ ID NO: 64090 - DNA, 1050 bp, Homo sapiens
aagtactgtacagtgcttaaatataattaattattgtttttatttttttagacgaagttttgctcttgttgcccaggctggagtgcaatggctctatctccactcaccgcaacctctacctcccaaatttaagtgattctcctgcctcagcctcccgaatagctgggattacaggcatgcaccaccatgcccagctaattttgtatttttagtagagacggagtttctccatgttggtgaggttggtctcgaactcccaacctcaagtgatctacctgcctcggcttcccaaagtgctgggattacaggcgtgagtcactgtgcccggcccagtgcttaaatttaatgtcacatcattttaggcaaaagcacacgccattttctggaaggaaagcatgtacagaaattatttgctagcatgtcttcctttatatttatcttaattatactttcttttttcttccagaaaaatcctgggtagaagctggatcagcaagaatgtcactccttatattggtgtccattttcttatctgcagcttttgttatgtttttggtatataaaaattttcctcagcttagtgagtaagtatactgagagataaactgaaaatgtatagatatttataagatgaaagtggattaaggccaagtgcagtagctgatgcctgtaatctcaacactttgggaggccgaggtgggtggattggttgagtccaggagtgcgagaccagcctgggcaacacggcaaaacccatgtggaaatacatacatctatatgtgtgtgtgtatatgtatatttaatatatttatatacacacacgtgtgtgtgtgtgtgtgtgtatgtatgtatatatactttctttttttttttttttttttttttgagacagagtcttgccctgtcacccaggctggaatgcagtggcgtgatctcagctcactgtataagccctgcttcccaggttcaagcagttctcctgcctcagcctctcgagtagctgggattataggggtgggccaccacacccagctaatttttgtattttta

SEQ ID NO: 64091 - DNA, 1198 bp, Homo sapiens
tcacaggttgtacgtagccctctctgagccttagtttcctgaaattcaggtaggttttgctcaacctttgtatttcccaccatcttttagatcaagcactctctggcgcctccaaattgaagacagcagctgcggaattgatgtaatgggctgaatcagcctcagccgcgaaatgccgactaatcacaggcacctccggcggcctggacaaaaggtttgaagtccctgggaccgcacttccgggtaattaaggctacgctttagacgccagggccagcgagtcgcagccgggtgactcgagtgccgcgactgcgcatgctctcgccccagcgcccggcggccacctctttcccgcgggcgggccggggcggggcactgaagggggcggtccaggaccctgacttgtctcgcggttactgggccggcgcgagcacgcgaggctcgggggcggcacggggcggggtttagcctgtggtgggcgctgcgggtgtttgcaggaggttgcagtactcgctgggctgaggtcgtctcgggtgaggaggtcgcgccggaagtggctctagccgtggcgcttcggcgtagtaaggagcctgcaacagagttttgttgtttagggggcgcggcaccgcaccgctcccttcaccttgcagcagccatggcgaaaggcagagtcgccgaacgatcgcagttgggcgctcaccacacgacccccgtgggggacggggcagcggggacgcggggtctcgcggcgcctggcagcagagaccaccagaagggtgagtgggcccggggagcagagctgggggtggcccgaggcttctgtgtgtcgggtggggaaaaggacccccgctattctcggagagtcgcggggaaagaggggggcctgctggcgccgcggcgggagcagagaccgtgggggagttgggcttgggcgctcgcgcagcacaaggccggacgccgagtaggtgcgttgtaaatgctgtttgagtagaattcatttaaaagaagggatgacactggcttgttgacgctcaggtagattgtaaggttgatgataacgacgctaggcagagctggaaggagctgtactgtggcattcgctgcgttgtttttacagatgaagaaactgaggcccagtgtgggtatatgacttataaagtcataaagccagatcagtgaagtagtagttaggagcgag

SEQ ID NO: 64092 - DNA, 1091 bp, Homo sapiens
acgccggggcgcctcggtgtggtgtggtggtggtggctgcagccaaggctgcctttgcttcggatcctgagctgggcctctggctgcggtctaggcatgaggagccggctgaggcggggcgggcgtgacgggttggacacatggctggctcgggtggctggccgacctctggctcattcccagctggttcctcacgtccaggagggggcgaaacttactgggaggtttttcagatgtttctgagaccagtctcgccgtcgcagggtttggaagggctcctgggaatgccggctggtcctttgggggctgcgcctgtcatccttgtcactttgctgggctgatcagtggcctgcctcgggcacaacttcctcctctctggctgagttgctagggaaggctttcaaaggcaagcccgcgcctccttggcaggataggagtagtgcgggacactcacagagtctgatccctgcttttccgctgtcctaatgcttcagtcggggagctggcttatgtagtgggaaggatcaggtgaagtgcacccttctaggtatagctgcaccattgattccttgagtgaccttgggccagtcgcttaacctcttgatcctgagtttttcccattcataaaattacgccacagagttgctgtgacagacaggtgagataatgttaagtctgagtgccttggaacatgctgagctccttatcagttcagatattgcattctctgaaggttttttttttcccccatattttgtggggaccgctccttggaaaacagcttaattgcatgaatatttattgtactatctccagtgtcattctttgtttctaaacttttgcatttttacgtattaatgatcagtattttaaatccttcttaaaagggctgctgtaacttttctgccagttagtaactgtccttcagcatgctgctgaatctgccagctttactgaactttagtgtacattttttaactgaaaaagaaatcacactttaaaatagaaattcaactattttatgcgtcttttagctggtaagtaaataatttaaaaacattgtttatattgacttaccagaaacagcagaa

SEQ ID NO: 64093 - DNA, 1015 bp, Homo sapiens
agtagagacggggtttcaccatgttggccagcctggtcttgaactcctcactgcaggtgattgcccacctcagcctcccaaagtcttgggattacaggcgtgagccactgcgcctggcctaattttatatttttagtagagacggggtttcgccatgttggccaggctggtctcgaactcctgacctcaggtgatccgtccgtcttggcctcccaaagtgctgggattacaggcctgagccaccgtgcccggcctaatggttttatatgtacaggcagcagtgctactttctcacttgctttatatgaaaaagtgatcttgcttttggtaagtttcttgatattttgtgtgtgtgtgtgtttttttttttttaactcacactaccctggatcacttttgggattgtcacaaaaggttaactattactgctgtatgtgatataccttacttataaatggttcatttgattccattttattaaaagtatttaatgaaaatcttaggtctggaaaagtgtaaaataatggcatatttgtaagataatttggaatgtttagaaattaagcaaaatattttaggaagaccagagtagcctgtagtttagataacattccttcaccaggaatattttgaagtactgttctgaatttgggagaaggaaagtccctggatacttcggctgttagatagcaagttattcaatgatatagcttgttaaagatctgaaagagtttgggcgcagtggctcacgcctgtaatcccagcactttgggaggtaaaagcaggaagaggatcgctcgtccaggagtttgagaccagcctgggcaacatacaaaaaaaatttttttttttagccagagcctcgctctgtcacccaggctggaatgcagtggcgcagtcttggttcactgcaacctctgccttctgggttcaagcaattctcctgcctcagcctcccgagtagctgggactgcaggcgcccgccaccactcctggctaatttttgtatttttgg

SEQ ID NO: 64094 - DNA, 1236 bp, Homo sapiens
ctctcgccttgggggcgacagtaagactgtctcaaaaaaaaaaaaaaaattagcggggtgtggtcatgtgcacctgtatgtagtctcagctacccgggaggctgaggcaggagaatcgcttgaacctggggaggcggaggttgcagtgagccaagattgcgtcactgcactccagcctgggcgacagagtgagactctgtctcaaaaattaaagaaaaaagaatgctagttgggataaatgggaagtgcagtgctatacaggctaatgaaaacatccaaaaagttttagaatttaagtcatcaaattccttaaagttcaatataagggagtgatgagaaataagactggaaccagttatgaagagccttttgtgcaagccaagcaatggaaatgtattggagcctctttgatctgtaattttaaagtatatttatttgcagaagtttaaaatggactttttttctttgtaggcacacaagtctctgaattttgtctcaacactgctccagattactatgtcggaacagctggatttacctgtgagacaggcaggcaagtttcctaaattatattgagtgtatgtaatctattgtttaaaaggttcataatcgaatagcagaagtgtcttgggatggccctttggcaattttttccccccaggtaatttgtttaccttcagtgtttacagctaacatcaggtaccttgatatctggtggcagagtttaaaggaataatttgacatttagttgaattaaaatagaagcttcaaatagaaattgatggggtttattaaaaggttctatgtatttttagagtccttccctgatgggtgattataagactcaaacatgtttgtttatatagtcatctcttaccacctttttgcttttatcgttttaacagtttaaaaagtattatactatttttagttcctgttcaacatattgagccacttccctcagtatcaaatagtctgaaaatgtggcatactacttttctgaatattatgttagtctgtaaaaaataatgtagtgtacatttttaattttttttattttttgtaggcagtctcactctgtcctccatgctggagtgcagtggtgcgaactcggctctctgcaacctctgcctcccaggttcaagcgattcttctgccttagcctcctgagtagctgggattataggcgtgagccaccactcccagccttttcatttctttttaatttatttgcag

SEQ ID NO: 64095 - DNA, 1894 bp, Homo sapiens
tgttggtcctatttgattctttattgtaggtgtagtttattttaaaaccttggctcacgcctataatcccagaactttgggaggccgaagtgggtggatcacgaggtcaggagagcgacaccatcctggccaacatggtgaaaccttgtctctactaaaaatacaaaaattacctgggcatggtggtgcatgcctgtaaacccagctactcgggaggctgaggcaaggagaatcgcttgaactagggagtcagaggttgcagtgagccgagatcgcaccactgcactccagcctggtgacagagcaagactccatctcataaaaataccttgttgaggggtattttaatatataatcttaatctatttgaattactataatatggaatatttaattcctaaattaaagcaaactagaatataaaaatcctatttctgtcggttatccttgttcaaataagtacaggacttgagataagaattgctaattagagaagatcgagtgttttgcagaatttaagaattaattttggacagtttccctttacagtacatcttacagatttgtgactctgttctcccccactctctgaaagtgctgggtaaaaagctttgctagcagcctggattttaccacttcatcagtttgttaacttttgtcaaatagcaatgtgcaaaggtagcagtatgataactgacagaaaaatagcaatctgtaatttctgaacacagtaaattctcccataacataatttgaatttgaagtggtatgggattgaaatacttaaatttatagattaagaacctttatatgctattatttttctgtgataagaactggtttttttattacctttgtgtgattagttgtagaagctatgttgggatatgtatgatggttttgtctttagaggcttcatttagaaaactgatttgatttaatttaactctcctgtagaaaacagggttaaaagtgttgtgacgttaaaaaaaaacagttttctctggggttgtttatttgcagagttttcttatgctgtgtgattcgtaataactttgtgcttgattgctgtaacagtgttcaatttgtgcattatcaactttaaaaataattgaatgtagtattttgttaatgaaagcatagctttacaaacggtagtgtgaaagaaatacttgaggtatggacacttgtgggattttcacagtactttcacagtaaacattcttttgtcaaactgatctgtattttaggtgttatctatctgaaaaatatgataacacagtattggcctgatcgagaaacagcaccaggggatatatccccttatactattccagaagaagatcgccattgtattcgagaaaatattgtagaagccattatccattctcctgagctcatcaggtatgtatttttaaaatttacccatttctgcaggtgtgtaactttcagggttttttgttttttggttttttttttttttttttttttttttgagatggactttccctctgtggccaggctggagtgcagtggcacgatccttgctcactgcagcctccgcctcccaggttcaagcaattctcctgcctctcagctccacgagtagctgggattacaggcacatggcaccacgcccagctaatttttgtatttttagtagagacagggtttcaccatgttggcgaggatggtctcgatttcctgacctcgtgatccaactgcctcggcttcccaaagtgctgggattacaggcgtgaaccactgcacccggcttttctggggggcttttgggggcttttcagaacatataggcctgttttttttgtagcagaaaacttacccaacagatgctgttgtaggagaatgccttagtcatttttttttttttaag

SEQ ID NO: 64096 - DNA, 1012 bp, Homo sapiens
tgggccgggcacagtggcctcagcccccggagtagctgggattacaggtgtgcacgaccaggcccagctaatttttgtgtttttagtagagatggggtttcaccatgttggccaggatggtcttgatcccttgaccttgtgatcttcccgcctgggcctcccaaagtgttgggattacaggtgtgagccaccgcacccagcctaattgatgttctcaaatgaaacttgtttattgatgataggaatgaaaaataaaacacctgtatttgtaacatttgctggttttcgtttgctcagtgacttattctgaatcatatatattctgtgtacatctaaaatcactgggttattttgaaattagattttgtctaaacagctattttcctttctatgggttagcaaaatcttacctagttaggattttttccttactgtttttttttggcttccagggtacagcttactacatgcattcatcacatcatcaaacatgattatccaagccgctggactgccattgtggacaaaattggcttttatcttcagtccgataacagtgcttgttggctaggaattcttctttgcctttatcagcttgtgaaaaattatgagtaagtgtttctttcaactcctatagagctttgagaagtaggaaaagttgggaaaatttaagccaatttgaacatgtaaaattatatttagcatagataataaaattagtgaattatatggtaatttcaatttattattttctttttgacatagcattctaactccgcagttgcttttctttattctactaagaaactccttgcacccttttttcttaatcaccgtctctttacctattcaaaaactaagttgtctctaaagacggcctcctcaatgtgtgctgataaaagtccttcaggtaagtttttctaaaatgtgaaggtgatcagaatacattgaggattaaagctctttattacttgtggcttttttttctgtgaatttttatcttaatttaggc

SEQ ID NO: 64097 - DNA, 1691 bp, Homo sapiens
ttataccatgatcgtgactttattgccagtcttaacagctacacagatgccattgtgacccctctaattctgggacttgcagttagcctccaataccctctttgggtcccatctcaaagtggctgatgaactgctgcttttattctctgagcaggagagaaatataccatttacagcattggtactggtgttttcttgtgttcccaccagctacccatcttcctgctaaggaatgttccagctgttacagttctggtaagtgagtgactaaaattggagagaataaaaacaataagctgtcaatatcattgaggaggttcaaggccctcctgtcccataatcttagcaggagggaatatgacagggatttttaagtgggagatacaggaggctgctacatcattggaattcagttcattttcagccagtgttttcgttgtgaagcacaaggtgttcacaagggatctgtgtggactgaagcagttctaagaaaatttacagagaaattggaatttttggtggtcctcaggagcatagatcctcaggaaatgcttgtcagttgaaggaacacaaagaacatatgaagaggaaggcgtgtcacaccatatggagtggtatgaacaaagaaagagatggaaatgtgagatgctgtctttagtgggtagtgaggagactgcttaatggtgctgataatttccagtgagaggttgggaatagttttggactggtaaattgggaccatgttaaagagggttttgagtgccagaatgggaaatttggatgtgatcttttagatactgagaaccactgaaatttttttttaacagaatagtgataagactagtatttaaggattttctatgagtatggttctgcagtttgacacatcacagccttgtggtagtagaattttattagtgtcatattttcatcctttcaggaatgttcaggtcttacagggtagtaataagtttggtaccataattttttactcattagcttagattaacaactagtaccactcaactcccagtccactattcagggtattgagggaggtaggagagaatatctgatgtagaacaagtatttaaactctcttagggtgggtgatggacctgtgatgcataaatagagctgcataatattagttctcacttttagtgtttaaagggaattttgtgtataattgtagtttgtataatcagattggagagtgcaaatggctttcttttgtgaattgttattttgtcaactcaaaggtatagataaccttttaaaatgtatgctaggtataatttgttagcactttaaagtaatatttgaaataatttgtcagtagatagtgttaatagctttagcagtcattgttaatgtgaacattcctttttgtattttttattcctggtgatttactttgttactcatttcacctggtaggaaaaaaaatagcttttaaaaagagtctcccagtatcattttaaaatgtactcagatactcaattctttatattttctctcttaaggaagagggataccaataaatacaactgggatgtgctatggaaaaccaatttaaagctgttttgataatatctgttccaaaaagataagctgtggctcttagaataatgatttctataatcagtaatctgtattttaaaaatttagtctgcctattgactccttaa

SEQ ID NO: 64098 - DNA, 2424 bp, Homo sapiens
tactttctcaactcattctttgagactagcatacctgttgtaaaaatatagccccgtctcacttgtgaaaatagatgtcctaaaatcccaaattggataacttttttattggcctactgagaaataggatttatcccaggaatacaagaatggatcaacagtaagaaattagtttttgtaattaacccttacatcacgttaaaatagagacctgtaaacatctttatggatgtcagataaagcatttgataaaattaaataaccatgtctgctttgaaaaaaataaacaactgttagaatcctagaacagaatctttcttaacttgatgaaaggtgttcattagaaatctacaataaatatcacaccttatggtgaaaataaaatatcccagtaaaatgggaatatggcaaggatgcccactcactgtttaccattatagataacaagcaaagaagtttgcctatgtactaaaagcaggaaatgtggattgaatgaaatacttttggtaggtattgtgaagagtaaaaagaagtaggattttctttagcaaggatttcgaaatattaattcttgacttttatttagtatacactaccactggaactgataaaccaacagaacctgacagaatggatagaaattttaaagactgttgtgaacagggatgtacctaatgtaagtttctgtatgttctcttatattactaaatgtaaatatttaatgatcttttgaagactttaactggtgtttcctgtaacattctttatgaatttttataatatggtgatgtatttttttctagattagaggtaccttttcatttgtttatatatgcattacatctgtacatttacttagtgtaaaaagttgtaaagggtgtttttttaaatatattattggtttaatttcttctgttgtccttttgtttcatcctaaatcttctgttccctctcagttcataaattaagagctcatagctggctcttagcctagttaatttgtcagatgcccacgtacagaggaagaggaagaacttgatttacagattggccaacttttgtagttatgttattttttcttaataactctattgagaaataactcacatacagtaaaatttattcttttaaagtacaacttggtagtttttagtacattcagagttgtccaattgtgttatttgtataatcaaactttttaaaattattataatttttctttatagtctagttttcttttttcttttttttttttttaagctgaagtttcgctcttgttgcctaggctggagtgcagtggcgcaatctcggctcactgcaacctccgcctcccaggttcacgcgattctcatgcctcagcctctcaagtagctgggactacagacgtgtgctaccaagcccgtctaatttttgtatttttagtagagatggagtttcaccatgttggccaggctggtctcaaacttctgagctcaggtgatccgcccaccttggcctcccaaagtgctgggattacaggcgtgagccactgtgcccggcctatagtctagttttctagagatataggggaatttacagattactgaatacgctgttttgttttgttttgtttttttgagacagagtctcactctgtcgcccaggctggagtgcagtggtgcgatctcagctcactgcaacctctgcctcccaggttcaagcaattccctgcctcagcctcccaagtagctgggattacaggtgcctgtcaccatgcctggctaactttttttatttttcatagagacagggtttcaccatcttggccagggtggtcttaaactcctgaccttgtgatccacccgcctcagcctcccaaagtgctgggattacaggtgtgagccaccgtgcctagcctattttacagtgtgttttatgtactgttattaatatatacttatttaaccctcaaaatccttctgacttttattttaaacttacacatgggagggttatgtaatttatccaatataatattgttaatcgcataagtgagaccaaagtcctattttgtagtttaatttttttaaagatttgtttcaaaaaggtttatgaacaatgcagaagaaacaacatttctacaccctccataggaaactagtttggtgtatatttttctttgcacatttaatagatataaaatataacttttaaagttctcatatacatattgtgcacctttttgttgtacaatttataatccgtgcaccgattataaataaacagttcagtgagttagcacaattattatgtacccatgtagccatcacctcagaatgtttgctcatggctggttctagtcatctctggcatcatctcattcccggcacaatagatttaatctgttttagaacttagtaagtaatcttttgttcctggcttctt

SEQ ID NO: 64099 - DNA, 1005 bp, Homo sapiens
tcttttataaccaactagtgaagcagtgaggatgcctctttgatttaaatagggttaatacttttccaagtctaaccttctactatgaaaggccaacatcaggccaggtgcagtggcgcacgcctgtaatcccagcactttgggaggcggaggcgggtggatcacgaggtcaggagatggagaccatcctggctaaccccgtctctactaaaaatacaaaaataaaattagctgggcgttgtggcggccacctgtagtcccagctacttgggaggctgaggcgggagaattgtgtgaactcgggaggcggagcttgcagtgagctgagatggcaatagagcaagactccatctcaaaaaaaaaaaggccagcattagtgaagcattcacatttttgtcaatctattctcatctcatgctgttcctcctatattgtattatctctatcattaaataagtgtctttttaaaggaaacacttcaagttgaagaagatgatcgacctgagttaccatggtggaaatgcaagaagtgggccttacatattttagcaagactttttgaaaggtaatctcatccatatatggtgatttaaattaatttattaaggttttgctttaaagtgctagcataaagcattataaagaaacaatgggcattttgatgttcttttagatatggaagccctggcaatgtttccaaggagtataatgaatttgctgaagtatttctgaaggcatttgctgttggtgtccagcaagtaagtctgtttttagtttttctcagtggaaacatggcatctttaagttaatttatatattgcttattcccagtttctttgacatctaaagagtgcctgtttggaccctgtaccaggtctcaaacatttttggtctcaggatctctttatgttcaaattacttaggataccattgggttctcatttatgtgagttatacctagtaatatttatcatattagaaattagagtaaacagttcattaaaa

SEQ ID NO: 64100 - DNA, 1304 bp, Homo sapiens
ttaattttcacaggccaggtgcggtggctaaggcctgtaaatcccaacgtgttgggaggccgaggcaggcagatcgtttgaggtcaggagtttgagaccagcctgaccaatatagtgaaaccccatctctactaaaaatacaaaaattagccgggcgtggtggcaggcacctgtaaaccagctacttgggaggctgaggcaggagaattgcttgaacctgggagatggaggttacaatgagccgagatcgcccactgcactccagcctgagtgacagagcgagactccatctcaaaacaaacaaaagcattcaatttgtacagaaaagacattgaattctgcttttgcaaaattataaagggatctgggatcattttcataccttatgtaaagattaagcatgttttttaatgctttgttgaagaaattaatgtttattgtcttaattttaaacttgttctctagatgtgtttgaagatttcatttctcctaccactgctgcccagacacttttgtttacagcctgtagtaagaggaaagaggtaggcttatttaatgtttagataacttttctgtattatttaaaatttattcaactatacactttttaaatgttagtcatgtgagtcattttgttagtatgttttttaaggactgttggcctattcagtaacaatacttttctcttttaatctaggtactgcaaaagactatgggattttgttaccagattcttacagaaccaaatgctgaccctcgaaaaaaagatggagccctgcatatgattggctctttagctgaaatacttctgaaggtattctttagtgtgtttgtatgtgcatgactatgcaagtagttttaaaaaataaatagccagccaggcacagtggctcacttctataatcccagcactttcgggatgctgaggcaggcagattgcctgagcccaggagtttgagaacagcctgggcaacatagtgatacccccatctctataaggataaaaaataggccgggtgtggtggcttatgcctgtaatcccagctatttgggaggccagggcggggggatcacctgaggtcagcagttgaagaccagcctggccaacatggtgaaaccccgtctctactaaaaatacaaaaatccgccgggcgtgatggctcacgcctgtaatcccagcattttgggagaccgaggtgggtggatcatgaggtcaggagatcgagaccatcctggctaacacagtgaaaccccgtctctactaaaaataaaaataaaaaattagccgggcatggtggctggcg

SEQ ID NO: 64101 - DNA, 1919 bp, Homo sapiens
taaaaacgtgaaaatgtgtttagtggtttttggtggtgaagttctggaatacgaaaattggttgtggattctggggttcaaagaatgagaataaatatatgtaacattaatagtcatttttaatagtgttatatctgtttggaaattgagatgattatatttggaactgtatcaaaataactgttgtttatatttacagaaaaagatctataaagatcagatggaatacatgttgcagaatcatgtattccctctcttcagcagtgaactaggctacatgagagcaagggtatgttttaaagctgcattatttatatacttttgtcttgtaatgaatgactctgtggacttttatattgaaacttttaaatgttcactttgaagcctgtgtcttattttaggtttctgtttaatgtaaatctttacatggctgctgtaatgtgtgcataggtttcatctgtgtctggtagcagtgtctgtctgtgtttttcattcagatcttgctatccacacaaacatcatgcggccaaagagtaacttgggatcatagtactggtctagtgttgtctctggacacatctaccactggccagcctccaaattcccacacacagaactcagggaatagagattagcttgggggaatttaaggtaaggtatctacagtaactcactgtgtttttacaaaaggcttgctgggtacttcactatttttgtgaagtgaagttcaaaagtgatcagaaccttcaaacagccttagagctaacaagaagatgtctgattgatgatagagaaatgcctgtgaaagtggaagctgccattgcccttcaagtattgatcagcaatcaagaaaaaggtaaaggatttttgtatgtcaagaaaagtgaatgttggccaggtgcggtaggtcacacctgtaatcttagcacttcggtaggcttaggtgggaagagcgcttgaagccaggtgttcaagaccagcctgggcaacatctctacaaaaaaaatttttaaaaattaactggacatagtggcatgtacctgtagtgccagctacttgggagtctgaggcagcaggatcactagagcccgacggttcgaggctgcagtgtgctacgattgccactaccctccagcctgggcaacagatcaaaaccctgcctcttataaaatatatatatatatattaattgtaaaaagccataatcctagaaacttggcatacttcctttttatgtgaaagtacttttttaaaaaactcatcgatatttgttatatcaggttttaagaagttttaggggttttacgcaagttttttactctttctcttacagctaaagaatatatcacaccattcatcagacctgtaatgcaggctcttcttcacattataagagaaacagaaaatgatgaccttaccaatgtaattcagaaaatgatctgtgaatatagtgaagaagttactcctattgcagtagaaatgacacaacatttggtatgttgtttgaacctaccatatttgcaagcattttaatgtagctctcagtatgttccaggttgtgtcaccagtggcttgccttaccttatagcagtcaacctttttggcacctgggatcggtttcatggaagataatttttccacagatggtccgggggagatggctttgggatgaaactgttccacctcttatcagacaggcaatggtttctcataaggggtgtgcaacctagatccttgaatgcacatttcacagtagggttcacgctcctgtgagaatttccggcagtaatgctcactcacctaccacttatctactgctcctaacaggccatggaccggtaccagtccactgcctggagactggggacccctgccttatagtagatatttcacagacattactgtgtagcacgtaaagc

SEQ ID NO: 64102 - DNA, 1009 bp, Homo sapiens
gccttcatggtacttgttcttaactactacctcgggctgcagcatgactatctgcatagtgccctggaatgctcaaaataatcgattgaattttacaaaagataaatcagtgacccccttgatgattaaatatacttttatttggacattgtcaagtgttaaccagtaatattaatgaaaactattcataatattaagtactttttataccttgcctcatttagtcctcgtacggtgtctatgaaatccccgaagtggcatgcagaaaaggtcaagagaagtcaagtagcttgtttaaggtcacccaatgagcagactatttgattatagagcttaagctctttattatcattaatcaatttggagacattgatttgttgtggtatcccaatgagaacgttctaagaattaaaagtcttagaccaaaacatatttataatgcttcagtgacaaacttgagttatattctcttgaatctaggcaatgacatttaaccaagtaatccagacggggccagatgaagaaggtagtgatgacaaagcagttactgctatgggaattctgaatacaattgatacacttcttagtgtagttgaagatcataaagaggtaagaagatgatctagtgttgcagtttttcaagccattttatgctttttagagggctctaatatctctctggcatctcatgtaccatgtttttgccattttcccttttataaagataagattggtacattatattttaagttctaaagtattagtagaaggaataggaagcaggtatttgttttaccatcttagggctcaggattttggctcctcgttatgttttctcagatccagaaatatggtggttcccagaaaaacaaaaatatttttcttagttttctttttctttgaaaaattttggttatacacatagcataaaatttacaatcctaaccatttttaagtatatagttcactaatattaagtatattcacattgttatgcaaccatcactac

SEQ ID NO: 64103 - DNA, 1032 bp, Homo sapiens
gacctcaggtgatccacccaccttggcttcccaaagtgctgggattacaggcgtgagccaccgcgcccggccaactcctttattttcatagttgtttgcatttttcgagaatgttgttttttcctttttaggtaaattaagctagccattccttgtgtttttctcattgtaatggtatttcattctatttttatctgagatcacaatttcataatgtgtaagtcattttaaaacaaagacttatttttttcacaatattgactttatatttaagtgtactgaattataatatgcgttgtcttactaagtcatttagtaggctgtaactgcatatgattttttttcttctcttttagataacccaacagcttgagggaatctgcttacaggtcattggtactgttttacaacagcatgtcttaggtattatacctctgattgtgctaagaatttagtgctatttcacatgagcaagcattttcctaatgacttagtattctcttttagaattctatgaggagatcttctctttagcgcacagtttgacatgtcaacaagtgtctccacagatgtggcagctactaccccttgtatttgaagtctttcagcaagatggctttgattactttacaggtgagtcaaagcagcatggaaatactgagggttttccctgctttgatttatttgtagcttatcatttgaacatacactttttttttttttttttgagtcggaattttgctcttgttgcccaggctggagtgcaatggtgcgatctcagctcatcgcaacctatgcctcctgggttcaagtgattctcctgcctcagcctcccaagtagctgggattacaggcatgcgccaccatgcccggctaattttgtatttttagtagagacagagtttctccatgttggtcagactggtctcgaactcccgacctgaggtgatccgcccacctcagcctcccaaagtgctgggattacaggcatgagccactgcgcctggcctgaacgtacacttttgaatgttc

SEQ ID NO: 64104 - DNA, 1060 bp, Homo sapiens
tgatttgctccatgaagtttttagatttctttcactcatctctttcctttctgaacacgaagtcacacataatcatctagttatgttagtcattttttactgccaattatattatttatattaatattctgggagcagagatatacctatactatctacatttctattcctgaacacttattcatatgtttatactcatctagttttcactagccttcaagtccatgttcatttcttgtctggagtttatagggcaacatttgccctcaacaggctgcctcttcctccctccgttcctctctcccctactggttttttgtgttattgttgttttcttttttaaagagaaaagggtttcctagaaatgtcaacatcttagctttttgtagttctttacgtgagaaaggttaggtgttttagctaccacctgtgtatgagaagttagtggttgtcaacttgctgtaatccagaatggcactacaggataggtgctttgatcacaaagaccaagatgccagagggctagactatgaaagataggaggcagacagctccagatcctcacagctatccagatcctttagtctttcatctgtgcaatgaacattgcagttattcatattaattagggtacctcaagtaatactcagagcctgtacacagggtaggaaattgtttccttgatttagatacctgatttaaaggataaagccttactgcaatttatattctgttttgatcaggttcttacaggagttgcaggagaagatgcagagtgtcatgcagcaaaattgttagaggtcatcattctgcagtgcaaagggcgtggcattgaccaggtcagtgaagctaataatgatttgtagttcagaggggtaatcttttccttccactttctttcttcattttttggcatttgttgcatattctgtatgtttttgtttattgagacatctagacaactaatatttttagttcaaaatgtaactaatatataataatgatcatatgtttaatgtacaggaattggactaagttttatggctactttgttatcatg

SEQ ID NO: 64105 - DNA, 1498 bp, Homo sapiens
cgctctgtcgctcaggctggagtgcagtggcgcgatctcagctcactgcctctgcctcccaggttcacgccattctccttcctcagcctcccaagtagctgggactacaggcacccgccaccacgcctggctaattttttgtatttttagtagagacggggtttcactgtgttagccaggatggtcttgatctcctgacctcgtgatccgcctgcctcagcctcccaaagtgctgggattacaggcgtgagccaccactcccggcccgtcgtgagcttttaatagctccatgaagactactagactttctctaaaattagatttcccagtgcagtgcctcagcagtaaatattggtcatctaatgctacaatagggttaattgaggcaacaaagaagttaatatttttagaatgtttgcatgctattaattatagtcttagaatatcttgctatctttttttgtagtgcattcccttattcgtggaagcagccttagaaagactgacaagagaggttaagacaagtgaacttcgaactatgtgtctgcaagttgcaattgcagctttgtattataatccacacctactactcaataccttagaaaatcttcgcttccctaataatgttgaaccagttacaaatcattttattacacagtggcttaatgatgttgactgtttcttggggtaagtgatgtattgcaattttactacatttgctttgggaggaactctgcttatttaagaaaagaaaacagttttttttttttttttttttttttttttttttaggcttcatgacagaaagatgtgtgttctcggactctgtgctcttattgatatggaacagataccccaagttttaaatcaggtttctggacagattttgccggcttttatccttttatttaacggattgaaaagagcatatgcctgccatgcagaacatgagaatgacagtgatgatgatgatgaagctgaagatgatgatgaaaccggtaagggattttcaatggaagaagacaaaacttatctacttagaaatattaccgcactgggccgggcgcagtggctcaggcctgtaatcccagcactttgggaggctgaggcaggtggatcacacggtcaggagttcgagaccagcctggccagtatggtgaaaccccacctctactaaaaatacaaaaattagctgggtgtagtggtgggcacttgtagtcccagctacttgggaggctgaggcaggagaatcgcttgaacccatgaggcggaggttgcagtgagccaagattgcatcactgcactccagcctgggtaacagaacgagactccatctcagattaaaaaaaaatatatatatatatcactagcccttctcccaaataaatgtgggatcatacccaaatgctttcattcacagaaaagacttcctttcttctcactagagtgatgtaatcaggaacttcagctgtattaccaacatgtagaacagttcaaa

SEQ ID NO: 64106 - DNA, 1220 bp, Homo sapiens
aaagatttatggtcttaatgttgactaaatttattggagacatccatcctatcatctattaattctaaaacctaagcatacttgcactataacattatgttaattaaatgttgataaatacattttatctataagactgtacactatcagtgtataaattgataaaatattaagagaaattattataagggtttcaacataagatagctattgctatttttgtcttttatcatttactaacttagccagccttttaaaaaaaatcttacaaaaggtttggtgggtgtaacggtagtgtgttcatactgcgcagttctttttcagatgtctagtattaagaacacattaaatcaaggttggttttcttggactcctatggaaattttcatttctattcattattgaacatgtatttaaacaccaattcctggagctctctcttgtcacttgtgacttgtaatttactgacagtgattgagatgattgtcaatttgttgagtaacaaaatatgtcattgttataaaagtacttatattatgacttggcagaggaactggggagtgatgaagatgatattgatgaagatgggcaagaatatttggagattctggctaagcaggctggtgaagatggagatgatgaagattgggaagaagatgatgctgaagagactgctctggaaggctattccacaatcattgatgatgaagataaccctgttgatgagtatcagatatttaaagctatctttcaaagtaagtcaacttgttacatgtggatccatttcattgaacaaatctgttgtagtttctgcctgccctttaaaggaagagtttggaggatatcaaacccagactagaaaaggctggttaggcaaagtaaccaaaattatttctaaggttgccatagtttctgagtattctttattcatcctgttattttacatttagattgtaattttggaagattataggaaaataatgtagttcaaaaaagtatacagtgacagtgcctctttgctacttctgattcccaatctcccagctttcctcagaagtaaccactcttacgtgtatacctgtttgttgtatgttattatttgtgtgtatccttttttcctgcccaaacctatacttaacgtgttaagagtatattagcatttatggcatatgatcttataattctttttttcctatattctgtgatgtgttaactaattt

SEQ ID NO: 64107 - DNA, 1107 bp, Homo sapiens
gaggtgccaaacttgttgtttctgtgccttgtactttgtagacagacaccacatgtcagtccctaaagaatggttcctaacacggggcccatgtaccacagtagccttgatgattttcaagttgctttagctctgaatcttttaagatggttgggttagctttattcctgaagtctccctggtttgttacttactatataagaactagttaggctgagtccttatttgctggagagatggatcgtaagaatgattagagtttttggagccataaagataagctgtagttaatttttattcctatatctgttgtttcacaaatatggtaattttaaaaattattgggagaatataaaatagatcagaatttcagtattgcctcgggatggagtaggaggaatagtgtagaacggagctaccaagcctctcttattcatgttgtttttcccttgtttttattttttgatagctattcaaaatcgtaatcctgtgtggtatcaggcactgactcacggtcttaatgaagaacaaagaaaacagttacaggacatagcaactctggctgatcaaagaagagcagcccatggtatgttaattaactgtaactcctctttaattagtgacttttataggtttaaaattttatatcgtttaattttatatcattaaattttatcatttaagatgatataaaaggtatagttgttgcaggtgataggaattaactctaatctgagggatttaattcaagataacttaattttggctttggctacagttggcttttttcgtttttttttgtttgtttgtttgtttgtttgagatggcgtcttgctctgtcgcccaggctgtagtgcagtgatgcgatgtcagctcactgcaagctctacctcccgggttcatgccattctcctgcctcagcctcccaagtagctgggactacaggcacctgccactacacctggctaattttttgtatttttagtagagacagggtttcactgtgttagccaggatggtatcaatctcctgacctcatgacccgcccgcctcggcctcccaaactgctgagattacaggcgtgagccaccacacccagccccagtt

SEQ ID NO: 64108 - DNA, 2183 bp, Homo sapiens
tgccgctgcactccagcctgggtgacagagccagactctgtctcaaaaaaaaaaaaaaaaaaagatttttttcttaacagtgggaagtgaaaattggctaagaagtctacagcatacagtaaaagagattatattctctacataatgcatgctcccttgcccttatacattggagaaatcatggattttggaacttcctggccactaatgatggttaagctactggcttgtttaatgttttgtcagtttctcaccaagttagtagatgattgaatgccctactaaaattttatttgttttctagaatccaaaatgattgagaagcatggaggatacaaattcagtgctccagttgtgccaagttctttcaattttggaggcccagcaccagggatgaattgagttatctctttctttcctgctgtgtgcttgtagtgaagagcttgtgttcctcctagtagtggttccagaactggttcatgttatctattctaaactaataatcaatagatggacaaaagaaacaacaaccccaggagatgggacctgatcatgcaacctggcactggaaaagaaatcagcgggattttgggggtggggggggatgggaggtaccttagagggagtattttctttattttttgaagaaagtaagatcctgactctgaagcttcaaagtgacactgtggaaatctgaaacgaggggatgtcatgaaggcagcttttctttttctgaggaaaaaataggcatgggctacaggactatttaaaatgtctcatttacagtataaaactcaaaggtagatgtaatttttacacctatgagtatttgtccaatttctgtctcttcctcaccattgggtatctattctttatatgtaaataagataaggtcatctgatagccttattcagtcttcatcattttcatcattgttcctatgtagattattggacatttattgtagcactacataactgattataaaaatctgtaaatgaattagcactttcatattgaaacaagcctgctagcctatgtataaaatagcaaaatgtttgctgtttataaaaagatgtaatggggtggggggcaggggtaatttcaagttattaatttaaaaatgaactagcaattttgtacctggtgactttgtggtgcactcacctctgatagtgacttgaattcggtatgtaaaaaggggttagtggtatttcattgctgctaaaaatgacaactccctctgtgtcctgtttttcttaaagctgtcagtgtacaagtgggtatttgaataccagaccttactgtaaaaaataaaaaaggtggtatctagagcatgtaaattggatataaagttctgctcttaaagagttgatctaagagtatggctaaacatctatatatgcaatctattaaaagaacttaattcggctattatgtcttgatttgattgcagttttttcctaattataacaaatttttcctcattggcctgtttttaatcctgtgcctagaaggagtacaaaatgcacactttacaaaattgatatttaacacttacccactcccctttccccatctcttctaccgctcttgttgatcgtggtatctgatcttgactagataggctgaaggcacatggttccctccaaaaaccactattgataccactacaaaaacaagccagcaaaaagatactgtagagaggttggcttgcttccctctcttcctaactgcatgttgaaaaataagccgttattgatcttaaacatcggtcagatgagtcatacattgggttattttttatatacatgtatacacaaaatatttcaaattgaaagcaacatcttaatggattcaaaactattacaagctgttgtctaaaacaggtgagaaaaaaatttataactgtaaaaacaaatgcacatattgatatttaaaatgcgtaattaagaaaacccattgttgttgtgtttttcttgtataccaataattaagccactactgttggcactgtttggttttctattttaacactgaaggagtgaaagtatttcctatatttatgaatttactactaaaatcttggcaaaaaaagaaaaaaattgtctaacgtgtgtgggtgaaaactgttaatcaagtgtttctactcccccccgaaaatcccctgaaagttggacacc

SEQ ID NO: 64109 - DNA, 1024 bp, Homo sapiens
atcagacttaagtttgcaagactctttttctaagcttcctcaagtctcttccttaaatgttgatatttcaggttatcagaagttcctatattcttttttttttttttttatttttgagatggagtctcgctctgttgcccaggctggagtgcagtggtgcgatctcggctcactgcaagcttcgcctcccgggttcattccattctcctgcctcagcttcctgagtagctgggactacaggcgcccgccaccatgcctggctaattttttgtgtttttaatagagacggggtttcaccgtgttagccaggatggtctcgatctcctgacctcgtgatccgcccacctcggcctcccaaagtgctgggattacaggcgtgagccaccgtacccagcccagaagttcctatattctagaaaatagtctataatataataatatacattttatttaaaaacaaaactaaactaagattgtttttccaagaatagggatggatttctgttttctctcacatgatccactgggttttgtaacctgttggaataatggtatataaatagctgtggaacagaacaaaaaggaatgaagtaatgtctgtcatggaaattacacgttgatgactgtagccatatgagtgcatggattaaccactgaattgagaagtactcttagattagcatattatgtcctttgagggggaaacattttttttttgctctctttctgacttcatgggaggtagaaagtgatgaaagacgagagggaccaggaatcttcctggttgacaattatagtagtaatggattgttgaaattgctgtttacttactggttctttatgaaataaagaagtgatggaggttccttttatgtcactaaattattaaccatacctcagataatatgccatacattgtctttacacagtgaggtcattgtgtactgatggtttgcaatcaatcagttgtgctaaagaccaagtttagtatcagtgggtgtgtttgcaaaccattctggctttg

SEQ ID NO: 64110 - DNA, 1037 bp, Homo sapiens
ttgcttagtattcaatttttattactgttttttaaaaataatgaatcatcaaagtttaaccacaggctggtgcccgggataacagtactgtaattggaaatggctttactctgaaaattaggttagtgggttggtgtaaattatttatttttgcttatgtacttttgttttaaagcttatttaccccaaagtttattattaattttgaatacagcaatttttaaaatgttacttttatatttatttatttatcatattggtggggggttggggggaaatggtgcagaaaatatcgcaaatgtaatggaatgtaacctaatacacatattgaaaggatgttgtttatcaagtacagagtaagtgcttttccatatatttttatatattcacaacaattttgtgagacatatgggatttactacctccgttttttacatgaggaaaccaagagtccaggagggaggctgactgtcgtaccagccctcacagctatggagaggcaggaccaagacgagaacccagactttctggctccaagtctagtgtgttttcactgcaccacagttacctcctcaaatgctcatttgtggcagagattatcaagatgaactttggtgatttctgattgcctaatgaattgagcagtataaaaaccattttctaatgctggaaaatcagcgttcaccaaggtcaaaaaaaaaaaaaaaaagatggtgtgttccgcagcagcccctcctgcactgtagttcagcgagctttatttgcagagagctgaaatgtggctttttcatttcaagctttacagtagaaaggggaaaacgttgtgctgtttgattttacataaatgttatctttgatcaggttctatgatcttgctaaaaaggatggtgacttacttgaaatcggaagcccttcagggttgggcagaacttttcctgcagaaccctttacagatgcataacattagcaaaagccctagtcaaccaccgatcgagtcttcattcttgacagagacacagacccacacagaactcccc

SEQ ID NO: 64111 - DNA, 1142 bp, Homo sapiens
gactcttcgacaccccgcacacgcccaaggtgagagcggcgggcgcgggcacccggcggccggggccgcggcgccggaggggccagcgccgctgcctgggttcggttacagaagcggccggccgctcccccctcgctttcctgcgccgccccccaaagttggcagcccttgtgtttggccctgccccgaggttgtccgttgagattatgtaactgaacaatgggcctcgtctggaacttcatcttacaaaggggccgatcggcccgtccgggtggccaaggatttgccgcccgttgagtccgggccgccccgagcgtgtcagccccgagtgcggcaccgataacgcggttcgcgaggatgctggagggtgccggcccggccacctgacactcccgagccataggatgccttttaaacgcggcgatcgggcctgtaatttgggcggcgcgggcagaaggagtttaaagaaaaataattgtcccgccctgatcgtgtcgtgtcgtgtggcgtggatgggggaaaggtctggggcatgcagggagactacgcttggacttgggagtaaaggctggccttccaagcatttacagtcctacagactcatcctaagtccaggcagtactgaggcctgtttctggacaaggtcttggcccagcatttgtttttatcgtgggtttgcggtgcccagagtttggccggcctccgtgtgattaggaacatcctaccgtagataaggtatcttaaagaaggaggtgttcagcacctgtgttttgaaaggccttcgagtactgcgcagatgaccacttttaaaactgcagattttaaagctgatacttccagagattaagacaagcctcgcatttgtaaggttaacagggaagatgcaccttttaaagtgagtttgttttgttttcaatgtactgtttgtcatcagcctaggcaatctgtgtgctttcgagctgtactgtttattggccgacttgctcaaggcaaaatccctctggaagtgaggggaggagtccagcggaggtggctatggaagccctatctagatgggggaggggagattttatggggctctcggactgctttctatttttggatgggttgaaagaatttgttaacttttagccactagaatg

SEQ ID NO: 64112 - DNA, 1714 bp, Homo sapiens
tcaggaaaaagggaatttgatgtgcgacagactcctcaagtgaatattaatccttttactccggattctttgttgcttcattcctcaggacagtgtcgtcgtagaaagagaacgtattggaatgagtaagtcgtttatttaacagtttggttctccaaataacctaagattggtttggtatacttatcaaaatttagttcctatttaatggcatggatgtatctgtcagatatattgatagaaaaataacattttttttagttcctgtggtgaagacatggaagccagtgattatgagcttgaagatgaaacaagacctgctaaggtaaatagctttttatttttatttttttgaaatttacttttctgccacttaaagcatgctatgaatatgttaataagcattaacacataaggtagaatggtttttaaatttcacacatagccctatcaccatagcaagaaataactgttttcgtatatttgtattacatatatggaaacactttttattacagagaattacaattactgaaagcaatatgaagtcccggtatacaacagaatttcatgagctagagaaaatcggctctggagaatttggttctgtatttaagtgtgtgaagaggctggatggatgcatttatgccattaagcgatcaaaaaagccattggcgggctctgttgatgagtatgtattaaacattttgtcttttgctcttttgtcccctatggtgttactaacattaaggtttcagctggtcaaacactgaattccatctctaacttttgagaagctgtaatgatttaatcaggtccttttcacttaataccatcagttcttattggacttgttgaataatatgagtctgattttggaacctaacttaaatttcttatttctagtcagcatccatgaattcacagtaaaatggagtttattcttacctgagtcctagggcaagcaacatttcttctttctgataaatctttaatggaatctgcctttggaaaaatctcttacaagtctaaaccccttctctcttaagcaagttgctttttagcataacaatagataccaaaaatttattgtatgaagtttcagataaattaattcagtttaagcttgagtgaaaattatttaccattctattaatctcaaatttcttctaggcagaacgctttgagagaagtatatgctcatgcagtgcttggacagcattctcatgtagttcgatatttctctgcgtgggcagaagatgatcatatgcttatacagaatgaatattgtaatggtgagtgatgtaatggttttcttgtgagcttgagaaaatgaacatcgaggaaatatttatggttatctaaaatcttgctctatttctgtcacttttatcttttataaatttaaagatcagagacctaacataaatttcaagtacaaggttaaaaaccttgtcctttctgaagcaccttgtacatatctcagtagtagaacttcgcatactatttatgtgcttgtcgctccaactgagctttttgacaagactatggcctcgacacatatattttggtgtccgtagtacctagcgtagtgtgtgaagcatatagtattatgaagtgttaagttgaatagattcttcctgtgtctggtctttgatttccatttcatgtgaggtgctgctaaaactgatgtttgttagtcactgagtctctg

SEQ ID NO: 64113 - DNA, 1086 bp, Homo sapiens
atggtgacctctgtggagtggggcaccaccaggttgcctaaagaggggtaaactggcctaagttggaaacagcacaagtcaaaactcctatgctgataagtagtgggatcaagcctgtgaatagccactggattccagctgggcaacatagatagaccctgtctcttataaattaaaaacaaaaacaaacaaaaaaaaagccaacctgataatactggtttactctgagaaagaaacaggtggattgctgaggtgtatgattgagagagagactttacattttattttgtacccatgcaaatgtattacctattgaaaaaacaataaaattttgatttcacaagcaggttgaagggagaaggtcctataaaataacactttcttggttgagattggttggttgagactcatttggtaaagatggaagaaagaaaatatttcagaaagaagaaaatgctaatattttctatctttgttaggtggaagtttagctgatgctataagtgaaaactacagaatcatgagttactttaaagaagcagagttgaaggatctccttttgcaagttggccgaggcttgaggtatattcattcaatgtctttggttcacatggatataaaacctagtaagtattgcagatcttctgacctgtgttctttggggttatagagaataaattacttcattatgacaacattgaaaaaatatatatcttctgttttctcattgttagttttaaaaggccttagatccacttaccaatattgttttatgatttctattcatctcttcccttgttaatccccaaaatttgagataaacttttttgagacagtgtctcattctgtggcccaggccggaatgcagtggcaccatctccgctcactgcaacttccccatcccgtgctcaagcagtcatcccacctcagtcttccgagtagccgggactataggcatgtgccaccatgcccagataaattcatttttattaaaagccagaaatttttgctgcatcttacaggaactacaggtgggatactaatgagggcactaaaaatctgtgtttaaagccccactcttccact

SEQ ID NO: 64114 - DNA, 1047 bp, Homo sapiens
ccagcaactataaccctggtttctgtcccctgagatgcttattccatgggtttgggctagaacttgagaatcggcattttaaaaagcattatggatgattctggtatatgatcttgtttatgaactctggttttattattattagtttggcttacataattaactgtttgacaggtaatattttcatatctcgaacctcaatcccaaatgctgcctctgaagaaggagacgaagatgattgggcatccaacaaagttatgtttaaaataggtaagaaaggtaatcagattattaccttcagataaagagaaggctgttttgtttttgctcttcactgtaagtttttcaatacttctaggtgatcttgggcatgtaacaaggatctccagtccacaagttgaagagggcgatagtcgttttcttgcaaatgaagttttacaggaggtaatttttcttctcccttaatcatagtttgctttgtaacacttagcagttgatagaagaatataaattcagatatattaaactttgaagttaactaatagaatggaaataaaatctaaaccgtcatctgagggcatttaataagcaaaaagtcatgaaggcaaagatttataatggagttgtcgtaaaaaatatgttctcatacaccactggtggaactttataatggcatatcctttttggagatcagagtattagtattgcattaatatttaaaaatcatgtacccattgactcataattttcacttctaggagtttttcctatagaactattcatatacaaatacaagttgagaacagtgtaaataagtgtttactaataagagaatgattaagtaaattatggcacatagttattagtatggcctatagtttcaaaagagtgtgacagtatttcttgataaaaattttgaatgaaaatagaataagtagaaaaatataaagtgtaattgtctgatcccattgctctttgtaaatatgtgtatatatatgtttgctttatcacgtatatgtgtatttgtaacttgtcagtgtgtttcta

SEQ ID NO: 64115 - DNA, 2101 bp, Homo sapiens
atataaattggagtttttgaaattattatttatttttaattttttttttattggggataggtttgtctggaaattgtttattattatttatttaaaaagatggggtcttgctctgtcacccaggctggagtgcagtggcactatcatagctcactgcagcctcaaactcctgggcccaagcgatcctccagcctcagcttcccgagtagctgagactacaggtgtgagtcaccacatccagctcaaattattttataagaaccaaagtcattactagcatctttactacttgttttcaagtatgtgtgatactgtaattcaaaaagcataaaataaaataatttcataaatttaagttgttttaatagaagcttcagtttcctgttttatttttcaattacatcttagaataatgatggcatgcaaatatctcccaatcgacaatatagtttgtgttagtttcttagaatctcttcctaggaataataccttgttttctatttttatgtcagagaactcaagaaagcacagatggcaaaagctgcagctgaggaaagagcactcttcactgaccggatggccactaggtccaccacccagagtaatagaacatctcgacttattggaaagaaaatgaaccgctctgtcagccttactatatactgagctactcctttcccacctccccctgaacactgtgacaagaggaagctaggttgaaatcactgatagaatccagtttgcaattactttctcgattggtgtcagtagttttactgattaggacttttattgtgaattacagttgaaagctgtattttgatgattgctatgtcaggctttcatctaatcttaccagtctgtcttctgtaggatgtgtcactgttggatgttacaccagcctttccagggttaaccactgtggtggtgtgctgcttatagtttgctgttgcattgtaataaaaggtgtctttccctgtagtgacctgtaaaaagtactcaagggctttattacagacataccctccctttgaaaagggacatgctaaaagactcattactactcagccttcaatgtacctgtgtgtccatcttatatttcttttttttttaattgtgaattagacttgtatatcccactgggagcactttgtaggcattgcatgaaccatgggatgatgattctgtggaggtattgccttgtgaatttgctgctattttagttttgtctttgctgtaaacttgtagcattaaacaatcattgttgttaataggtcttctttttgaaacaattatgtgaaatgtatagctgcttttgatgaaaagcagctatttgcctttttttttttttcctttgaactttgaagctagtgcattggaaaaatgcaccctttccctcctttggaatgctgtattaatgtagtataataattactggttttgtaacttgttctggtaatgtccttcccggactctttttaaatgtctccccctaagttttatacttgattgtattattagtctgtttttaaatgttttgcccggtttttctcttcaatatttgtgtatataaaccgatcttcgtgatactgtacatagctgtttgaaatgccagaatgacttctgacattccaagtttttcacaaaatatattttatctgtgattagccatttgactaataatactggctaacagatgttgaaaaaaattgtctgtttgttttctcattaattttggtctaaaacatgtttgcacttgtctttgacttgtgttttattaacattgattggcatattaaaagtcactctgagcttaccttaattgtctaaatccttgtgatgcctgttttctaatattttatctctattattgctatactataaaatgtatagtgtgtataatgtactattataaaagcagagggcacattttgattgaatatgaatatcacattgcatgttatgcatgtgacttgctagaaatgtagcatgatgtaatttaaaatatcttcaaattattaagtgaatataatatgattcataactttctgatttgtactgagtcacagaaaactttaaagtggggaggttttgtttttgt

SEQ ID NO: 64116 - DNA, 1036 bp, Homo sapiens
taccattttattataatttggtttctgctttttttttttcctctctttttcttccatctttgggattatttgaatatgctttagttttttgttttttttttttctgagacacagtcttgccctgttgcccaggctggagtgcggtggtgtgatctcggctcactgcaacgtctgtctcctaggttctagagattctcgtgcctcagcctcccaagtagctgggattgcaggtgtgcgtcaccacacctagctaatttttgtatttttagtagaaacggggtttcaccatgttggccaggctggtcttgaactcctgagctcaggtgatctgccctccttggtttcatgaagtgctaggattacaagtgtgacccactgtgcctggccaatatttcattttaatagagttttttactatatttcttcatgtaggtttttttagtacttgctctaggagttagaatatccatccctaacttttcatagtgtacttagagttaatattttaccactttaaggagaatgtagaaaacttatcaccatataggtccctttactctcactgctttatgttgtaattgtcatatttattaatctacatacattgaaatccccatcagacaatattaaattttttgctttcaaccatcatttctcttttaaagatcttaagaggagaagaaaattttattctttttttccagatattcccagatgacctcttaattttttttttttttttttgagccggagttgcgctctgtcacccaggctagagtgcagtggtgtgatctcggctcactgcaacctctgcctcccgggttcaagcgattctcctgcctcagccttctgagtagctgggactacagacacgtgccaccaagcctggctaatttttgtatttttagtagagatggggtttcaccatattggccagggtggtctcaaactcctgacctcgtgatctgcccgccttggccctgcaaagtgctgggactacaggtgcccgctgccatgcctgactaatttttttgtg

SEQ ID NO: 64117 - DNA, 1055 bp, Homo sapiens
ttagtttctgaagaggggtaagttggtaagttatccaaaataactttaaaaaggtggttcagttagagtgtaatccagtgccatccatgctgtatgacatcagtggcatatattctgtggacagcattccaacagatgactttgagttacttttccttaatctgtctgtaagtgttctgctcttactgaatcttcgcttagccctatgctagtcactgaaggatgcagaaggaaaatatttatttcctcccttcaataagggaggatatttgataagttagatatttgagataccattagtatctgaaacagaacatagttaaatgctgaataggagttcatggggcagggtggtaatccataaagatttcctagagtttatgaatgacccaatcttgaaggatgtgactaggcagaagagaaatgtttccagcacagggcatcactgtgggacagagagctaagagatttgagttctagtccctactttgttgctaattattgtgtgacttaggccaagtctcaggccacagtctttttatctgtgaagtgaggagatagaaatagtatattttctaagattattgttaatattaaagtatcacggctttagtgttaagagaatttttagaaagaattcacttagcagttattgaaagtcttctggattctgggcagcatgccaggtgccatgggcatgcaatgttgtataagatatgggcctttcagaaatgtacagtcttacaggagagagaaatcatgtgtggtagttagcacaagaggtactgcttgggaaacagagtgaagaaagatcatcttggtttgggtggtgaaggcttcagaaagagatgccatttttgttaggcaggaaaggaggtaggggtaaattgagcaagggcccaggggagaaagggatgtggtacaagttgcctgggatgcagttagtaagcttatttggctggatttatatggttggtgcagagggtgggaagaaataaggaaggtgaagtgggctggcctgtggagtgacttaaatatacaactcacatatttcc

SEQ ID NO: 64118 - DNA, 1818 bp, Homo sapiens
tgacatagtgagatcctatctctataaaaaaacttaaaaattagccaggcttggtggcacatgcctgtagtcctaactacttgagagactgaggtgggaggattgcttgagcctaggagtttgaggttacagtgagctatgattgtgccactgcactgtggcacaatggtctcactgtgtcacccaggctgtatagtgtgtatatatatatatatatatatatagtctctagatacagacagtaaatagaattgtgtctgttattaaaatattatagaacatactgggaaattctcagaaattcgaatttgtttttcttatttcagtgctagaatttgtgtgtgctgggccagtggatagagaaacatggtttaatatcttgaagtgctgcaccctactactgcattttgttctccttggtgtgacattctttaaacttactgaattttatttagttttaaaatgttctttgttttagtatttcaagtttttaaagttttataactgggggaggaaatatagtagtgttttaaaagtcaaaaatgagccactaaatttggagagaaacttattcacggagggaatgaggatgtgatggaacagtgagcccttgtttattattgcttagccacctggagtggaattttgccagtcctgcaatccaagtaaagcagccaaggtttccatggtttgagtttaaattgagcaaagattagtgccttatttgaaacttggttgaaaaaagaaatgccaacagtgactgaagaatgttaacataaaacttagagattataatcagctatgtagagaaaatatgaaatagttattaaacagttgcaaggtatgctgtcatgtatacatactgtctcatttgatcttcatgttaattctgtgaggcagaattggaattatcccccattaactaaagaggaaacagcttaaggtggcctagctaataagtgataggtagatttttgaacctaagccatttaatttcaccaccagtgtttctttaactgtactattgaaggattatttgctccctttaggaattaagtttttttccaatgtctcatatttggatacatgggggaaatattggtcgaaggcagggaggggtagagttgtttaaaagccattttgattacctcacacttgctcagttttcatccagttttcttctgttctgtctcaagttgttttaaggtgattctcttgtcttaattagtgtatggtgttccttagtgttcattttggtcagtttttttcagtttttttcccaggttgttttaggggttttctgcctttgcctgggagaattattctgaggaggttcataccaagagttaaattatattgaaactttccaaaaagtaatttttacggttggtttttgtatttactttgttattttacattgatagaattaattttcagctttcctgagacttcaaatgattaacctgtctgttgttcctttaccaagtattttttccttccaaatgttaactttttttttttttgagacaagtcttactcttgttccccaggctggagtgtgatggtggaatcttggctcactgcaacctccgccttctgagttcaagcgactcttctgcctcagcctcccgagtagctgggattacaggtgcctgccaccacgcccagctactttttgtgtttttagtagagacggggtttcaccatgttggccaggctggtcttgaactcctgacctcaggtgatccacctgcctcggcctcccaaaatgctgggattataggcgtgagccactgtgcccggccccaaatgttaaat

SEQ ID NO: 64119 - DNA, 1142 bp, Homo sapiens
cactccctctcccctatagctctaggcaagtgcaaatctactttctgtctatatatatttgcctattctggacatataatattaatggaatgatacaatagccagccttttgtatctggcttctttcacttagcataatgttttcagggttcatccacgttgtatcctataacaatacttcattcctttttatggctgaataacattccgttacggatataccatgttttatttacatattcagttcatcagttgttggacatgtgggttgttcactttagtgcaatcacgttggccttctctctgttccccagattaccaagacccttcctgcctcagagccttcagacatgctgcttcctgtgctgtaaggccaactccgcccatcaaatgcagcgaatttttgttgatcctttagctctggacttgattgtcacttcctcagggaggtttctcctggtagaacccacccttcccagagctaaccagctctcctataatgtgtttcccgcagcagcctgtgcttttcctctatagcacttactagttgttgggttgttgctgtattgtttggtgtctgattccctctccagactctgagttctgtgacggcaagaactggttcactgttatccagctcttagcatagtaactggtacctggtaaacactcacaatgatttgaatgaatgaatgcgcaaattaatactgcaaaccaggcagaggggtacaaaactgaataagatatggcctttgatttcaaagaattcatgatttcatgtgagttgtaataaaatatagaactgggactcaggaaagagtttgaggttagaaatgtatatgtagttatatgagaagagcctaccattttactttctccttcttggctcttgctctggtttaaatggttttatgaaactataaaaccattgagatataattcacataacataaaacctaccattttaaagtgtacagtaaaatagttgtgaatgtatttactatgttgtgtggccatcatccctatccaaattctggatttctgagaatttcccagtatgttctataatattttaataacagacacaattctgtttactgtctatatagagagagaccatatatatatttatggccttactg

SEQ ID NO: 64120 - DNA, 1326 bp, Homo sapiens
aaaaaaaaaaaaaattacagtattttaaaacattttgtagttatactgtgttccacaattaattgtgttttctttgaaaaactggatgtggggtgggtctcttacccttgatgttttgtttttttccatcactaaaatatttggtggacttgaaagtgaccttgtcctgatttcagaattagaaattagtgagtgtttttattgccttaggcagcacttgcttaatgtggatgacatgtcaatggcattaaatcaccattgagccacaggctgtgaagggagccagtcagcatcagttttctgactattgtgcctaagaaactcaaaagatttgtgctgcaggcatcccgaaggattgggacccacatgggccttgatgtgcgtttctgtaggccagagcccagccaaggctcctggcatgtttttcttcacctttgcaggctaacagaaatgtcttgattctctttcaaatcaagttaatctcatttgagaagtgaacagcctttctttgatttgttagaatagccaggcagcataccttgtcatgttactgtttggactcactctgtgctttgacagcttttactctctcatcatttcttctggttagaagtagaatttgagttagttttatagattttcctctggggccaggagtgcttgtgtggggaaagaagggatcattggagtagatttatgtgagattgctttgtctagctgctgaattaccctcctgaggttaatcacatggatttgtatttatgaagctcttagcctatcacctggcctttgaccaagcactgcaaactcaaggttatgctatattatgaaaaatacattctctgttagcttttgcttcctttctgaataataacacttcaaaaactatatttggactgattgtagacttacagattttaataaaatttaatgtgaaaacagatatatttaaaaaataaattttgaagtataatgtcataatttttcatgaacatataggtgggtttaacttgttatcagtagtttttaggatttataaatttgaagtaatacttctttccaataatccacttaccgtaatgatcatttgcattttgtttagagtgttttttaagaaagatttttttttaagccttaattaatacaatgtaaaatataaccagcctggcttggtggttcatgcctgcaatctttgggaggctgaggtgggaggattgcttgagctggggagtttgagaccagcctgggcaacatggtgaaacctcgtctctacaaaaaatacaaaaattagctgggcacagtggcacatgcctgaagtctcagcta

SEQ ID NO: 64121 - DNA, 1139 bp, Homo sapiens
aacctgaaatagttttaagagaccctaaataaataaaacctattaagccaataaaatgccccttattaatgatgatagagaaagcatttttaataaaataaattttggaactgaaggcctcgaaaatcacatgcatcttgaaagttttttctttgttatttttggtgaaacttgcttggaaggaggaagtaagctgcttcctgaaactgaatgagctcttagaattgatgcaggccactagagactaaaacggcaacacatgatttattatttagtataattgaatagtggagaatggtaatgtttgtctctccttggcccaatataatgaatcaaaaggcccttaagttatttggttatgatacgtatatgattgtgttgaaagtcagcaggaaatgaatctagattagttgtctggcacagtcactgggaatgctgagcagatcgaagctgggtgctaatgacaacttcataaggcttgggagggcaccttcagaaaggttcaggatgaacctggcaagctacttctagagctgagtttgctactaataggcgctttctgagttacaaacataacaagtcatctgattttgaagaaactgaagcttggagtgtgaatgacgtgggttcagtaagaggtaggtgaggaagagctaaggctgattcttgacttgtgccaggacatggtcattcggctctaccatcttgtctcacccacgtgtagtcatactgcacacacatgtggctatacacatgtgcttcctttgccttgctactaaaacttcgacttgtgcctgtattccctgtaccccaagttgtaatctgccagcctgggcccttctttttgctgccttagggagattgaatttctgtacctgttaatgctactgcttattgtaccttgagcaattgtttatcttaatgtcctttttgactctctttttcttgcttttatctcttcaatctcttcttattttttatttttttaaagatggagtctagctctgtctcccaggctggagcacagtggcgcgatcttggctcactgcaatctctgcctcctggcttcaaacggttctcctacctcagcctcccgagtagctaggattacaggtgcgcaccaccacacccagctaatt

SEQ ID NO: 64122 - DNA, 1064 bp, Homo sapiens
gccatcacacctggcttctcttgatattttttgaacttgtgatattttgtgaatatatatgcctttgcaaacatgcatgtctatttttctgttaaaatatgttattttacaaaaaacattataaccaaattattggaaatgcaaagaagaaaaaggaaaaaaattaactcatgatcctattgtaacaaattaaacctactgtttctgacaaatagttgtcaaaataattacataatcttcgtgcagtagaaataataggtaaatttagttttgtattcttcactttcttttgtttcataaatgctttctttaaatgtaattttgaatggttgaatagtatttcactcagtgcagaagggaagcaacattagtggagtacctactatgtgatgggcattgtgcaaattgctctgtatttgtctcatttcaccccacagcatttctgtaagtattattatgcccatttcatagatgagaaaattaaggcttacttagttaatttcagtttagcaaacattagttgagctctgaggtaccacgctgagctttggggattaaagatgagtgggacatggttcctcctacaaggaatgcagaaaatggtagaaaagcgaatgagtgaaaatacgttaagtgcagtgacctagaaaaggaacacgtgacctgggttagggttggtcagagcaggtttgctaaagcagcagtgcttctcaaaactttagtgtgcaaatggaagtactaggggttttaattaaaatacagattctgatttttggtcctttggttggtctgacagtcttcatttctaacaagcttccaggtggtgccgacgtcactggtccgcatgcttcgttttgagtaggaatattctagaggatgtaggacttgaataaataccaattaactgggtcgagaggtgggaaaaggtattctagacagagaagacagagtggggaatgacataaagcataaggaaaatatggtaagagggtaaactacttataatctatggcaagtggtggcaaactacagcttgctggctaaatccagcccacagcctatat

SEQ ID NO: 64123 - DNA, 1060 bp, Homo sapiens
ttgtagtgttccagtgggaggaagcagcatgaattttaaataattggcttatgtggaaagtttgtaaattgatcaataacttgtacatattactttgagatgtttaatttagcgcttgtttgttgagtaagactaatgttctgatatattgaaatatttaacagcgagtaatcagatcacattaattagtttgtatgctgtcatatatctgcagtttgttttagttctgcagacaaatatactacactattagagggttatcagtttttgattcctttacttattctgcactaatacagaccagtggcattttatttatacttctctccctgtattttaggagactctaaaggtaggcatttttggaactgtaaagagtatttcctaagttgaacttatcagtgtttataacataaatacataactatgttaaagttttttttaactaggaaataattatttcacattctttatgtagattgaatacctgcttaagaagcttacagaagctatgggaggaggttggcagcaagaacaatttgaacattataaaatcaactttgatgacagtaaaaatggcctttctgcatgggaacttattgagcttattggaaatggacagtttagcaaaggcatggaccggcagactgtgtctatggcaattaatgaagtctttaatgaacttatattagatgtgttaaagcaggtaagaattctgttactgtttttttttctcatctttagaatttgacattttaaaattaatatttttgtcacaaagatgagtataagtcacttattttcttacactgatttcgtttttttattttttgtttttttgagacagtcttgctctgtcgcccagtctggagtgcagtgacgtgatcttggcttactgcaacctccatctcctgggttcaagggattctcttgccttgaaggcatgcacccccatgcccagctaatttttgtatatttagtagagatggggttttaccatgttggccaggctggtctcgaatgcctgacctcaagtgatccacccacgtcggcctcccaa

SEQ ID NO: 64124 - DNA, 1411 bp, Homo sapiens
tgttgaaaccccatctctattaaaaattcaaaaattagccaggcatggtggcatgcgcttgtagtcccagctactcaggaggctgaggcaggagaatcatttgaacctaggaggcagagaggttgcagtgagccgagattgcacccactgcactccagcctgggcgacagagcgacactcctaaaaaaaaattttttttttgtagaaatgaagtctcactatgttgcccacactgatcttgaactcctggcctcaagcgatcctcctgccttggcctcccaaagtgctgggattacaggcatgagccactgcatcaggcctgatcgaggttttaatttacagagaatcattgttaggggttcattctttctttttaagtggaatagaccagtataatgaactcccacatatgcatcaaccagctccagtaaccaccaccatgtggctaatcctaccccacctacttttacctctcctgtattattttgaagcaaatctcaggtattttattttgtttataaatatttcaataggtatctctaaaagataatgattttttagaaatctcaaatgctacttaatgtcaaggggattctattgtctgcatatcactttggggaggggttgtctctgaagtgtctgaaattatatgcaaatttttgtctggttatgcttgcatgactaggtgtaatgcccctccatagattctcagaggatccaagaacaattggtgttcatgttttcaggatcatatatcaaataatggagtaggcaagtatatcaaggaagagatgtcagctcttacaaataaaaagacaataatttatatcacatttaatctttcacagggttacatgatgaaaaagggccacagacggaaaaactggactgaaagatggtttgtactaaaacccaacataatttcttactatgtgagtgaggatctgaaggataagaaaggagacattctcttggatgaaaattgctgtgtagaggtgagtctactcttacttctttgcatgattaccccgtgctgccccctgatgctgaagtagcttctcaccttcttccacctagactctagaaccttaaaataatccccaaatttacatttccaaaataatataggcatgcagttgccatggtttctgaaccaaaaattaaacatagctgacaaaatttttttctaatgtgaatttattttcaaccttctactcgtgaataaagtataaggattaaatcatttattggaacatttaaggaatcatttattgaataaaatggagtcataaaagagataataaagtaaaaaaaagttcagtaagacaatatttggaataaagaatatgccagaaaatctgggacattttgagtgcaagaaataaaagaagatgtaagcattgtctttgaa

SEQ ID NO: 64125 - DNA, 3748 bp, Homo sapiens
ggaattaggttacatatctgtgggtttcttaaaatttgacaggcctcattttaattagaagaaggaataagaaatcatggtagtttttataaattaatagatttacttaaagaatttacttaaatttttatttctacttttgtttcttttaaaaaatataatcatttgggtaggttcaaaaatatacaaatataaaaaggcagctgtgaaagattttctccccctcccccacttatgaatttccaccccttgcccaaggtaaggaaatatgaatatacattcttattttcccatttgttaaacacacaaaagtatatactagtgtcactgttctgcctccagtttatttcacttaatatattttttagatcttttcatatcagtataaagagagttacctcattcttttttatggctgtagaatattctgttatacaactgtgtcattacttagtcattccctgttagtgaacatttgggttgtgttaatcttttgttttaataggtaatgctgtagggaataatcttgtacctgtgtcattgtatatgtgttcatacatgttctgatatctctagggaatgaattctcagaagtgggaatgctgggtcaaagtgtgtaattatgaaatccgggctgatggaccagccgccatcttgagtgttgctattcactgtgccggaagaaaaagtgttctagggtttggcaatgcggtgctccagcctagaaatgtcacactgtacttctattgataatatcttggtgagaactagtcagaactttctgatgagtagtcagctgtcaagcttgcaggagttcccttgtgtgtggtaaatcatttttctttttctgcttttaagattattttttggtctttgtctttcaacagttttactgtggtgtatgtgggtgtagatctctttgtgtttatcctgtttagagtgtattgaacttgaatatgtagattaatgttttgccttaagctggataagttttcagccacaaatattttttctacttttttttccctcttctgatactttcgttatgcaaatgttggtgcacataatggtgtcccacatttctctaaggctgtgttcatttttcttcttttttattttctgttttccagttgcataatttctatagatctgtctttagtagatttttcttgtagcccaaatatactgttgagtccctctagtgaatttttcgtttcagttatgggactttttacttccagaatttccatttggttttttctgtgatttatatctctttattattctctattttatggtatattgtcattccttccattacttctctaagtatggtttcctttagttatttgagcataaaatatttataactgctttgaagtcttcatatgctaaatccaccatctgggcctcttcaaaggcagtttccgttgcctgctttttccctgtatatgggccatactttcctttttctttgcatgtctcataatttcttgtagaaaactagacattttagataatgtgtggtagcaactctggattctgattccacccctctccccagaggcctgctgttgtttgctcctttatttgtttagtgacttggctggactatttcagtgaagtttgttttcctcacagtgtgaagcttctgactgttgctcctcagaggcacaggcttggacaggaacacagtcaccctgcgaagaccctgatttttgcagggctctctttgagtgtctttctctgatctctcatttaagctttccacctctgttggtaccacaccaacagctgttagagttcactaattttgttctgttgttctccataatgccctggaacctgaattgcctcacagtctgagatcatttaaattcaggcctacatgtagtctttaaggtcagtctttgagacttgttcctactacatgagaactcttcttagctgtctctttctctggttctgtctgtcagacgtttggctggtctggaagagcagtggctcacacctgttaatcactttgggaggacagggtgggaggatcacttgaggccaggaatttgagaccagcctgggcaacatagcgagacctcatagcagtcaaccaacaaaccaacaacacttttagctggtccgtgtgttagtgtgttgttctcatggagcttctggcctcctcttaattctcagccactcttgcctggaataaagtttctgcaacatgcagctggggacaaagagaaattctggcagccagcctgcccctcccaggaaggtatcatagccctaggcttgagctgaggggaggggaacccttgtttggggttccatctgccaggagaagagctttcttctcactgacactgtgggggtggggagggagtgcatcatatgccacagaccctcacgattcttactgagagttagattttcttagataaatgttctccattttagaatgtccttagcataatttctagagacttttaaaggttttgtttttttaacaataattttcaccagttatggttgttttgttggggaaagggtctgtggagctccttatgccacccttctagaaattggttctggtaaaagttataatgaataatgtataagatgaaaaaactgtacagaaagagctcaagaaatagctctcaaatctcatgaatgtggctgggcatggtggcttacacctgtaatcccagcacttcgggaggctgaggtgggcggatcacgaggtcaagagatcgacactatcctggccaacatgatgaaaccccgtgtctactaaaaatacaaaaattagctggatgtggtggtgtgtgcctgtagtcccggctactcgggaggctgaggcaggagaatcacttgaacctgggaggtggaggttgcagtgagccgagatcgtgccactgcactccagcctggcgacagagcaagactcagtctcaaataaataaataaataaataaaaatctcatgaatgcaatcccaagtgaatttaattcaatgactgtactaaaactttctttgcaaaatgttgttcaggcttatcaatagtctttcatttacctaatttattttgtatgttgattcagcagatcgttagactggaattctaatggagctaaaagtttttattctattatctttattgaatgttaagaatgtttggcttttcctgtacttaagtatgactgtctctctctctttaatgtacttctactctaacacctgcttttctgtggatgggtttttgattggctagaaactggaggaagcagcatctcgtgcagcagaagaggaaaagaaacgccttcagactcaagtggaacttcaggccaggttcagcacagagctggaaagagagaagcttgtgagtatcacatggctggagaaagcagctgcagtagctcagcctgggtcggtgggaacagggaagggctggaggctacagtgaggcatgtcatcagcttggctttgctactgacctggaatgggctgtaggggaagttgcatgtttgttcattcattaattatctgtttattgaacaccttctatgtgccaggcagtgtgccaaagatgtaatggcaaaagacataaaccttgttttcaagactcctaagtggaaatttatggagccaggcatggtggcccactcctgtaatcccagcactttgggaggccaaggcatgagaattgcttgagcccaggagttcaagaccagcctgggcaatatctaca

SEQ ID NO: 64126 - DNA, 1030 bp, Homo sapiens
tagtgtcgtgttctgttgtgtacatcaaactccaagagacatctgaggagacctcagtgtctccaaagaaggatattgagtctggaagctgggtcccattagttaaggctggaggtggtcttcttggagaaggatgttctcaacaggcaacaaagctgccttccagttgcgaaagggctatcacagggaagagggagtagatacttcctttgtggaactagggtagtggatgggagaactcatcttagtataagaaaaaacttcgtaagaattgaagctgcccataaataaactggcccaatttgtgaggcaacgagtggtagcccatcacctagagtattggagctgagttgaataacaaccttgcaggaagttgtagagggaatttggaaattggtgttggtatagtctgttactttattcctttgttgttagttttataagagcagatgctggcaggtagtagtaactgaccagtcatgtgacttgactttgttaccataatattgttgctcaagccactagatatgtatcctgtccttggctggcatcgaacgacactatatacactttaatgcaggttttggctgtttgttagtttatttaaacaactacatagctgggtattcccagataggtattcctgttattttggagtcacacagacctgggttaaaatccattataacctgtgcaacatacttttaaaccctttggtttttcattgcttcatctgtaatgtagggacaatacctttcaggattgtcaggggattagcaataatggaggcaagggcctggcatgtagcaattgttcaataaatagtatctctattctgtctgcgttcactcctttcttcatcttcattatcagctttttccatggtaacaggtttttactagatgaaaatgttttcatgttgtagcaaccaggcaaacttcaaatcttggccctgccacctggcaggtggatgatcctagtacaggccactgaacctttgtgtctcacttgcaccatctctaaaatatga

SEQ ID NO: 64127 - DNA, 1057 bp, Homo sapiens
ctgcagagtttggaggggctcactgccactgggtactcagaacctctgtggactggatgtcagctctttcctttggcagcgtgtttccttttccgagtatgtgctgttaaactagattggccggttcgctttccatttcctgacacttgacatggaatgcctttgaccattggtgctctgacagagaagtcatggagtcattgccatttcctggttgcccttttggaatgtgatcctgttagtagaggttttctagcttctactaagatatttctttccctaaccatcatacacttggcatgtttcattcccatctcctttcccctcaccttaaaggagactacccctttgccccatattgtcaacctaattttctctcgtactctctctagtgaatgatgtgctaccaagtatatgccaggctgtgagaggattatactgagtagtagaaagaagctaatttgaaataaaaattatttgtataattaagaaagcagattagatgcacatggtcaacaggaagttgactgtatgtctgctagttagattcaaaacatcataaagatgatagcatgtcaatatattagcctagccattatgttagcctttgttaggtgggcagcttttctgctttttcccttcctctgtggtgacaacggaggaaatatccaacagaaatacgtctaacagggaaattgggatcatagtttatatgcatctgatttgaaaggagtattgaggaaggttttcatatatgatctatctttggattaaaaagaacatttatgaaatcaagccttctaacactagttataattgagaagcaacagtaactccgtggacagcaatcaagcttaaaattgtaaataaatatggggataattcagttgttgcaaaaaaagggcagaattcagtagaataaagtccttttctcttacaggtattaaatgaggacagagaacctcaggtgttcttatgctagtgcttgctgagtgcatactaagaaagcaattccaaatagatgtatacatctagagagagtggtattagagattca

SEQ ID NO: 64128 - DNA, 1874 bp, Homo sapiens
aggaatggaacctttcctgtggtttgactgcacattacaccagaagactccagtatccctcattccagaatgaggaaaaagtattctacaaagaacctaatcacctctgtgaaatctatgggatggaaacagtgtggccttaggagtcaaatagtctctgcatggtggggaggatcatgatggaatatgtgaatttctacttctagaagttgtgaaataggtcctgcacttttgcagaatgtccttctttaaacctggcttattccacagctgtagctgataacatgacctggggcttagctgctctagccctgggttcttggagacctcacactgcctggcccctggccatccacctaaggactgcctgctttctggtcacatgtggaccttgatacgactaagcggttacatatgtggttgtgcaaaagctttctgtttaatgcatagtgttaccgatttacatcttggttttcagtggcactatgtctaggaggcaatatccttttaaacagtgctttggctaagatagatacttgtgaatcaaagatagcacagaaatgaactaagtatatcccatttggaattatattttgatactatttaaaatggtttcacctgttaaagggccaacagaactcttggttttacttttgtaattactgtacagaaaatttcaagagtgtttgagtgcttgtcatcaggtgttttccttaataagtagggatatgatcatttacaggaattatatatgaaaaaagtttttgaaatgtatttttgtgatgtgctatgttgaggggaaaccaaatatttatgattttaaaacattcgtatgaaaacattgtacaatgtaatatgctcaactttctcaattttttgctaatttttctaagatacattaaaaatgttttatatttttttttaagtaaaatggacccagtaagaaaattaaaaataccagaacatacactttaaactgtctgatttaataaaacagtggggggtaaagttgggtgtatctatgtgtattttcatataatgagatggactttggtttagggacatttcctgaaaacactgggtttggagtttagaccccaagaagttagctgtggcctcatgtttggtgtttgagtcacgaatgtggggaagccatggctgatgtgtcagctcacaaacgggaacttacaaagatgatttctcattcattgttgctgttaccttcaaattttcttacctctgttttccttagttttctttttatgcctttcagtttttctttcaccagagtaaaccgtgtggctttttgtttgtttgttgtggtttgcattgttgccaagataaaatgcctgttgtggactaagtgggcccactcaggccagcttgattgtatattggaaagctgatctttccctcttggagggagggagaggacactggttggtgtgtttaaaaactgttctttctgaggcgggcagatcatgaggtcaggagatcgagaccatcctggctaacacggtgaaacgccgtctccactaaaaatacaaaaaaattagccaggcgtggtggcgggcgcctgtagtcccagctactcgggaggctgaggcaggagaatggcgtgaacccgggaggcggagcttgcagtgagccaagatcatgccactgcactccagcctgggcgacagagggagactccgtctcaaaaaaacaaaaacaaaaaactgttctttctctatcacagtggttctcaactggtggtaattttgccctccaggggacatttggcaacgtctggagacattttttgttgtcacaactggagggagtgttgctggcatcgagtaggtagaggccagggatgctgcaaaacatct

SEQ ID NO: 64129 - DNA, 1333 bp, Homo sapiens
ccatgcacactctgatagaatatttacgcccaacactaactgtttggcttggcaaataagcaaagccataaagtcacagctggcctgtaggctcccagtcaccatgtgcagctgagtcacaaccacttcccccaccccctggggagcaagcgcctatgctcatgcctgcactcagacacatatccacacagatacccacagatgccgcgtgccactgagtcatagctacctcctcagagagcacgtgcctgcatgtacttgcacacaggtccccacagatgccatatacacctgagtgtgagtcatcatcaccactgaaccctgagggagggcacccagagtgtgttctgccatccttgcttagagatacccatatacacacatatacagatatgtgcccaccacacatcctgttgtacctgctgcatcataccagcagatcaataaatgtttgtggaatgaatgaatgagtaaacaaatgaatgaactaacaagtgaaaacgtgagtgacaaccacactgcgtggatactcagtaaaattggttggggcagccctgcggggtgggtcccaagctctgtgtccagaaggagttgtcttgctccaaatatatcctctgtgggcgggcagggagccagggctgcctcccagaccctgacttcactgggccggaggcccaacctctgaggagttgaagaaaattaacaaagaagaggccctggctttctgtagccaaggctgagctgtgagatgagttggtgggggcatgtgtactctggaaataccacttactcagagacctgagatgcaggacagagtgctctgctgaagggcccagagaggactggttctggattgggcttcttgggaactctgccccaaatgtgcagaatgtgcaggaggcctggttccacttgagatctggggcaaatacagtgcttgggctgagctggtgattgcaaaactgaggccccctattagacagttttccatctaggcctgcccttctggcttgggcttgttcccagagctgctttcctgtctctcccttgaatcttcttttctgaagcccctgtgtctctgccctaattcatcatctggaatattttaatattaccccaactggtcttcccgcctttagacagtaagacctatctatcttgcttatagctgtcagagttatttttctaaaatacaggtccaactatataactttcctgttcaaaatccttccatagcttcccacttttcagcattaaagttggatggcctcagccctgtgatgagatccttcatgaccttactcccctctacctggaggttatgaaagggtaa

SEQ ID NO: 64130 - DNA, 1044 bp, Homo sapiens
ctcatgaagattggaactggaaagtcaggaacggtggctcttctctccgtctcccgaggacctcaaggttcctctctttctcacatttctctgtactcattcctgtctcagcaggctccctctgctcgattttcttgctcatggtctactctcagccactcttactcattccttctacaagtttttaccaagtgcttatttatgtgactgtttgtacctcaacaaagctcctacgtgttgaaaaatagcaagcaaaacaaagttgctgcatttatgaagcatactttctaatgaggagagagagacagtaggcagttacatgtgtgctgacgttaaatgctatggaaaaaataaagcagggagcagtttggggaggggttgggtttctgctgcatataggatactcagagggggtgtccctgatatggtcatatttgagcagagatctgaagaaattgagggggtgagccgtgaagatatctgggggaagaatgctctaggaagagggcgtggcaagtgcagtggtcctgaggtgggaactgtgtggcactgtgtgaggaacatcagtgaggctggtgtggctgatgttgtgtgaacatggggaggatggtggaagatgaggtcagacgggtagcagaggacagatcatgaattgtgttacaagccattgtgaggacttagacttttactccaagaaggaggggaggcattagaggatattcaacagagaaatgacatgatcttagattttaaaaaggacctctctggctgccgtgatgagaatagactgaaagggacaaggtgggaaagggagacagacagggagaccacttaggaggcaactgcagaaatccaggtgagagatgttggtggcttggaccagggtggcagtggtgagggcagtgataagtggtccagtttaggacgtattttgaaggtaatcaggatttgctgatggatgggatatgggtgcgacctccctctggtgaggtggccctgctcaaatcagctgtggacaaggaggatacgtggtatagtgtggct

SEQ ID NO: 64131 - DNA, 1028 bp, Homo sapiens
ctgtaagtataaaatacacactagattttgaggatttagtatgaacaaggaatatatttcattaattttttttggtattgtttactcattaaaatatttttgatatattggagtaaacatatggtaaaaacaaatatattaaaattaatgtctttttttaacttgaagatatctatggggcttgcattatatatgtttgatggtgctgctgtaaaccctatctcttcgtcaacactgctttattcactgcttaattcatagctttggctggcattgctgagggcacttctctgttatcagcttgggatctttcagaaattctttatgggatgatagggctacttagtaactcttacaagaatccctgattaaatacctataaatgtcagtttcccttgagaagcaaatgtgccatgttattagcagtttaagctctagctctggagtggagacaatagagtgaaggggtttgggaggtgggaataaaggatttgggtcaaaggggttgggaagtgacttatgctatgtgctcctttgagtttgcatctttcaagagcccattattagaagggttttgtcactgggaccacagaaggaagggccctgttaaggcttctgcaggttgccaagccctggtctttctcccttggaactgtaaagcaaaaaagtatatgagacaggtctcaatcaatttagagatttatttttccaaggttaaggatcatgacccaggacacagcctcaggaggtcctgagaatacaagcccaaggtagttgggttaaaggctcttgtttttatatgttttagggagacataagacatcaaccgacacatgtgaagtatacattgatttggcctggaaaggcagaagcttacaggtcacaggtggattcaaagattttctgatcggcaattggctgaaagagttattatctaaaaggctgaaattaattgaaaggagagtctgggttaagataaggggttgtagagacctaggttcttaggtagatgaagtctcataggtggc

SEQ ID NO: 64132 - DNA, 1098 bp, Homo sapiens
acttctacacatgaaaagtaagaactgtctttagattttctttactttgataacttgtgattgtttagcttaagacccaagaaatgctgtttgctcatggtaaacagaaacagcatcttcgctacaaccactgacaccagctggcgtcataggtagctagatcattgcatttgttttgaaatgttaatatgttaaatactaaactaatatttcaaaaatgtgtatatatgatttctatatccttgtttttcagatagcctgcttataatttaatataaattaactgatgcattcataagatttcaataatgaaatggttcccttttaaaaaataaaaatactttgtagattaaaaataaatcagaatttcaaatttaaaattgtccacacactaggaaatagaactgtgttaatatataagaaatctggggataattaagaatgaaggacttttctatcatttccattttataaattgccacctgtgaaaatggtttttgcacattatttgtatttttctttgtatatgaaataattttttgtactttgtaaaatatggagcccattgtaccttcagctatttgagactatacacagtgcttcttttgtaactggattactttaactttcgtgaaggcattacattgcctcacattcactaaccaccttgaattaaatttatttcttaagaaaaagcatccctcatttactgtgaactaaagttcattctgtagtgcacagcattcaggagggtaacactcaggattcatacatgggactaaaggttcaagaataaaacaaagcatgacccactttgttccttcattctcctaatgtcatcactgccctttgctcaagaagtaactagggatactggacatgttagcatgagcttctgggttccagacacacttctgcagagtttaggtaagagacttgaggccaagattctcatatgtgctgccactcctaccactgtctctaataagctgtttgaaattgcttaagtcccttacctattctgggtccattccaccacccagagtatatggtaatttgtgaaaattttaggcatgagacattgaagtctgtttgagc

SEQ ID NO: 64133 - DNA, 1020 bp, Homo sapiens
gagaccgttttcctgacagtgggcttccaatatggctccaactaaagaaaggggacacgaaggccaactttatggtatgcatgaatctcaggcatccccctggagcacaaggagctccctcaccttcagtgcattggtgcagtgcatgggaaaggttaaaggcaccattcattgctgacccttcctccttagtcaaagacgacactaagaaaatgcaaaataaggcgctcccagtgtgtctccctttcctgccagtacccttctatcaacatcccctatgactctagagaccacaaaagtaaaggcaataacagtatggtagttgaggaagaaaaattcatacagacgttctggggcagtatggaaaagaaaggtcacaggaactgatttaccacttacccaaatccataaaacagccctgcccttcatctctggttcactgtcatttggttttgtagctcaagaccagcaaacgtgtgtataacttctgcgcccaggatggacagagtgcccagcaatggatggacaagatccagagttgtatctctgatgcctgatgcccatggtcaacccacgcagaagaaacagaagaactcatgctgccagatagatagaaaaagaagcatggatccttgaggagctgacaacaagttatcccagggcctgaggttctcctgcccagtcccctcttgcaggggttgctatatctacttaacctgaataggtgtttcacacaggtctggtcaacagccccatgcactccctgtatcttgcactaaatttttctaacagggtcttagtggttaatgatcagaagatgtctcctgagccaactgtgaacctcacccaggcaaaatggctaccacctacttgggtccttcttcatgaaagctatagatccttttttgttctctgaggtcataatttcctcggagacctgtttaacaagcaaaaatcaaaaccctccaagattgtctcatattctacctggactaggtttcctatgagagacatctactt

SEQ ID NO: 64134 - DNA, 1085 bp, Homo sapiens
gatcattccaagcctcacagatgtggtaatcccagcagaaagcagcagtctttccccagaggtctagcagaaaaaatccagggagaactcttataggccatttttgaatcatctaggggaaatagagacttgacaaaaacaacagatatcccctcccctttacagcattttgtaagtgtaaatcaaaattaactctcctgtcatcatttcttctaggtcctttgagggaacactttataaaagaggggctttgctgaaaggttggaagccccgttggtttgttttggatgtaacaaaacatcaggtaatactcttaaagccaaaagaaattacttctgtctaggctagtcccagtccctggctattatgtggctctagcagacagatagattcctcatgtacagactgcttttttagtgcctctcatatgtagtctggaggctcctcaagggccccagatgtccctgagtaagggcaatagccttctgagggagtttcccaagtagctcggcctggtacatgcaggcagaggcagcaacaattgagcccagagcatagagcaatagaactctttttttaatgctcaaatatctcttgctgcctgatcttaacacccaggtgaggggattcctgaggttttcagccagttgcatacataccacatgcacatataagcctatgcctgtgaacactccccagaatacaagttaccttcgtcctcgcagcagaaagcatccattcaaaacagagggcattaatttattctacaaacatttatcgaacaccacctctgtgcccactgctgtactggttactaaaggaggcactgttacccttcaaagatggcagcaacaggggagtaaaggggccccaaaagcggcagaaggggatgtgcccacccaaacttggaattcaccgtgggcaagtactagactggtccttgctgactatgtcaagaaatcttttgactactgttaggttcttagctattcctgtagcagcctctgcaatccttagcatcatagtctttactccagtgatttcaagggagagcagttcctacccaaacctccagcaactctgca

SEQ ID NO: 64135 - DNA, 1031 bp, Homo sapiens
aggaaggctgggacatcactgcacaagtaaactattagacatattttttgatattttatatttatatttccatttggtcatttttaaattcttcagatgactcttttgtataatgactaatgtgtttatggacagagaaagtcctgtgttaaacagcacctggtatccatcagaaaactccgtaccatgagctcttagcccctacgcagcctggagctctggctccgggcatcaagctctcccatccacagatgtaccatgcaggcttgcggatggagcccttgaccagcagtgtgaggcgtggaccatccttcctgggttttgtcagtccatcccctggctctctataagccccgccttaactcactccagagtgaaaagtgtgagttcagactacattaagacattaatctgcatctgccaaaaagtagaattgattttaactgatcctctggcctctgattaacttaggaaaaggttgctgtcagcaaactggccagttaaggattaaagtctcaattccctgaaagtaaacttgtagccaaaatgaatttgagctttagtttttactggcaagtttacaaaattaattttattggccatcctggaatggttagtgaacaaatttgctgtccaggtaaatttgtgaattagctatcatcagaaggaagtgcttttatcttagtaataggcctttttcagaactaaaattaatgacaatccatcctgcttatgccctaggtgacatccctggttcagttactcagtgatcccttttataggacacttgaaggcttccagatgttggttgaaaaagagtggctctcttttggtcacaaattcagtcagaggagcagcttgaccctcaactgtcaggggagtggttttgctccagtcttcttacagttcttagactgtgtacaccaggtaagtagagcaagcttgagttgacttgatatgaaggaaagaacacaacatactagcattgatggagcattgcgatggtgtgcccggtaccttcctgtcataac

SEQ ID NO: 64136 - DNA, 1018 bp, Homo sapiens
aggaccaatgtattcctaacattcacccatacacaccccaaattccttaattttattataaaaatttgtttctgactgaatgacaatcttcaaaagcttcttccatttggtataattttttagtggcaccttctgctgtgtgctgtccatttcattgtgcttatagtatttataaacaggtgctgaaatttcatttaacaggtactcaatacatcttttttttgtgactgtgcagctttttgtttgttaattaaatcttctacttttattatatttacatttttcccctgctaattttaaaaattaaatagcctattcttctcttactcaatctgctctgacatttgctgctatatacattttatttctctttctgtctttaatcttacctaccagtgcatgggtacagagataaatgttttactcagtcaaatcccaaatcttcagctaagggaagagtccataatcaaggtactgtattatgtgtcctgatatatcactcttttaaaccatcttcatgtgaaactacatatgttacaagtaatttttttgcatttgtaaaattatatcctttattctcatctgcattctgaatttcctctgattccatttacaaaaaaattaataattgccataatgtctaagaaaacctcgtaaactacgtagaaagattcatgcagccgggtgtggtggctcgcacctgtaatcccagcactttgggaggctgaggcgggcggatcacctgaggtcgggagttcaagaccagcctgaccaagatggtgaaaccccatctctactaaaaatacaaaaattagccgggcgtggtggtgtgcacctgtaatcccagctactcgggaggctaaggcaggagaatcacttgaacccaggaggcagaggctgtggtgagccgagatcacgccattgcactccagcctgggcaacaagagtgaaactccatctcaaagaaagattcgtgcatgtgaagctgaaatgaccaataaaaacttttcttgggaac

SEQ ID NO: 64137 - DNA, 1030 bp, Homo sapiens
tagcatttaagcccaatggggaaacacatatacttacaacttggataaatttctttgttgagtagaaaaatgccttgagaaaattagtactgcctctcaaataccaaaatataatagctgggtatatttgagaagtagccacttggaggcagctttttaatttttcatcctttacattttaagtttttctccatgtattattttattcttgaaataacctccaggatatgtatttaaagaggcccagggagattaagtgacttggccaaggctgcatagcaaatattagtataactgggactagaattagttcagtgttgcatcgtatcagtgcagatatatttactgaatacatctagtgtctcatgcactgggccaggtataagatcacagtgatcaataaggccccacatgtgacctaagcatctcttttccctctcccctttcgtcagaacagagtagaggaaataacaccagtgcttaggaaacactagttctctgaacagtaacgcattcctatggggaaaatgaactgtgtcatatcttccctgaagcagtccccttagccggttcttactgattgggtccaaggtcacatggttcctcaggaaacaatacattaagagtttagtggccgggtgcggtggctcacgcctgtaatcccagcactttgggaggccgaggcgggcggatcacgtggtcaggagatcgagaccatcctggctaacacagtgaaaccctgtctctactaaaaatacaaaaaattagccgggcgtggtggcgggcgcctgtagtcccagctatgcgggaggctgaggcaggagaatggcttgaacccgggaggcggagcttgcagtgagccaggatcgcgccactgcactccagcctgggtgacagagcgagactccgtctcaaaaaaaaaaaaaaaaaaaagagtttagttacattctaattcaaaccatagtcccactacttactgtgtgattaagcaaattaggaaacctcttaattctcagtgtcttcatcttta

SEQ ID NO: 64138 - DNA, 2809 bp, Homo sapiens
ttttttgttttttgttttttgttttgttttgtttttgtttttttttttttgtttttgagctggagtcttgctctgtcgctcaggctggagtgcaatggcgcaatcttggctcactgcaacctccgcctccaaggttcaagcgattctcctgcctcagcctcccgagtagctgggattacaggcgcccgccactacacccagctaatttttgtatttttagtagagatggggtttcaccatgttagtcaggctggtctcgaactcctgacctcaggtgatctgcctgcctcagccttcctaagtgctgggattacagacgtgaaccactgcgcctggctgacaactagtatctttgaaattgcaatgcatcttacaattgatgtgatcagaaagaatagtgtcatagtttaaatggcagttttttaattgataagcagtttttattgttaggcaataaaataacagtgcgtcttagaattgatgacatattaaagttgataaaatacaataatgctaattatttattttctattcaagttgtaagaaaatttatgaatatctgttgtccttgtagtgagtccatcccctgtcctctttaaactgtctgggccgatttcagtgattctgttttgcttcacccaaaccaggcttatatgcccatcaacccagaattgctctcacaattgtgtatactttttgctcctcatttagaaggaccagggattggcagtagttgctcctatcttctccccatcttcttccactcttccctctacaaatctttataggctcatgtcccctggtgggcctgtgtggcagaattgaaataaagttgctggtattggaaagttcttaactctacccattctgggatgtcaaaggaacccactcccaagcaataacctggtcaggatggttgggggatatcatcaaggcgttgttgttcatgaatcttcattttgagttgcttggataatgagaagctatgccctgtgctttcaagcccaatctgtgcttggaagggtagccctgtgctggttttccagacctgggctctttctggaagcataatgaggcaatcaagaagtaggtgtggtaaaaccagcattacagtggaggattagccatttaatagactggcaatttaagtggggctggtttctatatttgggtgtggtaacttgtagactatatagagaaaaataagcatagatagataggtagatagatagatagatagatacttgttttgttaacacagagacagtttattttattcaatatattttccttttatagctcctacctcctctttagaatcttccagtagcatagaacaagagaaatacttgcaagccttactgaatgctgtttctgtccatcagaaactcagaggcaacagcactcttactgtcaggccagcctttgctctatctccaggtaagatttgataatacttttcttcttgacagcttctaatgaaaggtcagttctgttcctagggttatttgtactgttatttgttatttgtactgttccttcaccaagacttcttaaaagttttaccctgaagggttataagtttaactccttttacttagaaatctaccactattaatgtctagtaaatagtaacttaacttagagattcagttttttcttttttgttttattttcttttttttaagagatggggtctcactgtgttgcccagtctggtctcgaacttctgggctcaagcagtcttcccgcctcagcctcccaaagtactgagattacaggtgtgaggtgtgagctcagttatttccttttcaaaagagtaattggagaggaagtggggaatataaataaagtcaccctttattcccatatttatcatacccagctcagttatttccttttcaaaagagtaattggagaggaagtgggaaatataaataaagtcaccctttattcccatatttatctttcatagactttaaaatattcttatgacatggaatatgtaagtggaacatgtttgttaaatgtgtatttattaaaatcatcatttataagtttgaaattcccaaaatatctgcagcctattatgattttcagtacaatttgttttcactggatttggatgaagccattaagacttgtactaatattctgtttcagttatcatgtgatggaaccccaaagggttcatgtagaggtaaccctaatgtgttagacacaggagcatgtgacttgagaagttggtctctttggcttaatcagctatttgaattagctcaacataagcagaaagtggcttttcttgtaaaataacaccatgcatgccttgctccatttatcattaaattctctgattgcacttgccaaacctaactctctataatcttgcaaatgtgtgttatctctgattaataataacattgccttgttatctctaataaagctttgggtacttaaaagtacaatgtttggcagcagttaaacatgctacacctgaagataactttttgtcatttgagtaatgttaacccaaacaacatggtttttgttcttctttttggctgactttagggactgaaaggaggacttcaagaatgtccactgtgcttaagcaggtagtgccaggacatttggatgtaaacccatccaatagctttgctcaaggaggttagtaagattgattttataactgagcactgatgcaagcttaaaagcagaaagcatttttctagatagttgatattttaaatcaattaattatgattcaaattgttcttaattaccctcttctgaatgaatggtcaaa

SEQ ID NO: 64139 - DNA, 1025 bp, Homo sapiens
aatatgttggccaggcacaatggctcacgcccataatcccagcactttgggaggctgaggaaggaggatcgcttgagcccaaaaatttgaaaccagcctgtacaacaaagtgagaccctgtctctacaaaaataaaaataaaattaaaaaagaaaataaatatatcttacccttcaactaatatgtttctgaatcttagaaaattactatgatattagtattcaatttcttatattctctgtctccctcttctctcatttcctttccccttttcttcccctctgttccttcccccaatcattctcttctctattctatgtctctgaagctatcctggccttttagtcgtacctcaagctgtacaggacagtagtttaccaagagtagctcgctgctatcgacacaatcgcctgcctgttgtatgttggaagaactcaagaagtggtactctgctcctccgatctggaggattccatgggaagggagtcgttggtcttttcaaatctcagaactcccctcaggccggtaagcatctctctataacacaattaccacccgttcacataaggacagtgctaaaaataaaggaagtaaaatctgggaatggtgccttttcatcaagtcttgtctcacacacaaacttttccactttgctacatgcaacatgtacagcttaaacaagaactatacttgatagtgtgaggctccacattgaatttgacatcttaatatgtctggtctgtacttggattttaatagaaattaatataataaagtctttggtcctaggcaattttcattccagcaaaccagagtattcacagatggaaactaggttataccaatcttttttctttctcctgggaagcatccaaatacatttaacagcttcagaggtaagatgagcttctgtgccatgtgatatgagatatccatcctcactcttacaagtcatacgcacacacaagacagcaaactaatgactgcaaatgctgcttcaggatctttcaagcaaagaggttttt

SEQ ID NO: 64140 - DNA, 1042 bp, Homo sapiens
agcagccacagacagtaaggaaatgagtaggcatggccagttttggcccacaggctataatttgctgacccaggtgtaggcaaggctttcttatgcggtctaattggaatgttttcaagggaatattacttaaaggatgtaaataaagaggcattttcttttttcagttcttgtcatctctcactgtttttcaaatatgttgagtcttattccatgctttactatatgtaaatatatattttctaaaattacattttcaccatccacaagtttagtcattttcatctccaggtaagatttttctttgcatttataaattcctgcttaaacagctctgaaatcactttgtaaattgtaagctttgtacatattttagaaagttatcttaatgttactttcaaccctgttgctcttgaagatagatatgtcattttaaatggcaatttaagtttacaaatattaatatgaaacttcagaaacaagttgggaatatagttttgagattgtggccaaataaacattttgcatgaagttctgaaaaattggcactctgagtatgcagtaatttttctggaattctccgtcattctaactaaattttctctgaagatgagtcatgttgtcggggtgtgatgtcctgctgtttggaaagtttgctatcaaaattatgccagccattgagaaaacagactcatttatcattccaatctgtcagaagtaaaataaaattttaatagatgacttattagaacactggttataaagcatttatgatggtaaaaagtaatatatatccattaagttattagcaggaaggaaatggaataataaaaaataatccaaaagaaggcaagaaaggaaaaaaaaggggacatagaacaaatggaataaataacaagtagtaagatggtagatttaaattcaaatatatccataattgcattaattattaattgactaaatgttccaattcaaagaaagagatcagggtttgctttaaaaaaaaaaaaaaaaaaaaagtggctgggctcagtggctcacg

SEQ ID NO: 64141 - DNA, 1040 bp, Homo sapiens
ctcactgcaacctccacctcccgggttcaagtgattctcctgcctcagcctcccgagtagctgggattacaggtgcctgccgccacacctggctaattttttgtatttttagtagagatgagatttcaccatgttggtcaggctgctctcgaactcctgaccttgtgatccgcccacctcagcctcccagtgctgggattacaggcgtgagccaccacacccagcccaaaaggaagtttttaatcctgtgctttgagctaatcatttcttcaatatctgtctctaccatcccagtttcagatgagagtgagctccccacaggtactaccctgaaggcctcaattgctttgagctaatcatttctttgatatctgtctctaccatcacagtttcagatgagagtgagctccccacaggtactaccctgaagacctcaattgctttgagctaatcatttcttcgatatctgtctctaccatcacagtttcagatgagagtgagctccccacaagtaccaccctgaaggcctccgagaagtctacaatggaacagttggtggaaaaagcttgtttcagagactatcagcgtttaggtttaggaaccataagtggcagctcttcccgttcaagacccgagtattttagaattactgcctccaacaggatgtattcactctgccggaggtaagtgtgtcagtgggctccaaaaagaggtcttccttcctttcttcttatttgaatctttaataggccatttgcatccatagccctgagatagataaaaatgcctgaaaataagaacaaggtctccaggatacgagcaagcatctcattggcattctcggaacaattaccttactgaaagtacctctagtaggtgagaaggtgaaaggtaaagtactcaccccctatgaatttctcttgtctttctcttcccagtttgcttcttttctagcatgactaaagataacttgaagaacaggattttcccagcccaatagaggacatgaaagtcttttgtaggctggggagccacaaact

SEQ ID NO: 64142 - DNA, 1016 bp, Homo sapiens
ctttgcctaccagggaacatgttcctcagttgccaagtagccaaagatagctgtattacttgttctctatgtaataattaacttgggaggacaggttgctttagaaggcccaggtagtccataataaatgaaaaaatcctcttttgctttattttctgtggttcctgcattccttttgggagagtgactaaaggtattccttacagaaacaaatctgggtccaaacaaatttccttacagaaacttactgcctgacagtagtttccaaatgtagactagtagaacattgtgttttatcaccatcacttaccaaggagccatggagttaagtgagccttctacttgagtagacatcactttgctcatgtttctgtcgctatgtaaattgactactatatagtagtcatttgttgcatttaagtactgaccatgatttctttccttgactgtcttagtattgcaggaagtgtagctgagagctatgatacagagagtgggtttgaagattcagagaatactgacattgccaattctgttgtgcggttcattacccgatttattgacaaagtttgtacagagagtggagttactcaggatcacatcaagagccttcattgcatgataccaggtaatcactctgcagatattagagaatcagaatattggagattattgagtttcagcataaaacctggcaatacatgtcttccattatagttcagccatgctatttatttattttctgattagtttttaaaatgtttttaaattgttgtaaaatacatatataacataaaataatctaagtgtacaattcagtggcattaattacatctacaatgttgtgcagccatcactgttatctatttctaaaacttttttattaccccaaacactctacccattaagcagtaactcctgtttcccctggtaacttctaatgtattttctgtctctataaagttgcctgttctagatatttcacataagtggacttagataatatttgtactttt

SEQ ID NO: 64143 - DNA, 1366 bp, Homo sapiens
ctgttgttaatcacctcttaagtttactcttacgctgaaacccagcaggaagtccctgaaaggaaggaggtttggtttgtgtttatctttccctgcacaaatttggttaccagaaaatgcccttgaagcccagggcagtcttctagagagtatgtgagccaggcaacagctttggcggggaggtaatgggctggaatgagcagtaggaaaagtgcagttctcctgagtccctaattcatgctatatcctcattctgtgtgtaaggccaagctgtaggttcactcatatttcagttgctgtctctttaaaaagagtaccctaaagccatagaagaaatgttaaattatctggagttttatgtttacatcgtgatggattttattatatgccctaattgtaataatattcactaaacctacagtgcctccttttcctgtattttctaattgatataataacagctttgatttttagctgttactaaaatacccattttgataaagtgactgagactctcaaggatccaacagcaagcccacagttgccagttaaaaaggagtaagttgctgattgctaagcctgtactaccatacgatattctttagagaaatcctttgatctcatctatgattaactgtggcccctgtgaccttatgaactgttataattctgccagccccatgatgatgtattttgtgtgttctcacagaaacttgcccctggagtcagccagtttgcttacacgtgtgtacaagaccaccccatttggacaaatcagcaattttgggagacaaccttttacaatgcagtgcaggaacaggttcgctccctttatctctcagccaaggaagacaatcatgccccgcatctgaagcaaaaggtaagagagaagaaaagaactctaattgtgtgggattaggattctggctttaaggaaagcagatgttcccagggcaaaaaaaactctagctacttcctgccagtgtatttgggttttatttagggagccctgtgatatctttcctctgttgatttcagacattatgtttttccataataacttcttaatacagttcttcagcactaggattgttttaatatactttaataaataagaatttcctggaaatgactataggaagttgaatagaaagaacaaacctaaaataacaggcatacttctctatgcaactaacttccctggaggaatgtcaaattaaagttaattaactccaaaataaatgtaaaatttggtagttgtattaaaaaaatgccagtaataaatctaggtcttcttctaggaatattctacatgtttctctatgttttatcagcataaaatatttttatgaaaaatatcaaaaaa

SEQ ID NO: 64144 - DNA, 1017 bp, Homo sapiens
atggacatacacaggtaaaaaacaaaatgggaatgataatatgtaattcatgatcatggttacctctaggataggagagaaatagaatcaggagaagtatacagtggacttgtatgtattgtatgtcctttctttaaaaaaaaaaaaaaagagagagagggagggacaaagcaaatatgtttaagatttgataaagccaggttttggatacaattttttctattcctgtcttccttttgtttgtctctcaagactaagcaaaagaaagactcccaatttcatcagaaaatgctctaaaattaattattaaagtgatttaatatctggacttggtcaggccagagcagaatcacaggaggacttgctagcaccatccctgaattgtgcagttagttaggtacacttatattccagggaccagaactagataggaaatctccagcaatttagacaatgaatctctctattattctttaagaccattacatgtttatggaaaagacctgccagctagccttctttcctgaaatctggttttccctgagctcccaaacgagagccttgagcttggggaactaacatgtctagccagacaggccttcaacaggcccctcatgctgatatcttaacctttcccttaaccatctcatctctcagatgatttgcatcctttatttggatttgaatctggcctgctggttggtgagccccatgagtttattcttcatatcctgtcccatgctgggtttcctttgaaagctttgtggaaaatgaatggcattgcttaatctagtaccttcacgggctgttttttctagataaagaaggaagtcaacacattcttaaacatctcataaaattgcatggcacaataccacttttttttttaggacagaatcttaaaaattattatgaaatgtaaatattgttgccagaattgaagagaatgaaagagagatgtgatttgacaaaagcattcccaaccagcaccaccatctcacaccctcagtatgagtt

SEQ ID NO: 64145 - DNA, 1049 bp, Homo sapiens
ttgttgaatgaaagacaggacatgaattcaactataaattgaatgtctgcttcaccagtcactggatatacattgacaaataaaacagacacagtccctatgctcaccaagcttagcccaggtcctccagctggcaaatggcaaaaccgatgatgatgcatgtcagcatcctccacttttggggttggaagtcacagggcatacttgattatgttggtttttagtggactctaatattttcatttagggcaaggactttgtagcctgaagataggaattagaatacttttgataagatacagcctaataacataattgagaaaagaatggaaaatgcaaaactcatgactcgtgaataacaaaagcaaagattttaataactatgtgtccctaaaaagaactttatgaatagattattattctagtttaattttgcttaggtggcactgtttcctttgtattagccagcattgttagcatttttgagaagtcatagatttgatggggatttgtggaggagctgctaaattacagaagaaattattatggcagaaaatcaattatgtggtgctataaatacttgattcagtaactcagcaaattccctttatgtccaaagtgcaaacattttgtacctaagtcaaaaggtctgtttttaatttctgcagctttgcagttgttcctctttgtcactgatagatttttacatgataagagagacgtaaagataaagaggggtcactttcagagggagttttaagtgttggggagatgaaagcatgagcttaaccctcggtcataggcatgtttcagtactgatagcaggagattacctggaagaagtcagagagccatcttgaatgactgtggagttagctggttttattatactcttgggtgacatttccagctaataaaattagaattaaaattataatcttagaagcaagcctctgggaaatatgtaattaaccttttggaatttaacaagcattgtgtgtacctccagtacctatatttaagatgctttaacctagcatttgaattga

SEQ ID NO: 64146 - DNA, 1356 bp, Homo sapiens
ggcttccccaagtgttggagttataggtatgaaccaccatgcctggccattttcacgtatttctaatagggaacatagttttcaaaattacactaaatacacttttgtatttcactaataattcagaagttccttgaatactggctttgccttagtaattaatatggatcctgattgtccttctatagatacgagagtttgtaggtaattctgatggaatacaaatatgccgactttcatagtattgagattgtggctagaagaaaaatcttatagaaatataaaaaatagatatttcctaagtcatcacttttaattggtaaatgataagaggtctcaaaaatttacaaaataggaaaaggattttgttttttttcagacttcgtgatctggatacatcgcatttcctacaataggtctcaagggattatatttttgaccacaaaaaaaaaagataggggagggagtgggtgatgaagggttttttttcatcgtttttttctgctgtaaaccaaatattaatcttaaaaataaattagtcagcagaaaaatgtttgagagtgaagacaagcatcagtgctggctgaatccacatttggcctggaaaagatgtgaatgtgtttattacagcacatctttccagcacagcagaattttagaatggtcagagaattagtgtcttgcttttatttcctcccttcattttcttcttgttctttaagacagtttagcattcctcctcctcctcttccctttcagcacaacctctcctggcttctcccacttttcctttctagttttgaaaaactgttcctctatcctactgctcctgaaaaacttctgcttctgagaaactatgaattattataattagtttagaactaatgttctttattaagattagtttatatatactatttaaactagtgatagaaggaaactggggcaatttactcagaagctctagaacacttattgtgttcttcagtgaataattaacagtatttttaatcttattaaatttatttttataataattactaatttttaattttatgaaatatttttctgaacttatcaactttttttgaatgataattaacttttttcatgtgatggacaatttttttttatatgatgaaaaaaaggtttggacccttttgttcattcttcagaaaaatgaggcagcctactaagactatttctttgtctactccaaaagaaatatagtacagttcagttcagtagacattgatgtcctatgctaccacgtcctgagtattaggactacaaaagccaacaagtcaaaatctccaaccttaaatacacacgcttacagagaagatagattagtca

SEQ ID NO: 64147 - DNA, 1050 bp, Homo sapiens
taaaaaggaaaaaagaaaaaaaaggacaattcaactataatatggatccactttacaaaattcaagtgcatgttatatactatttaaggatatttaatctaatgatacaaacatacgtggtaaaagtatttttttaaaactaaggtaataagaaacaaaatatttaagaaaattacctctgcgggacacagaggaggggcagtaaacatggggatcttccaatgtaatgataatatactatttaggtacatgggtgttcattgtatcattcttcataaccttatagcttatgtatattttatgtcttaaagtactgactgctattagattctttacagggcatatttatcttctcaaactcacttcaaacattttgtagattgtataagttaattgccaagttaggggatgattcacttttactggatatacattctttagagtatgagacagtagatataatactttataatggcaaaaatcaaaaacagcctaactgcctaccatttggctagcgattaaatatggtgcacctcttctttagaacactgttcagctactaaatagaaacaagtacatctatatatgtactgatatggaaaaatttcttatatattgctaagtaggcaaaagggaagttacataaagtagatatgaatctatttttgacctaaaattatatgtatgtatgtatgtatatgatagtaaaaatctggaaggatatttacactaaaacctgttacgattatcctgataagagagataccaatgattacctctgggatgtggattagaagagttttgatttccattttaaacccttctctgcttgaaacatacacatataactacattatataagatatataacaagcatgtattacttttataatttgaaaaaagtcctcagttttttagaaaggaaattttagcatcctatgagaagaacttgccctaaaagaaaagccctgtcttttgttactttattacagttactttgttaccattattatagaggataaaggaatagaattaacagattaaggtctc

SEQ ID NO: 64148 - DNA, 1049 bp, Homo sapiens
tttaatttttctttctgttcttgccatggaaaatttactagttatagaaaggtgtcttacgtatctatggctttgactcatgatctgaagcaacagtcaatttggtaaccaaagttttgttaacttgaagaaaaatagtgaaattaaatgtttttcaatttatcacataattatcttatatttcttgctggtttacatataaaaataaccacaaatctattttataattgtcttaataataaatcacctattccctaggagtttaattttactaataactatgttaaataaattataggatgcgtttgaattttcaggatgattgtttgaaagttgttgtttcccccagtggtaccatttggtcatttgtacctctcttgtcctcagacccttcctgctgcactcagagcccttaaaggaaaggcagcaagacagtgtctcactgatgaattgggtttgcatgtccagcaaaaccgggcaatattagaccatcaacagtttgactacataataaggatgatgaattgtactctacaggtaatttgtagttctttcagattattcctcttatttgagaatacttttcatttttccagaatattttgtaattaccaatatatcagttcttgagcctaccacagctaataggatgaagcgtcagtatctctatcatttctgtcaaatacttttttattacttggcataaatattaagagtttttgttctttctttgttttctctttgaaaatgctagattattttactagttctgtaatataagcaagttctttgaaaatgaaaagtcatctttaaagcattcagttatatattacttaatgtctatagtcacatcagcccttttcagtcagttttcagttgtccaagcagaggacaatgaatggtggataatccaaacgataaatgaattacttaattaagtatttaagtactttgtgtttgtaaagcacaacaacaaaatttccacttggcttcaaaatgtgtgtatgatctttcagaaacaaacttcccacaaaacagtgaggacaatt

SEQ ID NO: 64149 - DNA, 1077 bp, Homo sapiens
gctagcctgatacttcaacactggaacatgtaatcaaaataatgatatggaatactttcaatgctctgtaataagggaaaaaataaggtgtaggtcatatcaacagtttttgtttgttttctaataagagatgtggtctcactctgtcacccagctgcagttcagtagtgctgtcctagctcaccgcagacttggactcctgggctcaagtgatcctccgacctcagcctcccgagtcactgggattacagtgcaagacaccatgcccggctaatttttgtattttttgtagacaagggtcttgctatgttgcccaggcttgtctcaaacctctgggctcaagggatcatcccacctcagcctcccaaattgctgggattacgggtgtgagcctccacgcccaacctacagtcttaaagtagtagtctctttgcttttgtaattaccaaagaagtttaatttatttgtgctttctttatattcttttactagtttcgataatggacaaggtgacgacagttttcaacagtgcacaaagactagaagttgtcagaaactgtatctcattcatatttgaaaataaaattttggaaactgaaaaggtaataaaatgtgatctttcccaagtaagcatttatcatttccctttcagatttacgtgctgaggttaccagcttctctcttctttaattctatcccttttcctaataaagtatcctctcattgtttggatcattttaaatgaatagtgtctaagatttaaagctgttgggccaagcttaattatatgaccaccagaaatatattcatagtaattttttctgtcaaacttttaaacattgttcacaaaacactattttgggatattacttagaaacttaaaatttttttcattttatttttatttttggagccagagtcttgctctgtcacccaggctggagtacagtgacatgatcttggctcactgcagcctctacgtcccaagttcaagcgattctcctgcctcagcctcccaagtagctgggactacaggcacgcaccactgcgcccgcctcatttttgtatttttagtaa

SEQ ID NO: 64150 - DNA, 2038 bp, Homo sapiens
ggtatggggtttaggagaaaacttgtttaaagaaaaaaacttgtgaattgttggtatttttatggtttaaagataggagactggaagtgatcaccaaggaatgaatgttaatagaaaaaagacccaaggactgagccctgagatattcacattgttaagggattagggagatgagaaatagacaaagatgtagcaagaagacctagaaaccaagtaaagaaagtgttcatggaagaggaagacagatgccaagctgtatcagatgctgctgatagagcatgtaagaagaagtaagattttggtacttcatgttttatggcgtatatatgaatgtatgtataactacccagctcgtgtccctgtaagctcccactcccttcctggtgatctgccattgttattttaacttggagtaattttacctatgtctgatattacaggagaatccaaatcctcatatggcattccagaaagttccacggccaacagaaggatcccatttgcgagttcatattcttcctttcccagagattaatgaagcccgggttcaggaattaatacaggaaaatgttgctaagaaccagaatgcacctcctgccacacgaatagaaaagaaatgtgttgtgccagcaggtccacctgttggtatgtatttgtctgtctgttttaaaagtaaactgtttataaggatgtaagacccaaaaaggaaaagtgtgcaatttgatgaattttcacaaagtgaacaaactcctgtagctagaatcagagcattatcaatactcagaaactgtttcattcactgcctcccaaaaagggtaatcataacccaaccactgccactatagaatcttttctttttttaataacagctttattgagatatgttacatactgtaaattcaccaatgtaaaatgtgcgatcccatgatttttagtatatttacagactcattcaaccattattactatttaatttgagaatatatatatattttatatatatatatatatatagagagagagagagagagagagagacagacagacagacagacagacagacagacagacagattgagtttcacccttgttgcccaggctggagtacaatggtgtgatctcggctcaccgtaacttctgcctcctgggttcaagcaattctcttgcctcaacctcctgagtagctgggattacaggcatgtgccacctcgcccagctaattttgtatttttagtagagacagagtttctccatgttagtcaggctggtctcgaactcccgacctcaggtgatccgcccaccttggcctcccaaagtgttgggattacagtcgtgagccactgcacccggcaagaatgtttttataacctaaatagaaacctcacacctattagcagtcactccccatttcctccccaaaccaccttctccccagccttatacagtaatctactttctgtcttcatagctttacgtattctggacattttatataaatagaattatacaaaatgtaatcttttatgactggcttctttcatttagcataatatttccaatgtacgtctatgttgtagcatgtatcagcatttcgtttcttttttttttttttttgagacggagtctcgctctgtcacccaggctggagtgcagtggagcaatctcggctcactgcaagctccgcctcccgggctcacaccgttctcctgcctcagcctcttgagtagctgggactccaggcgcccgccaccaggcccggctaatttttttgtatttttagtagagacggggtttcactgtgttagccaggatggtcttgacctcctgacctcgtgatctgccctcctcggcctcccaaagtcctgggattacaggcgtgagcctctgtgccaggcctcatttatttttaaatgtctgaataatactccgttgtttggatatatatcacattggttatttatccatcaattgatggatatttgagttggttctacattttggctattatgaataatgctgctgtgaacatttatgtgca

SEQ ID NO: 64151 - DNA, 1012 bp, Homo sapiens
aaatttgtgtcacttgctatcccacatagctctaagtataatttgtgcacgttaaataatttcaaatacttgaattaatctgggaaacttgataagctctaacaatatcatattgatttgtctttcagtgctgagaccaatacataggaaaaattttctttttcccaaggtggctgttgcctactttgaatttccattggggtttggggcttttgttgtgccttgctttgcttttatttgaaattagtttcaagccttgtattctgtaacccctaggcatattctcacttagcctaccaaagctgggggtagctgggcgtgctgcaggggggaggggtgctgcagaccagatgatgtgtgtatatgtcactttttcatgtctgagaaaaatcattctacctcgaattactaaagtatactcttaaagcaggattatagagaccattccttgaaaatcattatccaaattcaaaatgtaaaagacagtgcattctgccaaactcttttcagtagtttattttggttactttggaaaaaaatgttgccaggttcactgtaagtgtttagttgtctagcccttgtttattactttatatttgcatttctctggaatcaaagatgaaaatttggctgctgctttgtactgtcggaaaataacggatttccttatttcaacaaggagattcaacacaaaatttggctgtagcttttaatgagcttggtgacgttcaagggaccagtccaaacacatcttgtgttacaagtaaaagcagatgtttttaagtatatgcagaatacagtgagccctaccctaaacttcctctcattgctattgtcttctcaaaagtcatttcgcgaccaagttaggttcaaggtagcaaatgtggtcctttacatttatcatgctgcccgttagagggcagcagtatacagactcaggagccagaaaaccaaatattactgtattctggggcataagtctttttcgaatcttctaaacacagctaaatat

SEQ ID NO: 64152 - DNA, 1548 bp, Homo sapiens
ccctattctttaaaattgacactttaaaagtgatcatcgtgaagtattattattaagagattatattactaggtaagagcccttcaaatgtcttctacatttcataggccttattggaaatttttttcacaatctaattatatttcatttaatttaataaattctattagttaagtacttattagtgccaggcatattctaggtacgtaattctcctaatatccttcagaaaaggatacacagacatgacaagtaagaatttgtgactgtcccagtggattgtcattagattgtctgagattccttctagtgctaagattctgaagtccgtgatgacaaaatcatcattcatgaagtaaatactttataaagttaaaaaacagaacatgatagtaaagttactttcttaggttatgcaggaaattgggggaagggaggcaggatggtatcaatgcgaggaaaataatccacatggttctatttttaactagtcagttgttgtttttttaatcacatttctaaaattcccttttgataagcaagaaccagccatctaatttgactctttccttgttattgggttggaattgagacctggtgattccattcagatgtttgtaaatactttattgcactgaagtctggtatgtgtatctaggccctcttttcatttccctttgaagcacctcaaaaatacaccttaattttcctgtctcttctcaccactcctttatattgctttttagtgagattttaggaatgtgagtaggatgaattgtaactgagcttagctgctcttttagctttctggagcttcccaaataattaagaaaggcatttggtgactttgggggaatgggttaggtggaaggaaggagaaggaaatgactaaacccactagagacaaacagtgtaagcattggtaacaaagattattgtaaaaaagatattgtaacagagattatcggcaacacctctatgcagcttctttccattcccaattcataatgtaggagttggcctacttttttggctttcagaatcttcagtgtctgcatgagaacacaagtaactacttccctgccctatccctatgattctttttttttttttttcttaaagagacagggtcatgccctgtcacccagaaaggagtgcagtggcttgatcatagctcattgcaaccttgacctcctaggttcaagcaatcctcctgcttcagccttcctagtagctgggactacaggcacacatcaccatgcctagctaattttttgtaatttttttgtagagatagggtctcactatgttgcccaggatggtcttgaactcctagcctcaagcagtcctcctacctcagcctcctaaaatgttgggattacaggggtaagccaatgcccctggcctctatgattcttgatatgcacatataaaggaccactaataaatgttttcacaaagtgagaacattaagataggccaagacaaaaagataggccaagacaagaacttcataaaacttctacttcagggcattaagaaatcagt

SEQ ID NO: 64153 - DNA, 1049 bp, Homo sapiens
cacagaactagaaagcttcctgtgatagtttttttgctctggattgtaaattatgagatattacagttggtactgtatatcaaaatagaccacatttttcaaagtaattttcctgtcagtcagtgtgttatgaaaacatgttagtcacaattttttcagttagtcatttgccctcattatggttttcatttgggtctcttgtaagacataaagattagactcactggagaccagaaccacctcagacagaaccgaccagtgtcctctgctttggcttggcactgcggttgtcagctggtcaggagttgcattgttttgaacagagggagcgaaaagctgaaagaaaaaaagcaaattgacaagtgaccacagaaacacaaggatgaaaatattccatggatagaggaaatgcagtaagttaaaaggactcggatgtgataaagtgtgaaataactatttgaacaccaggaaagaaaagagcataaaatgacagagattatattcatatggaaaaatggatttgggctaatgagtgttccttatttcttctgctgtgaagttttgagtcctaagaaaagtaaagtaagtcggaactatagtcctccagggaaaagttgagggaagatgtgattttttttcattacgattaggtcctgactttagtaaacaaaaaaatattctggaagacagaaatgtaacattcgatactgtttctaatctaaacattgtcaaagtagaaattttcttttaatttgtggttctaacatatactttatctgtatagcaaataacttctgcaaagacaactcaaccgatctaaatttaaagccatatcattgatttaaatataatattggcatccaaagattaaaatataataatggttatacattttctcattagtcttttcataagggaaatatagaattgaacattaaaatcttactaataagatggtggttattggttgtatatctcttgaaaaaataaaagaaattataaatcaagtaaacttttgtttttgccgatttcaaacgttttttaaataa

SEQ ID NO: 64154 - DNA, 1045 bp, Homo sapiens
ggagtctcgctctgtcgcccaggctggagtgcagtggcgcaatctcggctcactgcaagctccgcctcccgggttcacgccattctcctgcctcagcctcccaagtagctgggactacaggcgcccaccaccacgcccggctaatttttttgtatttttagtagagatggggtttcaccgtgttagccaggatggtctcgatctcctgacctcgtgatctgcctgcctcagcctcccaaagtgctgggattacaggcgtgagccaccgcgcccggccgaacatgtttcaactgaatattttgtcttggagatctttctacaatagtacatatagaactaccccagctaattgaattgtattcatggagggaatatattataattcatatgctgacattttcatcttaatgtctcaataatagatttcattgatattatgatattttacataacaaaacttttttgctttagattttacacccagatttggaagtagcagatcatgcttttcctcctccacgaacagctttatcccactcaaaaatgctggtaagaagtttaatatttaaatttaatgctgttaaagagagctgtatttttatttatagggttgttaaagaagctaagtgaagttagagttagatggacagcagagtaaaaagtgccccaaattagaaattaggatacttgccgctgactgtccttatgtcctgctcaaggaggagccacagggaagttcactgggcaagaggccactagggctaagactgttgccctgaggaggcatgagttaagtgtaggacagaaaatcagagcctagattatagcctggaaaactgtgccaagcatcaaattgaaatggccacacaaggattcaaaacaaaagagatgcttacaagaatggatataaagaatgttggttataggagagaatcaagtttgaagagtctgtggatgaaaatagtttcaattagaagccataaaaggttacgtatataacagaggccccttttttattttgctcagtgcatttcttagcagtggg

SEQ ID NO: 64155 - DNA, 1047 bp, Homo sapiens
cacagtgggcttcaaatctagcttgggaagcagaaccaaaacttaagtacaaaaccattccaaagtatcatatgctaagtatcattcagtgaaacagataataattgcagactaggcaactggaataaatcatacagagtttaaaagactcagtggacattttaataagagctaacacctagagtaagggaaagaaaaaggacaattcaaacaaaaagcttgtgcaaaggaaaaaagattgtagtgcttatgataaattaaagtcttatgttctgggtactgtgctaaaagttttacaacactttatttcattctattttatttaactcacatatagtttattctcacaaaacaccatttgataggttttaacatttccattttacagatgaggcttacttagggacattcagtaccaagttaaagtgcttgattgattctgtctccaaggaccaaataataaccacatatactacaaagctgcaaaaattgtatcagtgtgctataggttcaagaattaagtgtcaagggtaaaaacaattatgggaacaaaaccaatactccagaagcagaccctattgtgtataggagatcagtgtccaacaatagaagctttataaatcaatggaatgtgtgtatttcaacaaatattatttaaacagttgatgagctatttgagaaaagaaaaaaatttaaacatagtatcatataattaattccaagcagttaagtaattacctggaaaatggagtaataaaaaggaatttataaattcgtctctagatggtataaaacagtggagaaaaccacacacaaaacagtgtatagatttagctgaagtactacaacccaatcatttttggtactcccccacccccaccatcccgctctttatcatagtaaactatgctcattgtagaagacatagagagaacatgcaggaaaaaatttgagagaacagaaaaagatggtttgacatattttcttccaataataaggattttttttttttaacaaaagttgctgtacactagttgaccatatagg

SEQ ID NO: 64156 - DNA, 1097 bp, Homo sapiens
agttcgagaccagcctggacaacatggaaagaccctttctctacaaaataaaaaatattagccagatatactggtaggcacctgtagtcccagctactcaggaggctgagatgggagaatcgcctgagcccagggggttggggttaaagtgagctgtgatcatgccactgcactgcagcctgggtgatgaaacaagaccctatctcaaaaaaaaaagaaagtgttgtttaacctgcaagtatttctggattttccagctatctgcctgttattgatttctagtttaattctgtcatggtctaacagcagacattctatgattcctcttttttaaatttgttgaagtatgttttatggacaagaatgtggtctgtcttgctgaacaagatatctctttttttgtaatgaattgaagactctcagattcatatggaaatttaaaaataattctattttccctcaatgatacatattttgcccttgatttctaatgtattccatgatttgttctcatagttgggggatgtctttaattttgatgcggtattcctacataggcctacctgggtctcagaaatggcacccagagtggcaactgtgggaaatcgaggctatcttcatgaaatatatatgcacattggtgaaagttttcaccattatgaatctgtacattaacttttttttaaatgttggctttagactcataccacatcaggtaggaatttgttaaaatgggcaaacatttaaaatttctcagagattaataattaacttttattgtttttaaatgttacatttttttttctatttcatttagttttgtcagcctggcgggtggcagctgtccagagagaggaagcagccaacgttctttgtggttgtcctgacagacattgactcagatcgacattactgctcatgcctaaccttctatgaggcagagatcaatcttcaggtacaaaaacctttactagctaaagtacagtcgaaggtacaacatttaggaatgttttttatatgccatatttttgttacaactgcaagtttgagttttatgggctagcataagaagcatgaagaaatttttatgtttaagg

SEQ ID NO: 64157 - DNA, 1035 bp, Homo sapiens
atcacagccatacataagctgcaaaaattacaacttcggccttatatttacagagtccttctttttagggtaaaatgttttaaaactaaatataacaataaaaattacccattttctagaaaaattaaaatcatgtatatgttatctccaagaaaaaaattagcatattagtaatcattttgattgccaaatgatggatctttctagggcctgagacccttactgttcccttgggacttgttttaatttctgtttctcaaaattactaactttgctttttctctacttttataagtgattggaagagttattttctctaaatattgtcttcagatcatattttgctttatttttcctttgtaggtgagtttatctttggtagtcttgaaatgtttaattattttaaagttcttaaaaatcagattacagttgttacattttacagtacaaataaattcagctaaactattacttgactaatccaaattgtactgataacttctgggcctcttccaagtaagagaaatcagggaagcaaaactcaaaaactcctagaaatctaccaagaactaacatttcatcataaccgacagttgtcttggttttagatcagttcgtgctttctttatctccttgtgcaggaaaccacaaaattatgtactgggtcacctagaaagtatagaattgtctcaaaataaaggcagcaagtaatggttgaatacctgccatatccataatgccaatactttttggagtggaataaatgatgagatacagttcctcctctatgcagcctccctacccccaaaattatctgtattacagacattaactagtaattgtttgctttattatgtatgcaggcaacattcctgagagcttataacggaagcattcatttcagttcattgggtctttatggagcactttctttatgtacagaattatacttaataatgtactttgttagctcagttgttatggtgacaagctggtgtataagaaaattgaatataggttatagtgtagagtaca

SEQ ID NO: 64158 - DNA, 1132 bp, Homo sapiens
ctgctcttacctcttctgtttattcattttgcttctgtcttctgtttcttgagccttacaaattttattttccccaaagatgtgtttgctaactgacttattaaaggttgcattgtccttgtctggtagtgtattagtccatttcacactgctgataaagacatacctgagactgggtaatttataccagaaagaagtttaatggacttacagtttcacatggctggggaggcctcacaatcatggcggaaggcaaggaggagcaagtcatatcttacatggatggcggcaggcaaagagggagcttgtgcaaggaaactcccattttaaaaaccatcagatcttgtgagactcagtcactatcacgagaatggtgcaggaaagacccacccccataattcagtcacctcctgctgggttccttccacaacacatggaaattgtgggagttacaattcaaggtgagatttgggtggggacatagccaaaccatatcaggtggtaagtgccctctttactctcagttcttgttcttttgctttcaagagtttagataaaggaaagaccagatgtgttttagaaatcaggggttcaaactttatcatgtgtagaatgtgacatttagttcatggctggtcttattcatactttgattcttgaaattagagactacatctttctgtgattcagagtaatttatgtcattcaaatttgatgtctaaatacagcttataactgctttcctctgaaataggagattttgcccttgatagaattttttaaatagtgaaacaaaacatctctaacagaactctaagttaattttttttggtttttttgagactgagtctcactgtgtcacccaggctggagtgaagtggtgtgaactcagctcactgcaatttctgtctcccgggttcaagcgattctcctgtctcagcctcctgagtagctgggattacaggcgtgcgccaccgcgcccagctaatttttcatatttttagtagagatgcggttttgccatgttggccaggctggtcttgaactcctgatctcaagtgatctgcccacctccgtctcccaaagtgctgggattacaggcgtgagccactgcacccagccaagtaaaatt

SEQ ID NO: 64159 - DNA, 1068 bp, Homo sapiens
agtatcacagtataatctttttagaaaactagacaaccaggaattaaatgaattaaaattcagtcacaatgacatacaaatgcaaatacctcaaccaaagtaatattcagataaacaaatattttttttcctttttttctttttgagagggagtctcgctctgtcgcccaggctggagtgcagtggcgtgatctcggctcacggcaagctccgcctcccaggttcacaccattctcctgcctcagcctcccgagtagctgggactacaggcgcccatcaccacgcctggctaatttttttgtatttttttagtagagatggggtttcaccgtgttagccaggatggtctcaatctcctgacctcgtgatctgcctgcctcggcctcccaaagtgctaggattacaggcatgagccaccgcacctggcccagataaacaaatattttatatgtacaattgtgtttgtagtagtattataacttacttttctacctgatcatcagaaagtttcctttgacattaattgaaagatacatcctgattgtagaaacattaaagtgtgaaagatatattttaggtttgaggttatatagtgttttcataatgcctatagcattatgtgtctcgtagattaggagtgccaattagtgttatatgttaataattgaagaagtaaaataggtgggaagagttgcaggatttagtatctagaatttagcagaaaacaaggaagaatagttaccaatgtgagaatatcaaatatgtgtactccaaatgaacagtaaatgggaatgtagtatatttctgtgtgtgcacatgagccagtaggtttggatctcagatcttcatgtctcaaatgggattagtaaaccatgccctttcttcccagggtggttgcaaggaatacatggaagacaccattttttgaatttacttaaaggattatgtaaactcttagcatacaacttgaatgtatttaatattatttttatgacaattactctaaaaatacacagcaatgtattgcattcctttattaaaaaggtgatttatagaaaaggttagaac

SEQ ID NO: 64160 - DNA, 1942 bp, Homo sapiens
cccaggctggtgtgcaatggcacaatctcagctcactgcaacctccgccccccaggttcaagcgattctcctgcctcagcctcccgaccagctgggattacaggcatgcaccaccacgcccggctaattttgtatttttagtagagaggggtttctccatgttggtcaggctggtctcgaactcccgacctcaggtgatctgcccaccttggcctcccaaagtgcttgaattacaggtgtgagccaccgctcccggcctatatggggtgttttctaattaataaatatgccttccttaattcagcatatggatcaaggggttctggcatgacgaaaatttttaagttatgttttaagataaattggattcaaaatcatagattctataaggatgtcttttacaagtcatctgcattatggatagtttttacaaatagaacagaattcccagttcagttccacaggtaaagcagaattcccagcctaatttttagtaaatcttagagaaaaacaagaactaactttgacaatgctacagaaaataatgaatcacaaaaagaactaaaaatatagtttattggctgatagctataaaagtatgtgttcctgaacgtttagtgaagatgacagtaatagttgattaatgttgactattcattggaaaatgaaattatgggtgatataggaatcatatgcatagtgacagcaatagacctatttaaatataaagaggaagatgggcaaaaattacctgcaaagctagaaatttcttctgtggtagccaaagtcccccagtccataattttatgttatactcaataatttaatttatgaaaaacagtagaaaggttattcaggaaatcatcacatttcttctaaatctaaaagtttcttattgtagtaaaagttgtacatttatgttttaagttaaaatgaacagagatgtttatcattttttctgatttcctacatttgtcaactagttggagtaatcagattaacctgctgtatactttgcgatctataaggaattatgtgaatgggagttattataaccaagaaaataagctctatgcagtagtaacatttgaataccacttttaccattttcaaagatattttgggtgtgctgtttctttgactttcaacaacatggggaggaaaggaatcctaattaaagatatcaatggatatatggaaccttgtgctcttcctccctaatcagcgaaaaaagatggatccagatggctgagcgagcaaagagatgccaagggattttctggttagcattatagaacctctttagaactagattactggatatttttagaggtataaagtattgtgtatgtatgcatagatgttttcaaatgttattgcgtccctgaaggcaagagactgtgtattttggaatataagatttgataacatatagacatgttctccaagggaaatacatgtcaacctttagcatagaaagttgggaagaaccttctacttttttaggagtcttacaagaaatgctgactggtgtttctataatgatttcatgccaattccagaaggtttaagtcatatgtgattaataatttaatatattagataattgctccagttctacgtttatccttatttggtaaaagatttatcctcccatttcattcctattcttgtttttacttagcagttgacctttttatatagacttgagggaaaaaaaaataactaaatgcctccatttatatttaaagtatgttttcctttgaagtgtttaagtctttactgttttatccaggtacaatatgtgggacatttatgttaaggtagaactaaaacagatgatcagttatttgtcgataaagagttttcaactaaacagcttaaaaactagcttttggggttgatttctagtcaataaaatattgttacttatttaaacaag

SEQ ID NO: 64161 - DNA, 2946 bp, Homo sapiens
tggctaacacggtgaaaccccgtctctactaaaaatacaaaaaattagccgggcgtggtggtgggcgcctgtagtcccagctacttgggaggttgaggtgagagaatggcatgagcccaggaggcagagcttgcagtgagcggagatcacgccattgcactccagcctgggcgacagagtgagactccgtctcaagcaacaacaacaacaataaaaaacaaaacaaaatactgtgtgatttcactaatatgagagacatagagtaatcaaattcatacaggcaggaagtagaatggtggttgccaggggctggggaaagggaggaatggcaagttgtttagtgggtatagattgtgaattttgcaagatggaaagagttttggagtttagttgcacaacagtgtgaatgtacttaacactatctgaactgtccacttaagattgttaagatgataaattttgtgttatatatattttactgtagttaactttttaaaacagtatgaaataaagctttatgtactgaaatgaataaatctctaaggcatattttatagcaagtagccaaaaactatctgggaaaaaaagaacaaagtttggaagacttatactacctggtttcaagacatcccataaggctcaataatcaagacagtatggtattagcttaaggaatagacatgtagatccatggtacagtctagaagcaaactcacatatatatcatgaatttatttcttttttctgaaatgttccactttattgaaagaaaagcatgtgttatcttttttgttttttccttttatttttagttgatatgtaataattctacatgtttatgggaaacagggtgatatttcagtacatgtatgcaatgtataatggtggaatcaaattagtgtatccatcacctcaaatacctatcatttctctgtgttgtgaacgttcagaatcttctaagtttttgaaaatatacactaaattattgttaaccatattcaccttaacggtgctacagaacacgagaacttatatttcccatttagctatgactctgtgtctgttaaccaatctcttcctttccttccctccccacatccttcccagcctctaataaccacaattctactctctgcttctatgagctcaaatttttgttttttgtgtttttagcttctacatatggatgagaacacacagtagttatcattctgtgcctgacttcataaattggtttttggaccgagttgctaatgtaattcagttgtggaagtgataagcccaaatggtgctagaacaactggatatccatttaggaaaaaaatgagccttgacccttaaaccatacacaaaaagtaacttgaaatggatcatagtctaaatgtaaaagctaacactataaagtttttaaaagaaaacttaggattttgagacctttagttaagccaagattttttagagagaatgtcaaaaccgtgactgattaaagtttctctggatttcctgaaaaaccttgaaaaatagtatataaccatgcagaaaaggtggataatacaatagcaataagccccattttttttagaagtttcccttggatctacagaatctttggatgctacttgggccttctagtttttactatttaccattggaaaggaggaggacgctggaagaaatgagaggatgtgggacgctttaagcagcgctttcacctagaaagggagagcaaagtttactcaggtgttatttttgccagatgccaggttttcttcttcaagccagaattttgggtatattagaaaatgtggggtgatgatcaccctgggcaacatggtgaaaccctgtctccacaaagcatagaaaaactggccaggcacagtggctcacgcctgtaatcccagcactttgggaggccgaggcgggcggatcacaaagtcaagagatcaagaccatcctggccaacatggtgaaaccctgtctctactaaaaatacaaaaattagctgggcgtggtggcgcgtgctatagtcccagctactcgggaggctgaggcgggagaatcacttgaacccaggacacggaggttgcagtgagacgagacatcgccactgcactccagcctggcgacagagcaagactccgtctcaaaaaaaaaaattaaaaaacaacaaacaaacaataacaacaacaacaacaacaacaaaaagacatagaaaaattagctggacatggtggtgcttgcctgtagttccacatacttgggaggctgaggtgggagggtcgcttgagcccaggaggcagagattgcagtgagccgagattgcaccactgcattccagcctgggtgacagagtaagaccctgtcttaaaataaacagacaaaaaaaaagtcaggtgattttgacaataagacttctttcttgaagttttgattgctgtaaatggtagccaacttgagatattaaaatcattatgtgaaagactttgtgatatgcaagaaagaatactgaactctaggattttatgtatctgtatgtttatatttatgtatatatagagaggtgtatatttaaatacataatttgcttataaaggacaacagcaatttgagagaacaccatctctctaggtcattcctgtaggtcatctctctaggtctactttcaaaggtacgtaaggaatgaatttttatattacctacccccccattttgatctcataaagctttttgtcgaattatacatctatacatccatacatcctaattactgtacgaaatatgtttacatctttttgcttgactttgaataattctttgagagtttccagttacggatattaccatgtatggtcatctccttgtaacttagcttaatttaaagtacctttaagctagccagaataacttgcaaatctgttgatttaataagatgaagtatttggtggc

SEQ ID NO: 64162 - DNA, 1126 bp, Homo sapiens
acctggctaattttgtatttttagtagagacagggtttcaccatgttggtcaggctggtctcgaactcctgacctcaggtgatccccctgccttggcctcccaaagtgctgcgattacagatgtgagccaccacacccagccgaccttagctcctttttaagatgccctgttttaggagtgaatttttttatatcattattcagaaaatatgccacaatctcagtagggcatgcctgtactaaggtttttgttagatgtacctgatttttttagaagactaaagtactgtagtaaataaattttgtggcttgaaaaagagaagcattcagttagaatttctaactttaatgttcttacgaaattggttctgttatttaaattatacactagcaatttgactacctgccctatgaattcagtcttctgtaaatgtagattgaggagaagagaggaaaaagagcttgtattccacattgtgcaggtgtaacataggaaaagtagctttaatatgggatgttatttgaggacagagaggtaaatataagtaccatgtaatgctttaattctttaagctgtttagaatgcaatacatacaataaatgggtagcaatcatccatctgacatagatgtaaatactgtttggttagaagagacttttctcttcctttttgtagaagaatatgcttgaaaggagaatgagatgacagaatcagggttcacaaacattttaaaaggcaggagttatgggatgtttaagaaaatgaaatataataagtaaaaatttaagttcttgcatgtgagtatataaagctagatttataagtaattatttagaataaagataggcagatactatccagctagagaggtttgagaaatagaagaagacagattttaaaaagtttataaaaggtatgtatggtagatactgtagatggaatctaaagcctctgtcctgaggtaaggtgcgaggtaaaatacacagttttaaagatggtccaaagcttggtataaaccgtgtgtggaaggactcttgatttggcatagagttgaggctgaaaacttaagaaaactgctacgaagtatgaagacctggcttttaaaacatactaagaactataaaa

SEQ ID NO: 64163 - DNA, 1735 bp, Homo sapiens
tcttcaaagcagtcctgttgagaggacatttggtataacatgatacttaagagtgcaggctctggagcagagtgcctaggttaaaatctcagctgcgtggtatgacttttgacaagttgctcaactactttgagccagcagaatacttatctataaaatgaggataatgattatattaatctcataggttgttgtaaagataaagtggaaaaaatacacataaaatgattagaacaatgtcttccataaatgagttgtcccattgtttaattagtattgttgctgtttgttcaacatatctcagcaccttacccacaggaacaattgttcattctcttgttggcatggatcagaaatatctgttagatattttgtattgaaaattgtaaattttctcgtcgtagctaataactgtccagttttgcttcactgaaaattaaagatacattgctaggtgcttagttttgattgttataactcagccatgtaaagaaagctgagggttctgtaggcctacagagggggtaaatcttgaattttggcattaaaaatggggaaggaatgtgaggatccaaggaaaatggctttttggaaagccctttgcattcctttctctttttccccatatgcctgcaaataccagtaattggccttacagtgtgaataagcaggcatttgttctataaaagcttttaaaccctgtttcaatgtcccttttagtgtgattgaggggaaatttttggtgctagggacctgttagaacttattgtgggttcctacctccattcacatcaaagtgtggagagatataaactataccaatttaacagtatgagcagtgactcaccttcataagtttcaggaaccaacagacatcatagagggagaagggaaatcatggattggcatagctatttagctaggacagagaaaggatagtgttgttttgaaaaccaagagaatagatacctatgatacctctcttatttctccagtagcaagggagagaaacatactgattttactacttagtaaatagatattttctctttgtatgacagacactgccatgttcaagtgctataaatgtttctccaataagtggagtcatgtgctgttagaatagtgaaatggaggtgctaagagttagacagaacttttcctccctaagattttcctagatgacttcttggcatattcttagcatagcatttcaagatttgttgggctagattaatatttaaagagtaatctgttggattacgtcagaaattttctttttccttttcctttttccataatggatcgcaatttcaattctttaatgtctatggtgttgtcaagtacaaaataaatttatcttacatctatcaaagtccattttaaaaacagaataaatcactattaattttttattgtccagtctttattgccttatttttgcatatctttagagagtgtgaatattctgtatatgaacaacaatagcttgaataattgtgatgccttatgtgatcttgagtaaccctgcggcttcaagaccaaagatagatataataaaattttagtctaattgaaggtgatctggcttaatccttaagtggtttgttgtttccagtgtagtcgtgacccttttctgatgatttatgggaaaaattcttaccccttccataatggtggaacaacattagcatgtaacattcatgttaatatgtagcagttgtataggattaat

SEQ ID NO: 64164 - DNA, 1049 bp, Homo sapiens
ttgtgatagagaactagcagacaccttagatcctttgtaaagacactaaagacacagctgatgatgggacatgaagtccataaaaaattggaggacctgacaccttagtgaaatttctgaggtaacagtattttgggatatattgggatgtcctttctgaagtagaagataagctactgcatcttgtattcactgctaccaaaaagaagtacagtaactggtgggtctctctgggtttgaagtcaggatatactaaattttaagtgtactgttccaacctcttgactcaacaatctataaaaactgccatttggttgctatgtggaatttgtggcaggctctgacaggagaatcacagtgaagcctccttcattttagagctaactgtatcttctctgagaaggctactggctttgttgttagatgtgatagagaacaaatttctaaatactggataccagtgacatgagcatgcatagcagtgttacattgtcaaataaaagcagtatacctgggattgggcaaaatggaagtactgaaaacacatgtacattgagcaagcaagaggctctttttttttttttttttttttgagtcaagagtcttgctcttgtcgcccaggctggagtgcagtggcgcaatttcagctcactgaaacctccgcctcctgggttcaaacgattctcctgccttagcctcccaagtagctgggtttacaggcacttgccaccacatccagctaatttttgtactttcagcagagacggggtttcaccacgttggccaggctggtctctaactcctgatctcaggtgatccacctccctcggcctcccaaagtgctgggattacaggtgtgagccaccgcgcctggccacaagaggccctttccatactgtgattcctttcacaaccccacacccatggttttattcctggggagtctgctgtgttcttggttaacagatggttctacatgatgtgttggcacctgtcagactaagagctgactctggtagaaacggccagttgtctcctaatactatttt

SEQ ID NO: 64165 - DNA, 1272 bp, Homo sapiens
ttttttttttgagacagagtcttgctctgtcgccaaactgaagtgcagtggtgagatcttagctcactgcaacctccgcctcccgggttcaagcgattctcctgcttcagcctcctgaatagctgggactacaggcgtgcaccaccatgcccagctaatttttgtatttttagtagagacggggttccccatgttagccaggatggtcttgatctcttgacctcgtgatctgcctgcctcggcatcccaaagtgctggggttacaggcgtgagccagcgcgccctgccgcgagtaacagaacttaaccatcagactcaagataggcatgcttaatatagtatgcaaattgattaaggggttcctagaactgtcatggaagggtagctcactaaggtcttgatcttgatactggaactaaacaaacaaatgaaaagagaacacttaaggtccaatgaatgtaggattgattttaggtctccataatgtctaatacctatagatttatcactttacaaatctagaactccttgaagaaaaaagaggcagcatatcttcctttaaggaaggaccttgtgataatatcacaagtaggcacaattaattttcttcatagccttccctaaagaaaggggtcttttattatttacaagcctaactgttcatcagaagacaaatactgaaacctttcaggagttattggaagctgagctaatgataattcccagcgactcaggacaccgttgtgttccatgaggcagatgggagcttgtggaaatcaggcatggaatggagctttgacttgaaattatttcacagtccatgaattcgtaccgtggttgtatcttgtttcttactgcatgtctggaataaatatgttcaacaagtggaagaatccccaaattagttcccatatccatgggttaatggactttatggtaggaagagccaagtgtaacctcccaaagttctttttaccaaagcagtctcacatcctgaatctcagagattagtgccatattaaagacttgaaaggttcagcctgctaactctggttttacctatgcagaagatagatacattttggagaatgatggtgtattatcataagctgcttctaccactccagttgtatatttggttccacatgtggtctctttgctagaaacagaacttggtagaaacaggcacttgctagaaacagaactttgctagaaacaggcacttggtagttaactatttgatctatcaaatgccttactgaatctaattaa

SEQ ID NO: 64166 - DNA, 1070 bp, Homo sapiens
cctctatctccaagatggcaaacctatttaaaatgaaacactatttgaaatgtgtgaaaatttgagtttatcttgagctttcagttaataaaatttataagcaccatcacttactcttattgtattagccattgggcatcctggtaaatcatgcaggtgtggtccctgttctcatggagctgtaggcctgtaggggtcttaggcaataaaagcaaaacaaaacaacaacaccataattaagcaatttgtgacaagtactataaagggaaaatatagtgttagataatggaaaatctattttcaacaaggtggtcagggtaggtactctgaagaggtgacatacaaactaacatgtgaagaattcgaaggaaccagccatgtatgcagaaaggggagtaaaccagtttgaggggacagcctattaaaaaaactttaggtatgaaagaacttggtatgttcaaggaattgaaaggatgcttctgtggctggaatatagtgggtgacattgaggctagaattggatgaatgacgttgtggaggtaggggccagatcatacagatcttgtaagcttagtaaggagcttagattttattaaaagtgcaatgggaagcaaatgaagtaaagtgacatgatctaatttattttggctgttgtgagaattatggatggggagtggggagactaataagaagtgatggtggctggatctagtgtaaaagcaatagagattgagggaaatgtatgcattcaaaatatagttgaccatttaacaacatgagcttagacaacatgggtctacttatacatggatcttttttcaataactatattggaaaattatttggtgatgtgtgacaatttgaaaaaacttgcagacaaactgcatagcctagaaatattgggaaaattaagaaaaaggtgttgcatgaatacataaaatataagtagatactagtctatcttaccataaaatatacacaaatctattataaaaagttaaaatttatgaaaacttacgccacaaacactgtagactatacatgacaccattcagttgagaaatgtaaac

SEQ ID NO: 64167 - DNA, 1030 bp, Homo sapiens
agcctggtggcgggggcctgtagtcccagctactggggaggctgaggcaggagaatggcgtgaacccgggaggcggaccttgcagtgagccaagattgtgccactgcactccagcctgggcgacagagcaagactctgtctcaaaaaaaaaaaaaaaaaaaaaaaaaaagtagtaaaattaattatacatatatacgtatatggatgcacacaaaaatctctggaaatacatatgttaaaatgtcagcagtatgccacttcttacccactggagtggttatgatcaaaaagacagaataacaagggagtagcaattgcaaaaccaaggacagcaatcttgattcttttttttttttttttttgaagttaagaattcttttaggttgtaatattttcatgttagtttttaatcatttacaatgttctgtgggtcacattttaaacatttttaaatatatgaaattctgtatttctttaagtacagccacaactacaaagcagagaaacgtaagaatacaaaaatcaaatctgcttcatttatatacacgatggggcagcctaatgcacatcataacattaacttttccaaagaagtttgctaagaatctgctcccataattagtgttaaaaataaagcaatcttcccatttagaaaaatcaagacatcagttgattaataaagcctattcttcctcccagcaatttgtactttctggtcttcatttaggaattataaattcatgagaaaagaacaaattttttatggaataaataacttccaggaacaacagtttataagtattcagttgtttaaataaacaaaactattttccttcctaaaatgtaaacatccagtaaatgaaacatacatgatattccaggtatagaaatcttagtaactcacttatgaaagaggtgcattttggtatgtttggtggtaaggtttttgtttatcttatgtataaaagtacttgcacaaaaaaacaagcagttattactatttaaaattctattccttcacccagttttc

SEQ ID NO: 64168 - DNA, 1052 bp, Homo sapiens
acagtagctaggattacaggcatgtgccaccatgcctggctaatttttgtattattagtagagatgaggttttaccatgttggccaggctctctcgaactcttgacctcaggtgatctgtccacctgggcctcccaaagtgctgggattacaggcgggagccaccgcgcccggcatgttattattattattattattttaagacaaggtctggctctgttgcccaggctggagtgcagtggtatcatcacagcccactgcagcctctgcttcccaggctcaagccaatctcagccttccaagtagctgggactacaggcacatgccaccatgcctggctaatttttgtatttttagtagagacggggttttgccgtgttgccctggctggtcttgaactggtgagttcgcactttggtagtgctgggattacaggcgtaagccagtgtgcctggcctggtattttttatttttaatgaataattttaaagaaatggtatggtgaaatcaccgtgtttgcccagggttgtttgtacttgtggctcatgaggtttgaagttattgaagaaattgttgcaagacttaaggaaattgtgtgagtaactggtaactagcaagtaagtaagccttagttacagtgaacgacttgtcattctcctaaagaatcaagattgctgcagcccctaggagcccagcgccgccgccatgtcctccggggctagcgcgagcgccctgcagctcttggtagagcagctcaagttggaggctggcgtggagaggatcaaggtctctcaggcagctgcagagcttcaacagtactgtatgcagaatgcctgcaaggatgccctgctggtgggtgttccagctggaagtaaccccttccgggagcctagatcctgtgctttactctgaagactcgagagaagtttgctgaggaatgccttcaagcacaaagtgatgaatgactgccttcaagtctcaagaaaacacttttacctaacttttagagatatttcagccctttcctgtggcctggtcctatagccaaaatca

SEQ ID NO: 64169 - DNA, 1064 bp, Homo sapiens
tatggtatgcataaacatttgctatgtgaaaaagaggatagaggagattataggcatagaggaaaaatgtgtgtatgtgaatgtcttgttacaggaatggagagaagtgaaagtagatggaaactgaggtaggctttgatgcttgagtgggttgacaattgtgaaaagctctgtatatcaggctatagaatttagccttgactctatagatggtgagccttgactctatagatggtggggtctgttgaaaaatggtagctcttaaaaagcaagaaacaacatagaaatgtgactcaaatggcaatgaactgaagggagaaagaccagtatgagaaagctcaaacgtttttatggtggaaatggcaaggaaggtatggatgctagagaaatttgaaagttcagattagtaaaatttagtaatgaatgaatgtgaggggtaaagtagaaagagtggatgagaggtaatatgtgtcatgatgctatggatacaaatagggaattcaggagaagaaatgaatttggatgagggaaggaaatgctgagtgaaaggtgatggtctataatcaaggtagagatgtcatttaggtgtttagacatgtgagtcaggaggtaaggagaaaagtgagatttaacttggcaattgtcagtagccagctgattgtcaaatatgaagaaaaatgtgagattgcctaggaaatgtgcaagagtgaaaaaaagagtggcctcagaattgtactcagagaaaaatcaatattcaaaaggtagataaagcagtggcagcctggaaactaaataggagtagtcagaggtattgcaaaagaaccaagatagcatgatatggtatcatggaaaaccctgggtatatagaatttcaaggaggaggaaataacaaatgtcaaatgtgctgaaaatgtcatgtataataaggactaaaaataggcttatggatttaataattaggataactttcgaacattatagtagagttgtgggggccatagtcattttgatgaatacatgccccaagtcatatgctgtataaacctcatgtagtctagtttgtt

SEQ ID NO: 64170 - DNA, 1011 bp, Homo sapiens
tgttgggctgttactccttccaggtcctgttaatggtcagggctggtaagtataggtatgtatgcataaacatacatatgcatttatatctatatttatttattatctctgtatattgaaaactatgaattcatactgatacctccaatttcagtcaaatagtccaggatctattctagtgttctcctttttcatattgtaacgttcttctctgacagtgagaaatctggcttctgttatcctgaatgtatttacttattgttcagtctcccatcttcactaccatctactcctctccctgctgggacttggattcttcattccatctcctccatccccctaccccagtctggatctaagagtccataccagcatgcttccatacagggacaccctccccagcactctggttatgactcctcatgttggtctccccactgtcggtggacacacttcgtaccccactcagactctgacacaccccagtgagttgcttccattggaagatatccttctcactctgttgtaccccagtgccctttgccagtttccccctcctgccttaatgcttgggctctgaagcaaaatgtttgcctcttcccctaccacacagactccttccctagctctcttggtctatgacaatatgacaagctccaccccagggatccacctccaccccaggggtaccatgacaactgctcttctcacagcaggaaaagggaaggagaaggaagattaattttttaagtaatacaatccagaagcttgtataaattgtagaatgtcaacagtgaaatgtataactttttaacttgggataattcttcttttgtcatgttgatggcagcgaagaggtgcgggcggtggtgtcaggagcggctatgggagcagcaatgatgctggtgggtcccctgtgccctgcatccctgaggcagccgactgtactgcccccgcccttgtgcctctgggcaggacctgccctcaggcccggagcctccccagctcctg
